United States Patent 9,328,346 (POLYCOMB-ASSOCIATED NON-CODING RNAS) - sequence listing, part 24

SEQ ID NO: 3958 - RNA, 60739 nt, Mus musculus
acucucccuucaaacgggaaacaagauggcggcggcagguccgagcacucgggcuucuuccgcugcggccgcggcagcucugagucggcggggccggaggggccgcugugacgagauggcggcagcgaaagccggggcuccgggcccggccuccagccccgcguuguuaguguugcggucagcgccacggccggaggagucgggcugcaccgggugccuggagaccccgggggaaguggcggcccugccgugcagccacucgcggugccgaggcugcgccucgcgcgcggcgggcccgggcugccgucgcugccguccccgcgguucgggcugggcccgccgucgggcgcgcgacgacggccaggccgccgcggagcugaugggcgagcgcgcccgucguggacagccagaacccugccgcccgcgccgggacgggggcgcggcugccucggggcccaggccggagccggagccgcucgcggagccagguggagccuccccucgccccugugggcuucagccaggcccagccgccgggucuggccuggugagcgggguggagggucccgggcucugcugccgcggguguggagaguucugcuggggucgcgaccggguucugcccaggcgcaguauguguuggugaagguugaacuuuggagcgaacuguacgcguguugaauuuggaggggcagugaggggaccccgcgccuugcguaagucagaaguuuggaaggaaacaauuccuggaacaaguuaggggcauguugaaguuggugcguggagggggaggggcccuggaggaucccagcagcgcuuguuucaguguugggcagagggcuuggggucgcgcggucuaggagggaugugucuuccagggcuggagagaaugaggugugggauaucccaggcucagggggagcuuugcagacuugagagcagaguggguuuugaggaugagcucucgugugaaguucuuucucaugcuaucuugggaaaaaaaaaaaaaaaauauauauauauaugcaugcuuagcgcagagcuugccacacaggaugagauaaaugccaucuauuuuggugauaauacuaaucauaaacguuaguggugcuugaugaagaaagcugggugggauuuaaguuuuggagacaaagauugguuuggcugggggcuguuuucugucuuucuauguaaguuucaucuaugaugcuggcaacuuaaaggucuguuguaggacucuuggccugaacuccuuugccuuucucaccgucggcagcccaucacuuguuggugcugaagucugagauagaaaauuccguuuguaacaugaaccgagaccuaggcuucuuuggugcaagccuaagcaacauaccuacagcugagauuuucaagaaccgugaaucaggaaaagccauuugcuagcccuuuuauguuaggaauucugccuuacgucguuuucagcagaaggaaggcauugcuuuguguguauaugaaagugcaguuccuagaaacuguagaguccagaaugcaucuauuuuugguucaagcagagacaccugccaaagacaccuuguuuuucagucuaagggcugagaugcucugcauuuuacuuucugcguuucuuguuaucccuuccaaaaccaucacagugcucuugguuguaccuuuauuucuauuuuauaggugaaacugaggcccaaagagauuaacuaacuugucuuaugaugaaaguacaauuccauaugauuuucucaauuuagcuugcuuuaauuucugagauuauaaauauaagcaauuucucuggucucccuacuacauugacuauauggucaaauagaauagcaguucucuuuauauaucucuuggagcuguuaugaaacauccaccuugaaauuugaauuaugaaagaaugcauugcuuauugauuuguguaaacuuuucccacuaaaagaaauuuguuuaaauaaaggauaggcuauuagugauuaaggacauuuaccuaaaaugagaauccauaggacuuguuaaguuacuuaguaucuuucaguuauaugugggucauaaugaaaaguauuuucccuaaauuuacuuuuuggaucauugcaaucauauguuuguccagcuaaauaauuuuagaagaauagaaaauacugccgagccagucauggugaugcaaacuuggaaucucaguauuugggaaguggacucuggagggucagaaguucaagguuauuggcaucaugggaagccauuuaaaaaacaaaacuuaaaaaaaaggaauugcugaguagggcuuggaaacuaucuuuuagcauugguagguauuuacugaaguuauacacaaucuauuuuaauuaaaacuuuaacaacggggugggggcagcaagaagucaccagcagugccaaccuaacagugaguucaguucaggacuuccguagugagggcagagaacugacucugaaaaguuguccuuugaucuccacaugugugugguggcaugugcaccuaccucccaaaauaaauaaagaaaaauguaauaaauacaauguugaguguguuagggcaagccuauaaucccacaauugggagguagagacuagagaauaaauucaagauccuugaguacauaauaaaauccaggccagucugggcuacaggaggcucugucucaacagaacaaaaccaaucucaacaaccuuguaucacucgugaguugagggaaaugggagaaaguauucauucggugaaugugcuuucuucccauuuccagggucaccgguguuuuguuuacucuuucacaguuugugcaucugcaugaaauccaaaucaaaauaaaauacauauuugcuaugcuauacacacuguucucuguguguguguguguuguuacaugggcacacaggacagagggaugucagauaccuuucucucugccugugguucccaaccuuccuaaugcuuccacucuuuaauaaauuuccucauguaguagugauucccaaccauaaaguuauuuuuguuguucuuucauaacuguauguugcuacuauuaugaauuguaauguaaauauuuguguuuucugauggucuuaggugaccccugugaaaagguuacucaaucugcaaagggguugaggcucacaggcugaaaacuacugcuuuaugccuuucugcuuugagaugaggucucugacagaacugggagcucuucauuuugcuagguugacuggucggcaaguucucacagucccccagucugucccucaaugcugaagugacagacaccuguaacugggccuggcuuuuuuuuuauagggauuugaacuuaggucauccuugcaggucaagcacuuuuacccacugagccaucaucucccuagcuuguaaaguucuuuuucuguuuaauaauacaugcauacuagaagagaaaaugucuuuagccuuuuuacaguuguauggcauuuuauuaaauggauauaacauuauuuagcuaucuauuggugaacauuuaaguggaaucuuauauuuugcuauuuuuuuuaaacuuaaaaguauauauguaugaguguuuugccagcauggauuuugugugugugugugugugugugugugugugugugugcaugugcgcgcuugccuaaaguggccagaagagggugucggguucccuggaauuggugucauagauuuuugggaacugguaggugggugggugcugggaacugagcuuggguccccuggaagaguagcuagugcucuuaagcacugagccaucucucucgacucauaauuuuaaaaaaguuguuuuguaacuguaugcauuuccauggagaagucacccauagcuugaacagauuuauaaagaguuugcuaaagaaaagaagaaguuaaggaugguuucauucuggguccucauuguugcacagagaaaagugacagggaggcaagaacuacuaguuagaaguugcagugagguaguagauaaacagaagcuaacagagggacacauuguguaaaagacacagugcagacuguggacaggggaagguucauguugacuuuguuuugguuuuugaugagaucugaaguuagaguccagccagccugaacuauucuccugcugcaguuuccugagugcugagugugcaggugugaggcuccugauggcuguuaauggaggagccugaaguauuugcauugugauuucaugaguagaaaccucagcagcaggagggcauuuguaggcgcccuagcgaguguaccucuuggugguuucuuacagaacaguuauguacagaaggugggguuggccugcuuugugcgacugucccuggugcaaugcuguuuaagugagagucuguuguguuugcuugcuggcuuguuuaguugaggcuagguuguguuguguugcagaggcugcuuuugaacuccugcaguccgcccacuuucuuuuuuuuuuuuuuccuguguugagacaggaccuugccuguggagccuuggcagacaguaaacuuggggacuuccacccuuugucgcccaagugugggauugaagcaugggccaccaugcacaauuuauuuauuuuuaaaaaagauuucaaaauucucuuuuaggguugucuaugaaauauaaaaguauaauuugugcuuguugaaauuuugguuguguuuuugacauuuuuguggcuugaaauuuauuuacuuugagacaggguaucacuguguauccaggcugcucucagacucauagcagccccuuagccuucuuagugugcuggcuugcagguguauacuaccacaccuggcuuauuaguuuuguugauccguaaaacccugugugugaaggcuacagcagugaucaugucaagacuggcucugagcugaacuucacauucuuugaggcugugcagguccuugucugugagguuguacuaagcuuugguauugucuugaacaguaugcaggguuuauaaugaauagcuacauuuuguuaaguauuuuucauaccagcaaacaaaauauaaaacucucugucauccaauuuauauucuagauacaaaagcauucuaauguguugauuuuaaaaauauguacuacacagguguaaauaguuuuagaacuauaauaauuguauuuaagucauauugaaaaugauuaaagaauuuugacuuaaagccaaaagagcuucuaaauuauacugucuuugaucuugaaaauggaacuuuuuagcuuuuaggauaauucuuuuucuuccacuauagguaaugauuaaaguaauaagcuagacaaaggcugauaacaauuuuaagcuggcagacuuuuuuucuuuuuuugucuuaaaaucaaauuucaaaaauauaguagaugauaggguucauacugucucauuuauccuuccuuuguaucucacagucuccacacaaacaucccuguucacacuuccugcucacuuaugauuaacacacacuuuaaacauuuguuuucugugaaaagccaauaguucuggucuguuauucaauugucagacaacaucugcuaagcguguugccuaaauuccuuguaggacgaguacauaaugcaauuaugugaugguguaaaaggacagggcuuucucuggucuguagggcuuguuucagacuaucugaggugacucaucccuuucccuaaugacgaaaugagcauauaccauuguguugcacuaaagcagacuccaugugccucacacuugcugaugugcccuacaaagcucauguugacauuaccucaccaucuacugaccccggaaaugaauuaccacugaaggaauuaauuccucagcucuugggagucaaacugaacagcaggaaugcaggugguaucggcuuccuuccucucacuucugcucccuggcauccaguugauuuagaagcguugcccgccuugaguucauuuauaugugacuuggcuugacaauaugguaauccauuuuagucacauuuuguuugaauaauguaauuaaugauuauuugguuccuauuaguuaggacacaguguccagaagaggguggaaggucggggacagacuuguugggcgacgguggacuuuggaugcccugucaaagggugaggaugcacuaaggaaagaggagccucuuuugcauuucacauguguuggaaaccccaguugucuuugaaagaugguagacuguacauaaccaaacaaauggggaauacagaacagggacuucacacauuccugagguugcugggagacaguagucaacagacauggagcuaucuaaaccguuaagcccugugcccacaguguuuuacccuguaguaggcucaagggacucagugaagccagagugagugagaagguucuguuuuaaagacuugugcauagcucagggucuucaugggcuguguucccugugaagggauuagcaaacagacaaacaaacaacuacccucggucacaaagagagaacaaaaaaaucuugucuugauuugccugggcuuuuugcacagcggaaauuaaaaaacaaaaacaaaaaaaaaagcuuuccuaaaaaacaaaucauaggauauguagcucacucacauuuaagaugugaaagauuuugcuugguucagauagccuuauggugaggaauuaguauuaaaaagauauaucuccagcuagugaacuaugcacaucacauggcacauggagaaacuaaagcaagauuuucaggaacacucuccuacccagacgguccaggguccuuccagaaggaagaggcccagcuguggguaaacucaguggaacgacaguuugagcccccagggacccacagacaggagaauccauacacaggaagcgaggacuggaguguagagugucaguucacaggauaauuaaaauagcauaguucaaaaucgacaccccaaugaacggacaugguucaggacuaaagguauuccagaauggaggaucuuuuauauacaauaaagauauccagaacugaacaccucagugagugaacaagacaggaaauaaucuguagaacucacugugauggaagccucuagucagugaggcugcagcucagcaaggcaaaccgggcucuaaaguggccuagugugugaggaaacgcccagaaaauagaaagagaacugaagagauugaucaggaagcuccaaggguuaacccggggguggggaguggggaaagaagauagagugaagggguuauagacugugaagaugugacgacuugagaugauuucagaaugaauacccccucucucucaagauuuauuuauuauuauacauaaguacacuguagcugucuucagacaccagaagagggcaucagaucucauuauggaugguugugagcuaccaugugguugcugggauuugaacucaggaaaaagcagucagugcucuuaaccugcugagccaucucgccaguccaacccugucucuuaagacucaugaaguccagcaagaauuggaaacacccagggccccuauaacuaaacacauugugguggaacugcagaacaucaaauccccuggcuggggauugggcccaguuucuaaguuacaaaaccaaauagcccaggaaaguuagaacaauaauagcaggucaaguccaaacaaaggagguacaaaauaggaaagaauggugacauucucaucugaggcacuggucuucccuguaagauggaaggaagacagugcagcuuuuccagcagugcguaucugccucaggggaacucacagguacgcguccucacaccauucaucuccaacugcagaacugggaaaagugaacaguuuccuugagauaaauuaugggucacuucuguaacuguuacuauaacgaaugagcaaagacccuauguaucgucaugaauaaaucuugaaaaacuguguaguggaaaguuacaaaaggcucuagcugaugccauuuauacaaauaaggugcacacaaaggugggcuuauuugaaugggcagaggucugagagaugaaaagucagcaauaucuacuauucuuucuggcaguuaggugucgagagaaagaaacugaggcauaagaaggcagggagaguccacuucuacagaagagcaaagcagguuugacucaggacucaaggugcuuuuggagaguccccguucuugggauuaugguagaacuugagagccuaauugacagagaccaccuuuccccauugccagguacugcaggaaggacaagcuguccauuuguuuaugaauugcugcugguuuccaguugcugguagaaaggaguuaaugguuaaggaaggucagggccaggccuaccuaguaaauuaacagugacaaagugcuuaugugccaagaauuggucucucccucccuuccucucucccacccccuuugugugugugcccaugcacaugugugcacuuguauuuaucgaggcuagaggacagccucagugucauuccuuagaaucuauccagcuggggucucuuguuuuauugauuacuauagguuggcuggcuagaaaucugcaggggucauccagccgccaccgccccagugcugguauuacaaaugcaugccaccuuuucacauagguucugaggaucaaacacgggccuccugcucacaagacaaacgcuucacugacauuugcccacuuuuuguucauuuuagcucuagauauggaaggugaucccuaaauuguuaagcuguuguacuaugugguuauuggcaucuaaacaugaauagucauuucuuuucucucucagaguaacaucuuuuaguuuguuugugaguaauacacauaaauauguuuauuuccuauacuaguuuuuguguguguguguuucaguuuucugguccauaaagaguaaacaucacaagcuguacuggguugcuguaagauguagguaggaaugaugugugaaaacacuuaguguagagcccagcauguaagcacuagucaaugucaguuuacuagguagcuguuccugacugggucgaucggccucaggucuguguguauagcuuaauccucugagugcuguagccugcuuuaaauucugcacucacucucccuuuaucacuucucugacguugguggaggugcuagguguucgcuuucuucugcguaaauggcuguaguaauggcaacagccccuggggaguauugcaaggguucaaugagauauucaauauaauguuuagcagugauauuuaaacaguaaaaccacuuugaaaagggagauggaauaauacuucacguuuuuaugagauuuuaauuuuaugagauucccgguaugagcgaguauuucuugagcucuuuuucuucuguuuguuuauuuugucugguguguuaguuuuucuuuuaucuuuuuauauuuuauuuucuaaugagagauggagggaguucuggaaguaauagauggaggaaaaaccauaaucaggauauauuauguaagggggaaaaucuauuuucaauaaaagggggaggagcagaauagacauuagcauagugagugauuuauguuguacacaugaauuugacaugaucugaggaaugagguaaaauguuucuuacugugaauuguguuuuuaaaaguuugaaaguuacuggcuagcaguccauaguauuuucaguaauguuagcuacuuuuuagaaccuuuuuauuuccaauagauaccuaccauaaaaacucacucucucucucucucucucucucucucucucucuguguguguguguguguguguguguguguguguguuuggaaaucuggugcacagaugucuucacauuugcuagagaaaaugauuagguuuugcaguuuauaggacuaaguuuauuggugacuagguuugagcuaacaugcugagaucaggacugagguguggggaggguaccugaugucuguggugcucuaccuggcacccaguagguucuuaaguauguucuggaugaaugggaagacugucuuuaguagagccuaaauucagaaugucucuacuuuaauaccaaccugauagagucauagacagauuugucuguuuuguugaauuucauaagcagucauaagacuuauguuuuuuaaguuuauccacauuuauaacuugacuauaacguuuagguugaugucagaugcugacugaguccugcaggcuaccuguggacggagcgagaagggagaagggcauucugcaaaugugcccucaggccaccgcuucuauuucagccucugaggcucagcaggguucucauguaguuacacuuuuacugagaucagaaggauuguaaaaugcauauaugguuagcuauagcuucuacucucaacuaaagaguaacuuuuuuguauacugaaaaguauucuggaagaaagauaguauugaaaaguaguggaucugaaugaauucuguuacagagcccuguuguagcugaggcuuugggcaagcuucuuaaacucugcacuuaaauuucauuuguaacuuugaauaaugguugcauuggagugcguguggauuagauaagauggcuuaugucaggugcauagagcaaguaaacaccuaacguuagccuuuauuaauuguuuguuaauguauucauugauuauugugccaagcaggcagcuaguucuuagggacacacacagauuaguaaauucccaagcuucugugaggaaagcugcgacacucguuaugacagugagugugcagaguggauguguggagagcagaaccuagcuauggagacacuuagaagucauuugcauucaggacgggagaacugaccacugcaaagcauggugaagcaagugacgacuuuauguaagcaugguuaacgaggauguauuuuugucaagacuuuuuacuugcuguccuagucagcucuaacugucaaguugauuaucuagaauuaucugagaggaaaacauugauugaggaauugcccagaucagaugggucugugggcauuuuugugggggauauuugguaauuaauugauacaggagggcucagcucacuguggauggcaccauccccaccaggugcuucuggaccauguuagaaagguagccaagcaugagccugggacugagccagggaguaagcuugcaagcagaguuccccaugauuccuguuccaaauccuuauccugacauugcucacauauagacugugaccuggaaacagaagccauaggaccgcuucuccccucgguggguuuggucaggguguuuuaucacagcaacagcaaggaaacgagagcuuguauaaauguguggcucgugugcacccaaguguugugagucucagagucugggaaaugucuacugcaucacaauuuuucaugcaucugucuuguagagugugaaauuuaguaacucugcaucucugcuucuugugauucucucucaaugcagaugcucugacagaauuuagcaggcuuguuaauguagaugaaggauuugucagauguaggcauugcucauuacuagcaggaaaguuuuggaggugaaagaauuagcauuuguggaauuuacuucaccuauaugcuaaggcuuugugcuguguuuaauggagaacuccuacuauguguaaggcacuggacuaggugccuagaaggguggacuugagagcacaaguguauuaaacagaggaaugcugagggagcacugcacugauccuuugcacuggaugaguauguuucauucugcugggggagaacgcauuguaagaagcuuuagggguggcggagcgaugagagcacaaaggacggcacuugcugguuauucguucccaucuuuccagcgggagcagauccuguaacgacacgugagauacucugcccagauuuguguuucagugaagcuuguauuuugguuuuagagauccuuaguucuuagacuaaguauaauugucuuugcacaguggagugugaacugcugugcguuuguacuguuucaccauccuuggguaacacggcagccugcuugggcacuuuuuaaagcauuugguacaguaguugaaugaaaucaaccacagaaacaacaucaaccacagcaaccaaagaacccauagaauggccugaauugagaacuaaaaacaagauugcagaaacagauagucuaagucuguugaaagggagcagagaaaccagugccuguggggauaagaacuuaagcuuuccuuguaagagaggugagucaagucaccaacagauguguuaggcuucuguguuaugguggaggggagaacuugcuggugccagagacuuugaguagagaaaacugaauguggaaguuuauauucucauuagauauucaaccaacgcuuucgaaggcacugaaugacaguuggugucuuagcuaagguuucuacugcugugaagagacaccaugaccucagcaagucuuauaaaggaaaacauuuaauugggacuggcuuacagguucagagguucaguccauuauuaauauggugggaagcauggcaauauacaggcagacauggugcuggagaaggacuggagagauccaaaggcaucaagagacuaugugccacacuggguguaccuugugcauauaagaccucaaagcucgcccccacaguaacacacuucuuccagcaaggucucacauauuucaacaaggccauaccucccucccaguuggugccacucccuuuuggucugugggagccaauuauguuaaaacuaccacauuuggauauaugucaggagauccucucucuaucgcaucccuagguagugaggcagauccaagccucuguagcaaguaugauacaugcuagugcguuuauagacugcucucagccggguugguaauguauuucucucuggguuaguaggaaagcuuuggaaaagagaaggcagagaaaggguuugagguauggguagagaaucaucacacagugaaggagagaaacaagugugaagucacaguguaaaucaaguuaggaauaguggcgugggugagagcuagggaccgacuuacaggaaggguagaggauauagcucgagugguaggguugggguccuguugcauauguguuagaggggguuaaaagcuaccaaaacuuacucguuaggaggaugauagugucaugucgcuuuauacagaacuaaauguugaggcuguggaaacaguguugaggauauaugggagacaaagaguuugagaaacagggagccugccauugggugugcacauacacuguuuucaguaaugcuggaagaugagaugagaugaacuguuaagacagagccauuuuaugguuaaagaaucaaauuagcaaggaugaauacuggagguaaaucuaggagaggguacaauugaaugcaagucgguuugguucuggaucccggacuguuucuaacuuaggaaucauuuugcuaaugguuguugucuuagucaauguccuauugcuauuauaaaggaaaacauuuaauugggucuggcauacauucuuaaguuuaguccauuaucaucauggcagggggcaugguggcaugcaggcaaaccuggugcuggagaggcagcugagaguucuacauccagaucagcguggggggugggguggggaggaggaccuggcuugagcauuugaaaccucaucgcccacccccagugacacacuucccccaacaaggucacaccucuaauagugcuacucccugugagccuaugggggucaauuauauucaaauccacaauugugaaugauauuuugccucacauggcagcagaaaucgaaagcuguuuuuccaugguggugguggcuguguugcuguggacaccugaggauaagagcucugaggcccaagcccuucacuguggcugcuucugagcccugugccuacaucugauccuguggcucuuuaaucauagacuuuacugaugguccaucacagguugccuaacaagaaaauggcgucuuggggguuguuuuuagacucagcauggaagucuuauuugcuugacuauuucuauuucugcuuuugcaagucugucugaccuuccuuguguauucccagggccuaugucucuguugugacagucacucaguaaucauugcuccaacuucaucccucccaccccugccacucucagaggcaugucaugucacuuugcacuuuagaugcagagauacauuguuuugugucuaacccccggggucuagucccgccuuuaggccuccucagcagccauuuccagccuucuccacucagcaucgucuucccuugcugucuagcgcaugcauccuauguuccgcucuaguucacagugcacucacacaguuuacgaguggcuuucuuggcuuugcuagaauguuuucuugaucccugccauaacuaaccccuugcagggagccuggcccuuuugauuauguuagcgccuguugguccuuucuuuucccuucagauuuauuccugugucugcauuugccauauaauuacuucaucucauaauuugaaaaaaauaguugggucucauuugugcuuuuaucaugaaauuguguuuuacuuacagugcuuaugaaguauguggauuuuaaauucuucuggguacaguggaacagauuguagcagacaaagacuccugcugagaauaacuagaagagccuuauuuaaaaaaaaaaaaagaaaaagaaaauccacaugagagcacuguaagguugccaaggcagccagagcuucagauuuggauucuuggugaggggaggaagcagcuagugagaagcagagagucagcugugcucuccucgugggccugaggagauagaaaaguguagcucagggcgccaggcagccagacucgagaggccaggacccuaguaaggaggagcauggccccaccuccugacccuuggagcaucugcugguuaaaguggguaggguaaaaaggcuggggagccucacagaagccuuggagaaacaggcggccuuagcguuccuucaggguagaggaagaaaaugcccgggagcuccugaggaagacaggccugaugaaugcugggaucuucguuggaccccuguggggugugcacaagggcagagucaaguuuacagucuggaaacugcaggcaguuuggagucuguucauguucucuuuagguuguggggugauuuacguucauucugacugcuguuagggaacauggcgagccucagcagggagaugaugucauccagagcugcugugagguagguguguauuaaucaugcugauuuggauggcauugcuuucuugguguccuccacccccucuggcucuuacauuccuuccuucugucucuucuucuuaggguucccugagcccugagggagggauuugauggagccuugcuguuuagggcugaguauuccaggcucucuuauucucugcauaaugucuggucauggucucuguguuuggcccauuugcugcaggagggagccuuuuugcugauggcugagcaaggcaguaguguuugauuuuacccuaggucgugggcuauaauaauuuccuauguccuuugucuguuagagguguguguguguguguguguguguguguguguguauuuuaguaugugagagcacagaaucugauuuccaggguuucaaucauguuuuucauacacuacugggacacaggcaaauuauacucucuguaccucaguuuccuucuuuggaaaauggugauaaaggcgcauuacagagacauuaugaugagugaguuaggcaugggccuggcauauccuauauuuggcuccuauuaaaggaugguuuauuuuaaccugguaaggguggacgguugagagcauuucaggcauagaugugggacagaaugugguuuagccaggagccauaaacuguaaggaaggagugaggugauguaaaacugcggagguggcagagacugugccccgugacugacucuuacacuguauugaaauauaagugguguggaaccagcucugguaguuagagacaauuaucccuuauguuugaagagagugcaacacucucuaguuaaacauuuugugguagauauuaauuuagccauguauuugaauggugguaaauaacucaccaaacacguuuacagcuuacaaccuuuuagaaucaucguuuuaugucaugucuguaguuuugagaugugguuguaauauuguaaaauuacaaaugacaaauuacaaggacaaauggcuagucagaauauucacauuaagacauaauagguuuuaagacucaagaaauccaaaauucuccuugaacuaguguuaacuaguaagcuggauuguuuuuucaaugccccaaaagcagagaagaaaucauugcuagagcauugcaaugcauguuagagcacugguuuaaugcaaagacuaaauuuuucaaaacuacuaaguaucuggauuucuguaacuaauuucuaccaccaaauagggaguuagagauaguguuaaaaaaaaaaaagaaauccaaaauucucuuuuguucugcuaccuucauaagaaauuaaacuuugugagaggggacacucaggcauguucagggacuagcggacaguugacuuuggccuuuggaauugguaagcuagcaucuuccaguagaguagaguaggguucuuuuuuucuaauacugcauugaaggaauagagagaugguuccaugguuaagagcacuggucucuuacagaggauucagguucacuucugagcacccacauggcggcucacuauugucugugauucccauuucagaggauccaguguccucuucuggccuccacaagcagaugcauggugcacagauagacgugcaaacagaacauccaugcacaguaaauaaaaauaaaaaagucuacauugaauguggguguuuggggcaaguagcagaaugccugguaguucauuaacuaaucacuggucacccugcccagagaauccauuuuaagaaggaccuuuaaggauguuuuucuguucuuagaauguacauuggacuaaagaccugugcuuagguuacugaccacagguguguaucuuucuuaaggcaccuuccuuguuccuugggaguuucucuuccugauaugcagagucagagggcaggcaucaggaaauucugucagccuggauuccucuaugaauggggauauucugugcucucaugcauccagagccacgucuagcacuuucugcaagggagggaagugugagcauuucuuguguuacuaagacauuugggaaucauugaacaguugguugauguuuuccuagauaggcacuuuuaaccaacgaagcuacaaggccccaugggauugguagauuuuuuuuuucuuuaaacuaacugcucugaacaaggaagggcuguguugcuuuuccuguuggccuggacaucuuguuccucugcuuaugauagcguugcuggcauuucaaccucaaguuccucuuuugggguagaggaagcugacauauaauccuaagaagguuagggaagugagggaaaauuaaguaaaaucccacaucagcagauacaaacuaucuuacaaaucauggagccaaaugguucuacccacugauaauguuaagugucugcuacacuauucagcugugaaagauugauuugaaagaggagcuuuugggccaacaagagggcucagcaggccagaugcauacugugagcccuggccaccugaguucaacgcccguggcccuuguggaggaaagagugcugacugcccaggcuguucguuaaccucgaugcacacaguggcaagcacccaccuccugucagcuaauaaacauacggucagaagugggaaggggagcuuucauuucuggccuuugcuuggucuguuuucuucacacucauccaggcagauugaagugccgcacuucagaguuucagaacugugacuuugauguuauaacuaugcuaagccaaauagcauuuuaccuguaagauugaacuguaguggaauuuuacagacuucagaagaauauagacuaggaaauaagagugaauuaaaaguugaugcugagcugggcaugguggcgcacgccuuugaucccagcacucgggaggcagaggcagagacaggcggauuucugaguucaaggucagccuggucuacagagugaguuccaggacagccagggcuacacaacgaaacccugucucgaaaaaccaaaaccaaaaccaaccaaacaaaaaaaguugaugcugaaucaacuauagaugugcuuauugcugucauuucucagauacaaacugagacaaagaauuuuuaaagcuaggcauuuaguagugcauauuuguaauaucagcauucagaagucugaggcaggaagaucuugagguuagcuugugcugcacaaugugugugcacgugugcaugugcaucugugugucuguugucugugucugucugucuguacccaaucaccacccacacgcaauaggagcacuuacaggacucagcagauaguugaacucauagcugugaucuaggacauugaaauaauacugagcaaaauaaaaaaauaauacugaggaaacauuuuguggaacaaagucuggaggaaguuagguucaggcuuccagaguuuucccugaguggaggcaugcaagauguguauuacucccccagcaaagaaagaagaacacuguguacauguugucaccagagaaccuugcuggagaccuagugccuagaguugaucacauacccuuucugcugugcgugugccaagacuucauauucauagcagauaagcagguaguucuagaaucaguuaggugcaguaaaucauucuuacugguaagucagggaggauaggagcccuaucuuaaauccuaguugaagggaucaggcaaaggcuaaguugauaggcaauccuucauaaugacagaucgcagugugugguuuguauguaugugauauuuaguauauauugugagcucauuaacuguuacaugucuuuauuguaaagauuuuauuuuauauuuuugagauagcauccuacugcauagcccaggcugagccuaggcuauguaucugggguggguuggaauuuacaaagauccuucucuuucaguuuccugaguacuaggguugcagguacaugccgcacaggaggccuauuguaaggauugcucauuggcugcuaacacuaauacuacuugcaguuaugguaugcuuuccugugagguagauuaguuuuuaagaaaacauuauccuuuguggggauuccccacaggcuugcuuucuagcuggcagggaaaugauccaggugagagaagacugaaacucaguucagccugauuuguacugggccaaacuuggagagucugacaccacuugguugauuuuagccauauuuaauuaagcacagcaugauuuuggaaacaguuuucugauaacaacucagucccaugaguuuaauagagcuuaagacauguuuacauugauauucuuuauaaaguacgucuggcuucucucacauagaugaguacuguugacuuagauagugcccgagauuuaggguaaagagugacagagguaaacauaaugaacgccugugggcaucaggauugccuggcccuaagauaacuuagaagucacuuaggccacuguaaggcacaagugacaucacucaaauaaggacagagugugucucagcaagggauguggacagagugugucucagcagaggagggauguggacagagugugucucagcagaggagggauguggacagagugugucucagcagaggagggauguggacagagugugucucagcacaggagggauguggacagagugugucucagcacaggagggauguggacagagugugucucagcacaggagggauguggacagagugugucucagcacaggagggauguggacagagugugucucagcacaggagggauguggacagagugugucucagcagagggauguggacagagugugucucagcagagggauguggacagaguagagugugucucagcagaggagggauguggacagugugucucagcagagggauguggaucacagaugcacuggcuaguuuucugucagcuuuacacagcuggaguuaucacagagaaaggagcuucaggugaggaaaugccuccaugagauccaacuguaaggcauuuucucagugaucaaguggggaggucuccuuguggguggugccaucccugggcugguagucuuggguucuauaagaaagcaagcugagcaagccaggggaagcaaaccaguaaggaacauuccuccauggccucugcaucagcuccugcuuccugaccugcuugaguuccaguccugucuuccuuuggugaugaacagcgauguagaaguguaagcugaauaaacccuuuccuccccaacuugcuucuuggucaugauguuugugcaggaauagaaaccuuaauuaagacacauagaccugagugagguaacccaaucacaaaggaacucacacaauauauacucacugauaaguggauauuagcccagaaacuuaggauacccaagauauaagguacaauuugcuaaacgcaugaaacucaagaagaacgaagaccaaaguguggacacuuugccccuucuuagaauugggaacaaaacacccaugggaggaguuacagagacaaaguuuggagcugugacgaaaggauggaccaucuagagacugccauauccggggauccaucccauaauuggcuuccaaaugaugacaccauugcacacacuagcaagauuuugcugaaaggacccagauagagcucucucuugugagacugugccggggccuagcaaacacagaaguggaugcucacagucagcuauuggauggaucacagggcccccaauggaggagcuagagaaaguacccaaggagcuaaagggaucugcaacccuauagguggaacaacaauaugaacuaaccaguaccccggagcucuugacucuagcugcauauguaucaaaagauggccuagucggccaucacuggaaagagaggcccauuggacuugcaaacuuuauaugccccaguacaggggaaucccagggccaaaaagugggaguggguggguaggggaguggggggggguaugggggacuuuugggauagcauuggaaauguaaaugaggaaaauaaccuaauuuaaaaaaaagacacauagaaaacaacccauuauucuaacccaauacucagaugauuuaugucaguccuaauguuagucaauauacgauaacacccuacucuugucuuuugauuucaaaguuagaggcauaguaagauauaggcuagauaauaauaauaauuguggucuaauugccugugagauagguuggccauuuucuugacucguauuugauagaugagaugggaacaaagcaaagcuuugccauuucuaaauaauuucauuucaugggcagaacaagugucugaaccugauauuauuaugucuuuuacacgucuuuagggcugugaugccagcuguuuauccuuguaugaauuguuuuaagauuuauuuauuuauuuuauguauaugaguucacuguagcuguacaggugguugugagccuucauguggcuauugggaagugaauuuuuguuggaccucgcucucuccggucggcucugcucgcucugacucaaagauuuauuuauuauuauaaauaaguacacuguagccgucuucugaugcaccagaagagggcaucagaucuuauuaugggugguugugagccaccaugugguugcugggauuugaacucaggaccuucggaagagcugucagugcucuuaccugcugaaccaucucacuagcccuguaugaauucuuaaugaauguuucaaagcaaauuuagcuuuuuuuugugcaaauguacauauaaaaacagcuagaucuguguuucuuacaaguuuaacuuauaaauaaaaacaaauuauaauuuaaggagcauuauaccauuaauauaauaugcuauaauauaauuuuauguuuaauaaauugugcuauaugcugcucuguuugaaauuauuuacaaauuguuuucacucuccuuauccucguuugauucuuaagucuauagugaaugauaucauuaauuagaauuauauuugcuguuauucugauuuuauagaccagggaauugaaccuuucuuauccgaggcucuuacacuugucugggaucaaguuuuaaauuuuagauuauuuacaagaugaagauauuauacucuugagacuugaaaaguuuauuuauuuuugaaauuaguauauauuaguuauauaaaauaauagaauucauuguauacuaaauaaccagcaagaacuguuuuaaacagagaaaauuuucuaaugguaaacaaguugcuauuucuacccagcuaucacugaaguauuuuuauucucuuauguuggauaguagucuuauuuauaagccugcauauguuccuuauguugcuccucaaaauacuuagaaauuuaaaaagugcaucugagaagauuguuauaguuuguaccagaaggaacuaugauagaauugauuaugucuuggucccaaggucuuccaaauaugaauugaagugcagaagccaugaaagaacaguuguaggucaggcauggcagcgccacgugccuuuaacccuaagcccagcucgugggaggcugagguagguggaccuuggaguuccaggaaaagagccugucuuuaaaaagaagaagaagaauucgaguaauguguucuaaaagaauauccacuggaagaagaauccacaaccgugauagaaaggagaaguaguguucuucacuuacacagagagcuuuaacaaaccaggaagaugggcuuauguagucaauacggggaccagaucuccucuagaggagauguaaacugcucuuagccaugugggaaguccugguguuccucaugaaaucucuauaggaaugccauuguugccaacacugcugagcagauggcagcuccgcguugagcuggagggucuaucacccagugcuggcuuaggaaggcggguuuauugucuguuaaacacacucgucuucggcucaacaugcaggugccagcaguuuggcuuguggacaacaagcagccacgcagaggaacacaauauauaauguuaguuguuguaguauuaacagugacuguagacugaagcccagugugcaaccccauuuggguucuucuuuuaaaucuuucucuuuuacuuccuuuugcuuuuaucagcuccugguauacuguuuauuucagauuacuuuaugaaaaaauacagcuaaaguaauaaaaagcagaaaucuacacuugugaauuuaauuaaaaaaggaauuuaaugagaaagaauauuggauaacaguuggcaguuguauagcuagaaagcucaacuuggaaauggcagcugguguuaaagaagaaagacuuuauaguaucaggacuugcagugggugaaggugauagauugucuuccaaacugagcguggagugucuuuuuagugcaugggagaacuuugagucccuguuucugaaucucuaucagguucacuuuuuaaguuucuucuuuauucuucaguauacuuucuuuugaaaacauuugagacaacugaaaaagagcaaaaggcuuuugaggaacuugguuuuuauaaagccaacacugggagguuaaaguuaccaacaaauuguaaaauuguuaccauaguuagagcacuaaauaucaugaggauauaaacuauugucauauuuacagaaauaaaguguguaccccucacccuuuuuaaacauaaguucuuguucuguagucugggcuauuaaugaauuuaugacaauucugcuuuuggcuccugaguacagggauuacaggauaguaucaacaugcauggcuuuuuguuuuuuauaagacuuaccuacuccuguucuaaguucuuauuuuuauuguccauuugcauaauauccauguacuuuauaugccuuauagaccucagucuuugauuaacaaauagaggauagaaagagagaagauagaaguuuagaugagaaaucaaauuguaauguacaugguuccuguuuugugguuaauuagucagggguugagcaguguggugauuuugaagaugaccaauuaauggagccccuugaaggaaguaauugcuuucuuugguaggcucaugagagccacuaagggcuuggagggcuaaagaaaguagguuacauacuggaaaauauaaaacauauaugcacgugugugugugugugugugugugugugugugugugugcuugcgcgcgcgcggccaugcacgugaugugugacauagggcuuaaaugcaauuuucuuuguguuuuuuuggcauguucaucaaugaacccuguccugaccacucugaauaaaacagacuuuucuuuccacccuacauuaauuuccuucugauagcauuuacuaccacugcucagaauauauucucacuuguuuccuucuuuucugcucuuccucacgauuguaauuccauggcacaaggauuguauuuguuuauauucuagagcuuaauacaguccugauuuauaaccuuuaguaaguauugauuaaaugaguauucaaauuaagguaaccauaagcaggcaugaaagcacaugccuuuaauucuagcucuugggaggcagaggcagguagaucucuguguguuuaaagucacccuggucuacaauagugaauuccaguauauccagggcuacaugaugaaacacuguuuaaaaaaaaaaaaaaagauaaccauaauuuuuuaugcagguuguaacauggcugucagcgguuggauacugugaagaucccuuccuacaaaacugaauuaaaaaguauuuucccuuucuuccagaguuuauauucagaacgccaaucaaguuaagcaagccgggagaacucagugaggaguauggaugccugagaaagguaccuacauguuagcauggcgcuuaguuucuuacaguuaauugaaauauuggcauucaagaaugcuuaucuuuaauucuuugggucuuuaaaaauguaugacucauagccugucuuucuucauacuauuuuauaacagucuagauagauuuaaagcuacacuagaaguaaauguagcuaagaaccuuugagcugccuugucgcaggugaaguguggcuuuuaggggcuaucacacagucaagaaagcuguguuccauacucagacagcccuugcuaauaauugcuuguguaacuuucccucccagacauuccaguuacuguagcugcuguuauuuguaugcuuuuuacuuuaguaaguacuccaggagcauuguauggaggacauaggauauuuugaauaaucucuuaauuauaaaauauuuacuacugaaaaaccuuuuaaguauguuaucauaaucuuuuuuguuuguuuguuuuauucaauuauuggagauugaaccucgggcaugguggcuauacucugccaaugagguccagcuccagccuauaacuguuacuuuuuuuuucucuaauuucaaacuaauugucugagacuggccuuuuguugucagacaagcaucccugguccacuccuacaccacugcucucucaggcuuauaaacgauuaggugauaauucugcaugugggcauugacuuuauaaagguaaaugcccuacuuaccagaaucaggcguuggucuaggauagaggcaagcuguagugaugcuuuucucauggagauaaaugccuggaagaagcacugagagcguggagggacagucacuccuggugggaaggguauggcugcaggugacccugugguaacaggcaaaggccuguggugacagaagggcaggugcuugcucauuuuucuacaagugaggcacguagugaggcuggguagacaccacagcagcucacuucuuccaucuagguacgugcacgcgugcacacacacacauacaguguaaaagcgaugauauguuuuuauuacguacaugguuauugaacaccugguaugagucacggggguauucaucagaauuuuaaauucugaugucacagaccccuccugguggagagccuggcaaacacugcauuuuagcaggugugcuaguuuccuguguacaaagaggauugccuuaguaagaaagagcgugcuuacugcuaggagcuugcagugucugccucauaaaauggaaauaagaccaauuaggauacuuuuugcauaagcaauguuaaauuaaaccacaguuaaacuuuugcuaaaaguuugguagaaaggauauaguaaauucaaagauguguccaaagaaguuauuagaguugcauauuguuguuuugcuuuugaaauacaagucuucagccucccaagaaggugaaauuauagauauguggcacugugcccaacuaguuguggcuuugggucauaaaucuagguuuauuuuaaaagagcaguaaaaaaaauacugagcugucaguuuuggugucaagaaaggauugcagaaguuaagguuacuagcgcugggguaaagcugaagagcuagggcgugguggucuaaauagggagaggcaggcuuagagggaaagugauuccagaacccuuucucuccucuccccuccucuccuacucucuccucccuccucuucuuucucccuccccuuccuucugcgcccuucccuucccuuacucccucuccuccccuguguauguguguuauauaaaaagcuauguauuugugccugugugugggugcgugcgugugaaugugggugcuucagagaccagacuugagaggcauccuagcuccugggacgguguuaccagcagcugugagcccuuggcaugcauggguucugggagcugaacugggucuucuucaagaacaagugcucuuaacuguugagcuaacuccagucucugaagcuauauuuuaaaauccucucauuauuguucugcuuugaacuauaaaauagaaccuauuuuacugaaacuugaacauuucacuuaaucuacuuggcuauauacacauuuuaccuugauuugaacuagccuuucucuuauguauuuuguuuacuuauguuauagaacacguguagcaaccuagagaguguaaaacauguuccgucaccucacagaggaagcagguuguuggccuauuuuuaaaugauuuuccuauagcauuuauaaguauaggugcucaccaaauguuuauucuguuguugguuauauaauccuaaagcauuuucuuuaugaacaaugauuuauauaacagugcccuugguucaugguaaggcuggaugcauguuuagauuccugaugcucuuaugucuauuuaucugcuguuucuucugacaugugcuccugcucucucuagagacagaaauaggugcagggccuuauguguuuaagagcaggcaaaugcaugauagacgcuuaaacucaaagaauguuagauaaggauguggucuccuuuuugaaguaauguacucuuuggagaaaauaacauacauaaauucagagugagaucaaauuuauuaaggguauuucugaaaggugcuguguugccuugcuacuuucauauuuaugagacacaaucaauaguuuuaaagcuauuauacuacuauaauuauuuuuauagcuuaggaaauaguuuaaauaaaaucauuucaagguuacuugcaaagcaaauaaagaaaucaucuagcuguaacuguuaagccccuaguacaaacaaaauacauuauuaaauugucugauuaaguaugcuuuuaguaaguuaggauagcuuuaucauuuuccuuuugugaaaggcagcagaguuguauaagucuuugaauggugaaaaacauuaaaaauucuuuuaaaaauuauuguuauguguaugaauauaucuguguuuaccauuuacauguuggugccaaaagaggccagaagagacugucagaucauccugggacucaguaauagagguguuggcuauaaccugggcccucugaaagagcagccagcacucuuuacugcugaaccauuucuuccgucuggugaaaaccauuuuuaaaaaaucagguuaugaaaaaggauuaaagacgggaaaucagcaguagucaggacaccuaguaaucauguuuaaauguuguuuacagcaacugggcacaguugugcuugccuguaaucccaggauuugagugacugagauagaucgcaaguuggaggccaguucauacuacacagugagaaaaugcugaccagggcugaguauuuuguaaaaccaaaaccaaaccauguuuacuauagauaguguagauacuguauauagauaguucuuaaagaggacccagguucaauucccagcccccauauggcagcucacaaccuuuuguaacuccagggaauccaaugccccuucuggccucugccagcaccacacucagaugguacaaauaaauacauacauacauacauacauacauacacacacacacacauacauacacacacacauacauacauacauacaugcacacacacacauacauacauacaugcaaaacacucauacacaugaaaauaaagguuuaaaacaaacaguguucgacuuuuugccacucugauaguggcaagcgcucuaccacugaacugucauugccccuccaacauuuucaguugccguauagaaaacuuuagugccaguguuguccugaaugucaagaccaaaagucagaaauaacuuuuuuuuauuagguauuuucuuuauuuacauuucaaauguuauccccuuuccuaguuuccucucugaaaauccccuauccccuucccccuugcccugcuccccaacccacccacucccccuuccuggccuuggcaguccccuguacuggggcauagaaccuucccaagaccaagggccucuccucccauugaaguccgacuaggccauccucagcuacauaugcagcuagagccaugagccccaccauguguuuucuuugauuggugguuuaguuccagggagcucuggggguccugguuaguucauauuauuguuccuccuagggggcugcacaccccuucagcuccuuggguacuuucucuagcuccuucacuggggacccugugcuccauccaauggauggcugugagcauccacgucuguauuugucaggcacuggcagagccucacaggagacagcuauaucaggcuccugucagcaagcucuuguuggcauccauaauagugucuggguuuggugguuguuuaugggauugauccccagauggggcagucucuagaugguccuuccuucagucucugcuccacaauuugucucuguaacuucuuucauggguauuuuguccccucuucuaagaaggauccaaguauccacacuuuggucuuccuucuucuugaguuucauguguuuugcaaauuguaucauggguauucugagcuucugggcuaauauccacuuaucagugagugcauaucaugugaguucuuuggugauuggguuaccucaagaugauaucuuucagauccauccauuuaucuaagaauuucauaaauucauuguuuuuaauaagugcauagugcuccauuguguaaauguaccacauuuucuguauccauuccucuguugagggacaucuggguucuuuccagcuucuggcuauuagaaauaaguuggacucgaaaaccaaauaacccuauuaagaaaugggguacagagcuaaacaaagaauucucaacugaagaauaccgaaugccugaaaagcaccuaaaaaauguucaacauccuuaaucaucagggagaugcaaaucaagacaacccugagguuccaccucacaccagucagaauggcuaagaucaaaaacucaggggacagcagaugcuggcgaggguguggagaaagaggaacacucauugcuggugggauugcaagcugguacaaccacucuggaaaucaguuuggugguuccucagaaaauuggacauaguucuaccggaagauccagcaauaccucuccugggcguauacccagaagaugcuccaacauguaguaaggacacaugcuccacuauguucauaguagucuuauuuauaauaaccagaaauaacuuuuaaaaaugaguuuaaaaauauucuacaaaaauuuauuuuuaucuuuuauuacuuuuuuaaagaguuauuuuuuuuauguguguguguguguguguguguguguguguauuuguguaucugccauaugugugcccauggaagccagaaaggaaguuggcgcccugaagcuggcauuauauacaguaaugagccacgugaugugggaacugaaccaggguccuuuuaggaaagcaacaagggcugagccaucuuuguagcccuucugugggggacauuucagagcaggguuccucuguucuguagucucagcuguccuggaacucacucucuagaccaggcuggccucgaacucagaaaucugccugccucugccucccaagugcugggcacuaccacugcccaguuuauggcccuuuuccagcauggucuacagagagaguuaaaggacagacaaggcuacacauagggaaaccuugucucaagaaaccuaacaaccaacaagcaacaugcaaccaaacaaacaaaaacaccaaaacaaaacuauuuuuaaaauaaauucaaauuuuucacuuuaaaaaaaaaaaaaccaaaaaaaccaaaaaaaaaaaaccagggucucucuguauaucuguggcuguccuggaacuuaaucucuagaccuggcaggccuuacacucaggagcucugccugccucugggucugaaugcugggauugaaagugggcaccaccaugccuggcucacuuaacucuuuuuuauaauuaaaaaucuacuuguuuaucuuaggcuuuuaaaaaugcagauauuuaucaagaaauaugcauucuacaguuaauacuaaucuaaaccaagagguaaucuugcagagccaacugcccaacuugaaauccuacuuuugcaacuuacuaaugugugaguuuaggcaaacuacauaaucuuuguaugucuuaguuuccuggucauuaaaaugaauaccauauucccuagcuuacccuuauugugaaauacugcugcuggcacauguaaauucauauauaauuaucaauuauucuuauuaguauuuaaaaaaaaaugagcacauagugacccucucgguuuuugcuuggguaagaaauggaagacugaaaaguuguaguuagaagugaagagcuagugcugcgcgcccggguagaccgucucccccagacuaugaugcugagaaucuuuucucaccuuucuuaucuucuggauguuacauuagauguuauaucuguucaaauguuuuuguuuuuuuuuuuaaccagguuucaaauuuuuguuuuuguuuuuugucuugggggacaaugagcuacaggauagccagagauacauagugagagucuguuucaaacaaaacaaaacaaacaaacaaaaaguguaaaaacuaaagugcaagaaggaaacaguaaugucuugaucuuagaccagacagccaggggguuuuuagaaaggauaacaauguuuccaacuuucuaauagacgaaaaauaccaauacacaauaacaaacucaguuauauggauaaaaucaucagacaggaugcaauugagaaaauaccucuauaagauuguaagcaagcccguggggcuuuucuuaauuaauaauugaugggagaaagguuuagcucacgguggguauuucuaucucuggguugugguccuggguucuguaagaaagcaggcugagcaagcagugaugagugagugauccaguaaguagcacccauggcugcugcaucagcuccugccuucagguucccacccugcuuggauuccugcuuguacugcuccucacgaugaacuguuguguggaacugcgagggaaguaaacccucuucuccacaaggggcuuuugcucacggugaugaacccuaacuaagacaaccaauacauugauagugucaaaauguaaaaacaaacgaacgccgggcgugguggcgcacgccuuuaaucccagcacucgggaggcagaggcagguggauuucugaguucgaggccagccuggucuacaaaguuccaggacagccagggcuacacagagaaacccugucucaaaaaaaaaaaaaaccccaaaacaaacaaacaaacaaaccccacaaacuuugcucuuuaaaucugucauuuaagacauaaaaaggcaaagcaaagauuagcaggaaauauucucaaaauguguauguaacaaugaacuuguauccagaauauauauauaaaaauuauuguacuugcuaauaagguaauaaguaaauaaaauuauaaaagagcaaaagguuugaacagucauuucacaaaagaacauagccuauuaaggacaugaagacagcguaauuagccaucagagaaauacuaauuaaaaccacagagacaacaccuuacauccucucccuuggcugaaaagacaacagcuccaagauguuagacagaauaugaacauagaauucuaaucucucagagcccugccuccaaauaugaggguuacauuuugaacacauggacuuuuaaugaacauauguaagcuguaacacagagaaauauaugcagacacauguauguguauauuuuauccugacaguccucaucuccaaagacuauaaguaacucuuauuagaagggcaaagaugugacguggcuaaccaugccagaaagaggaugugcaaguaacgagcuucgggaagugcuuugcgggccuggcucucaaaguccuaaugcaguaccagcccacaggauggcaaaaauagauagagcacugagugguggagaaucugggagcgacuguuuuccuccuggcaggaggggcugcaggugggaguguagucuguacagugagcuugagaagcuggccgcacgcccacaucggaugacucacagguucuuccagacuucugugguaugcauaucccuagguaagucgucaagaauaccagcuuauuuuuaaauagccacaggcuagaaugucuccagguaccuaugaauaauagauggucagauuguuuuaaaaucaagcaauagaauacaaagaacaaaaugagaaauugcacacagcuaaguuuccuggaauggugaaugaaggauggcagucaaaaaacagaguacucuauguacguaaaagucaaagcuaggccggauacaguggcacaugccuauucucccagcauuugagaaacugaggcagcaggcugggaaguucaaggcuagcucaggcucuaaagagccucgagaagauaaaaugauuuuauuauuuuaaaguguuagaaaccaagacuauaguuacuuuugagugagauguugguccaggcacagguagagguugggguucucauagacacuucauaaguacagcugguuuacuagagggcuuccuugaacucaggggccucuugugcucaccucuucaacaccaguuuacagccacacaugcaaaugaagaucugagcaggguaaguccuguggggguggucuauagcuuccaugugcuacccuaagcucuuagauccucuccugcagccuugggugugagcaaaacaugggcagggguagagguguaauggacacagaggccuaguuuguuagcucagugccuggcacacuguuagcaaauguaauuacugugaugcuaaagccugaucucguuuuuccucuguaucccaugaaagaugcaaugcccaucuguguguugucugugguuagucuccaaacaagagucucugagauggccugugagcacugacuuccgucuuguuuccugucuguggauuugcuccucuuccuguauggucucauuugaguuggguggagcuggaaguccacuucacugcaguguacgugguguuuccugcuuacauauaacuacuugaaguagcuucagugacuucgagacuaguucaggcuauagcagucagaccuauagaaauggaaagaauaaagccaggcucuauuguuuuguuuuuguugcuauggguuguuguuguuauuauuuaaaucuagagacaaccuccugugagaaguaugauuuuuaacuaagugugaagguacaaggcuggaaugccagcacgugggaagccaagggaggagcacccugagcucaaggcuagccugugcuacgcagugagaccuuuuguuagugagaugacucagcucaaggcuagccugugcuaugcaguagugagaccuuuuguuagugagaugacucaguuuguuaaggcagcugccgcccugccugaccaucugaguuccaccccugggacccauacagaaggaaagacaggcuccugcaauuguccucaagugcaugcaccauggcuuccugacuugcacccagucaucuaugcaaauguauauacaaggaaauaauucacuaacuaauuaauuaaaacagacacaccucccccuaaaauagucuuguuucuuugucaucuuuuuuuuuuaacuguaucacuacuaaguuuauucagaaacccaucuuuguugguuuuuuuuuuuuuaaucccauuaugaacuggcuugucaaccaacuacaacacugucuagcagacacacgguaaaaagggcucggcucagaaucguccagaucucucccggucucuugaccgccuccugucacgcuccuuccuccgccaccuccaccuccaccaccgcguccacggucucuggaucgggaacuccguucccuggaucgggaccuggaucuaugcuucuugcgcuggcgcccauacagcucccgucguagcucucuugagauggacuucaaaugcaugaaguugcagaagcccccucuugugcacucucccauuucauacuggcggcagcaggcuucccugaagucaguuacugaggacagcucugcauggaucggcuguccauuaaaccaacgguuauucaagucgaucacggcuuucucugcauccuccucauggucuccuagguugucgcagacguucaucuccucgacuuccccguacuucucuuccaucucagugaagacuuccucaaagaacucaucauagugcuccugcaucuccacgucgcucacagcacagcgcaaaccgucagcagacugggaaggguuuugagggucacgguaaauguucaagagggcaguggucuggcuaaaggucgguuuauugugcaaccgucuccaugacgacaugcuccgaguuugaaauaaaaugaacaguugacuuugucuuuuucggugccgaagauggaggccaaguauuccaccauuuucgagcggacgacucuggcacggcagccaacucugccaacuaccacgucaucuuuuuaaaacuuaacuaauucuuugugaauuuuacgucaugcacuccaaucccacucaucucccagcccuccauaucugccuuccauccuugcaaccucucaaccaaaaggaaagaaaaacaaaaacccaaaacaccaccacaaaacccucacuaugaagcugcagcuuaucacagugugucacucacagugugucacucacagugugucacucacagugugucacauaccauccaacuuuccuuccagugcucacugcagugagucacuggucugguucaaggacccuggcuucugucccgcagucaagacuggauccgcaccgggacuccucucagauagccuguugcugcccugugucauggagauccugcagcuuugguucugcagaacugggcccuucacacacucuagcagcucacagaugagugggccagcucaaagcccuggaucuaggccugggugguacugagcugaccagcuugucagcucuccugugcugcccaggugagggguggagccagcucuccuguguaccagagguggggucagcucagcucaccccuuggacaucagcguggccucaggcagcagcuuccacauggccuuuggugguaacaugggccacagacauugacacagagcgccacugcaguagggccaccaacagagcagucagcggcacagguccagaccucgccacgcaccucaggcuaaugucuggcuguugcucauugcugugacaucuccaguucugccucucuucauagugcaccagacacuccaucucuccaucacguacuuggucaucguaguagcggcugccccccuuggcugucuucugucuauuccaaguguaggcagaccucuuagcuuuaucuuuuuacaagaaauggaaacuguaaauagcuuaucaguaguugggauauauauuauuucauuuaaauuuauuaaaacuuugagcaguaaaaaaugaaacuagggagaauugcuugauacuugguaagagcacagcaggauccucugucgaccauuuagaauacucacaaucaugguuuucuuagaguaggaugcagaggccccuauuuugaguuacauaagugauuaaccacuugccuaacaucguucaguuuuuuuauuaaaaguccucugcuaguugcauaaugcagcucugccuuucccaaaugaggagauacauaucugugcuguggauuucuauguaggccuuguguauuuguugaccuaaccugugaccauaggauaugaacauaacaugcaggaccugggaggagucauugcuguugcuaauagacccagccagcucuacaugcuuugcggcugcuucugccccuggccccauacaguuauauguaacuucagcgguaagaacuuuuagguuuaaguuuuauuuuuccuaugugaguaaaucuagcuauauagcuagcucuuaugguuuuauguugcuuaagaagacaccacaguuugauccugugcugggaaguaaauguuucccucgagcagugguuuucaaccugugguucccaucacaguuuggggcuugaaugacucuucuacaggggucacauagcagauagccugcauaucagauuuacauuaccauucauaagaauagcaaauuuacaguuacgaaguagcaaugaaauaauguuaugacugggggucaccacaacaugaggaacugcacuaaagggucgcaacaguaggaaagcugagcaccacugagcuagggccaaguaaaagcagauugacuuagcaaucaggguggcugcgccgaauaagagagucacccuggagacugccgcuugaucuggucuguaaagauguuuuuaagucuaggauugccuaaaacucuacagucucugugugguuuguauuuuucagcugagaggggagaaguuacaggaagaaaaagauugugaugaucagauacacaagcuacugcaggaggauuccgaaauggggaagaggaaagcugaugagcagaaaaaaagggaugaagcaguggugcugaaaacaagucuggagcaggucagugggucacgcaugucugguggacauugucuggagcaggucagugggucacgcaugucugguggacauugucuggagcaggucagugggucacgcaugucugguggacauugucuggagcaggucagugggucacgcaugucugguggacauugucuggagcaggucagugggucacacaugucugguggacauugucuggagcaggucagugggucacgcaugucugguggacauugucuggagcaggucagugggucacgcaugucugguggacauggucuggagcaggucagugggucaugcaugucugguggacauugucuggagcaggucagugggucacgcaugucuggugggcauugucuggagcaggucagugggucacgucugguggacaucugccucagagagcccugccuugcagaccauggcaccaggaauacucauugauugugcagccuaagagcagugaagcucuauccauccacguagagauggaggaaguaguuuugaaugggacaguggaaucuguggaaagauuaagggacccgacgacagacagacgaguaagaacaggcugggauacggugcugugugugaugcgguuuguaugucuaccaucagguugacauaugugcagguuuuugacauuaacgauguacaccuuaacuuaauauccucaauuagauuuuuuuaaagcguguauuuuacuuuccuuuauccucugcaaucucuuaagcagaacagugcucagauacaagcauguccccaauauuagaugauagucuaaacuuaacuaauuaggcauaugacugggccacaucuugccugagcauuuuucauuacuuauguuuuauuauuucuuagagugugugugagcaccuacacgugcugacacacauguggcagucaaaagccaaacuaugagaguugguuuucucuuuccaucguguggguccuggggauugaaagcagguggucagguacccucacccuccaacucaacccacugguccaaggaaggacuuuuugaaaauauaauuguauucauauagaaauaaacagcuuaauaucaauucuaaucacaacaauuuggacaucuaaugcuugcuguauauauuuugaguaguguauuuucaggauuuuuauguagccuucuuaacauuucaaguuauuuuuuaaauggguuaaaauuaaugaagccuuaacauaaauggagauaggcaauauaagaguaggaagagggggcuggagacauggcugcuuugcagaggaccuggguuugauucccaccacccacagaggcgcuuacagccuccaucucccaggaucugaugcccuuuucugacuuccguggggaucaggcacacauguagggaacaugcaggccaaauauucauacaauaagaaugaauaacauauauguuuauauauuuuguauauuuauguuauaaacauauacauacauauuuauacacagauagauagaaaaaaacaauaguuuaaaacaaaacaaaaaaacccaacaacacuguaaaaccagcacugcgccuaacugcacucuagccaguuucuuccuguucauccuuuuggcuuaguuugcauaaaggacagguuuccugagcuuaaaaaacagaaaauuuuaaggcugucuugggucaguguauuuguugacuucauaugcaggugacauaugauucugguuauaguauugaucaucauuaguuauuauuaaaaauagccauuuggaaacagcaugguggcacacauggaaacagcaugguggcacacaucuguaauaucagcacuugggagaauggcaggagggcugcaguuaagcuaccuagacacuguaguaaguucuaggucuccuuggguuauguauauagugaggcucuuccuccaaacaauaaaaauaaaacaaaggcacuuggaucucacaaguuuucaguccuauaaaagauugcauuuaacaagcacagaauucugugugcuuucugugcuauaugccccaggaaccuucaaaggcaaagaacaguugcugggaaggaucaguaucagcuuagguggcagcaggacagggggugguuugauggcagccuuggcucugggcugcagucucugaaagagcuuugccucuucccauuuguaauaugcucaggcaaacuauccaaaagccuccaaguguugguacuugggagaugccauuuccuccaggaacuguauuagagaauuacuccuucuggucugugccgguuuaccuuggucaugaacucugcagccagucccacaguacccagaagaggcucuacucccaggcgcucuagcauacccaggauuuuaggaucagaggugaguaggacacaacaucugucccaaaaccaccaggaauaacugggaccaguaggauccagggaugcaagaaccccgcccgagacucaaaucccaggagcucuaacacacccaggaucccaggaucccaggaucccaggaucuuggucacaccagguucucagggucccagaggcagcuugacucccaggaacucugacacacccagaaucucgggaucacaggaucccggaaucacaggaucacaaggacagcuggacucugaggaguucugacacacaggauuacaggaaggacaggcuccagucagauauagagagggcaggaggcacuagaaauaaucagauggcaggaggcaagcauaagaacauaagcaacagaaaccaagguuacuuggcaucaucagaacccaauucucccaccauagcaaguccuggauacaccaucacacaggaaaagcaagacuuggaucuaaaaucacaucucaucacaaugauagaggacuucaagaaagacauaaauaacucccuuaaagaaauagaagagaacacagguaaacagcuaaaagcccucaaagaggaaacacaaaaauccuuaaagaauuacaggaaaacacaaucaaacaggcgaaggaaaugaacaaaaaccaucuaagaucuaaaaauggaaauagaaacaauaaagaagccacaaagggagacaacccuggaguuagaaaacauaggaaagagaccaggagucauagaugcaagcaucaccaacagaauacaagagauagaagagagaaucuuguggggcagaagauaccauagaaaacauugaaacaacagucagagaaaaugcaaaaugcaaaaagcuccuaacccaaaacauccaggaaaucaggacauaaugagaagaccaaacuuaaggauaauauguauagaagagagagaagagucccaacuuaaagggccaguaaauaucuucaacaaaauuauagaagaaaacuucccuaaccuaaagaaagauguccaugaacauacaagaagccuccagaacucccaauaaagaccagaaaagaaauuucucccaucacauaauaaucaaaacaccaaaugcauuaaacaaagaaauaagggaaaaaggucaaguaacauauaaaggcagaccuaucagaauuacaccagacuucucaccagagacuaugaaagccagaagauccugggcagaugucauauagaaccuaagagaacacaaaugccaguccaaacuacuauacccagcaaaacucucaauuaccguagacagagaaaacaagauauuccaugacaaaacaaauuuacacaauauccacaaauccagcccuacaaagguuaauagauggaaaacaucaacacaagaagggaaacuacauccuagaaaaaacaagaaaguaaucuuucaacaaaccuaaaaaaugauagccacacaaacauaauuccaccucuaacaacaaaaauaacaggaaguaacaaucacuuuuccuuaauaucucuaaacaucaauggacucaauuccccaauaaaaagucauagacuaacagacuggauauguaaacaggacccagcauuuuucugcauaccuuagugacagauacuaccucaaguaaaagguuagaaaacaauuuuccaagcaaauggcccaagaaacaaguuggaguagcccuucuaauaucgaauaaaaucagcuuucaaccaaaaguuaucaaaaaggauaaggaaggacacuucauacuagugaaaggaaaaaucuacgaagaugaacucucaaucaguuuggugguuccucagaaaauuggacauaguacuaccugaggacucagcuauaccacucuugggcauauacccagaagaugcuccaacauguaguaaggauacaugcuccacuauguucauaauagccuuauuuauaauagccaggagcuggaaagaacccauauguccuuuaacagaggaauggauacagaaaaugugguacauuuacacaauggaguacuacucagcuaucaaaaaugaugaauuuaugaaauucacaggcaaauggauagaacuagaaaauaucauccugaaugagguaccucaauugcaaaaaaacacauauggcaugcacucacugauaaguggauauuagcacaaaagcuccaaauaaccaagauaugauucacagaccacaugaaguucaagaaggaagaccaaagugugggugcuuugguccuucuuagaaggagaacaaaauauucacaggagcaaaaauggagauaaaguguagagcagagaauaaaggaaaggccacccagagacugcccuaccuggggauucaucccauauacaguuaccaaacccagacacuauuguggaugccaagaaguacaugcugaaaggagccugauauggcugucucuugagaggcccugccagagccuuacaaauacagagaugcaugcucucagccaaccauuggacugugcuuugggucccccauagaggaguuagagaaaagacugaaggaguugaaggggguuacaaccccauaggaagaacaacaauaucaaccaaccagacccucccccaccccaccccccagagcucccagggacuaagccaucaacaaaggaguacacauagcuccagcugcauauguagcagaggauggccuugucaugcaucaaugggaggagagguccuugguagauucccaguguagaggaauugaggacagagaggugggagugguugggugggugaggaauacccucauagaagcaggaggagggagaaugggauagggguuuuccgggauggggggaaaaccgggaaaggggauaacauuugaaauguaaauaaauauccaaaaaaaaaaaaaagaaaaaaaaaaaagaaagaaacaccaucuuaucuuaauagagagaaaaaaagagagagagaauacugcuuccauguugaggcugggggucauuuuaauuuuuugcuucuggcacuguuaucuuugaaauagaaaguaguugcaucagugcaauuuacuucuuuaaaggaacuggaaaauacagauucucagauuuucuuauuggccauagucagguucauaacauugucaaugcaaagcacagugagugaaaucugacgccuuuggacuucugugguccucccuuuucuauccuuccuaucuccuuuacaguuuugaagacuuuuaaaugacuuuaguaauuuuuagauaagcugggcaaugguggcacacauaauuaaucccaggacuagggaggcagaggcagguggaucucucugaguuggaggaccgccuggucuacagagugaguuccugcacagccagggcugcacagagaaauccugucuuaaaaagcaaaaaaaaaaaaaaaaaaaacaaauaguuuuuagacugauaaagacuugugcucucaacuagaagagacugaagucagaaggcugcaacuucacggucuaauugggccucaaauaaguucaaggcuaguuugggcaauucauugggacucuaaaauaaaaaggcugggcagaggaggagaggggccauugaccagccugugcuagggaaaagcaaguguuuggucuugagcaaaugauuucauuauauugaaauugggacccaagaaaaccugaaaugauaucaggggacagccagucaucguauuaagguuguguuaugauaagacugucauuacacuugccugccaccaaaccucaguggcucuacauuucuuuagaacuaaaugggaacucuucagccagcacccaguuccauccuuaaacaugaaucuagcuagucuuuccagccgugaggaugcucugcggcucucagaggagagauguuugcugccaacauacgcacuccacuuuucuaugucaggcucaucucaacagcuugcuggugggaaggucacuguuugucuucaugucccauuuaaaagcugucaccugcaaacuggcagagacuucacccauccuccucuccucaguucacccuuaguacuuuguggcuuuuaugggauuguauacucccauuauagauuuuuauguuuguuucucucagauugcuuguugacaugugucugacccaacuaaaagccucccgcaaugucuugcccaucacaaguuuuugaugcaugcucaugaaauuaaacucagaacgaauucuagaaagagagauuaugauauauuguuuuuauaauagaaauaaaaugggcacaaugcuuaauuuguuuuauuauaguaccauuacuccaauaaugguaugaauuguuggaaagcaaaauuguuauagucaauaguuauauucaggauuauaaaccagaggugaaaguuuaauuauccuaugaccuagaaauauuuccuacagacauuuuggugauuauccuaaucagaucuacuuucaaaguacaguguacacacacacacacacacacacacacacacacacacacacacacacacagagggaucuccuggagagaccuuacugcuuuaaaugcuacugugauaaauuacuacaagcagaaggccaggggaaaggaagugugcuuugaggcugugugaauguucauugcccagauguccuggagaaggugugauguagaugagcucuuucuguguugugagggagcccugcccuccaguggccuaguccugaaagcauuucaugcucuguacuguccuaaggacacaauaaugccuuagguuuauuuacauccaaggugaaaggugagaggugaauauuucucacuucguguuuccagguguuaggcauggagaggaggguaguuuugucuuuguagauauuuauuugcaauaaugcagcuuaguuuucaucaguuaaaaguaauuuggugaaugguauaaaauuaagcuuuccccuaaugcuaucuguagcuuauuuagugcuuaucagcuugaaggaucuucucagcagcacggucugcacagaggaaguggagacagaccagcgacacugauggagaucugaucugaaugcucguucacuugguaccaaacuaguuauaaaaagagaccaaaauacagauugccauuacuuaccuuguguugagucuguugucucucucccagaguuggaagaaaauaucauacacaauuugauaauggguuaauuugauuuuggacauuuucagguaaugucacauuugcaauuaguauuuuuagaaaaaaaaaugggaucaaacuggaacucagaacagugaguuagagagauggacuuugaaacuauacuaggauagaucccacagaacacuuugucucccuugucucuuuaacaguguccugcgcgucucucggauucagagaaugaagagccuucucggggccagaugaugcagacccaucgcuccgccuuuguuucuaagaacagcuccugcuccuuagcguuccuggcaggguaagacugaugcugaauucagucugaguucuuucauuugugggaugacaaagggcuuuugggugaguagaaggggugaaaagaggugggagcugaauuuccaaauguggacuacagagaaagggcucaccugaguguggcaagcaugcaugcaugcgugugcgcacugaagguuaaucucauguggcguuccucaggagccauccaucuuguucuuugagacaaggccccugaagugugccaagugaguccuggcugggucucuuccuagccuagaucuaacauggauuucaggaaguuuuuaaaacccuggucaaggaauuucuggauccuuuaggcuuugcagguccuagggaggaaaagaguaugguuggaugguuguuugacucuggaggcacgggguggaaagggagggaauggggggggggccgagggaggagggggaagaagggaaacauucauuuacucaguagacucuuuggcaguggcuacuccauguugugcuccauuuauacuaggguauaaagcagaaucuuuuuuuuuuaaaaaagauuuauuuauuauuauauguaaguacacuguagcucucuucagacacaccagaagagggagucagaucuuguuacggaugguugugagccaccaugugguugcugggauuugaacucuggaccuucagaagagcagucgggugcucuuacccacugagccaucucaccagcccauaaagcgggaucuugaccucauguugucuucuuuuacuuaaagcuggugguguuuguccuuccugcuggggcucauucugcucuugccaacacuauguauguaguagauggcuuucuugcugccucucuggacacacaugcacucuucuuuccuggagacgcuacuguucucuguguguaacuacagcagacuaucaaguucaauaacuuugucagagguucuguccugaaaggccccguguaaugucuguuccggaaaccuuguguauguucuucuggaacaguuugguguccuuuguugaagacuuguaaguguaaaaguuaccagaucuccaggcuucucugaaguacuaguaacuucucgaggacccuucuuuacauguuuccacauguguaauuuguccuagacuaguguuucucaacuugugaguugugaccccuuuggaguuucacaggggucacacgucagauauccugcauaucagauauuugcauuacaacuccuaacuguagcacaauuacaguuauuuuguuguaacaaaauaauuuuaugauuggguauagucacaccauuaggaacugugucaaagggucacagcaguaggaagguugagaacuacugugcuagacagcuuagucgauagaauuagaacuagguaagccugugauaaagauggacucacugugugugagcuggaagucagauguccuuccagcuccacaaagcagaauaguugucacuuugugauuuuguaugugguuguguauacccaaucauuguuauaucuuaaugguuauaaaacagggaggaaauaaaaucauuuuucuaauaaagccagaaaucacaguaaauauacaccaaaacuaauguuuuaugacaucuguaauuaauauuauuaugugaaauaacuuagaaaaauaaauuaauauucuuguaccaaagaaacauuguaccaguuggaguugauguugaauggguaaauugcuuauuaccaauuucagcucugccuuuguacugguauaauucauccuucugaacgaggaccuguggguuaauaugccauuacauaaaagccuuaaaaaucauucugucuuggacagaauugcacaagcacagaggaguaugcuuggggaacaucucugccauuucuucuuuucuguuuccuagccuauccuugcaugaugggaccaauuaauaugcaaacacugacugcagacuuuguuagcucccauuaaaguuaguaucaugcaacucggaucucagggcucaucuuacaaauauucaagucaggugaaguucaguuguuaguuuaguucuugagacaguugauuggaucacauaugcucuugaccaccccacaaggaagcaucacuggacucuaucucccauagcuguccuguccaaaucagagucuccaacaaaaccuaagcagccacacgauggucugggaagccaauguggcaacagggacauucauggacauguaguaaugagauagccaaaugcuaaauucuucaagcgcugugggguugucacuuagaccauuguaaaagagguguaugcagacacaccugugaggccucacaggguagaugaaagcguagaucuacagagggugagugaucucaggagaaucuccaaaaugaggcacccacuucacuguggaagauuuuuaucaggagcauuagagagcauacuugagaaacauuaucuuagucaguguucuguugugaagagacaccaugaccaaggcaguucuuacaaaauaaaacauuuaaguagagccuugcuuaccguuucagaggcuuaguccaacauccucauggugagaagcauggcagcacucaagcagacaugacgcuggagcaauggcugagagcugcaucugauucauagacagagagagagggagauggaaagggagagggagagggacagagacugggccuagugugcauuuuaaaagccuacucccagugauaccuuuuguccaacaaggccacaccuccugguccuuuaaaaacaaugccacuuccugaugacuaagccccaccauaaauuuaagagauuauguagaacagcauggggaauuugaagugacugaaauccugacuuacugcagcaggaucuagaagaggaacuuuacuuauguaaccuugauggccauggcagcguagacaugacuguccagaaauauuguccuauucacagucacagcuguaaagugaggaaugccuccuggaagcagggcgugccuugcauuucuucuagcugaaggggcugaaauuguccuggauacuuugguggucaggggagcaagcuuggagcugggggcaaguuugguugugcaggaaccaucacuagugaucauuacagcauccaugcuggcaguuaagcuagagaauauuguggcagcagggauggcuacaguggauuugguaaugguagacacagucuuagagguaguggauuugccauuuauggugaucagucuucaggcuuucgagccauggaggguuucucuguguagccugucuccugugaugauggaggcuacuccuuugccaaacccugagacacaaguggcuguggcacuuccagcaguagcagcagcuguggcgcugguaggauguuucccuuuuguuuuggguuucguuuuuuggcucugucaccuaggccagccuuacucucucaguccucucuccccagccucccccaguucuggggucgcaggcugggucagaggauguugguuacugcuagauaccagcuuagcagaaaggaaagauggagaaguaacgggaagacacaggcuacaagaguuugagcucagcccagcacagggguggcaaggccuggcugcucuggaaaggacgugcuuuagacaguguucauguaugggcagggagcccaaagacucucaugacuguguagcagccauuuuaauugcuguucuguggaaaguuacuccagaacauucaaaaaagggccuuuaaaguaguugacuguuugccccuccaugcuguugauuguugauauaaaugaugcggcauugaauaaauauguccuuaaacauaauuuuuauuuaaagaugccuaaauuagggguauggcuuaguggaagaguacuugccuagcaagcaagcgguggugagauuguucuccagcacugccaagucaauucgaaacccaaacacaugaccgaaaacaaacccgaugucuuuagcggggcaaugaucuucaguacagugggagccccugguagaaaacuugaguacaggaaugcugacgggucuccuguuagggugggccugcucuguagcucagaaacuguuauguccacuugaaacuguuuucagauuuuaggaaaacagugaaagguuauaaugcugacagugauguguaguuauagacaaugagaaaguuaacuugaugcuaguuguacaaccaucuaauaaauuuaaaauaguuaaaaugauaaaaucuguguuguuuauauuuuacuacauaaauauacuagcauuguuuauaguuuggagagauuucaagucuauuuuuuucguuuuguuuuguuguuuuuguuuuuuugagacaggguuucucuguguagccguggcuguccuggaacucacuccguagaccaggcuggccucgaacucagaaauucgccugccucugccgcccaagcuauuuuuuucuauuaaguaacaaaaaaaugaauaggcuuucucugaaaauuuguuuccuaaagagaguucccagguaacaauuuuagauuuuuuuuuuuuauaauuauauuuucaucaaaugaagcugccacuuguccuucuugucugcuuuguaagcauguuuuccuuaagcacagaagcaggcaagcaggcaaauggccccugcggggcggccaugggugaagcacaugaguagauucugccugcagaugcugucaacagaucaacucacuuuuguagaagaaacaaaguaagaggguucuguagucauccagugagauugugauucuuucagauaaccagaauaauaaguuaaucaaagaucauuucuagauauacauuuauuagaaaaauuaauuugaaccuaaguaggauauuuuacaaaauaaaauaaaacuaaaugcaugaaaagcuuaauuaauuaauuaguuaauuaauuaauuuuaaaaccauuauuuugcuuuauuccucaucccuguuucuccauugaguuugaacugaaacugugauucuguaagcucacucggggaaacugguugauguguaucucuucucuugcuaagagcuccgcauugggcuguguuuuccuuguuaucugggcugucaggggguugagcuuuggggagauuucagaucagacaaaauggcuuaccaacaugacauaauuuaaaaaauuauuguuucuauacacucuuauacuuauuaauauccuaucuagucuucauuaagaguuucauuuauuuaucuuuuacacuuauuaugugugugcauuugugugcgcgugcguguguguguguguguguguguguguuccuguggaggucagagggcaacuugaaggggagucaguuuucucuucaauaauuuucuauaccaaaguucuauauauuaguagugaacaauuuaaaagugcaaugaaaaaaagaaacaauuccauuuugaucuauuacuaggauuaaaaaaaaauagaacacucgagaggcagaggcaggcggauuucugaguuggaggccauccuggucuacaaagugaguuccaggacagccagggcuacacaagaaacccugucucaaaaaaaaaaaccaaaaaaacaaaaaacaaaaaaaaaaaaaaacaaaaaacaaaaaacaaaacaaaaaaaaccaacaacaaaaaagaauaauuagaaauaaaguuaaccacgggagcauaaaacuuuaauacugaaaauuccaaaguuugauguuagaagaaucucaauaaaugcaauggcaucuuguucaugaauugguagacuuaauguuguuacaaugucaguaaucccugaguaguuucuuaaaguucaguauaacacaugcuaaaguucuaguggauuuccuugcagaaauguagacugaugcuaaaguucucaugugggaucccaggagaucccacauauccaaagcugcccagagaaaggacagagguugauggcagcgauugaaauagugcagugccggacuaggagacagacagagagcaauggauuuagcauuaagaguccagaaaugaucuauacauuugcggucaguugauucucaacaaggguggcaagaucacucucugggaagaaaaccugccucuugucagggagccgcccagcugggaaucaacaugcaggagcaugagagcugcagcgcuuaggacagacucugagcuuagcugugcacuugcugccccucaggacagucucuaaugugguggccuucaggaacuagaugugccuuugaauuagcucaucagcucgugucuagugcuuugccuggaguugcugcuuaaaauguacuuuccucucuaaaugacagagaaaggaucagugauguugacguuuaucaaaaauauuuucacugucaggaacuucugucgaucuucauuguacgcuucaucacaaaugugaguuugccccuagguuuuuucuuucaccaauacggaguugaagggacaguugugcuacccacaguugacaugagugugucuguaauuuggaccugaaacuagacaagucaacugucagcugggccguugccccugaccagauggguuccuggccuggugugaagacucuuguuaauuccccaguaccgaaucuggagcucgggguuuagguguggcuucagcuccccuuccaguggcaucaaacccaguguuccagagcugcucugcugaacggugcgagcucuucuuucuucacucucuccucucagugucuguuugccucacccaaagucauguauuugaaauacuaaugccaucuuucaucucuaaaucccugguccaagugcucauuauuuacaaagcauuuugggauggcuuaugugacuggcaauguguguggcuucuagcagugcaaaugaauucuaauguuuuucuaaguaucaacccagcuugcuucuuagaacugucgucuuagaguggcaguuguuugcuccagaacugagagagacuuuccuuaagugcugaauuuucuugcuaaaguacaaauauguguuacagucaucaucuucucccacuaacaccguggggccaugagacauaggaugggagaaaccacgcaggugcuggaguagaauucugagugcuagacaggcuuucucuggagaugcaagaugcagagaauucugggggguaaucccugcccucccccccccaccccaccccugccuccuuguuuucccugagccaacucugacauuaaaaguccugucuacaaaagaguuuauacgcugcauucuguuuaagagcuaaauaguaucaauugagggaauaauuucuauuuggagucauuggaaacguuaguuguagugugguguaggugaccaccugugugugcacgcaguucuacaguagauucugucuggcacagggacagcugacaggcaguuagaccuccaggcccuuaccacaugcagaggauuaguucagaauaaaucaaagacccagagguaacaaccuaaacacuuagguuguauuuuagcuauguaagggcuauucuguuacuucauuuggcaugcuaacacaguggacugcagugcucagugcaggugcuguggagugugguuugcaagucauaacacaagggcucaagaguugacucggugguuauggucacaggcugcucuuuaagaggacacagauuggauugcacauggcaguucacaaacacuuguaguucaauccuagaggauccagcgcccucuucuggccuccauggcacagguuuacauguucugcacagauguaugugcaggcaaaacacccacacacaaaaaauaaauagaacaacaauuguaaaguuauaauacauaagauaaaaaucaugugucuggaagacuuuggaagccuuuuucucuuuugcauuugguugcuaaauuaacccguuuucuauucuagcuaccuauggggauugucuuucuugagaaauggcuuagaauggaaagagauugucaccauuuucuaaacucauguauggacuaauuguaacuguguauucuuuuuuaggaaguuaaacaccaaggugcagagaagucagagcugcagcgacacaguucaggacagagugaggagcaggcucagaacagcuccgcccaacagagccaagguacgagguguggucagccuggggcugcugcggcgcuccgccauucugcauccuccaccucagcacacgaagcucccugcacagggcagagggaaucccaggcagauuagauuaaucaucuagagaauccugcaaaaagacaugaaggaagaagguucaaauuaguagacagauggggagccauuauagaaaccuuucagaagguuuggucuaggcaagauccaucuucagguuuugauguugcuaacucucuuacugauguguaugaguuaggcuaggaauuuuucccauuuuuucacaccacccuuccuuuaccuuccuucucuaccccuccccccacaucuaaaggacuuacguagaaaaaaaugcaugugcgagagagcuggagggaaggcucagcaguuaagagcacuuguucuugcagagaccuagacuacaucgggccuuugcuucccauaauucuagccccaggggauccagcaccuucuucuggccucuuuggacaccuguacauacacguacauacagaaccacauauacaaguuuuaaaagauaaaagauuaaaaaagucaaaaaaaccacacacaugaucuuuuauauuucuuucagaucacaacuauaacuccaggcuccacccccauuauugguguucucuugucuacucaaaacaaccgcugccucucugccccugacuuaaccaucgaaaagcgccugcccuucggcucccuuucauccuuggcuuccuugcauaagccagagcgcuccaucagcccugaaagcaaugacagcaucucugaagagcuaaaccacuucaagcccaucgucugcucgccaugcaccccucccaagagacucccugauggccgggugcucaguccucucaucaucaagucaaccccucgcaaccugaccagaagccugcagaagcagacuucauaugaggccagcccucgcauccucaagaagugggagcagaucuuccaggagcggcagaucaagaagacccuuuccaaagccacucucaccucccuggcuccugaagcaggggaagaguuuccagguucugacacaauccauuccagcaaggagaggccgucucuggccuuuaauacaaggcuguccaggguccaggugcucuccgagugugcugggcccaccuccacugcccuugagugcuuccccucuguuaaccagaccaaaguagaacaggacuguguuagaaaacggagccgugaguucucacuggaaaccugccauuccucggagcacggaggagccuccagugggccuucucuggaacgggagcagugugaggagucaggguccaccguggacgccacauuagucaaaacuugcauaagcacagucaugaagacugcagcgguuaauucacugcuacccaaaaaugauguuuugggugggguccucaaaacaaaacaacaacugaagacacucaaucauuuugaucuggguaauggcauucuggucaacagccuaggagaggagccgauuccuucccugcgcagaggccggaaaaggcgcuguaagaccaagcacuuggaacaaaacgguguuaaaaaacugcgaccaccgagcagugacauggaucuggcccccaaggacccagggcugcuugagguggggcggaaauugcagcaggaggaagaggaccagcagcuggcucugcagucacaucgcauguuugacagugagaggcggacuaugagccggcgaaaaggaagcguagaucaguaucucuugagguccagcagcuuggcuggggccaaguagcacuugauguauagaauaauguuaccugcuucagagguccuugaccugucauuuauccaaaagagcuagcugaauguucucauuuugaguuucucucaauggcaaaccacugucugcuaugguucugagaggauccagagccuugguauucaaaagccaagugucggcaucuuuggcuuucuaggaccagggccaguacuccucacucuuugagugagccaacucugaaggcuucugggcccaaaucuggcaguacccacuuggagugagcuugggaguggcccucauucaugaaugugagggccaguguuagagaugguagggagaugggauggauaccuucucacacucauaaagccccuggcuucuucccacagagugguguuuaaguuagccuugcagauaaacauggauucuuuucagagacaagcagugccaguacuuuggaagagccaagauaaauagaugcucacauucaucuucccuccccuucgcuacauguuauuucuacauacccaagucaguugagcucagaacuuuuaccucuacagaaauuauuugcauucuuugucuaaacuaugacauuugauugaagcaguguggcugacgcuggucuuccugcgaccugauugcuaagugcugucagcuggauguccagguucucuuagcugccagguggccuagcccagacugaccacuggcucucaggccacaagucccauggauucucuacaaucacaggguguccaaaggaaguacagccuagggcacgccagggccaugacugaacaugacagugcaaagcccaccuagaagcacuucaccuugccgggauggaaagcaggacuggagugacuucccugccugcuuacugcuccucuucucccgggagcccucgccuggggccgaacugggagguuuccuuacuacuucccacauggcaauggcaaaacuucccuaaagucaggcaaaggacaaagcugaaacuccauacuguggaaacaagguaucuagcuggaugcagcuggucaauucagucccauggaccuuugggguuuauuuuucuuagcagcuugacaccgugugucuuuugcaucccugguggugcuuggugcuucugcccuucugggcuuauugagaauaggauuaugauacgguuuuagggacucucaggugggcuggccuuuccugugugugugagcuguuacauagucaugugacugucauuuucacaaaccuuccagagcuuuuacacuuuuguucccuuuaaaaggucccagcaagauacuccauagucaucugaucagaaugcuucugaaacguucgaagcuagaaguagcuggagcuuagacucacuuuucugugccaagggagaugucagucucugggaauucuagaagagagaacuucagauuuggaguuagacagaaacugguugaagcuucugaaggugggaagaaggauguggacucccaagcacuaugucccuugaagcagacagaacuuaauuucucugcagcucauaguugacuguucgcaggaauguuugauguguaagguggccauuagcaagguggcuucagaggcugcucuggcaggaacugugugagucuggaguguguguguguuuuuaaaacaugaaauagucucauuacuuuauacucacacggcuuuacuccccauccuaggcaacuuagggcuuuucagggcugcgggaaggcaggccagcaccccagggaggagagcuggccccggcugcggacaccggaaaaucccauuagagaaaacuuagaaaugucuaccaagucauguauuuccuuuaugagcuuaguaauuauuauuggaaggcuaggcuuacuggguagcuuuaaagacacuuauuuuuccacuugccacccuuuuauaugucacuagugcuuagaaaaacacuuucaguuggaauuaauuuuugguuuugguaagaagauaaaauauuuuaauagaugaaagauauauauuuuaaauauuccccugccccuagugacuaccuugaguagagugcgcagcaguggcaacaagugugggcucaggugcuguugcugcugagugaguguugcagacacugggcugucccucuguaccccaccccaccccccagggagaccccaaggacuguagacaguguucuuucccauaauuccugcugagagcaguggcccuugaaauagaggcaaaacaguuuauguugggaaggcguggcuuauucuuuaguuugcuuacccuugaaaauggaaaaacuacuaacguaucugcauacaagaugcucucaaacucagugaaaccugaacacuucauuucugagaauuccccaucuugguguuugacugaaguccauugcagcuacaguugcugauggggaucccauaggagaaaauggaccagggaagagaacgcuugggaggcuggugagcuugaguggaagacauccuuuuacagcuagaacuagcugcagucacugcaguccuagcgaccugcacacugcccacauucugcugugcuccuuagugugugugcaaagaggaaacuaggagagacaggaggcuaagucuuucugauggggaauccaagagaugugcuaugccucaagagggcuugguagcccuucucuagaggggaacccuuauaccuguuugaagaagucaucuaaaucaucugggccugaugugcugguaucaagucgggaaguacucugccagcacccagcuucuggccucgggcccuuaguacucugccagcacccagccucuggccucgggcccuuaguugccucuuuaaauaaaagaaaagaaagaaagaaaaaagucugccugagacuugacuagaaauccuuccuaacugaccucauuuauuuaaaaaaaaauucuuugauuauggaagaaguacuuuuuuuuuuuaagucuuuuuuuuuuuuaagguaaaaugccccucaaaaauuaaagcuauuuaguuauugucugauuacaaacuggccacugacuaaaaugggaggcuagugagggaggcuguguucauucagaaggcacuucugagcucuuagaccugccacccugugcugggccauguguagugcagugugcauggaugcgcuugacccaagaguauauccaugaacuuugaaaggccguuccaucccuggcaaugcucuacaauguuccuguucaggagaucuggcucagcagaucacucacauuuucuauaccuuaucaguauuucugaguuugauuaacucugcuuuuuccuaaguaauuuucccaaggaagaauggauuuucccugcagugauuauagacuagucuccccuguucaaaggcugcauuuagcucaaaucccaagaaaggagucaagucuggaucgcccugacaaagccuguccuucacuugagugaccuccuagugcaucccaagcugacaguggcagugacugggcuuucuuucuagcuugucauugaagcagagagccaguagggauagcuagcuagcccaucauuggguuaaauuuggaccagcaucaaccccuaccuuuaaaugaagacccacagcucugguucccacuguagugcuccagggcccaaauaauugugaaaguuaugugguuugugaaggggacauccaaaugacagguuuuaugauguuuguuucuucuguuuucuucaguuaagaaauaccuguaucuccugaauacacccacacuauauaaaguacuuaguaggggguaccccguagugugauuuaagucauuggugagauuuugguuggaguagcugugguuuuaauuaacagccuuggcgguuucuuucacucaaacuccauaggguccuaacccuuccuuagccagcccuuuccucaccagccguacaguccucuuuagacugagcccuuaggauggauggagcuggaguucuuagaacgcagcaggauuugaggaugaggcugcugcacagaauuuuuuuuuuuuuugguggggggugggcaggggcagagaugacagagaugcacauuucccagauuguuauccaugguagcauucugaggauuguucuguggaagagacuuggagguacacagagguuaccaauuuuuagucauacaggauggaggaaaaagugccauguccccaugaguagacagcuuuguguauuggcaggauuuuuucugagggggaaaaugcacucuuguguuuccuaaguuuguugccaggagugugggaacuuacaccacacgagagcugacccuagacucugaggucccucacucccucacucuucggagucuugggucuaggaggaguuagacaaggccaugcuaaggccagacuugcucaugcccuucccagugcugcguuugaggcacagacaguucagccuucggaugucaagcugggccgggagcagcuucaacgugguuccagauaccugcagcugcagccagggucucucuagcugcuaccugcccuccaaaccgagccucaguggagcccagcagaucccaguuugcucaggcauaaccaccagcaaagcaagcagacagacuaugcaagacgggaaauaacuagcugaaaugccaacuauguuuguuuuuuuuucuaccugauaacacuguuuacuuauaacuguauaaauauaguuguccuaagagccaggagggaaaccuuuccaccuagaaauagaaugguugucuguuggcuuuaggccaccuguuacagcuccuuguggucugaugauugugguuuauucaaccuguuuacauuagaauuggagaaggggcccuggaucuuggugggcugccacugcugucuguauccccuugacuccuaaagagccuuuugauagagggacuugggacaagguaugcccugucagggaugcuuuuaccacaaaggaaugguauggaaucaagugggaugauugauggaugauuaacacaguaccaaagugcauucuucaauguguaugugccuguuccaggcaaggcccaaguugaaaaugcaguaaagcagacucaugaaagcaaacagacuauuucugaucagucuggagagcugcgucucaguguggccuaagcugaaggcagcagguguuugggugcgcucggggcuggggggugccuggguuagugcucucggggcuggguuagaaugccucacuuuggcauucgccaugagcaggaagcacuggaguggggucuucacagggaacaaugugccuuuugacguguucuaauggacauuacuuacugucuccugaucuccugugaccacuccuguuccucugaagguaccaagaguaaagaaugacuuggggacgccauuauccuugcaccuuauggccacucuuagcaaucugguuuuuuaaaaauauccuucuuuggaaccauugcuagaaagucauaaaaaaaacaccuuugacauaguuucacauuaaaagagaacaaauguuuaccuguuccuuuuaaacucagaaaaugaaccuggaagaccauuuugaguugaugucacacauggugaggcaggaugugggaccuuugucaccugguccaagaccuuca

SEQ ID NO: 3959 - RNA, 39454 nt, Mus musculus
cuccaauucaaauuugguuuuauuagaaaucccaccauaaucaaauuuuuuaaagacuggaugguugccuuguacuuuuccauucccauuuacaaaaaucacuagaggcaaugacaaaaauaaccacugaaaauagggaauucuccagagcuuuccuguaagcuuaaguccaggcauuccacucuuuuccacguuagaaaaaacaguuuuggaguacaccaaccuuuacucagcuugauggacaagcaucugcccuccaguucucgacaggagaccaggacucaucucccaagcugcuggucuccagguagcccaggcuugguugcuaaagcagauguguaaaucccaagucagccccaaccccaaccuccaacaguaggcaacugauuacaugacacaagccagcccucagcggaggguuggagcagacaucccucaucuccccuggguucacaccagcaguggagucuggguucccucacuacagcucagugugcaaagccacugccacacaacacggacagggcucaccuccugcccagccagaauggaaggugacugaaaguuauaaaagucagcccccuguccccuccuggggagccugugcugcuggacaaaugaagaacuugacaaaacagaggagcaacaucuguguagaaaugugugcuaaguucucccuuccuucccaggacaggaaacugacauuucuggacucuguauuuccuugagguaaguuaucuggugcauagaaagcauucuuauuuuaaucuuucaucucgcuguacagguuccacucucuggguaauaaguauaggaaaucuggaagaaagaaaccacacaugaguauaugcauacccugugcuagcaacaugccagcucugucauuggccaccaugugacuuuaagucauuucuggugaggcuggauucaucagcacaucucagucugagggaagugagagggagcggaugagaugaaaggacuggacgaugcacacuggccuagccuggagcugagucacucacuacaucaacggagaucgggaauuacagaagauuuuaguuuuagcuucucaucugacuaagacuuaaaagauuuacagaaaacagauuguggggucgggggacagaaguaugguaguguggagaggaaaguggagacgcggugaacacauccaguagaacucaucaaauaaaaacacugccucccgcucacagaacacagagaccaggagaggcacaugcgcagggcaaguguggcccagcaggucauucuugaaugaauucuccuaggcagggcaaagauugugcuuuauauuuauaaacuuauuacaauguaacagcuuuuaaaauguucuuuugccccguuuccaggugacuuccuuuugggugaagaaaacagaagugguacacgugucccgugauggcagagcagcaucugauccaggcgaggcaaggagcgaggcaaacuuacacaguaagugacagucuauacuucuuggucuucucccuugaccagcccgaguccuuucagagguagcauuuacuuuuucuggaagaagccaguaauggacacuugucuguuggcuuugcccagagcagcagccccuuucuuggggcccuuccguucuucucugggcucccuuuucacagcggcagcaggggguuugugugcugaggccggcuucaucuuaagcuccuccucacugucugugcaggacucacucucauagacuuucucagucacuggaauaggaaaaaaggagaacacggguggcuugagucaucuaccaaacgguaaguugugcugcgucuuucuuacuggaaaagcacaucuagacucagccagaaaauaucauacagucacauggccucuagguggggcuggaaacccccacuccuccagugucccaugucauuagaugggccuuuaucaucuaauugcccacaucuguuucuuggguccuagucuauaucagcuaacuuccagagcccugcauaugaacuguaucgaaaacaccuaccucuaaacuccacacugucuggcuuccugaguccgugacccauacauacacuuacucauuucuaauucugccgaagcacucucccaccaugcacacuuguaacucacucuacccugauaccaaccacugcuccaauccaaagccauaauuugcuauucaacugcucaguuuuugaaagccaaugacuacagugaacccaacauuuacuacagccuacaucaugaugaaaacuggcccaaacaaaccauucuagaugauacauuugaaaguuuuaguggacagacaaugauaaaauaagaagcaauguuaccagcuuucuuauuccccaggagccgucggcuuuuccugucucugaaaugggcuugcagagaugcugccugccaagagcauuucuuacuccugcagaggaccugagcucagccccagaacacacaucaaguccacaacugccugaaauaccaacuccagggggggucaaauguccucuugugauccaucuccuugagcaccaggcacacaugugauacacacacauguaugaaauauacacauaaaaaacuaaaacuccccaaacucuucuaaaaggaaaccuggaaaagaacuaugcuagaggccacucagccccagcaugcgcaggcagaagcguggcuccaaucauguucucucaggucagacggagagacuugccacgccccagcaucacacacagagcuaccucacugagaugagaacuaaagcagcagcacccagucuuucccagccauucugggugcagcacauaaugcagcaacagugaagggaaacaucucuucacuaaaacaguagccucauaugcauaaaagugcucaaagcauuaaagcccaaggugaaauuuccccaucaaagaacagauauuuucacacccuuauucauugauaauuccuucuaauuaaaauguacugauuaaaccguuccaaaggcccaggcccagggauucagcucucuguguucuaaugccuaggcugucccaaugugaacauguacugggucagcuggggaccucgugggaacacugcuggauucuagcuccaaguuccacacucagcagcaggucugugguggaaccugagaacuuguuuuuaaacacauucccagacacaaacauugguggucugggugacacuugaugaaccaauguccuccucuccauuaaaauggggagcacacccacucucagcagauauggaugcacuuggcagucuuuggcaaacaaagacuucccaguguucucucuucacaguacacccugcuggagguuaaguggcuacugccucugcagcacagccuucaccuacauccaccuaacacaacagggcugcaaaccaccaaguauccccccauggaggucuugggauuggucuucacuuucaagaacugagaacccauguugaugucacaagcuuuaaaauguaacucagucuggaggacccggacucucuggugaucuaauuagaaacgcagcaucucagucaggugagaggcaagcaccugacauauguauacuuggagacuggucagagagcccugaugagaccagcccaaguuguauggugagaacaugccuacaaaggaagagaggaaaagaaaaagacaagaaaaauacagaauuccaauuuuagcaagacuuucaggugcuucacagauuagagaaaucugucaacccuuuuucaaagauacuugagacauucccacugaauaucuacaguccagcaagcaugaccccaggacccacuccaucccaacaagcacuauguuacaugcaucacacaacucaauucaugggaaaaaacucugagcuguuauuauugaugucaggaagcucugaagagcuguuuagagaaaggaaaugucuucggaguugguaguaacccuguuacuucacaagcuaucuucucuagucaaauggcggcaugucuaagcuaccguaugucagcacugauuaccuuguaauuguauuacuucuuggugaaaccacuggcugucuccuggcugacuucaugugguacauugcucggaaaguuaaaacccagccaggccauaccaaccaaaagucucaagcagcacacuuagugaaucuaaauuaaaagggguguuccaauagccacagcuuagcuacuccaaacuacaggacaaaggagauuugaacuucaaagcacagucucucuauguuccuuggcugccauucuaaaaagccugcuguguggacagcauuccauucaguuucuuugcucuuacaaaccccuuccuugaucagaaacucagcccagccucauucagggcccaacaccauaauccccgcguccccacuauaaacccccaggaaaacaaaaucuagcaauggaaggaagggugagccccguguggguccagcugcgcagucgaagcagagugaagggagcacacacagucuuugcuggugccagagccaagggucauuagguugcacuuggacuaaaaaccuuacagaaaggcgcucugugagcaguucccagcgcugccuucaagccuguuagcagucuuguguggagaaaggcugaaaaagaagcccauguuccaugccugcucagaacaaagcaguaaguaauuuagccacagaguccugguaaacccuuauaacgauacccuugacuuucuucuuguagaguaaggaugaggaaaaaaaaaaaaaaucacugaugcuuuugccuuuuaaauucaauuuaaaaaauauaucacaccucaaauagcuaaacauucuaaacauucuaauuauauaaaauacuaaaaaaaaaaaagcccauaaacacauccagaaguugagaaugcagauuuugaggagaggugcugcagagagaggagcagcagcacaugcagacaugcagagagaacgacgggcaggcacagugacaagccugccagaagaacaggagaugggagaacagcacugggugugcagccaacacaaugucccaugagcguuagugagcgcccugucagggaaagcugguccuucagagccaagcaauccuuuaaagauagaaauuuaaacaagaaaaggaaaaucaaaaaagacagugcaaccuggugguuuggcggugguacacaccuuuaauagcaacacuugggaggcagaggaagacagaucucugaguucgaggccacccuugucuacggaaugaguuccaagacagcuagggcuacaugagaaaccuugucucaaaaaccaaacugaaacaacaaagagauagggcguuagaaucuucucuaggagauccaccucgugcugggugccguaagaaaggagaaagaauuaccccugcuccagagcagaggguuacaaaccuaagccccuaacugcuuccagacaggagagcaugguguuagaaucugagcgugccaacaggcuucaccgaagaccacugcaugguggagagagccugagcgggcacaaggaggaacacacagaaagcagggaggucagaucauauucuccgaagaugaaugagacuggacucgccagggucuaaucaucugcaggaagcuuccuuuccauuacagaaauguuuaacacagucaguauuuaaaagaaugguuuucaguguuugagacagugcugcuagcucaucugaaucuuuacaaaggccccaccggaggcaaauagauauuucucuuccauuccacagaccaaaaaaaucuccagcagagaugccacacacucagagcuuuauuucacagaguagggccuacacaaaagcccaguguucugacuccgcugcaguguucuuuguauucuauaagugugggccacggaccacaagcaacagcuugcauaggcuaaauccagagcauucacaucugggacagacugcucugcaggggauucuggugccucugauugagacaucugucuuaccuaugcagccuucuucauccacaaagguuuuagauuucaguacacgcuuucgucuccuuuugguuucuccacuugaacgcuaaaagguccgagaauaacaauauuaaguugaucagugaagcuauagagaaaaauaacaaaagacuuuaugucucucaaaaccacuuccuaacaugccauuaugauaaaagguagagaaaggaacucuacacagcccugcugcacugccauaaugcuuucuguaugcauugccaucuucccaauuacagaaagaaaagcagaaugcuucagaaagaucuguguucuuggcuaacaggcaaauagguuaaggacuuuaguggaagagacagacaaggacagcauacacugcaugcaguagacuguguaaggaacgcuugggcagagguguucuuagggcucugaguaugugcccaugaagaaaacacuugccauacucagccuuggcauacccagcuaugugggaagccacaugugccguugcugaguggcacugacuacugcuggccaccacgcauaagauuggaaaaacaaccaauguguacauaugcaguaaaguuuuuugcaaagacacugccuggcccaggcaugauaaugagguucuguaagguacugagaguauaaccaaucagaugugagacaugcaaaugagguaugauaaugagguucuguaagguacugagagagaguaaccaaucggaugugagacaugcaaaugagguaugauaaugaggcucugugagguacugagagagaguagccaaucagaugaggaacaugcaaaugaggcauagugcauaaccaauccaggugugagacacgccucuccuaggccuauaaaagcagcaccaguucugggcucggggucuuuucgccucuacaaucaagcucucccaauaaacgugugcagaaggccagucgagggugcgcaagacagcuaguuuagccagaagcacacaucaccacugucacuuuccuuuugucuccacuaucucuuucaucccauuucuuuggcuaagauauaaaagcaugagauuuacagaagucuuaacaguguggauuaagaaaacuacuacugguuacaaagaaaaggaggcuuguuagcagucucuuaacauuucacauccauacuaacagacauggauaagucacagcuaaagagcauucaaaacugcacgucacuguuguggguuuucucaucccugaagaacaaauuugaaucuuucauaauuugcccuggugcaggcagggccuccuuuugcaugauuccaacugcagcuguguagcacagcacccauaugguaauggucacaaaaacccaaccagcugcccagagcuaccugugagcuaccucugcagccuuccuaaggcuaugcccuacgcaacggcuugcuccccucaggugagaagagagcacguccaucuggccaagcugaggacaccaugagauagaggcagcuacaaguaccggugaagcacagagaaaguaagugacacacgauucaacauggugacuguagguuccugagagagaagagacacacaggauggagcacucugguggguuuaccuugacaggagggggcucaguuuuuggcauaggaucaggagguggagauacaggagguggagauggugagucugcuucauacaucucaggggagucuucgaagacugggaaaaugaaacagguuuaaugaagacaacaagcucuaacuggcacgcugucuucuccacuccaucugucuuaauacuugcgguuaucaaaggguauuuuauaaccaguaauucaugguaaccaagaacuuaacuuuaagaaacacaauaauuaagccgggcgaugguggugcaugacuuuaaucccagcacuugggaggcagaggcaggcagauuucugaguuugaugccagccuggucuacagagugaguuccaggacagccaggacuacaaaaaaacccaacccccccccccaaaaaaaaagaaacacauuaauuuuacauaauuacaauugaggaauaaagaauuucuaaaggugacaauacuuuagagaugaucuuggccaaguguuuuauuacaacaagaucagagcaugaagucgguugaaagauaccgaucccuuaccacauggcaggaguuucacagcuaagagacaggucuuacuccauaauauaguugaauaaacagagguuucaggaagauuccuucaccuggcaaaggcucaggacucauaacaagauuuaaacccaucagugugacuccacagccuuccuaacacaaccauccauguucuuaucacucacgaccagaaggcaguggagacagcuugcucuacuaaaugcacgaagcagcgucuuugcugcugugaucggaggaugacuuaccccuagacugucuuugaaagcugaucgccaugaaagaucugauuaguaguuucuaugggaauauuucuagugacuucacugauaagccuugcuuuguuacacagagcaugggcaggagaaaaguuaggagagaaagaauucgguagaaaugguauccacaauggcacaccaugggaagaaaucccaguguuucucaauaaggaaacagaggucugggagaagaccaucagaguggaggggaggagcugcagcagacacugcuuguccagagcugagguccugacccgggccuugcaguuacuaggugaguacucuacacugagcuauguccuuaacccugaccugcugcugaaucaccacaaagaaauugcugguugugggcuguggcagcugcuuaguuucaccuguucccugaagcuccaggcuacauucaaauuccuugcacaaaucuugaaacugaauuucuccuaacugauuaagucaguguuagaaauuaugauaguggaggguucgugaccaaaugaccuaaagaggugaagcagccuaggagccagaauaaaacaauaaaugagacacuucacauaaaaugggucccuaacuuuacaagcucagcagagcaagagacagaaaggaaaggaaagcagggagugccagucuagcugugaagccagcuucaugaagccagugcacgaugggagccuaagcaagaggcaugucauacaccaggaccaagaacucaagguucugaaguaauggcuaacuagacaacugaaccucuggucggaggaaagucuaggcagcaaggaaggcaaagaaaaggaguuuugagugcuuagugacaaagcagggugcuuuuguucaguacuuucacucaguuccucaaccacaugaccuagaaaaggaaacaauuccgauggcuccccuugggccccuacuagcacugcauguaacuguuuacuuauggcucaccucaaagaggcagggaugccauagcuguccuggcacuaaugcagagcagcaguaacugcguuugcuuuaaaucaagaagaauaagcacuuccugaauauaauuggggugaggaauauucaggucaagggaagacugcagacacugccuccuuuccacuugcccccucccaaagaaucauaaaauaauaaaaugucaaaaucccauggaagagaagagaacagagauauaaaagagauuucaacacaucuggagagauggaaggcagauggaagaacgcugacaacuaaagucaguucagugauucagaugguagggauuaucauuauaaacuguuuuaucugacuuuaaaaauuguguauauguagacuguguuuaaacuuaaauauuuuaaggaaggauaaacaaccaacauuuucuacuuuauaaacauuaaccacucauucucguaauaacuccacaaaucauuauuugucucguauaacugagguccaaagacauuuuuuuaaaaacuugcccauauucagucuuuaccauuaagccaagccuucugacuuaacacacuuuuacugacguaaauauaacacaugcuuucagaguguaucugaaauagauuuguagucaaugaugagaaacauucacguggcaaagcaucagcucaggaaagcagcuuguuggaaaacuagcuucagcuaaccagcaauguaaccaaccacuuguuugucaagaguccucuggcagagacuagaaauuccaguuccuggaaagcaaucaccgcuuccuaggacucaauacauauuuuuacaauaccuaucauuaccuaaaaaaacaauauucaugugucaugugcauaauauucuccacaaacaaccuucaaggacugaaacauuagcaaguaccuaacacagcuauaaaaacuauuucuucuuagcaacacagagacuagugguauuucuuucugggccuggcauacuucuuuuaaauauguagaacuacuaaaggugcuuaugaccuuccagggugaaggagaggcuuuguggaggugugaaaagcuacucagugccaagcacuguccuaacguuucugaugaacguguugucuucacgugcacagagcuggaguuugcagugacaggguaacuuuggaggagugaacaggaaaugaagucucugcucacaucagaaaacacagcaagcagugcgggaagacuuaagcccaggacucuggagcuccagccaucacugcaggccuguggcgcaucugcuaauaccuagccugagauggcagaccaagcuauuauaaucaguggaacacaaauaaaaaguuagagaucguauaaagguucaaaacaaaaccccgauggcuuuucagacagaaguuuuagaauaaaaugauuuagucagaugccaaacugaucucuggcagaggaaagaaccuagggccucggcucugucuucugcugucaggcgcugcucaccgacaucccacuucuuuacgcucuuuccccacuaauagccuguggguauuauuauuuugugggcuacaaucaaccacaggaacucaauuccgagcuggcacuuuccauaacacuagacuaugcagucuuucuacuaguucugugaguggaagaaguguauacacauguucacgagugugcagguguacauguaauucuacaacaugcacacaaacaaccaaaggaacaccagccuuaaagagaaaaaaaagcucuuaguaugugcaacagaauucacacuuuguuucauacauuuucacaaguuaccaaaugaucacuauucugaucaaaagacugaaguagauuucaaugaaaaauguucuuucauugcuacaacuacuguaauccacaguaagugacauuuuagguccuugugcaugaaccaaaaaaugaucccccuaacaaaaauucuuagcaaugcuuaccuucaucuucacugcuaucagacugaggaagcuugauucuucuucucuuuuucuucagguguucgguuuccuuugccuccucauccgacaagucuacucgcuugccccugcugcuguccggaauauguuaagcccauuacacagaucacauguuuaaguaugugcaugcuccuaugcagcuucuuuuagagcucacagucuuaacuccagaggguagagauuuaacuccuuuuuguuuguuugacacacaguugcuuuuugucuuuuuguuuuuuuucugacacaagcuuucuguguagcccuggcuggccuccaacucagaauucuaccugccucucucugccuugagcgcugagauuaaagggcugacacaggguucuauguagugcuggcuguccuggaacucaauauauagaccaaacuagucucaaacgcacagaaaucuucugccucugccuccuaaaugguugaccaccacacccagugagaagauugguuuuuuggagauauaugcuguuauaacaacuauaggguggccagaauaaaagguauccccaguucuccauaggcuaguuuaucuagaguuuucuagaugcccacccccaaccccugcuaacuggccuuuuacucuuuuaacacacaaauaauaagcagcuaagcaaucauaaugcaaagaccaggaaagaaauacuguucucaagaagcucuggcaggcacaagucuauaauaucaacagaggauccuaagacuaaggccaaccugggccucacagugaaaccuugguacaaaaaaugaacaugcucuggccaacugcacuagcuauuauacaacaggauaacaucuaauggacaaauaacuuugugggacaggacuguuaaaagcuaaguagauauucaacagguaggaagggaagacaacuauccuaaagugaaagaacaacgugaacaaaggcacagacaaguccauaaagucauucuaaugauguaauaaaaaccuagacugucuugacauuauucagccucugucugcuuucuccauuacagcauucacuuaauaaauaauuaagggcuuauuguguguuucagacauauagacauguaaaccagggucuuuuuaucauugaguaccugucuuauuucauuuugaacaucuuuuuuuuuuccuacuuuagcuagggaaaaacuaaaacaaacccaacguaagccaaaagaaauaaacauauuagcagaaagcaaugaaauagaaaagaaagaaaaauuuaaaaaccuaaaguuguucugugaaagagagaagauuaauaagccuuuuacaaaagagggaaaauguacuuccaaguaagaauagagaauaaaggaaucuguagucuuaacuauauagucuauaaauacuccaaaaccaagacuacauuaugaacaacuuuaauaagcucaggcacuuggaggaaauaaauuccuuuaaaagcacaauuuauguaaaccaauccaaaaagaacuagaaaauuugaauaacacuauucaaagaagcuuucacacacaaaaauuaaaauucuuccuauaaagaaaauccaggcagauucacugguagauuuuaucauauuuaaauguauuagaaauuaucuuuacauagggucagagauggcucagcagaccaaggugcuuauugccaaaucuaaugaacuaaguucuaccccagggcccaauuuggugaaaauagaaacugacucccacaggugugcccucugugcaugguauguacacauaccacccccccacacacagacaauaaacauaaaaauauaaaauaaaauucacaaaguccuuuggaaauuggguaacuucucuuaauuuaugaaguuaacccaaguuugauacuaaagcuagccaauuaccaggaaagaaaacagaugauauaaaauauagacauuugaggauacagauauccucagaaauauagaaacaacccccuccuucuaaaguuauaucaacugaucuagcaguguguaaaauaaauaaacaugaccagggagcuaaucccaagaaugcaaggcugguuuaacauuuucaugucaaucacuauaauccaccaucuuagcagaaaaaguguacaagucaccucaauaaaagcaggaagagcauuuuaaauguaaaagcaaugaauaaaaccucagcaaaccuggaauaggacagcguccucagccggguaaagaacacccacugaaaccuacacuugacuggcuguuuaaugguggaauacugagugcaugccugguaaaagcgucuaacagucaggguuaugaucauggcuggggacauuuuaauccacauauaccauguguucccaggagguaggacccacuggacagagccuuaccccucugaaaugucacuacuuuguugcuccaacuuuaccacaaaaguuguuucuuugugggccuaucagugcugacaguguccuuuagaguuucuuucaacagacuaauuccuaccagcuaugagguagugucucaaacuccuggauccauuuuuaacagcuugugugcuuuuuauuuucuuuucuaauuacauuuuaccacuugaaaaauaaacucauugauauaaaaagaaaacaaagaacuucuucucuuaaccuggacuggaaacaguaacuucucacuggguaaugugaugugaaacacacaugcgcacgcauacacagaggcacacuuacacagugucuacacauuuaaacugaagucuggaggcaaaggcaaucaauuugcuccaaugaggacaaaauauagccuuggauccuaaaucacccuaaccagcugccccuugguccuaacucacuagaugagcugugggcuucugucuucauucuccuggaugguuacaucccuaaagcaguaaggaggauuuaaugccgagcugagaagugccuguugcagaaagcccaagcagaccaucucaccuccacaagaccuuccucccucccuccgucccgggacagcauuucccaccaccuuuucuccuucugcugcaccuucccaggcucggacuuucugcuggauuucuucugagcugggggagcugccagcuuugguucagugacagacacuggagguugcuccacuguuuuuucuuccuuuacugcuuguucugaauccaaauugacuuuaaguuuaucuacaaauaaaguauaacagaugauauauaacccaucauacaauauuaauccaucauucugugacaguccacuaugugccagguuaggagcaagggauaaaaaacagucccuguccuaaaggagagcacaguugauuaagaaaacaucugcaaucuucacuucugcuccccacuaaccucucauuauaucacagcucuaaaggacagcaaacaaaggccuaaacuaaaaauaccaaauucagcuuuggggcuuuacauuuuaaaaaauuauaucuacuucuuuaguguaguauguaugcugggugugugaacgccaugguacauguauaaagcuuagaggcuauguucucuuccaauaccaugcaaaucccaggaaucaaacuugggucaucaggcauggcagccccuaaauuaagauguuaauuucaaacagagcugcaaauggucaugguguucaagaauacagcuuaaaaauaggugacagcuaaauucgcagcaacuuuucuauucuauuucuuuucuauuccaccuuuaaaauauuacuuauuuuguuuguauggguauuuuauguuuauuaucugugcaccacaugcaugccuggugccuguggaggccagaagagcauuggauccccugggacugcaguuacagaugguugugagccaccaugugagugcugggaauugaacccaggacuuuagagaagcagccaguguuuuuaacuauugagcccuguauucucucuccaagcccuguauucuaccuuugaaugccuagaugcuccuaucucacuaccaccuucuaugauaaaccugaauuaauuuaaauccugcuucccucugggcaaguccaaaaaguauucuuccucuuuugagaacuggaacaauauucacaaaacuacuaucaggcacagacacugaguuacccaaggucucacugagaggaaaaauaagcucuggauaugagccucagucaguucaacuucuggucuggguccccacacuaagcugagacaacaaacacaccuaagcagccauguaggacaggaaggacccagccaacaaaaagaauacagcaaugcauaaucuagccucgugcauacccagugauagcuuuuuauaggcaaagccacaacauacaguuagaaagcuauauacagcaagugguucuucaaaaaacaguuuggguuaccuguuaugaaacugcuuaauccaucuccuauguggaaacccaccuaucucagucuuggcugauguaugugcagguuaguacaauaguugugaaaagcacaacuauucuuugauaguauagauaaugggucagaauguaagauauauucauauuuuugaggguuuguaugggaaaccuaaaugguagacuucacuagcccaguagugcuaucauugcuucaauuuucaauucugugauucuuaucugugaucuucaaacuuucccacuaaaacaucccaaauugacuaggaaaaugaauauuuugcaagcaacagaauuucauucuuuuaaaggcuaaguaaacuaucauugucugcaucuaucuaugggggaagauuuuuuuuguucuauuuucuguucuaucaccaauaguaacaagcacauaguaaguauucaauuaacguuuuguaauuugacuuauuuuuuuacuauuagcaaauauucacauaucuuacauauuuuaaaaacaacaagcaaaaaauucuuuacuuuggacuacagcaguucagcaguugcaagcauguucuaacuacccuugccaccauccacagcaggcagcucacaauggccuguaauuccagcuccagaggaucccacaucuucuucugguuuccaugguaaacugcacucauguaaacauauccccacagauauacacacauacaaauaaucaaaaacaguuuuaaauaauuaaaauuguucgcugaaucuuaagauuacaaacacaugacacaacgacaaaagcaucaacaguauggacuggauacaugucccaguaccaggcaugcaggcuaaugacagugugacguguucacagcagcagcaaccuccuaugcaccguuccggcacugauaucaaagcaugcuucuggauaccguccgaguaccucacuuucuacucucacaauggaaaacauuccgaaagccuccacagcaaauaaaaccccaucaccccaguccuccucauguacugacugaucaccauggcagagcagaacucacaugaauuuugcuuggauaggcaacagugugguaagugcccuaugguuccuacauucuuccugguauucugccacauaccccccaggggaugaauacuugauaugagaaguauaaaaauaaugcagcuauuggcucuuucuauuaaggaagaauucuuauuuaaauaaaagaucuuuucucaaaaaaaaaaaaaaaaaagaugcauuuaaauggccuaaccauuacugccuauauucacauugacauguuauuuagugcugugaguaaccuuaaaaaccaacuuaagaaaggcaaaauauuuauuuuuguggucccuggagagacaguaggaguuaggcucacaccaagcccacugaugccaguauccacuguauuaaguguaacuccacacaggcagccacucucucauuuuaauuacccauuuucaaaagcuccaugagugauuauuuuauuuucuuucuaaggcaaaaaguaaaagcagaaauaauacaaacugcccuccaagagcucucaaguacacccagaaagucuccugagugguugguuucuucaucaauaugaugggcggcacacugugaauuuguuaggaagaaggaauuccuggauaggcaaaagcuagacuagcggucuccaccucagcaucuguguuaccuguaacguucaccugugaguucuaagacauaaagaaccugcuuacucauugcagcuuuuccaaaaaaguugcucaucacacucccuuuuccuggugcuuugcccccagcagaagaugccuaaaagcauaaaaaagaaaacacacagagaccaggcucuuagugcacagaaggggcucaauguggauuguuccucaucuucccguuuucccaacgcagaagcuugaaaacaaugacaggaaggagcagaagcaugagaacugcacuuucugaauuuuuaaagcauuaucuugguaucucucuuuucuuuuugagauagagccucaucaugcaaccucaucuuuuugaaugcugggauaauaggcaugugccaucaaauccagauacaguuguuucagucaguuaaguuaguucacauuacuaggcaguaacaagcaaagagaaaugaaugaagaauaaggacaaggacaaaaagcacaaaccagagcaggaauguuaacucugcccagaaggaagaugcauacagcaaccccagcuacuaguucucaaaugucacaccgcugagauacaaguccucaaacuugcagguucucagggugauuuuuauguacauuauuucaauggcugucacaacaaucuuaguguacaagccagguaucaccauuuuauagaaggagaauccaaucuugugagaaguacuauggggaaaaaggacuaucagaggugacacuaaacaguaacuaaaauaugacucaaacuacauaaggcacagugacucaugcuucuucccagcacuagagaggcagagagggcggagccugaaugugaggucagccuagaccugauagcaagaccucaaauaaucauaaauguucaaacuaaaguagacaacucagaacugcucaugggccccguccacacacaggcuagcauggaagccaggaaggcuuccccagauccccguccugauacagaauagcagccuccuggaaggacaacuuacacugguuacuucucgggccucugguuugguuuccuuguugguguccuggguuuuaguagcagcuuuagagauuaacauucccauaauuccuuugggcugcugggaagccuguuuggaggcagguggaccauggccauugguagucagcucacuggcuugugccucacucgcugccugaagauuugacuguucauacuuucuggaagauggggauucugcaggagcucuggggacugcagcugcacacuguauggcacuaaaccuaaggacagaagugaguauaagauuaaugucauuaucaaaccuuauuuucaaacucugugccuucuagauaucuuuucacauuaauauaaaacuaagaaauuuaaaaacuacacugaucauagaaaaaaauguugcuauaaaacuccauuuggguaaagaacuaggcaguguggagaagaaacuuuggccugugguuugcacuuaccuagucaggaggcuaguccucaaucaaucacauucuagcacaucauacuccacacacuugcuuuuuuguuuggguuuuugcucuuuuuguuuugguuuuagacagggucucucuacauagccuuugcuguccuugaauucaauauauagaccaaucugccagccucugcccccagaguacugggauucaaggugugcaccuccaccggccagcaaccucacuuguuuuuauucaccucuuauucuccagcaaauaguaauaaucucaccauccauaggaaaccagaagguccucugaccaaguucaaggagcaguaacuaucaacagauucagagcuaacagccauacaucacuaaccaauuucuuggcaacuguccuagccagagugugccaugcuuuaaagggugaaguagggcuagccacuaguucccauaacucaugcuccuucguauccauuuguuucucacuucuaaaaauaccaacucaguccagggagcaaccgagcaaaggcuagugacgucuggggaacagucugcauagcguauuacugggaauaguccaccucuucgucugcaguaagugccaaugugccugcuucaccugucugugaugcaacagugcacgaugcggauggaaaccuacucagccuucucaggcgucaggcagaaggcagaguuccccagcuuuuccuaacuaagaaaacauuuuacuucccaguguuucgcuuauggggguaggugaaaguucccuggagggacucuucauucuuuguauuauaggaacucagcauucaguugggcagaaugacugguuugcagaucgggggagcuucuggcuucccuuucuucuuuaguguaucaccucaacuugaaaaagaaaugcagaaaccauguggagauaggagcuauuaaaaacuaacgaaaauaacugccuucucaaauggucacugacaguauuucguuucagaaauaacuuuugacuaaguagcuucagagcagcacagaucuuccacugagucacuauggccacucagaacacuucugguugaagagagcagacagaaaccauugacuuuuacccacugguccuccucucuggccuugaagcgcuuccagguacaauggaaaaggcaauguuuuauuuuacugucagcaucuaaaguuggcccuaagacaacucuuuauuugguaugcauuccacaccuuaggcugaggaccagcaaguagcaaccaggaagagaccagguuaggcuggagcuguccuaagaaaacugcucacccugaaaucucacucccuugcuuucacagcaguuucuaaaacacagcagaucucaggaggcucacaagucuuaggaacaaacacaaauguuuuuacuggagguaaacucuccuguuuuccucuccucuccuccuacuuuauguuucacccccucccccagauaagacaagaugguuagcugggcagugccaacacacaccuuuaaucccagcacuugggaggcagaggcaggcggauuucugaguucaaggccagccugguuuacagagugaguuccaggacagccagggcuacacagaaaaacccuaucucuaagcccccucccucaaagaugagauggucaaucucucaguugucaaugugaugagauuuagcaucuccugggagucucgccucuaggcacagcuguaagggaguaccugacuugguuagguaggaagcccugcccaccauggagagguggcaccuuuccuggaaggagacccugggcuauauaaaaggagacuguggguggaacaugcuuucacugcucccuggcuuuugacuaggauaugacaugacaagcugcuucaagaaccugcagccuugacuuccccaccucauggacuaugccacugaauuguaagccaaaauaaaaccuuucuccuuaaaguuuacuuuugucagcaacaggaagcuaaaccaugauuuggggucucaugcagcacaggcuagccucagauuccuacauaauugaggaugauguugaacuacgacucagcuugccucuaccucccaagugcuggggucaaaggaugcaccaucaugccuggcuaauucucaaauucuacagagauguucaguauuaguagaguugauugcaguguuuucuuuaugaaucacauuuuuacuugcccugguauuuuugugcacagaacugagccguucucaacuugugugucauaacccgcuuggggaucaaaugacccuuucacaggaguugccaaucagauauuuauauuaugauucuuccuuuucuuuuugguuuuucgagacaggguuucucuguguagcccuggcuguccuggaacucacucuguagcccaggcuggccucgaacucagaaauucuccugccucugccucccaagugcugggaucaaaggcgugcgacaccacacucggcucuauauuaugauucuuaacaguagcaaaauuacaguuaugaaguagcaaugaaauaauuuuaugguugggguugugagacccugacuuaaagcauuucucccugaaagguaaagccccugguuguuucccaagcuuguuuucucugaucucuaaaaauacagccagaaagaagcucuuuguucucuauagccagcaaaaagcuuuuuuuguuucaauaccuuacaaugagagaugcgauaauuguaaaaagaccuagccaggugcuccucccaacuccucccaauuccucacuuuuccuuuaaacucucccuacuguuaccagaguggaacuccccugcccugcgcagcacauucucgggacuugagcggaggcccagcuuugggggucuuacagggucaccacaaccugaggaaguguauuggcagcucagcguuaggaaggcugaggaccacugcuaaacucccaagcagcuuuuacucuuccuuguuuacuugcugaacauuaacagaagcuguuuuaucucagguuggauaugagucaucuugacaugccacaagauuuuaauacagauuauuuuuuuaaaaaauuaaauguuuuacauaaaauuagcaaaguauuuuuuucuugaaauuguucucuaaaacagggaacuuauaaauuauuuucuggcuauauacuauuuaauaaauauucaaaugcccauauuauucaaaauuuaaaauaaagagacaaaacaaaacaaaacccuaaccaacccaccauaaugcccauuauucauagagucaacauuaguuacugugugcuagguuaacugacaggaauccuaaucagaugguaaagaaaacacagauggcaauucucuaucaguuucuccagaucugucucuaucaguuaucccacccccucccugucuucaaccacuccucucugacuccuaccuaacaacccaauguaagucacccucuugcuguguggccugacuagucugguacuaaguaacaaauuggccuggaauucggucauccccugccucaguacaagucuugcaauuauuucugugguugggcuuuauuuugcagugcugaggcagaacucagggccuuaugaagcaagaccuaccacugagccacauccccucaacucuaaaguuauaugugugcgugucacucacucacacacacacacacacacacacacacacacaauuucaaaguuucaauuucuccuuagcuaugguccuacuugcccuccauuucagucucauuuucuggaaauauuuaucuacacugaccgucucacuucuuccugucucacucagcuggaucagucugacccguacacugaagcucucgaagaaggucaucaccauauucaauggcuagcuuccaucucuaucugaccugcuucucuuaaaacauccauuaguacuccuuucuugaaauuuugcccucagcuuauggaaccccauauauuuucauaauuuuccacuucacuggaugcuuccucuuagaccucuuuuucgguccauucacuaaaauaagagcaaccacaaagaguacuuacuauguguggaacacagcuguaagagugcuaugucucuuaguuuacucaauccucgauuacauguaagacugccucuacuuuaccauacauaaggaaguugaaucaccaagaggcuaaauauuuuauccaaagucagauggcugguaaaaaucguaaccuucaguuuuacuuucuguucuuccuucacuccacucucucuccucacagaucuaucugcugcccuggcccagcagcuuaccugaaccccaacuccucuguucaccuugagaauuaaccacugcaauaaauacccuuacuugagauuuuccgcaaaucuaaauauccaaaccccagccgcuuuucucaggaucaagccugagcuccugagagucugacuccgucuucucguuacuucccaccugucugucagccuaugcguuagccacaggcaaugacuacgcaauguccuguuucucucucggcucucuuuacucugacacuaccaucugacaauuucuacuggaccucugagucucaaccuagaugccuuagccuuuuggaaaagccaccucugcuccccucacuccacccauccagaaccugguaauaagugucagucuccagaacugucucaugccguuccucuugauagcacugaacugaacugccaucucuagugggccaccaaccucaggaacagguaguacucggccucaaaaguauguaacaacucaaugguacacaucagacauacaccaaacaaauucaaauuaucuuuuaauuaauuaauuugauauuauauguuaagaguguuuggccagcauguaugccuguaccccauaugcacacccaaggaggccagaagguauuagauccccuggaacuggggcuauagaugguuguaagccaccauguaggggacuaggaauugaaccuggguccccugcacaaucaaugagaauacuaaaauacugagucaccuuuccagcccauaaauuuaaauuauaauuaaaucaaagugguagauacccaagaauauuuuuaaagaacugacuugaacccucaguacaaucucacaaaguaggaauuaucacaacugauuuaaagaugaagaaaccaaagcuagaaaguacuaaguaauuuguccagagccacugggcuauuaaguagcaaaacaagacuaaaacccaugauuaucagugucuaaaacccacacauaucauagccugucacuguccaaugcccugaagaacacaaaagauuuacaagaucugaucuuggcuaugagcuuuggggacaaguuacuuuuggcuggaaggaaugggacgucaaacuuaagaacaauuuuuugaagggcaacauuuaaucuagcucuuaaagaauggguaagaguuagacaagcagagacuagagcaaagggauagaggggacacaacaaacaucucugguggugaugacaggauaaauauaugagaaauagauuuauggggaguccagugggguuucaauauggguuguggcugcuauuuuucaccuuaugauguacuaauaaaacuaggcaugugucuuacugcaagauaaaugggguuuuacuagacuuggcacucacucuuaagaggcagccacuguguaaacaccuuacaaaaucaauucguaaagaagcccacaagaacauuaaggagcuuacuugcugcaguucugcaaauugcuuuuaaggaugucauagucgguauugaacagaggcccacuguccuuuagcauagcuuucuggaugcuguacacauggaugcuggcagucacagcuaacuuggacuucacugcuacaagucaacaggaaaagcagucuguuaauacacaacuucauagcuuguggggacuuuaacaagaaacucuucugcaccaaaaucauuugcuaucuauggugguccaaaaccucuaacaggccaaacagcuacauagaaaguagaagaacaugaagcucugucugcaaugggacauguugguacugagucgcuucccaguccagcaccugugagggugugucucacccagggacagucagcaaacagugacugaugacuaaugaugauugugaagcuuuguguucagucaguuaaguacucucuaccugagaagacuuaucgccaccaagacuuacuuguauguuucaauuucagcuuacaaaaagcagcuacauaauaguauuacuaaugaacugagucuacagaacaaaauuaaaagaccauuaucauaggaguaaacuauggauucuacaaggaaagaacugugccuaaccuguucacuguccccacagccuagcacagaguugggaacauauuaaccaccacauauuaugcaguuucuuaacauuuccuuuuuaaccagagauuuuuaugugcauauauauauguacacauauauacauacauauauauauauauauauauauauacacacacacacacauuuucauauauauguaaauauacaauuuaaauauuuauugauaguaauaaagaauuuuauuuuaaaacaacccuuuuggcauauacaaaauaauaauuuuauuaucaaagaugaaaacaaauuuaacauacuacugaaacaaauguguguguuuauuuuucuacaaagcaaagaauugaaaucuuggcugaauauuugauccugcagaaugcagcacauaucaauguuguuugaguugaucaauauuuugcuuuuauaaccaucagugcuaacaacacuaccacuuugcagaaauacaaaguacaaaauagaggagguaaauuuaggccauuucagauuuguuagaaacccuguuguaauucaagcugaaauuuacuaaauauuuaaaaaaauaaaaaauaaaacaaggaacaacucagauagcauguuuuagaaucuaauauccuaacauaaauacaaucccaaacacacuaauuugauguuuacacacuaaggaacgaugguaggaaaauacuaauucuuuguuuuucauaauuaaaguaucauguuucuguaagagcacagaaguuugcauauacagugaauagacuacagcugagaacauccaccacggcaugagccgucccggugggucaggcuauccucacugguauugcauggcaggcaaagagcacugaccaugugcucagaacuaggcugcagugaggcuacaucauguaacaugccugagcacugccaugaaacccacguucugugggcucaucaucccacauacacugcuacauucacugucuaccacacuggguagcuagcuuagucuugguuguuaugaguucaguuugauaaucuuuuuugcagggucuagauucgguuuuucauccccacauaguaucacaauccacagcuuaaggagccaugucaucuggaacucaugacaauauuuuuauguaugucaugagucuugaaauccugucaaagauuuacuuuauauaugucagccuuaaaaaugugaaguuaggcaaauauaagaagacuaacgauucaaaaaccauuaguaaaaggaauauaagauugucugguuaaauagccaaauacacuuuauacagacuguacccaaccaaugccguaagaggcaaagcgaaaaguuuauucagcugcucaaauucuuaccuuccaguuuaucuucucucacuacugcaaccuuguggcacuguaaggaacaacaauucaucaguagugaaguuaaagaacucagaauuucagcuucuuugacucagcuaugaaauuagaaaagcacuggguaccugaaaauacacuacaguauagggcagucugacuaauuuuuaaaugguauauuuuacaucaucuugaaaagagauuaaggaaaaugagaggccagccucaguacuuuuaugaaacaaaauuaucucaaacaguuuaagagcaauuuuuaguaaaugauugaaugauaacugguauauaaucuauggaacuaaauaaaaguuagaucuggcuauucugcuauacucauagacugucaucaaagaggcuucauccagcaacugauggaaccagaugcagagacccaaguauuauacagaguucagggaguccugaacaagaggaggaaaaaggauuguaggagccagaggagucaaggacacuacaagaaaaccuggagaaucaacuaaccugcucucaaccuggacucauaggagcucacagagacugaccuugacaaucagggagccuucaugggacugcaugugugugugugugugcgugugcgugugcguguguguuauacuuguauaguuugguguuuaugggacaccuagcagagggagcacaggcuguuucuggagcuuuugccugcuuuuaggauccuuguccuacaggacugccucauccagccuuuauuauugcaacuauuguccaaccuaaucuuauugcaacuugauaugccauguuugguugauaucccugggaggccugcccuuuccugaaggaaagagaacugaguuuaaauagaucuuaaauugguaaauugccacaaugagugguuuaagcagacuauaugcuacaggaaaaaaaaaaaaaaacuugcaaaguaaaaaauuccugaaaaaaaauuucaguaauuguuaguaaaaauauucauuuuuuccucuaaaucuuauauuuggcuacagcaauaaguauuuaugucaauguuaagaacacaccaaaauccuuaauauaaaagagcaauuuaaaaaucaagcaagcuuuuuuugguugguugguugguuuuuaggagacagaaauucacauugcucaggcuggccucaaacucaaaaacuccugcuucagguucucaagugcugccaauuacagugugagccaccauguuuggcaacaauguaauuuguacuuguuuugguguuucaguccugauggucaaacccagaaccuuguccaugcuaggcaacugcucuaccacugagcuaucuccaauauaucaaaaaaugcuuuuuagaaauguagucauaaacuugaauuacaagaauucauggauucuuuuuguugguuccuuuucuaguuaaaaaaugaaguaaggcaacagcucaguugcuaaaauaauugccaugcaagcaugaggcucuaagcucgauucccaguguccauguaaaaagaugggcauggcaggaccaauuauaauuugaaugcugaggagacagacaggaggaucccggagaccacuggccagccagcuuaagccaaaucagcaagcuucagguuccaggcuugucucaaaaaacagaggagacaacucuugaggaguaaugcccaagaucauccucugacuuuaccaagugcuuguauacccuuagauauaugcauacaugcaugugugcgaacacacacacaccuguaccugcacacacuuacaugaucacagauacaaaccagacauucccaaaaaugucacaucacauucuacucaaaaaugccaagcuuaugaaaaaaaaaaaaaaaaaaggcacuaggaacuaaucauuaaaacacugcagauccauaguuuagccuuagaagcaguaauuaacugaugccuaaggaacuagucuagacuaccaagcaguucaguguggcuaaguguuccucugcuuggggcuacugaaaaagcacaggccucaacaguggccaugccaccuuacuguacaacagcagugcagaucagcacagagcuggcuacugcagcggacaccugucacggugaagggcccagucagcacagcaucacaaacccugcuucaugucagaauuuuauuguacauuuuugagaucaaucuugcccagacucgccugcaucaaccucccaagugcuagaguucuaaacauguacaaccacacuaggcuucaauaaaaguucuucacaguguggugguugacaccuuuaauccagcacuagagaggcagggggauugcugugaauacgaggucagucuagucuaccagccaagcuacaaaaugaaagcuguccuuaaaaaaaaaaaaaaaaaaucuucauagaucccagauuaaaauuugacucuucuguuaugucuggcaaaugaauaauaaauuaggugauuuuuuaaaaaucaucaacuaaaaaucacuacauaaaacagcugagaacuuguaauuauaagcccuaauuagcauaacaaaaacccacuaaccagugguucucaaauuguggacugaaaccccguggaggguugcauaucaaaaaucuugcacaucaggaauguauauuacaguagaaaauuaguuaugaaguagcaaugaaguaauuuuaugguuggggucacagcaacgugagcaacuguauuaaagggcugcaguguuagcaagguggagaaccacugcugacuaaacaccuaagagucucaacaguacaaaaacaaggaacgaaacacuggcuggagaacgcagggcucugaaucuaaaguucugcuuuuccucauaaagcucaccuaagagcuuuaaaucacacaugcuugggacucuuguuaaaaaacaacugccauuaguauuauggcaaauaaaguugagguuauaaacguaugauuuugaaggaaaaucaaaaggguaguaaaaaaggcaucuuaguagaccuccacgaggagcccugauccugggacugauggcaaugaaacagaggugucuucagacaggcucaaggaaagugaggacggagaagaccugcacaggaagccggugugcaagaacuaugaacgagcccuggauucaguccaaggcaacagagcuucuggugcuuaaggccugggaagagcucaguaauaccuguuccccaccgcgagggaaacaauggaagucaacaaaagagcaccagcgcugagacugggacugagacugcguugugguugagaugaaaaaagcaacaguacccugagcuggcgggcaugcagaggggcaagaacagaaaagaaugcaggagccuaaacaccugucuguaccagcagcuaagccucggccuuacaacaggccacuccaagugaccuaucaaaacgaguacucagguuacaaaucaccuaauuuuuuucccuccuuuuuuauuuaacauuggaaucugacuugaaauuugaagaugaaaauuaaguaccagugucuacaauacguauucaaaaggaaaaagagguucaaggaaaagccauucccuaaugucucauuuccuagguaacuaagagugacagucuccucaucacagacaagauauuacauaaccuuucuugucagauuuaguuuaaaauuucagaacacucacucucuuuaagagguacuuuaaaacuuccauaccauucacucuuccuucuuccuccuguuauuucuaauaauguuucuaucucaugaacaugaagucuuguuacaagagaacuuacagaauguccguucuguauaagacugccagacaccaaguagguaacaugcagcugagcucccgaauuuucuuuccguuuccuuucaacauauucauagagcauccugugccaaacaagacagaagugacucauuagcaugcagcuuccucaucgacuccggauucaugacuuggaagucauauauaugaaaucugacaguuucuucaacagcacaauuuuuuacuuacugaacagauuuuugaaaaaacaaugaaaaaacuuuagauggagcaugggacuggaaccaacuuaucugaguuggcuaagacacccaggaaguaacugagguaaaucuagaaauaugccaagagggacagaacccauagucaaacaguggcaauggccaaacugcagauacaaaagugagucaauuaucgagcuauggcauccagaauaaacuuuucuugguuuccuaucuucaggcauaaagcacaaguggcauuacuacaugaauaacucuuauaacccgaagucauacacugucugcaagccucuauucucaaauaucaauagucuauaugugcuuuccuagagauggaaaggauuugggguuuuuaguaauucuaugagaucauuauguuaaauacuucaagucaucauauacaucaugacaaauauauauucaccuguuacuacugaauuacauacagucagauguuucaugauguagaauauagcagaugcuuacaccagccaacaucuaaaauguucauuaaccacacacuaaaugcagaaguguugcuugcaguaaagucuuuauucacuuuuaucccaaccacccaaaauaccagaaguugaugccccucaauggaguuuaacaauaaaaagaugcacaucaucugucuuuauuucaagaaauauuuagcaagcuucuacaacauaucacacuucaguugagaacagccagaaacucagaaauucugauagcuagguauggugguacaggccuuuaauuauccuagaggaagaggcagguggauuucugugaguucaaguccagccuggucuacacaguaaguaccaggcuuacuccaguaagccuaagaaacccugucuucuccagacgcccucccucgcuuaccuuccacgauacccagccgaguccccugcuacaccugcuccauuuuuccugcaguuucugugcuuuccucuccuuagccaucuuacccuauuuuaguaugaccagucaccccaguuugccugacucagauagguuuccugggaaaugggauaugguuggucaccccgugguauccuccauugucuauuuuauucaacuccauggcuucgguuuuuuuucccugaugacaucaucauuuguucaaaccaccuuagccagaaauccaggagucauuaccuuucuccuuaugcaaugaguugccaagucucaucaguccucccucccaacuaacucuugacuggacucuaugcucuccaacacgcuauacuagacuauuucaaguccaagggucaccuguauucucuuuucaccaucauuaucugugaggcugucauagugaaguuuuaaaaugcaagucaguaaaaaaaaaaaaaaaaaaaaaaagucaauagauuaaaaaaacgaaucaaaacguuccugagugcccacuuguguucuaagcaguaaacaaaggagucacggcuccuacccaucuggaccagccauuucuuuccuagagcguaagcuuaaaauugguaggaacuugaaucacagccaucugucugccucccuuuaauccuagggagggagucugaggccagccuggcuuacauagggaauuccaggccaggcagggcuauauagguuccauccaucuaauuccuccuacuccaagucucucugacacggcuagccaagcagagcaccucugccucccgaguguuaacagcuuacgcccuaucaugcauucugacaucuacuacaccacacucuaucacagguuuuuaaggcugccuuuccauacaccaccaguuacguaaguacaaagcgugcacuauuugucaguuuuacggauucuuccgccuugcucucucacaucuuccccacuucagagaccacguuagaagggcagaugaggggguggacucuugacuguugaugcuaauuaggaccugcuaauagaaaaccaaaaaggcaaauaccaugucuaccaugcucucaagcgugucagccaacuagucuuuucuccacagcucuugaccuugccugggucagucagcaaaccacugucuucugcacagguuuccccaaauaaaccccagcuguucccauauuaguuucucuucucacuuguuuuuguuuuguuuucuuuuuaaucuauuucccuucuuacugagaaguuuacaacaaacuuuuuuaaaaaggaauuuauaccuacuuuaacacguuucuuauuuaguaaaggcaaguacuccauuucugacaauaauauaugugaaauauucuuuaaaaugagugaaaagccuugacaugcugcagaauguuuccuaugcacaugaugacuuacaaccuccccgagacccuuaacuuuccucuccuuuagcuccccuggaaccaaaccaauuuuaguccuccauaauauuuuuccaaucugaagaugucauguuuaagucaaugaggaaggaucuugucuguuaaauaauacuuuaaaaaaagaacuaaaaacaagaauuuguuuuguuuucucaagaaaagguuucucuguguagcccuggcuguccugacacucacucauuagaccaggcuggccucagaacccagagauccauuugccucugccuaccgagugcugggauuaacgacacuuagccacaccuuuuaauuuauacuuuauauuuucuaaacaugacugagccagcaucucccucccuagauacugcucuacauuuucucauuagagguggagcccaggaggcagugagucagugaggacuuuugagggacugccugagcgugaagcaagucagaaauaugaguggcuucuguuaugugccaggacagcuauuagggcccugaguagcugucuaagaaaucugacuacuccaagacaccaugcccaagcccuguaacacccuggucuauagccccagcuaaaguucagcugauaauuaguaacaacugccagauguacauaaagaugauuaaagacugggcugcaguggcugacacuucccagcuaagacugcagauaccauucagcuaacaugggucauucccacuaugcccuguccacacugcagaaucuaugagugauaaaaugguuauugcuugcauuaaaguuuuggccaauuuguuacacacccacaguagucagaagagugacaaacuucaacaaucaaaucuguucaaagaacgccaccaagaauaugcauagacaagcugcagaacagaagucaauaaaccucuggugguuuaagcugcccauuuugcaguacucuguuagaggaauuaagaaacuaauacaccauagaacaguguuuggccauaaaaacaaauuauguaccaauauauacuucagcuuggacaaaccuugaaacauuaauggaaaaaaaccaaauaaguaugaauauguguguguguguauagauauuuaauauucuauagacagaaaauuaauaguugucuaggaaacgugaggugaagacagagguuaaaaaaacagugacuguuaacaggcaugauuccuucuggagugaugaaacacuggaaaauggagguuguauuaagagaaaaagguaccucacaggcauuuuaauuugcauccgacucaucaguagugaugcuaaguauauaagggcuguuguauuucguguuuaauguguaugcauguuugacugcuuguccgucugugcagcccgugcaagcacugcuccugggccagaaggaggugaugguaacaacugcagcucaggugguuggagcugccauggagauguuggaaacugaaccugaguucucuggaggcgcagagaacccuuaacugcugaaccaccucuacuuauuuuuuaaaugguucaaaaacuucacuuauguaucuguuggguugcuucugauuuaccaaaugggaugauuucugaauuggcauuaaauaucuuuccugcuuugaaaaauuaaaacaaaacaaacaaacaaacaaauaaacccugccucuggugacagcugcacacuaaaaauauuaaauauacuuucaauggguaaauuguuuagugguucaauauaguucaaauauauuuuauaaaagaauuaacagugagaguuggcauagccccugccuaggcaaagggggagagcuggcccugguggcacaggcacaagagaggcugaacaacacagccacuauucaauugggcacacaggccagauggcauguuaaggcuagaacaaccaccuauagcucuaauccuucaaaugcaucuuuauuuuaaugucuauuaggugacuguaauagcagcugcuucauuccaaauucuaagagcuaucacugaaaugaauaaagcacaggcacgccuuuaaucccagcacugggaaggcagaggcaggcagaucucuaaguucaaggcuaaccuggucuacagaguucuaagcuaaucaggccuacauagugaggcccuguuuacaaauaaacaauaaauaaagcucuuaucuguguccauuccuagguuuaggccaaagcugaucuugggcaaucuuguuaaaagcaggucuaaaucuaaccucgagcuaacaguuucaguucuuaagagcuugaacaucacagcuaaaaucagucuccuaaaccuauaauguuaacucaaauaaagccaaaccagucagacguguacccuguugcuauggcucaaagaaagcuccuacuacaaauaaaaaucugauuucccagaagcaggacaaaccaaagaagggauuuaacccauacguguguccucaaaugauuaagugauuaaguaauuccuccuccucuuuggacaacauucugcaccuuuguagaucaauauucuaacauuaaaaguuguuggccgggcgugguggcacacaccuauaaucccagcacuugggaggcagaggcaggcaaacuucuugaguuugaggccagccuggucuaaagagugaguuccaggacagccagggcuacacagagaaacccugucucaaaaaacaaaagcaaaaacaaacaaaaaaguugucauuucucuuuuggccucaaauuagauccgaucuaacaaaagaaauaaaaagguguggcagaaugcaagaagggcggucucuagccgccccgagcacuugauuuacuuucacucaaacacucuccuaucuuuaucauacuuaauuagugcaugcuuguguacauacaugcaacagcucaagggugucgagcagaagaccaccucugagagucugucccuguccccuuuccaaguccccagaauugaauucaggucaucaggcucaagagcaagcaccuuugccuccuugagccgucucacuggcucuaguccucacaccguauacuaucaggcagcuaaugucaaacagcuguugacuaaaucgccauucgcuuccgucaacuccgaccgacauacuuaggaacagggaaccugagcugaggaacugcguccauuggauggggcuguguguguaucuguagggcauuuuucccauuaauuuauuuauucacuuuuauucacauuuauucuggauugcagcuccaccccuacacacagauuccccuccccuucuccucugaaaagggagaagccuccccacgccccccuauuaccccacuuuggcacguggagucacugaagggcuaggcacauccuaucccccuuaaggccagacaaggugcugcucaguuagggaaaugggaucuacaggcagucaacagauuuagggacacccccugcuccaguuguuggggguagggccuuuucucaauugcuaauugcuauaggagggcccagcccagcaugagcaguauccuaggcaaaugguucugaggugucuacggaagguaacugaacaagccagaagccaauaugcugcgcuccuucauggucuccacuucagcuccugccucuagguucuugccucggaagacaaauaaaccauuuccuucucacaugggcuuuagucaguguuuuaucacagcaacaggaacuauuaugaaaauaugggccaaaguuagggcuaacaaacacauguggaaacauaaagaucuaagacaacaaacauaugacucuaagccauaacugagacugguuagcccguuuaauaaacuggauagccuuguguugcugugauaaaggucaucacaaaagcagccugcggaggaaagaguuuauuggguguacagagggauaagaggccaccauggaaaguggggugucaggcaagaguagcugaguaggaagcugagagcucccaucuucaaaugcaagcacaagcaauaaaucagagaaaguaaccaugaaguggaggaaggccauaaacaaccaagccugccuccagcaccuccagugccuccagcaaggcugcaccugcuaaaccucccaggaaggugccaccaacuggggaccaagaggucaaauaucuagggggacucauucucauucaaaucacuacaaaauuggcugcaaacuaucacaacacauuugcauacgaguccacugaucuacgggaaaaacagggcuggggaaaaacucacugggucaaaggcccaccagcaagcaugaggaccggaggucggauccccagaacccaagcaagcaaagcuggguaaguagcauauuccuguauuuccagaucuccuguggggagagggaggcagagaccaaaguauccucagaagcuugcaggccaaccagugugcuguacacagcagagaauaacaagagacccccaccucaaaccggucagaaaggcaggaaugaaaccaagacgguccucugaccuugcccugugcccuguagccugugugcauacacauuuacauacaugaacacacacaguucaaaagacagacaaaaguagucaaaaggcagagaaaguaauauucuuuccuauugacccagguagaaagucaguucuaaccuaagaguuaguucuaugagaauuaaaacaaagugaacguuuucuuuaaggggcuggccacugggagucugaccaugucccaugacuauacaggcaacucagauuggacucauuuguguguguguuggaccuggaaggacugggaaaugagugugaguggggugcaugaugugaaaauuccaaauaaacaauaaaaagaugaugcugaaaauaauaaauaaaaacaaagugaaagaaaaauuccaauauuauuaaaauuagcagucaaaugaacuuacuguuuggccugguuaacaugaaccccuaguguauagcuuagccacuuguaagucaccugaaacaaaaaacaauuuuuaagguuuuauuagcugauuccagaguacagauaagugccaagagccuguuccuagggacucuuauucucggauggcuguguccuguaaacuacagcagauaccaacaagaaaaaaaccauaugacaaguaaggccaggguacuuaccuuacaaacacuaagaugcuucacagacugaucaaugcaaaagaaucuacaaaggugggucagagagaugggcaguggggaaaggcacuugcuaccacacccuuaagaaccuggguuuggccgggcggugguggcacacgccuuuaaucccagcauuuaggaggcugaggcaggaggauuucugaguucaaggccagccuggucuacagagugaguucccaggacagccaagguuauacagagaaaccaugucucgaaaaacaaacaaacaaaaagagccuggguuugauuuguuggauucguacgguggaaugagagaacugguccucugacauccauaauugugacauagcacaauuaugugugugugugugugugugcgcgcgcgcacgcgcaugacacuaaacauaauaagaaaagucuuaagagucuacaaagccaagccaaagauuauuuagcucaaacuccuugucuuacuuaaaagcucucugacccucuugucuuuaagaagcuaccuaaaacuauccuaaaauuuaucuaaaaccuagcauuacuugaaagcacauaacccaggaacuucucaguaaauuugcaacuauucaaauguuaagaggaacagguggugugggaaucaaaaaaaaaaaaaaagagagagagaaaaauggauaaauguaguaugggguaauuucaagaacuaggggcaucgagccuccauccuucccugacccgguaugucuguuguuucuuccaaagcuaaacgaugcacucccaauaagaggacuaauaaagauuggucagaggcagaguggcagacagaggcagaggggaaagagacagaccugggauucaagaauuuaucuauccagcccuaauggcccuugacgcguuuauacacgucauuugacccuuggcuaaaucccacuucuagggauaacacaaaagccuggaggacccgggaggugugagucgguguaccaaacuguguccaugggcucacagcagcaaagguccaucacacccaagucucuucauuuuuacgcuagcccgaggaggugggucaagcugcuuucaauauuuaaauuuccaggaagaggaaacugucucugguggguaaagcaccaggcagucgccuaugaaagucggccagucucaacugucuugaggggccaccacccgacagagcagggaaaggaagccucacgaaccccgcuggcuucccaggcuccacgcccccggaccucacaaucccgcccaaggccccggggcuugggcgcgcgccagaagcucugcccgcagggcgugucucccuacgcggguuucgcggugaccaguggccaccucagccgguccccgagaagccacaggcaccgggggucgcgaccccucgccgaccgggcaggcccagucccccgcacacccgccucgcacggccccgccuuccccacccccgugguccuagcuccucacgaucuuguucugguccgugacgaacucgucuauguuuucuagauacagcuguuccgccaugguggugcggcuucgagccccgcgcucaacccgccccagccguagcucccgccggcgggaaacagcuucgcucacucucgggucacaggucgucucccagggcaaccaaggcgccgcgcuacggcggcgggugagggcca

SEQ ID NO: 3960 - RNA, 45576 nt, Mus musculus
aacacucuuucaccaacaguucccggaaagcggugccaaaagaaggcgccaauuagagccccugcaaauggacuacaacacccaugaugcuuugcuucccuaccuuggccaaguuggaccagggcaccugcaucugcgcaagcgcaaauugauacacuauuugaggacuucauuguccagcaugcauugccuucaagaggucucuuccugcuaggguugucgaguucucugauaggagucugagagauccgcagacuccguuacccaguuuccuuugugcgaaggcuguugcgcacuuccgguggaagcgcugcggcgagggggcggggcuuacugagccagugggcgguaggcggcgcugccgguggcugguugcuguccaaaggcgacugggcgucguuagaggagagagcugugaccgguuguacugcacguaucgugggacggaccuugggccacuguugucgacgugcggccucccuuugaugucggcccuugaaaaaagcaugcaccucggccgccuaccuucucgcccuccucuacccggcagcgggggcagucagagcggagccaagaugcggaugggguacgugacuuguaccacucucccaggagaccaggcccaggccauuggagauuggugucugggcauucagagugccacgggaagggacgcugugaauuggaggaaaugcuggccuuggccuggagguguuuagauagaguagaagguagauuuggggacuaggugaggcgcuaagggaguaguccacuggaggacugauaacauuguuggagaaggggaauaaggacaagguugagaaaaugaaaggauaaucuaagggaugacgggaaucaacucuagaagugaugagucugggagaaagagugaaucagugagaugaggagaaaucuggcaucguugaggggaauagggaaugacugagagaaaaguugacggguuuggggaaucaaguaagugagccaggaguaagaagguuuuuaccugaggguuauagaaaacaucugaggcaaagacuagggaguagaagguucuagagaaaguuuccagaaguguaagagucaaguucagagaaugagggggugaaucagaaaacuuggagaauaggccuaaggaaagacagagaacauggcuaggggacuguuaucaagggagugagcccagaggcuagggaaauagggggggugugaugaggaagacagcugaguuuggaacagugaccacugauaucccagagacugagaaauaauuucgaguaggauuuguuaaauggaagcacuggagagguaaaaucugaaaaccaaagaagauuuugucaauuguuuuguuuugccaagcaaaugggaccugagggaaacuaucuauuggucuaagaauuagacuuagugaagcacugggaguaaccacuuaacaauaaaaugggaguaaaugguuugcuggaaagggaguagggcuugagugugugugugugcuuauguguguggguuagaaacauuuauuaauuuuugugguguugaggcuggaacccagaacuagauaaaugccacaucacugagcuacacucccaauauaaaagcugagcuaaugaaagaaacuuuagaaauuuagaucccugacaggcugugucauuuauaguuauaggaugcuugccugcuggagaaaucgugauaguugaacauccuaguaagagcugcuggaaggcagagagaacuggauagucauugggcuauuuggaggacuacugaugguaaagagaaaagagaccuauguuggauuugggauuggagagagaagcugguagauauauuucaagaauuuccacagacugaccaaaaggcaagaaaagauguaugcaguucugugaagacugaguauaggagaugagagagaguccugcuauuaaaaugauugguaaaaucugaauccaagagguuaugaucuauaauagaaaaaaauugacugaggaggcauaauagcagguaaaauggaaagcuuguuauaagauaaaauaaagauuggucucgaaaagacauaaagauugaacuuuuaacauaaagaaaauuuggaagcugaccuauaccauuauuuuggaaaauuagccugaaguauaaaaauaaauguaaugauucuucauguguuuuuuuuuuuaguuauuaauuuuuugggggaagggggggauauggucacacuuuauaagccaagccuaacccugaacucuugauccuccugccacaccucgcuuaggagcuguuuuuuuccuaauuacaguuggaucuuucaguacacuggcacucaccuguacagauauauuaaaugcuaguuuuaaaacuaacucuacauguuucagguaaguuuaagugaacuucagcuccucccuuuaucaaacuuaaguuuucugaaaaugauuaauugggagaaccauaccaagagcagaucuacucauuaaacaauuuuauaguugcugguucuuuauccuuuuuaaguaacugcuuugguuuuauugauuuaggucauugcuuguccuggaaaagauaaugcuuuaggaagaugcccuuucuuucuuuguuugauacagggccuugcuuauagcccagguuggccuggaauugguccuccuaccucacccaccuguguacugagauuacaggugugccucagucaccagacccuacagaaaaaugcuucucugugugauccucaagugucucauuuccuuuucugcuuccuuauuggugccuagccuuucuaagaagucucaugguaauaguaaaagagagucuuccuuuuagaaucauaaagcugaaagagaacuuacugucccauuuuuccacugugccuuguggcugaggaaccugagaguccuagaaaucuguauuuuugcucuguaugucaaaggcagaggaaauauuuuauuuuaguaaaugugaaaaccaagacuuaagcauuccugcuacuaagcgaggcauacuaaaagguuaguugguagggcuccagggaguacgacugggugucuagacagagacuagcauuugguuuaugggcaucacccuacuuacccuugaguuguguauauugucacucuaggauucuauuuucaguccugauuugacaaaucucauuucugucuguuucaaagcuuuuuuaaaaaaauuucuccuuuugcuggcuuuuuacuuaccauuuccuuccuaccuugguuugauggacacaggggucuuacuguacagcuguggcuggccuggaacuugcuauguagaccagacugaucuggauccuccugaauuugcuuccugagugcugggauuguaggcauucaccaccauacccaaacugauuuuuuuuuguuuuguucuuguguuuuguuuuuugggguuauuuuugcaacugugucucaggcuggcucuaggcaguccuuuuuuccugggcuucauaaugcugggguuagaaguguuuguccugcuuuuuugcuucaauuucacuaaauuuuauguauacuuguuuauuccaacuuuaugaauuccaaguuuaugaauuuucuugaguuuccaucauuugguuuuucaaauuguacuuaaaaauuccaauauauucauagauaauauaguaauacuuacgcuugcacugucacuacaacuuaauuaugagauuugguuuaauuuaccuacaguccuauaaaauauauauuccuccccauuuauugguaaggaaauuuuauaucagaucaaaagucacccaacugguaugugguagaacuagaauucaaucuagcuuuagcuuuugguuaucaucccuuuuuuaaguauacuggugcugcucuuggguaaggccugaaauccugguggcauaauucuuuaguagauguucuuaaaugacacaaacauaguugucugaaguuccuacagacgugaggcugcucucacuaaauugaacugggguccuugucugggaacccugcuaugcuugaggggaguaccacuuacaacccucugcuucagacugggaagugggagcacacacuugaaauccuagcacuuaggagauagaggcaggcagaccucugaguucgaggccagccuaguuuauaaagugagcuccagagcagccaaggcuaaauggagaaaccauguuuacaaacaaacaaacuggugcauagaaaucagcguguguguguguguguguguguguguguguguguguaugugugugugucuccaaugaauuaaacuaggguaagggaggauuaauuuguuucucccccaugugcaccuuuuuuuuuuuuuuuuuugagacagaaucauguaaacacuuaauuauccugucucugaccaggggguuauagucauguaccacaugcucagguaacauuuucuuuuaacaaauguccauugacuugccugauaccacagaaucauuggcagaaacagcauucaagcucaguacucuggauuuuuuaguucauugaucuucuugggucaaagagugugguguucagaauaacacagauaaagaacgagcccugugcaguguuugcugaaggguacagacugcugguaaaacaccaaaucccucugauucugauuuguguacuuuuaaaauuauaucaaaauaaauuauacauauauguacauacacacacaccuauauauauaauuuauuaggguuuuuuuuucuuuuuuuuuuuuucaggacaggcuuucucugaauaguccuggcuguccugaaacucacucuguagaccagacuucccuagagcugugguauauucauacuucauuucuuuccuuuuuuuuucaaauuuauuuuuuauuuauaugaguacacuguagcugucuucaaacacaccagaagagugcacuggauuccauuccagaugguugugauugcugggaauugaacucaggaccucuggaagagcagucaguacucuuaaccgcugagccaucucuccagcccaccucauuucuuucuaugacugaauuuauucuauuguguuaguauauacccccaacucugccaaagauuugagaggggggcagggaaggucucucagguuaugaaauaguuucuuuauaaaagaaacuauaaaaaauugauuuaguuuguggacauucacaguguauauauggaggucagaaaacagcuugcaggaguggguccuuuccucccaccaugugagucuggggaucaaacucagguugucagguuugauggcagcccauuuaccugcugauccacuuucugucccaagaacaagcuguuaauagagucauuaaaaagguuagaugccacacuuagauguuccaaauuagguguugacuacuaucucuagcauauauuaucaauauauuuugaagauugacuaagagaauguauagagaacuccagccauuucaaauucuaccagaaagacugauuuugcuuccagucaggucuuuuuaucuucugccguuagcaagccauguagcucugguuaguuauuucuuuccugccugagccuuagccaucauaguaucauagaaggaauguuuugacaccaaauaguauaaauccaauccucaguguuacaaaaaggagcuuuucugagccgucuuuauaauagaaauacuauuauuauuccagaauuuaaaaccuuguuagcuacauaauagaaccuacuuguuuccucccuagugcaaaauuugaguuagauaauuuguaaugcuuugauucaaauuauauauaguuuuuugaauuguagcauuuacuuugagugugcccuugucacuaguaauggucacuccaauucuaccacaacucccagccagccaucugguuguuuguuguuguuauuguuguuuucuuuuuaaaauacugcuaaugagggcaucuuuagaagcagcagugccuugauucaagugacuugcugcaauuaaacuucaguauuugccucuucuacaaaauuccuuguccagagaguuugugacaagugacuagggcagugccugugaaguuuauaagcauuaacaguaauacucuaauuagaucuuuaauucuauuaggccuacuuauauuuuuccuuaaaauauacaaaauauguuucuuuuuuucuugaucucucaggcuaacagcuuucuccuuccccuucugccaugguggauuguauauuuuucuucacuacuguaacuguguguguuacaucuacccuuguagacauaacacccaucugacauaagucaccauugcucuucccucaagagcuuccuuaggauaggguuucugccggauuucuuuguggugccuuuaaaaaauuaauuuugcccuuauuuauugaguuuguguguguguguguguguguguguguguguguguacaugugugggagggcggagcacaacucacaggaauccugacuccuccuuucuacccuguggguccuggguugaacucuggucaccaggcugaguggaaagcacuuuaucaccagcccucucugauuuuguuaagugcugaccauugacagagaccuauuuuuacccccauucuaaggaugcucuuauuuacccacuggugccuugaagaugacauaaccagagcuguauuucuuucuuaugaaaguuuguuaaacuuuauagaguaauucaauuuguacuuuauuucaucagaugauagguacaguaggacuuauaaauguauaagacuuaaaacuaggucaugcuuguuauuggucucuuuauugcaaggauccaguccugauuaucuuuuccucucuaagucuaaccugaaagcaagcccacucauagaguacuaucguauauuagcaguuauuucuacaguagcuucauuuuauagagucuuuuucuuuuuuuccuguucuugcccuguucaucucuuauucucuaucugaaaucuguuuuguaaggaggugccaccuacacacuggugacuuugccagguuuagggacuagaucaaacauuauacuuuuaaguagaagccccaaaagcucugcauaauuagucucaagcagugacauucaaauuucauuuauugguuguugaugaguauugcacuuaggcagcaaacaugccccuuauguucuucuccacugagcuacauggucagcccacugaaggcucucugcgugugccagcgcugcguuuacuuugcuugugcgccuucuucccucacuuuaaacagaccuacucucaggaggcucugaggccacucuagcccaugccuuucucucccccguaaccugacacccaaacaugcuuugucauuuccucuccuuaauucuugcaugucacuaguugguuuuuguuuuuguuuuuucauuauuauuaugucaaacuugggugggauaaauuaaugcgaacuccuagaguacaaagaguuuuguuucuuuuuuucuuucuguaguagcaaguuaaauaaauacuucuauaaauuugaguggugaauguauaacauucauuucaaaugaauccuaagguuuugccugagcagugcagccuuuccauucuguuccuguuuucugcugucuuuguggcaccugucguuuauaugcaggaccagcagcuuuucuaugaaggccucauagaaugucugcuacagccuuugaacucugcugucacagggugaaggaagccagucagugagcguacuuguaugccaauaguacuuuauuuggagccacugagguuugaaugucaugucuuuuuuuuuuuuuuucuuuuguuucuuuuaaacaucuauuugaauuggaauccaaagcaguuuccuaccuugaucgugugauuuuucaugucauuaaacagucuuuuccuauccuuuuagacauuacucucaacucaugggccauacagaaauagaaggauuggcauggacuugcccacagacauuuuucagcucuauuucaauacuauugguucaguacuacugucuuguagaagaaugaagauacguuuuugguuuuuuuuguuguuuuguuuuuuuuguuuguuugguuugguuugguuuuuugagauaggguuuuuuuguguagcccuggcuguccuggaacucacucuauagaccaggcuggcuuugaacucagaaaucugccugccucugccucccaagugcugggauuaaaggcaugugccaccacugcccagcuugaagauagguuuuaaaaagcaaaguaggauccccuucuuggcuucacuaauuagaguaacuugacuuuguuuucuuaaaauauguaaaacuaaucuuacuuaguuuuaaaggaaaaaaugggauucuauguaugcagacucauuguuuaagguauaacaaaauguaauacaaauuuacuuauuguauacuaaugauccuccugccucauccuccccagugcuggagucauaggugcguacaaggaucacaguuuuaaaucucauuucuauuaaguaagccuauggaccugcccuccuauuuaaauucagaguggacaguguuacacuguugggaaaaauggcauauuuucauuguuucugaguguuauuuguuccucuaucaaaugugaauuccaauaaccuaauuaaauugaugcaaguaaauaaaauccaaaggguguuuauacuuaaauaaguaaguaaauuaaucacuauuuuguuguuaggagaauaaagaaaauauuguguauauacaaagcaccaucagucaucagaugaacuguuaagaaaaaagaccuaucaauuaaauugugacauaauacuuuaucacuuagaguucauuuuaaauuuggauauaaaaacuucucauuauuuuauaugagcucuguuggugugaucauauuucacuuaugagugcaugcagaaagggaaaggggagcaaaauaaaaugcagugcuucugacacguuuucauauuuagucuucacucuugugaaucauucucaccaauauaguucucugugccucacaggaacauuggccaugguguguuucuuaaaacccaacagcagcccacauaccagcaucaugcuuauguaaaaccaucuuaccuuugacaucugcugcugacauccuuugacuguacaucuagcccuuaaaccauucacuucucgugacuagaagagcacuuuauaucagucuucaagaucuucucccaaccugucaacaccugucuugaaauuucugauucugguuuuguuguucacucuccaacaaguagucacaguuaaguuagaacuguuucuuggccaccugcauuguuaaaacauugauaccuuaaauaugaaaagaaaugugugagaacugauggaauaugguaaagaaguuucuguuggauuccuuuacaccauuuauagugacuccaccuguauaccaucucaguuccuccucagaauaguaucugaggcuagacuugucaagguuaugccaguaauguguuagguagugagcccacauagguaauucuaguucauuguaaauguucuauccuguccaauuuugguaaaagaaguuaguggcuauguugucaugcugagugaguaguggaacaaaguauaggcauuuccuccuaaauuaaaguggaguucuugauuaucaaagguauaaaaucacagcuuuucuugcugugcaacagcagucucuccuuuguacacuuuaagcaaagcauauuuuuauguugucugacucagcagguuaugugaaaugguuuucaguggaguacaguuugacuugcucugagccacauuauuugagcacuccugcuccauguccccuuauauaaaccuccguuauuuccucuuuggacuccacagugucugauaccuggauaauuuaauauuuucaccaccaacaaaaaaaauuaagacuaggauuuaggauuuucacauguacaguaucucaguauuuaucaugaauucuguuaaagugccuccuguguucucugucugggaguagcacuagagaaacuggggacucagaucuugaauuuuccuuucuugcuucaugccccaccuuggucccaucaucaucauuucaguuacaaaccucuacuccugccuguuguuacauuuccuucccuacagcugggccagcuuccccucacauuguccuaaggaucugggguuuagaauugccagcuuugaugguuucaaaaguaaagaaccuaauucuuuugaggacaaaguggagaacugauaagaaagugaccugagggcuccagcucaugugcucucugcaguucuagacaaggugucugacuucucuguauuguaguuuuguugcuuuuaaaacccagagagcuguugcagaaauuaauguguguuuaucuuuguaaucccuucaaccugccaaaaccucacucaauuguagugaaguaauuuagaaaaaaagaacaaaaucagaagucaggaaagcuaggaugccaacaagauucaggaagguagaaaacaaauggaagaauauuaagcuguuuagcagagaaaaacugaagacuauuuguaggcaaaugaaaguacaagcugaucuguauuguagcccuuauauaaagugaggacucagaggccccuaaggaaugugaauguucuuuucuuucuuuugccccaaccccaggaguuuuauacucuuagcucuuauauguaagccugcucuauuuuguguuaauuuuugugugugauauaaggaauggguucagcuugauucuuuugcaaauggauaacagauuauacuaacauuuuggaguguggggguccuuuuuccuaaugcauuauuuugacaucuuaaacaaacaaacaaacuucauuugaccauaaaaauagauuguuuuugaguuuucacauuuuaugucauugauguauucagugauguguaucugucugugagcuaccacaccauauuuugaguguuguagcuuuguaguaaguuuaaaucaggaagcuuccagccuuguacuuuauaaaaauuaucuggaguuuucuggaucccauccauuuccaugugaguuuuaggaccagcuggucuguuucuguugaggagugggcgauggucuucauagacauuccuuuaacucuguagauuaauuugcagucgucccucuuaauacuagaucuucauaucuguggauacaaguguuucuccuuuuaucugcuagagauaacaaacaaacaaagauagauuacauauagauuauauagauuuuuauguacaagcauuacauuucuuuaguuacauagucuaaguauuuguguauggauauaucugagguauguuugccuacauguucauguguguguguguuuagaagccacaagauaaugauaauguugagugucuucaaucauucaccaccuuuuuuuaaaaaaaggauuuauuacuuuaugugugcaaauguuuugcccuuauguauauaauguauguaauguauguauguauguaaacuauaugcuugccuggugccuaaaguggucagaagaaaguguuggacgcccaguagaguuagagacgguucuaagucacuauauaaaugcuaggaaucuaaucuggguccuucaccaagagaaacaauugcucuuaaaagcuguaccaucucuccagccuucuauguuauuuuugagauauggucucaaugaaucuggagcucacugcuuuggcaaggcuagcuugucaguaagcucuagacauccauccgucuccaccucagcacuaggauuacaaaugcacaccaucgugccuggcuuaaucuugggagcuggaucuauacgcauuuccucaugcuugcauggcaagcauuuuacuaccugaaccaucuucccaaucagccuaaguauuguuuaauuuuaauuuuuuaaagaauugaaaaaaugcugggcagugguggcgcacgccuuugaucccaguacuugggaggcagaggcaggaggauuucugaguuccaggccagccuggucuacagagugaguuccaggacagccagagaaacccugucucgaaaaaccaagaaacaaaacaaaacaaaaacaaagaauugaaaaaaauguauauuuacuauuguuauugaggguaggggcgugccauccugugcaucuggaggccagaggacaacuuuguggagucagauuuuuccuuccaccuuuccaugggguucuggaaauugaacuuuagucagauuuuugaaauaaguucuuuuacccacuaagacaucccaccuacaccacacacacacaccuccaacuccuaguauuguuaauagugguacuuugauagaguuguucuguuaauuuuacuuuuaguguuuuuuuuaaacuuuaacuauagaaauauaacucauguugguuuuuucuucugcaguguacuaaaguuuaucuuaacuuuuuuuagugaauuauuuaggguuuugccauaguguuaagugaguagaaaaguccucguuaauuuauuuguucuaaaaucguacaaagaguuuaggaaacagugccagguagaguaauaguguccauaauaaugaagaucuacaacucugaaaccugugacuguaucuuuuacauggcagaggaaaauuaguauugcuaauuaguugaccucaaaaaaacccaaaaaccaaaaaaaccuauccugaacuaucuagauaggccuucaguacucacagacaucuuuuaaagaggaggaaggcagaauggauuaaagcugggagagacuugaaccuuuugcauugcuugcuagcuuugaaaacagaggaaggaccuauaaauucuaggcagcugccagacaguggaagugauguuucacguccuggacaccagaaaaacucacugcuacuaauuuaauuauugcuuggaggccuuuucacuagacauaacuagcaguaauugagacaaaagggaucaugagccacucauaucucuacuuugaaauuaagauuuaagauuguuauuuugaaauuauauaauuaucucuucuuuugcagugauaaucuugaacauuaauccaauuaucuaauugcuuuaucuaaauauauguguauguaauguucaguguuacaaacuuaaaaccauuaaaaaucaccagcaauauuaacauauugucuagaauaucuuucuagguuuguuuuucuuaaaguaugccauaccagaaauuuaccauaaaauaauuauguuugaaguuauuuggaauauuuucuaaucuaccacuaauuugauccuuauuuuuagaggaggcauuugauuuuuauaaacuaauguuugcaaaacaaagauugaaugcaggguaugaugcugccuguuguccuagcacuugggagacugggaggagaauuacagagugagacacugucucaaaaaaaacauuaaaaauaaauaacaaaaauugaaaacuguaagcuacuuucauugauaaaauauacacgugaaaguucuaaacaauauugcaaaccuuauuucacaacccaagaucaugaucaaauugguaucauccugaguaugcaaaucagugaacagaauucuucacauaaauagaauuaaaaacaaaagucacaugaauaucucaacuguuacaaaacgggcuuucaguaaaguucaacaucccuucaugaugaaaaguucugaagaaacuaggaauagaaggaccauacuucaaccuaguagaggcuauuuauucagacugcuagucuguuuuacaacaaaguauuucuucuuaagucaggaacaggacaagguugucagcuuucucuacucuuauucuucuaaugcuucaauuccuaguggagcaaucagguaaggaaaaaaaaucagaagauacaaauagaaaagaagucagguuaucccuguuugcagacaauaugauuuguguauuugaagacuuaaccacaaagcucguagcucuuacaaucacuuucagcaaaguaguagagcacagagaucaguggaagcaguagguccucuaagauccauggucucacuagccccagguuguuggcuagguuccaguaucaaguaugacuucccuccaguugaacaggccuuaaauucaauuacagagcugcugguuaccaccaagauaaagaguaccaccauuguacccuuagagauaucuugccauucuggucauugcuguggcucaugugucacaaauggguacaacuaaugguugcuucccucucuuggaagauugcauggcaccuuauaguucugugugagcuaguccucaagggagacuuucaggccagauccagcucagagucuuaauguccaaaguguaugcauggugccuuucagcaacagggacuuaacucugucuucugagagacagccaaggacaacagcaauagcuuauacugcuuuggcagucucugggacuucccugaccaacaacucaaaaagagacuucagaucugggauuaguuuuuauuagauaaucuauggcucuuguagggaacauugucagcccaaaugggaaaacuucauucaaccuauauauguauuugacucauuauggccuuuuuagacauccuuacuguuauuuuauuacccccuccucauucucuccuuuucuuccuucaaaucauuucugucuugcuaucucuaguguguccucccauggcuucuuuuuacuucccugguuucuauugcuguucuauguggcauacccacaucugaagaguuagagcuaagagccucagaugagaaagaacauaccacauuucucuuucugaguguugguuaccucauucuauauauuuuuuaguuccauccacuuaccugcaaauuucauuauuuacauuauuucauuuuuucuuuauggcugaauaguauuccacuauguauauguauguacgugcacacacacacacacacacacacacacacacacacacauuuucaguauccauuugucaguuaaagggcaaagcuuccauuuccuagcuauuaugaauagaacagcaaugacgauguuugguccuuagcauaugccaaugauucauagcuggguuauacgguagauuuauuuuuaucuuuuuuaguguucuccauacugauuucuaaaauagcuuauagauguucaguaaccccagcaucugugggaagauuguucugugcuccccaccccgaauuaccauuauuccuguuugaaccagaucuuguugguuuguggacugaguugguccuacuccuuacuuguguacuauaggcuucauuacuagaguuguauaguguugcauuuucuuuuacuggaaaccuuacuagguucaaguaagggggauuguguuuauuagccuccaagccauuuaauaguaguaaugauggauauauacugagauaccaagcuaagugcuguauuuacauuggcucauuucguagugucaacagauguuaauuauugaugugucagguucuguuaauacauggggaauguucuugcucucaguguucucacaguagugccaaguuaggugaacuaaaauauagaacuaaaauauuuuuagaaaacauagagcaagcuagucugagaguaaugaguagugagagggcuacuuuaaucuucaugccagccuggauaaaauugacagugcagccccgucagacauggagaggcucgguuuguagaaauuaaauacuguguuuaaagucacacaaaaaacacagaauuggguuauaaaaauaaacuuauuagguagaaaauuacuggugguuuaacaacuauuuuuuaaaaauauauugccuugugauuuucuuuuucucuuuccucuagaaauaauuguuuggggucaaaguucagguguucuuaauucaguugcaaauggguuucuaagcggagcuguauuggaccugcaugugugguccagagugugugugcauaugcucgaaaaccgcaguguccacaacccuuguuagauucuaagccuggucugcgaucacagugaaggcuccgugaguuaggcagaagccagauuugcuuuguuccucucugccaaaggcagaguaggaaauagaaacuguauauccauuuuguugggcuuaaggugaauuucauuuugacauaaaaugauuuuguaugcacugaccuaucaaagugguucuuauuuuaaaguaagacuuaacucaccuuuagaauugauuccaauucugucugauauuccucauauuguuaacaccccugaguuuuguugauuaccuuuucaaaggucaauucuuucuucuuaaguccauugccaaucaagguuguuauaaaaguauuuucacugcugugcaaacaguucuucagaugcauuccugaaagcuccagacacugcuaucaugacugccuucugagaacacaggcuuuggcugauuaggaaaugaaaaggaacacgaaaaaguuugagauugaugugaaaaaauaauauugacuaaggauaauuacaauaagaguaaacuaaggacgggcagugguggcgcacgccuuuaaucccagcacuugggaggcagaggcagguggauuucuugaguucgaggccagccuggucuacaaagugagugccaggacagccaagccuacaccgagaaacccugucucgaaaaaccaaaaaaaaaaaaaaaagaguaaacuaauguguauagauaaucagaauuuauccauaaugaaaauacauuaauuacuucauuguauaaauuuuguuugguuugguuuuuugagauaagaucuugcuauauagcccuggcuguccuggaacuguacaccucugaacagcaggcuggccuugaacucagagauccaucugccuuuuccuccaaaguuuuggaauuaaaggcaugcacuaucaugccugucaauuguauaaaaucuuaauguuuacucuuaaaucucuuuggaccuauuuuaauacuguauauugugcuuugugaacucuuugugucuuuaugagaaagcacucuugcuauuuucauuucagauuuacaguuaucuauugaccaagauuuuaccuucuuuccuuccucuccuuagcccuggacggaagcgggacuuuaccccugucccauggagucaguacuuugagucaauggaagauguggaaguggagaaugaaacuggcaaggauauauccucucaaagaggcuucacagcauaaggacggggacuaagucagacguggggagcuccugaacauucuccuuguccccaccagucccuuacauggucuggaaugugaccuucaagccuuuggcagaaucuaucuuggcugcaguucucugacacaugggaaaggauugggauuaaauuccugaaaguaauacucugaguccaacaaagucaagugacuuaguuucuagaaaccaaguucugaguccucuucagggaaaaggaaauauuuauuuuucauugaaaagaaggcauauacugacaagcaggcuucaaaacaguguugauaucucagaaacaucuaaaguuucuuuggaagucugcaguuuucauauaaguuguuauaaccuguuugucuuuuuuaaaaaauaaguauuguuaugaugaaucaaaaccuuaaaucuauugucuuuaacuguucauacacuuuucgaguuuacaagagugguucugaggguccaguccugcugcugcuucauggaggaggccauuccgcccuuuccugggcaguguucacgguaaguuguugguaucagaagcugguguauuggugaucauuuuuuucuggguagacuugucuaguuaacucuuccuuccacguacagucacuguugggaagaagguuaagguagagcagguugcaaagcuuuagcuuuauguucucaaggucaacuguucuuuaagccggugggccuuguaacauuucguguauauauaugcacuagggugaagguauggaauuuguaucuugucaaaaguaggggucuuuaaucucaguaauuuaaacacuaggugaguagauauuucauuuuggauguuuuagauuaugucuaucucucucuuugucagacauacuaccuugcacaugauuauguuucagaaauauucagaagauauuucuauuuuuggauaguuuuauuauuuggcaauuucaaacaugaauacaaugcuggauuccuuucaacuauguauauauuuugggaagcuuauacaguaguagguuugcauaugguuuuucaaauggccuuuaguguuaguugucacauucucuccuuuacccuucuuucccaucccccccucccuauuuuaucuuccagcuuuuuucuuugucucucuccuuccuuggguguuccucugcuccccccccccccccaguccaugaguauuacuuaaccucugcaguuauguggauuguagcacauauauuggaaauucauauccacacauaaaagaaaauauacaauauuugucuuuugggcuaugguaaccuuacagugaccccccccccaguucuauccauuuaccugugaauuucuuuuacuuacucauucauuuguucauuaauucauugauuuuguugagguaggguuucucuguguagcacugacuauccuggaaaagaucugcuggccucggccgcccaaaugcuagaauuaaaaguguaugcuaccacugccuagcuaccugugaauuuuauaauuuaauuuuucuuaauagcugaauaauauuccauugugcauauauaccccaaugucauccauucaucuguugauggauaucuaaggugccuccaaguuuugacuauuaugaaugaauauagcagcaaugaacaugguugagcaagugucucugcaguagaguguagaguccuuuagacauaugcucaagagugcuauagcugaaucuugagguagguugauuuuuagcuucuugaaaaacugccacacuggcuacuacaggggcucuaccaguuugcacucucagcaucaaugagugaguguccccuucuccucauccucaucaauaugugcugucauuuacuuuauuauuguuuuguuuguuuuuucgagacaggguuucucgaaacccuuuuauagcuggcuguccuggagcuuguucuguagaucaggcugucauuuauuuuauugaucuugaucagucugacugguauaagguaaaaucucaaaguaguuuuaauuuauacuuccuaaugguuaaggauguugaacauuuuaaaaguguuucucagacauuuuugcucaucuuuuuagaacuuucugcauaguccgugucccauuuuuaaaugaguuacauuaagaaauguucagguuuuguuuuguuuuguuuuguuuuguuuuguuuuguuauagauguuaacucuguccgauguuaaggcucuuuuacccggucugugcugacacuuugucugcaugcugauggccuuugccucacagaggcuuuucagcuucaugaggucccacuuauuaacuguuggucuuggugccugugcuauugguguucuguucacaaagucucuuccugugccagugagugcaagccuacucuacacuuucuuuucuaugaaauucaggguguuauuuuaagcucuuugaucuauuuggaguugaguuuugugcagggugguagauauggaucuauuugcauccuucuacaugcuaacauccaguuagaccagcaacauuuguugccuuuccuccaguguauauuguaauaaauaaauaaauaguauauaaguaaaucagguguuuguagguauauuuacauaugucugguuuuuggcuugauuccacugcucagugugucucuaugccaauaccaugcuauuuuauuauuacagcucuauaaugcaacaggaagaucaugauuuugagauuuugauucucuuagcaaauaaaccagcaaguaagcuugucuccucuaaauacauaaagcuaccaugagucagucauuaggcuucccucaggauuuuuaucuuuuucuaaucauuuucuaagggauaucccucaaaaaauuaucagcagauuacguuuuagccuccuaauucuucacuauggagauuaaauguugacaugggaagcuuugugguaagggagaacucucaaaccacaucaagccauagugacauguguuaaguuccuuguuauacuaucuuuuuuaaaaagcauuuucuuuuuuuuuuaaagauuuauuuauuuguuuuauauauaugagugcacugucacuaucuucagacacaccagaagagggcaucugaucccauuacagaugguugugagccaccaugugguagcugggaauugaacucaggaccacuggaagagcagucagugcucuuaaccgcugagccaucucuccaguccauuauacuaucuuuuaaauucaguauauuaucuuuuaaauuuacagagcacaucuugccuuuuuagaggcaaagaucguaacuuauuuaugucugcuagaauaugcauacuuaagagauguuuuguucuuuuuuguuuguuuguuuguuuguuuguuuuguuuguuuguuuuuugagacaggguuucucuguauagcccuggcuguccuggaacucacuuuuguagaccaggcuggucuugaacucagaaaucugccugccucugccucccaagugcugggauuaaaggcgugcgccaccacgccaaggaagauguuuuguucuuaaauuacuaacaauacuggaaugguauguaaugcaacugcaccaagaugaucaggaaguuagguguugggacccuggagagcagacacagcuuucucauucuggaaugucuccauauaaugucugucauagagucaaugcuugguacuccuuucuugacuauguuugcaucauucccaaacaguugagcugggauuaaauguugauugcuauauucuauuuaagaaagcaggaaacagccaggcaaugguggcacaugccuuuaaucccaacacuugggaggcaguggcagguggauuucugaguuugaggccagccuggucuacagagggaguuccagaaccaccagggcuacacagagaaacccuaucucaaaagaaaaaaaaaaaaggcaagaaacagugucuuuuacuuuuuauuuuucuugaagcaaggucucacuaugcagcuuugacagaccuagaauucacuauguagaccaagcuagccccaaacucaaagaacuuugcaugccucuaccucccaagugcuaggauuaaaggccuaaaccaucaugccuauccccuaugucuuuauuaaaugagucauuuauaugugacuaguaaagaaguuacaucauaugguuagaaagcucccaauucuaggacacaaggccaguguacuuaaagggauagaggagaaggugagugccuugauuggggugucaugaaaucccugagcauagacugccuuguucaguauugugugccuccugcguccacuguucaggaaaauuauuucacagagaugugacuuauacugccuuguggauauauccugcuuauuuaaucaccaucaaucaugucauuacuuaugugucuccuguuguaaguuacuugggucuauuccugcuauuuacuauaguugcuguuuccauuuaacuguccccguauucagagauaugcucuaaaucuuggggaauucugaccuuuggagucaaggcaauugcuagaguacuggcuuucacauggccauuuuuauuuagaugcugagagucaauagcuuuuucucaaguuagauucuguaaauguacaauuuccuuguugaaugguaguauagaaaugaaucacagugacuacuaaugaaaguauuucuccacggguuugcucuccaucauagccuuuuaucuguucaugccuccuaguguuugggagcagugagccccagggaucaacuucaacaggaaaauaagcagcugcaucucccuagacauuugccuuguguaggauacccugcucagugucuagcuacauagucccauuuaauuuuucugugauucuuucagauuagacagggaaagauaucaaaauuuagagcaauaacguagcuguaacagcaacaaaauacaaacagaacacuuagucuagacaaaaacuuacuacguuagaggguaguacauguuuguaaggagaauuguuucucugagucuuaaauacuugucaggucagauaaugugccauauuuuuucagccuuuuucucaaggcugaaauuaucugagauaauuuauaggcuaucaaagugauccugauucccacacacacguaccuuaggucuugcuuuguagcucaggcugggcuugaacucuuaagucuuccugcuucaaccuucccacugguauaauugcaggcauguacuaccaugccuggcucugccuagcuuucuuccaaucuugucucuaauucucuuuaccauagacuaccuacagaguuccaaaacuuaauagagauaagcuuggccucuccuccagucacuuaaaucagaauuucuggugggcuuauaccgcacuccucaaagcuccuuagguacuuguguuaggcaggcaagguugaggacugcccuguuucuauuguuuauuggcucuuugguccuggugagacacuugacuccuuguaaauucaccucuccugaaaaugaugagaauuguuucugaagaguucugaggaguaaauuagauaaugcauugggaguacuuagaguggugaaugguacacuggaagauuugguaaauauuagcugccauugauaauaguguugauagcacaaauuccuaggaggaaacaguugggugagucugguucugaacuugcuguuuuucacuuacuucaaaaauaucaaaauugugcuguuggaagcaagaccagaaaagaagucacuggcagacacucucucgccccucaucuguaaggccugugguguucugucagguuacuuugcacucauuuacucuucucuuugguuuuaaccauacaggaauguaaacggcacgagugcaggguguucuccacugcugucacauuacucauuugugacaguuuuagaugucacugagaaagacguauuuaacuaaggaaacaaaaagcugcuuuuaauauucuuguuauucuuuucuggugggcacauaaugguuauaaaucauugacaauuacuaaccucagaucuaucuuucuuuguaguaacuuuuaaaaguguggaacaauuaagcagauuucacaaaauuuuguucuauaacuuuacauucaaaguguaaauuuguuuuuggccuagaagguugaacuaucaccauagugcaaucaauaacuucuguaaaugaacaaauuuguccccuuccagggacaagcagcacaauauaguagaauuugagacuuuuguuaccuuuaaagaaauguucacuaagaguaauaggaggaaaaauaucuggcuuauguuaucuugguaacuuaccaugaugcuaauucugguuuuacuacuaacuuguuacaugaacauacacaaaagaguccccuuuuucuuggucucaguuuucucauuauuaaaaugugagaguuagacuaaaccguuacuuuauucuuaaaguuaaaauauagagaugacauuugcuagcugugauauaucacugucagaaaaucuagcucccugaggaagaagaguuauuucagguuuccuuaaaccucuaaaauuguauccugugauauuuauacuuccuaucguacuauguaacaguagcacagcuugcauauacugcugugcauaucaguagauuucaugacuugcucugauuuuaggguaauuucaugacucaagugucauguugguguaauuccugagccaaaauaguacuuccaacuuauucacaauccuuaucuaggggauucuggcucuaaacuaaagaaaagccauccaggaaacauggaugaaaaccacaggccagcuucugggagugcuuauacuguaaggaaaggcuaggaagaaugacuuuaaggagggguuuggauaaaguuuauuuuuaaguuggagacugaccacaauauguguguguguguguguguguguguguguguguguguguguguguguguguguaagagagacucauuauucuuuuauuauacuuaaaagaaaaccuuugagauaaggcaaguuuucuuuucucuuggguaccuugaauuaugaucacaguucauuuacaacauuauugguaacugggcaaaaucuguaccgccuguuuucuucguuuccuuccaggcagcaaucaucaguagaguacaguguaggauuguggcucuggaucugcgaggucacggugaguacagcuccucccaguaccuuuaauaaucccaaacauuagcaguguuagcaaaaauuaaccuaguguacuccauuuggguauuuugggaggaaucauagcuuguagguagacuacuauaauuaccaucuucagaauagcuagccauaaagauaugucuggaauguacauccuagcuauccuuaaaguugcuauuuuauugcuccugguuuuaugauuccuaucacugaaauuuauuuauguauuuaucuaucuauuuuaggagaaacuaaagucaagaauucugaagaccugucagcagaaacaauggcaaaguaaggaagcaaacaaugauagauugccugagucuugacaccaucauaaauaguagugcaauuuuauuaugcugcuggugaaauuguuggacaguccuuaacacacagauuucauuucuguucucucuucucuuuuauccuuauuaauauccuucuugguuuauccagucuggugguuaucacacaaauugucuaguuugugcaggcuuuuggaaauuuuccuucuuugggugaaacuaaauggaauguggguauguaucuuuuauagucuucuguuuggagaaauauuugaauauaaguagccuugaaugcauauuaagguagccugcaugaauucauuagcuaguaucacaggaaagugaaggcaggcuauggaagaauagcugcuuagaaacugggccucuaagucaaguaguguauauuccauacuucucaauguguucacucaucagggucauauagcaaaaaaugcaagugcacuggacagaccccagaccugcugaaucaguauuuuuagcaguaaaaccuagacauauaauauacuuuaaaauauuuuuauuauuuauggguauagauaguuugccacauguuugccuggucccucaggaaccucuggaaaagcugcuaguguaguguuguuguuuuguuuuuguuuuucaagacagaguaucucuguguucccuggcuguucuggaacuugcacuguagaccaggcugucguccuugaauucagagauccaccugccucugccucccuagugcugggauuaaugacauaggccacaacugccuggcugcagccagugcucuuacccacugagcugucucuccaagcccuguuaugcauuuuagacccggucuaccuucauacauuuacaacuuucauaguaaaugucuaacucaguuaauauguauuuuaagauguguaauuuaaugucuuccagaacauuuuauuuaacucauuucauccuuaucaacuaaaauuuuacuagaauugagaauuuuucuggaaguuauacacugauauuuguucuaaacuuuaaucuauuuuuuuaaagauuugccccuaaauaauagaaucauaccccacauggcuuuagauuaauuaauugagccaauugucuauguguaaguacauauauaucuuuacauaggaaugaacauacaguuuuuuucugcucugucauauugauauauaguaauaugacuuggcuuuccuuucugaagcuguguaagucuccuauguuacuuguucuaaagacuucuccucaucuaagucaccuuuguucuugaacugugcugacuuuauggguccauagugcuggauuccaaggaaaggggcuuuaauuauccuuaaugugguagcagaaauuugcagcuuuuuuccuuguaauuuugguagaaauacaauguuauuuugguagacccaaugaauuuaauugcuggcuaauuuuacaguugauaaguaugucugagugagugucuuagagaauaguagaaaggacccuuucagacaagguuguggaagaaugacauuagaugacacaugugcaugacagguccuugccugacauugcugcaucacuacaguaguuuauuaggcucacaguuuagagccagauacuagucuuggauuauaguaugguaaaggagauagcugugagccagagagaacgcucuuuauaacagucacuccuucauuacucuauaaagcaguuuuauggcccagucacuuuuguaaguccuaccuuuuucuacuacucucuagaacaaaagccaacaagaauauagaccgaaguuaagcacaauguuuaacuuuuaucaaugauugcuuuuccaacagaaauacugcaaacuugcaaagaauuauacuuuacaauauaugaauuugaaaaaggcauuuguuaaucacagcuacacugaauaaguuuuaguuuuuuccuuugcacuaaguaacacuuugccuuucccaagguaucuugucuuuugaagcaacacugcuguaaaggaaacuuggauuuucuuucuuuuuucuuuuuuucuuuuuuuucuuuuucuuucuuuuuuuuuaacuuuugaauucucuuuucagcugagucuuuucauuugaauaguacuuuaccuuuuggauaacaguuuacauucacuucucacucauuucucaaagcagcuccuacagauuguccucugacuuccacaugugcgcacacacacacacacaaauguaaaacaaauaaguuauguuagaugacagaaaaaagcuccuagugaaguugauauagcucauacagaggcugaucguaugcugcuaccccaagccuuauugcauuauucauggaaaaacagaggcuuagaguaaauuauuucuccggaaugccaagcuuaaauuaacauacaguuguauauuuauaugauuguacuaaauuuguaggaugauaaaaggaugguacuaagaaagaucagaaauuugggguucuuaguccuuaacuggccauuuaucuggagaacuagguguguugcucucugcauagauacuagggaccgugcaugcaggcuuacauaggugucuuuguagaguggcccugugagucuuuaccauuucccacaacguuuaguuacaguccaacagaagaaacugagaaagcaagcuauuuuuggugucuuccuccagcacucucaguuuucucuuucuuugcagagauguuggcaaugugguggaagccauguauggagaccucccuccuccagucaugcugauugggcacagcauggguggcgccauugcagugcacacagccgcagcuaaccugguaccaagccucuugggccuuugcaugauugauguuguagaagguaaguuuucuuaguacugaucaaaccagauucagucauuuguaggagguccccugguaugguauuaccuuggccuuaauuuagucucaauuucauucaucuugaaguguaccccuaugucuuugugucuuuauacaaucagcuagagaaaguacccaagaugcugaaggggucugcaacccuauaggaggaacaacaauaugaacuaaucaguaccccuagagcgugugucucuagcugcauauguaucagaagauggccuagucggccaucauuggaaagagaggcccuuggucuugcaaacuuuauaugcccaguacaggggaacaccagggccaagaagugggaguggguggguuggggagcagggcagggggaggguauaggggacuuuugggauagcauuugaaauguaaaugaagaaaauaucuaauaaaagauuauacagucauuuuucauguuaccaaaaacuauucaagaauaccuuuuuauggcugaauaauacuucuaaucaugugcauguaugucucuuaguuuuccauuuaaaaagaaacugcuuuuaauuuucugacuuacccugagaaucucacugcugcuuguacagguuagcuauaucuauugaugugugccacacaaggagugaauaccaguagucaagaauugcugagacucauauuggaagcuggcuuguguuaauucuugcaauguuauuaaauugcaucuuuacuuuuacccaaguaucacugaauuuuccuguuaccaggagcaaagauauagaguugacucaauuugacaguuuugccccugugacaaaauaucugagauaagcaauuuaaaggaggaaagguuuuugguccacagugucagguuugggucuguggcuaguggguccauuucuuuuaggauguggagagucagcauuucauacagagggagggagacuguacucccagggcuugccccgaguuacugcuuccucuaaguagguccugccuccaaacagccugcucaguaugcacucaacaauagauacucuaucagugaaguuaguaucuucauuauuuaaccaccucucaauagugugaacagcuggugaccaagccauccacacgugaaccuuuuggggaggagucugcccguacaaguaauggcaucccgucauugugaaugugaagaguaacaugagcagcuuuguucacauggugauacaggcauaggcaagggugaguaggacuccaauagcacaggaaguaaucugaacaauuaaccacuggaaguccacgguggccuucagagcaggaaaggaucucugaaagcuagaucauaguggagaucaauauccaauauauaaauauauuaauauccagcauauaaaaacauauacuguauacauaaauacaguauguauaaauauauguguauacacacacacacauacauauauauauuuaauguauauguaaaauucaacaccagaaggugauaucauuuagucaaugaaugggcuaaaaaaaaaaguucucaaaagaagaaaaacaaauugcuaauaaagaauagaaaaacuauuucauauccuuaaucaucauggagaugcaaauuaaaacuguuuuugagauuucaagcaccuuagucaagauuccugucaucacuaaaacaaaugauugcuuggugguaaggauaugaggaaggagggacccuuacucguugcugacuggaauguagccacacuggaaaucaguauggagauuccucaaaaauuggaacuaccaaugacccaacucuaccuguuuugguagaaaucagaauaccagagacacacccauuguaaagcugcuauguucacaauagccagggaauggaacuagccuggauauccaguauagaugcauuagauaaaaugugauacauaugugcaaagaaaguuuaugcagccauaaagaaaaaaggaaaucaugacauuugcaggaaaacagaugaaacuguaaaucauuaugugucuuagagauuuauugcuaagaggagacaccacgaccaagcaacucuuuuuuuguuuguuuuucuguuuuuuuguuuuuuucaagacaggguuucucuguauagcccuggcuguccuggaacucacuuuguagaccaggcuggccucgaacucagaaaucugccugccucugccuccugagugcuggguuuaaaggcgugcgccaccacacccagcgaccaugcaacucuuauaaaggaaaacauuuaacuggggcuggcuuacagguucagagguucaguccauuaucaucaugguggaagcauggcagugugcaggcagagaugguacuggaggagcugagaggucuacaucucgaucugaagguagccaaggaggagacccucuacucucuucugugcugggcggggcuugagcauuaggagcccucaaagcccaccuccagagugacacacuuccuccaauaaggaggagccucagauacuugggaggcagagacaggaagauuucuguguuugaggccagccuggucuacagacugaguuccaggacagccagggcuacacagagaaacccugucuugaaaaaaaacaaaaaaaaaaaaaaaaaaaaaggaggaaccucagagaacucucccauguucucuuucauauguggaaaguaaauuuaaaauugugugugugugagagggagggagggagggagggagggagggagagggagcuauaaaagaucaucgugagaggaggacacuaucuuaagguggugagaggguaauggguuauauaugauaagagaucagaagaggggacuuaacugggggagaaggaaagccagcuggagcggggcgugaaaggaguagucagggaggggagugugagcacccagcaacaaaguauggcaggagugauggagccaggauuuguguacuaaccuaaaaagggaaaagaaauauuuaguacaauuuguaaagcaagaaaacgaaaaaguuuauugauauauuuaaaauuuuguuucagguaccgccauggaugcacuuaauagcaugcagaauuucuugcguggucgaccuaaaaccuucaagucuuuggagaaugcuauugaauggagguaacccacaaaccuaagacuuaauuuuaaauguuauauucuaaccugccccgccucucuuuucuuccucccucccucccuccuugccucccuccuucccauccucccucuauuuuuaagucagcucagguacuaagauaaacaggugagucucccuuucugugauaguauguaaggaaauaguucaaagcagaguauuuuuuaaauguuucauacuugccgcaguccucuguaaagugugccuaauauaccaucuccuaggacauuaguggucgcaggccaccugcuguccagcuggguuugcccugaaguugaggacuuagaccagguggucugcaaggccgccuccuccucugaagcuccaugguucuacauccacuuucuguguuugacauaaaaugauaaagaaauagcagauggaguuucuguucuggagugagcagggcaaguggagauuccucucucuagaauuauuuguguuuaugauaaaaaccuaauaguaaauaguuuauuauaaaaauugcugauagaauuacccauggcuucuguuaaaggcugucaaucaugaauauauucauuaguccaauugauaauuuuauaagucuguauaaaguuuucuucaugcugaagcacauggugacugcagcuuuuuguuugauccuaugcaaucuacaaaauuacuccuuccuucugauguugugcugagaugaaugcagaguaaccucuccuuccuuauuuuccuuuacuagugugaagaguggccagauucgaaaccuugagucugcccguguauccauggucggccaagucaaacaguaggucuuuuaucucugccugguuagagaguaagagauaggacagaauucgauuguuccuuuauuucuacacuuacucugccacacugguaaaugcuuccauucuuuuagagaaaagucaaguugaguucuguuaggcuagccaauuuuguuuuguuucuauaaacccuaaagcuugauaguguccagugaguaaacauuuaaacuaaguaucuacucuagugucccuguguuagcagcccuguugucacugagccaaacucaguuagcuaggaugugcaaguagaaaauucuggcagaacuagaguaaaaaauaaauucaaaggcugagcuaacguuacuuaaccuaagugaucuuuccuguggaguuacacgaguccuuuguguggccacagaugaauguuacuugagaaaccaucgucccuuagagcaggcaggagugcaggaguuagaugaaauccuaguggcaugguggggugcuugcugugacagggacuguguggcagauucagucugcagucuuguugguaagauccugaauuucuggaaacgacaucuuagugucauucaaggaacccugcuguggucagugcccauuuugagugcuuuagccaauggcaggucuuguguagucugugugccuguuuacuuccucugggcagaaaugccuugaagcaaacucuacccaaaccugauuacuuuugcaagaauuccuuaugcucuggaagaaaagauaacauaagaauaaugacauuaucauaccuaaaauccaggaucuuaauagcauuaauuaacuaaguaguaauauugcugauugucucaaguuuugguaaguuuuugauuuacagauaauaguugugugcauuuugauuuucacuuuuaacuuaggaacuaaauaacaaggcaacuaaaguuaacaauaauguagaacguauuucaaaaaggccagaaaagaagauuuuuugagugauuuuaccaugaaaaaagcauuaaggugauagcuaugcuaauuauccugaacuaauuaugauaaaguauacaugauauugaaauauuuuuugaguuacaauuuauugauggaagcuggcaauuacugugacaauggccagcaggaaccugcagguuugaacauccaauccaaaaaauuaccauuuucuucuucuuagaaauggugcccccuuauacaaacacaggaugacagaagaagggagacacacuggcaagaaggguuucagcaggagaggaugagagaggggacagggugugagugacuacaguuuuucuguauguguauaaaacugucaaaccuaaacguguaagcgggcaaacaacaguaccgcguuccuauguaauuauaggaaaucaugaacacccggccccgugguuccccuuaggagagcugaggguagucagagacaggguuugugcuacacaauacagacaaauuauuuuugagaacacagcuuggcaaggaagaacagaggauaagaaaggguagggagaggacaaaaaaacugaagggucggcccccacucucuccuuaacagauaagaggaguagguuuucccauaggccuauuguaaaauggacuccauguuuuucugugcacuuguuuuguucugguuuuuugaucuucaauuucaguugauuuuccuuuuugagaaagacaaagaacauaaaguuggguggguagagaggcagggaaaaucugagaggggucagggaguagaaaaaacaugaccaaaacacacuguuuaaaaaguauuuuaaagauaauuuuuguaaacugaagggagagugacagauuuuuaugagcagcaacuucuccuuuucuagcacuaaaacagcugggcaugguggcgcacgccuuuaaucccagcacugagguuaaucucaggucacuuuuugagacaggcucucucauugaaccuggagcucaucauacauccagcuaagcuggcuagccaaugagcuccaaggaucuaccucccuaacacugggguuccagacucccuccacaucuggcucuuuacaugaaugcuggaacucaaacucaggagguagaggcaggcggauuucugaguucgaggccagccuggucuacaaagugaguuccaggacagccagggcuacacagagaaacuuccuugucaagcugcuggccauugucacaguaauugccaguuuccaucaguaaauuguaacuccucaggacuuuuuacuguccucuuuggucguuguucuuaacuauucaggacuacuucagagaauugcuaugagagucaucuaaaaauaccaauaaaaccacuauccuuauccagaagauggcuacucccuuuuuauggguccuuauugguacaagaacuggaaacuagccauucgcauauagccacaguuggucuugaccucccccagcccuaaaaccacacaucuuccucccaggaacgguuuuagcucuaacguuugauuauaaaaggccauaaggauaucuaagauagcuggguaaggcauucacgaaaguuuuguuuucaauccaggugugaaggaauuacaaguccagaagguuccaaauccauaguggaaggaaucauagaggaggaggaagaagaugaggaaggaagugagucaguuaacaagaggaaaaaggaagacgacauggaagugagugacggucucauccucaacagaugaggggagaaggggaagccgagauagaauuguuauuuuugauuauuuagaauugaauaguuuagugggcagaggcaccacgguaagagagcauugaguggagggcacgaaugcaguaugcagcagcuagagugaaaaacuuacuguguucccucagacuuccucccaggcucuucucacuccuguagguuccucugcuuucucuaagggggaaaaaaucucauuuuguaucuguauccuaugacuguccagcucuuacugccucucaaggcuugucucuuggaacaagcuuucugaccucagugucuaucaguccaucugcaucguacacuuacaacgauauggugcaguguaccacuucugaaaauuucuuuuuuuuuuuuuuuuuuuuuuuaaagauuuauuuauugauuauaugcaaguacacuguagcuguccucagacacuccagaagagagaucuuguuacggaugguugugagccaccaugugguugcugggauuugaacuccugaccuucggaagagcagucgggugcucuuacccacugagccaucucaccagcccugaaaauuucuuauaucaggucuuaauaauuaaaccacauuuaaagaugcuguggacgccugacugucagugaugccuccuguugccuuugaauuuaauagaaaucauuacccaagcaaacaaauuauguuauuucgugucuguguaaguagggauucugguggagcaacuguuugaggcugcugauggauagugcugcuuggugagguguuagugacuuccuagggcggauggugacuucuuaaugccagguaagguuguguuaccacauaaucccuugccuuuggggaugcugcuguuggcaagaagaguacaucuuuucaaaguauuuuuuauuuaaugaggaucucucagccauucuuaagaucguugaucagaauauuucauacuucuuuagaauuugcaaauauauaaagaaugccucauguuuuggggccucaaaaccccguaaggugaagggagguuuuucucucauauugcaauauaguagcaucuuaauucagaaauuggacuugggagucugaggcagagggaucacaaauuugaggccugacuggacaaaauaaguuugaaaguugggugacuuaguaacaccugucuuaaaaauuacaagaacaagaaaagcagaaagggccaggcauguaggucagugggaggcacucaaaaccacuccuccccccaccccaaugacaaauauauagauuuuucuauagaacuuuuuucacuguggagagcugagaaaaugaggcuucugguuucuccaucuaguucucauauugcugccugucucugacuguagcagucuggguauugugaaguagcaucucauugagggagguucugguucgguuuuuaagauaagaguguuauucuuuaguucaagcuggccucacacuggcagucuccugucucagcuccagagugcuuguacuacaagcucaugucucauuguugccuauuguuguggggcaucuuuucauucucagugccucaauguucucugacaugcugcacuuguuuaccucagcacugugaagggggccugugccccaccaauacucuugauacccuuagcagaggucauuugaccguguacucaauguccacuucuaggacucuguuucccuugucugucuuuaaugacacuauaaacuuucuugguuuuaugguucauaggccucaacaugcuaaaccugugccacugaacuguauucucuaagucagaaacuuuuuuaaaaauuuauuuauuuauuuuaugugaguacacuguaucugucuucagacacaccagaagagggcgucagaucucauuacagauggccaugagcuaccaugugguuccugggaauugaacucaggaccucuggaagaacagucagugcucuuaaccacugagccaucucuccagccccuuuuuuccccccagaaacuuuuaauuacuacagauuauacuguuuugaaguaaaaaaugaguuaucuucuuuugcaaaguugguuagauauucagaauuguauguaaucuuagauaauuuuagaaucauuaaaauaucaaaaagcaccauuuagacuuggaucccacugacugugagucacuuugggugauguggacaucuuagucacuuacugaccuugagcagauggugucgucucguccacaucuagauuccauguugcaguuggugcaccauccugugauuguuucaguuguaucugaccuaguuccaugauucaggcaaguaugggaucacuuaguagucuaccuacauuucuguuugaugguuuugguuuuuguuuuucaagacaggguuucucuguagagccuuggcuguucuagaaccugcuuuguagaccaggcuggccuugaacucugaucugccugcaucugucgucccguuguccccgucccccccccuccccgugcugggauuaaagguguguaugaccacagcccagcuauuugauagcacacugugcgccauucgccacccaguugucaggagaaggcagauguagacacauuugucaugucaccuuuuuagaaugacuguuccuggucauugucaucaguucagaacuaagaaaacagcccuguacucacaacugagcuuguucucuugaggacgucuaccacaguccucugauagugauccuagcuuggaggaggcucugcuuugucucucacuuagguugguuucaggguggggaacauucuuuuguuuuacuacacuguggucuuuguauggcucuuugaugaucuguccuuuuuacucacugaaagaaaaguuccaucuuggcucaauaauuauuugcuuccuaaauuuaccaaaaguuaccagugguugugucagaccuuguuuguaguacuggccauuugggagguugaggcaggagacuuaugagaaccagaagaaagcaaauaggagugaaaaagaaagcuuaggguuauccaaaagucaaaauuagagcagcgggcagugcugugagaaggguucaaugcacacugaguaucugggcuguaguggguucucaccugugcuggcuccccuuccucaccccagaccugcucacccucaggcucaccuugcuuucauuccuacagaccaagaaggaucacccauacaccuggagaauugagcuggcaaaaacagaaaaguacugggauggcugguuccggggcuuauccaaucucuuucuuagcuguccuauuccuaaacugcugcucuuggcagguaagugguguguguguguguguguguguguguguguguguguguguguguguguuuccuuggcugaaauaaucaaauauuugaaauacucaaauagauuggguggcuucaagaacugaacccugcguuucucaccgucggggcugacaguguaagauuagagguuuggguuuggguuggacuacguucucaggucuuccugguucacagaccuucugugcuuucacauggauaagagaaagcaagacaguuuucuggggucuuuuacaaggacaauaaugguauugugucagagacccccccuaccccuacaaccucauuuuaucuuuuguagaccccaucuucaaauccacuggagguuauggcuuccccaugaauugugggacagugcguccauagaauugucagaauacugucaucuagaugugaccucaucacaacuguuaagauuaaccaacaugggugugacuucuaaaguagagaaacccccuucuaaacugccccuguacaggccuaaaccuaacagguuuaaaccccuccagugcugcgugguguugcccugaguaccugacugaacccaacuccuagagcauucugaacgcugugagaauugagacaguaaaaugauauuuucaucuaaacaucuguagugcacaugauugggcugcacugauugcuuagcaguuaaagauacuuguuauucuuccagagaaccugaauucaggucccacuacccauacguggcucacaaccauuuguaacuccaguucuaacacccuuuucugaccuccacaugugccaggugcauaugugguacauauauauauacauauaaacaaaauacuuauacauaaauuuauuuauaaauaaauuuuaaaaaugaacauuauuacccagaaaucucaacccaaaauuuuucaucuguugagaauaugggagucaaagaauuguauccaucugauugaaagugcaguggucuuuauaguucuguagcaguguuuacucaguacgcagcaaaacccauugcacaaggccuuuuccagggagcuauucagauucuccuguuuuguucuagguguugacagauuggauaaagaucugaccauaggccagaugcaggguaagucauccagcaauugugccauggguccuuuucuaagggcaaggagaugggcaauccuaggaaaauugauauucugggguggugaauacacugagagagcaugagcauuagaguccagcucugcuggacaccuccccgccaaccccaggggacugugggccgguaucuucccuucccuuuuguuuuguuuuguuuuguuuuguuacggggggggggggguguuguuguuuuguuuuauccccacuccaccccaggcaggguaucucuggcuauccuagaacucacuauguaaaccaggcuggccuaaaacucaaagauccuccugccucugccucccaagguaucuuccuuuuuuugaagagugauugucuuuuccccccaacuaaaaaugggaguuauuauguuagcuaugaucccugauggaaggauuaagauggagugauucgucuggaaacuauuagguuuuacauaggugucuaacacugggaauagacauaauuuucugaguguucuuuuauguucagaguuuaagaaagaaaaauauagguaccaaaggguauaaagucuguuagaagacaucauggugaggagagagaagagagagcuucaggguguggugaguuuuagaugcugcuuucccaguaaucuguaucagcuggaaggcuguucacggguaaaaugagaguguuggugccagccucaagggugccaaaguguggugggcaugagcaccacacacaaugcagaugugagggccgugcagcaguggauggagcaggacccauuucuugcucuauguuagaaucauaugagucaguaauauaagagaugugaaagagaggcugccuugugcaggaggagggccauuaguagucuucaugaaugguauggccucaguuccuucacuaauuacacagccuuggacgggacguugccccagucagagcuaguuuccuuagcccugugauuguagagucagcuuuaacaguggguggaauaguacgcugaagacgugaacuauggcuguaggagaaagcugcugcugcgccugcguuagcaccacaaggaugcuccagcucuccuacauuuaaguggaaaaacugggcucagagaguaaaacgccucucacaccuuccccaccccaguaguuguuagcauuuaacuacaguccucuggugccaggcacacccugcugcucaugcuguagcccagcucagcuuuccguacucuuauaucaaacccuuggccagcacacucuaggaaagcuacauacccaguuguugcucacuuuuaauaauugucauauuaggguucggaguauaguucacugguuuguuugaguaucaggcuuggggcccuaguuucaaucccaaguaaccacaccccccacauuacuauaaguugugagcuuucaguauucuguaagacagugugagaaagcacaucuuacagugccuggcacauuguuaaauacucaucugcuguacuuuguaaugauccauuucaauauucuuaauauagauucuuuuccacugcagccccauugcuagccacucacaucagcaccaagccaggcuucucuuuuauuuccauggguaauugccauuucuagccaccucuccuuugagugggcuauucugucugugcagaagccugccuggaugccugcuggaucaucaagacccuugccacauuuuuacagucugugugacccuuuuuaccccuggaaccauaauaccauuaguguuguguuuuacucucccacuggacugaacucugugagcacaggggcuggguuuucugcccaaaguaaauguacaccaaguaggaaggaaaguacauaggcaaaauugaacugugaagggagcacaacauggguccaguuacacucaucagacuauccugggggagggccuccugggcugcccagugaccugugagguacagagaugaggaggggagggcuuuuugucccugagguugccugcuuguuccucuccagggaaguuccagaugcaggucuuaccccaguguggccaugcaguccaugaggaugccccugacaagguaagucuggugccuggugacuuaagaggauaauggcaggaauguggguuccacagaaaguaggauaagccuguaucuugggguuuaucugcagucugccagcuccccaagccccuuccuggugagugaguacuuuguaugucugcugaagagcugcugguacccucuguuucaucccagagcccuguggcuaaggucuucuuuguuaccccaaaagccaaacugcacccuaaaguccauuuauucucagagauacuagagcuugugaaaaaaagguguuuguaacccuuccagaaguaaaacauugcugaaggccagcucccacaccacaagguaaagugaggagagcgaaguguggagucgauugcagccagugcugauagcaaaacuuaauuaucuggagccugcacucucugugaccggugaagaacucuaaacucuuuaaacuccuugggggccaugagaaagaaacaagaaauucacacacacacaaacuuaguggaugaagcaaaacagguuucaauaagcaagcuucaacaacuucacacacacauacacauacauauauacauacacacauacauauauacacauacacauuugguggauagaggaaaguuccagcgagcaaacuaaccauucuguaugcauacauacauacauacauacauacaugcaugcauacacauacauauaugcacaguugguggauagagcaaagcuccagugugcaagcucuaacaacuuucuuuuuucucuuagccuuuuucuaucccuaagucaaaguucucuauguaaaaagaaaauuaaccucauucaaaagcagauaaaauuguuauacaaguguuugggcugcgugucugccuugcuccugggaugccaggagugccagcacaaugcucagggguggcagaacacaguccauagugggaguccucauucuguguuucccuggauuggaaacaacggaguauggacgauuucuguuguuccaagucuccuguguaccugagaguugggaacugggguucccagucuacacuuccccucagggcauccucucaccgggcaggaaggggaaugcagggccuaggacaagagcagacccaaguuugguuccaaaugagugcugagaauacugagaggcugggagagagaaggcccucuccagauuuaagcucuguucuuuuuuuuuuuuuuuuuaagauuuauuuauuauuauauguaaguacacuguagcugucuucagacacaccagaagagggagucagaucuuguuacggaugguugugagccaccaugugguugcuaggauuugaacucuggaccuucggaagagcagucggaugcucuuacccacugagccaucucaccagcccuaagcucuguucuuuaugaggaaggccuccccccacagugauccuugauggagagacgguccuggcuuauccaaacugcuuuaguacauggcaggugugaaugcauacaccuuacucagggugaauccggcauuaaauaccuuuugugggaaggaaugcccaggaaaggaagcucauuggcugaacacucagggacuaucuagauaccucauuagcauggagaaagaacucgguuuuuaugcugcgugacugguugucgugguccucugagugggggccaugguugcaugucccagagcaggugggguuuagcaaggaccuggcuccacaccuacuguauucaguucugaguuccaugggguuugggcucaggcagccuuacuuguucacuugccccauacaagagaauuacagcagaauuguugauugcauguuuuccuagcuaucuuuuagucuacaaguucauuauaaguugaaagcaauaguuucuuaugucauagguuaacaaaguuguuaccaagaaacaggucaccuacccacuccuuguucauggccuuacuuaggccugugagcacugagacccauggccucauuccuggaccuaaccuagaaugaguguuuuccuucaucauuaauuuauuccaagccuauuuuucauccuagugcaauuuaugugcuuguaaugcaugagagcucacugucguccuuuuccagccugugcagccuuuacuauuuugcaggaggaggcacguucuauuuuuuauuuuaacuaaacuuucuaucaacuaucuucuuaaaauuacuugaaucaagucaggaauucuuuaaaaucacuacuguaagucauuaauucauguaaaaagcauaauuucaugaaaguucaucuucauguugaucugcagguaauuugcccaauaguauccaguaaccaaccauaacagacuauagguagaaaguguauuucuuugccuagucacaccaucucagaaaaauuaggaauacagccaugacaaacacgggaaggcacagcagcagcaagaagcaauccugggaugaagcccuggggccgugcuucuccaggacuuaccagucacagccgucuccaggaagcucacugcccucugcaacuucuccugcauacaguccaccaaaagguccuuguuccuccucagcucucuggccacccuuacaaggagucccugguccagguccuuuugcucuuaagccacccacaguagguacuacccacauaguaggacucaugaggacaccagggagccuugcacagagccugccuuccagcagaagcacacaggcuuccagugcugagcucagcacuuacuuucacagagccuggaaugccuccucuuuuccagguagcugaagcuguugccacuuuccugauccggcacagguuugcagagcccauuggaggauuccagugguaagugugcacaagggacaucuagccagcugguccaccucaaaacucaagacucuuguauguggggugggggagcggggugaauaucucugccuuagccuugccuggucuagguuaccaaacugguauguguuuucuuguuguauguggacucuguccagugagaucuuguugagcugugauugagucauaccguaucuccugcucuagggcaucugcccucugaggaggcuggaaugaaaucagccuuugcuagaaaugaguguucugccucugcugagccgagcuguggagguuguguagcggucuagaucagggauuccaaucccugcccugcugacauguagaagagaugauccuuuguuguggucacaggguguucuaugcaccacaacaacacccuggccucugucccuaucuuccagaaacaucuccuaaacacaguucugccaaccagaauuguucccagauuguaccguucaucagggaggcaaaagcgaaacaguggcuuaccuagagagggagaggaagcaagcccucaccccagaaagcuccucguauuagggagacaacccuggcuuuauguugaaggagagacaugcagacccacauugugugguauaggccacuacaagcaucuguucugcccuggaggaggcccuugcuucucagcccaugugucacauguaucacuccuguuggccucuucucagaguuugaugaggcuuugggggagccugugcucuuccacagaaaguuugaagaagugccuuuugccuuagacagcucugauugccaggcaugggagauggcagugacaggaguggugggggcaucaguccugacggggaccugggacagugaaccaggaagguggugguucaugcugcccacuccugucuguuaacugaccauccauggacccuagagucaauagugaagacuuaauuucucaauuacguguuugggggcuucuaaccauuuggugucuuggaaccauucauugagggcagcacccugucuagccccaugugggcucugaggagauggaacauugguggucaauagggagggcuccccagagaaaggaguaagcuggagaaaagcuugugaugguuaaauugugacaguuccccuuucuacccuugacaguguguuuccuggcugcuagugaccugcugucuacuccucccucuacauugagcucuguuguaaauacaucgcaccagaggccacugugacgccgcugucuccuccucuccaucccgcccagccaugugacaccggcucuuguagagggcauccccagauguccaaacccuuuccuguguacuguugaaagcauuguucuucagggcccuuguccaacaguggcccgugcagucugggguccacagcucuuccucuccuuccugugcucccugccuugccuaggaugaagccuccagcgcugcucccuggcccuguuccuggcauauggcaauguaccccaggcucagggaucucccuuccuugaggauguucuuggcaugguccugcccuaccucaugggaugggcaaugcacacacuggcccuuauuuuucccuuucaaauaaaacaccagucagguaccuuuaucccagucuuaacugucccaaaucuggaagguccagaguaagcaggauucagggagagggaguggauagcaaguaucccaagaaaccaaccuguaagucagguccagccaguccaagcacauggcuucccaucugggugagcccacugucccacucccacaugucugggcaccugcccugggcugaggccaggcugcuccaagggccgcaugagcccuaaucugccacagagcaacccagguuaaacacagcccaugcacaaagccacaggcuaaauccuguggaauuguuuuuaaugacugaauuuaaccauuuucauaguugguuccuggaggugugccaagugcccgcuugccucuucuagacccacagcuucuugauccacuugugguuuccaugucacuaauguagaaacaucauggacuagcauccccagucuuugcccucauccagcugucgcagcgcagcacuggggccucccccugcugcccaggggggggggggugggcagccuccugaaacccaucuuucugugacugucuuaggugacguguagcccucuuccguuuuuucacccaacaacuuccucuguccugcugcacgguccagagucugggaccgacuuuguuucuuuguuauuuaugaucuuguuuaaagaaaauaaauaucucccaaccuuuauuug

SEQ ID NO: 3961 - RNA, 10454 nt, Mus musculus
cuguaggcgcggguucgcagcuacugucaguuccgcccucggugucgucgggucgccagcuuccugggcagccaccacucucccgccgucggacacagccuucugcacuccuguguucuccugcgguccggugagcgugccccaucccuucgcuggccgcaccugcucucucccacuccaucugucuuuucucuuucuuuucccuucccuggaguccuaauuugcccucucuagguuucuuuccuccuaaauacgcccuuuguuauuugccucugacguccaguuggucgaagguuaaaaccuucaucucuuuacuucuuccccucagccucgauguucccagccugacccgggcggggugggggaaggggcuuucacgucagcgaagaucagaaugacugucaccaggaggcucugggccaugugcccuaaagccuguucuuguaucaaggguuguuugugccuggaggagccuuggaguuuguuuggccuuuguuacacuaucuuauguggcugccugccggagguggaaguagggacacagggagacuggaccugccuuauccugauucaacacaaauagauauaaugcuccacucaacaguuuugugacuguaucccccaggcacagcacagcugccugucuacauaacugucugagaaacaaauuuggaagugagccaacgugugggaguaaagacuccugaguucuuccccuagacccuggcugcucugagugagaacugagccuugcaugggucccucccagcaaggcugucugaaaggacuugugugacagaugacccuuccuugcagggcggugguccugcaaagacaaucuuccuuucuaaacuuggcuuccuuccucucccccacaggacacaauaguaugaacuuuaaguguuucgucucccagccauuuucuauggaaaaucgaggggaucgggccaugguagccaccggcagcuuugaagaacgagacaccuuuagagaagcuugaccuuggaggccucagccugagaccucaaagcagccuccagguaaggagucccggcuaaggaagccuucucucaggccuggggccuagggcugcucagcaagacaauaaaaauuccccuccucccacccugaugagagccucuucacagcucagcaauccccuucuucaucccugaucaccuucuggcccguaaagauggcggaccccaguguauaaggggagaaccugagugggguggggacugguuccagguggccuuggcagucaacagcagagcuggggcagaagcuuaugguguguguguguguguguguguguguguguguguguguguuaugguguguguguaugugguguguaugugugcucacgugugugcucacgugugcaugugugugcaugcacguuuauguaaaggcacacgggugcuguggcacgcacaugaaggucagaagacaacucaggccuccuaccaucugugucccaauggcaagcacccuuacccacugagccaucuugcuggucugagcuuccauucuuuuuuuuuuuuuucuuuuguccuagcuuuugaugucccugugaaugagauuagaaauuggguguuguuuuuuuauugccuccagugguuguccgguccuauaaaguggauucuguuuuuguugguucauuuugggucgggaucucaggaccucucuucggcugcccuggagcuuuagaugcagaccgugccugacaggauuaucuuucuaggccugcguuuuagucauagaaaccuuuaguacaggugaucuuugccucuggucccaacccucgaggacccgaccuuuggcaaacccuacgcugcauucacaauggcagcugagccacauguuuuugaucuggcagcaacuggcagcugagccacauguuuuugaucuggcagcaacugagaccucgucuuucuggacuucacaacauucuaccacuuagcucaugauuagacaggccugcaucagacucaugcacuaauaccuacagaggaggucugcccagagcgucucagaacuguuuaauuggucagaaagggcuuccauugugaagggccuuaucugagcccgagacugagaaaaaccgggagacaugaggcaccgcggggcugggcagacagugagccuguggacaugguucugagcucucccguuuaacggggacccagggagggcaggugccuuccaggcugcugucaggauuucucaguggagucggaguggggagcacuaccugggagaagacucccccgugaggagucagggagcaccuucaccuagacauugacuccuauucucccugagcuccaggggcccagacuccugacugaagucaggcuuuuccuagaggcgcccuugagccuguugucauggugagucccucugaugucccuguuugucccagccugggugagcuguuuuguuuccauggcugucuguguucacaggugacuaccgccacauccucccuccacccgcuagggcuuuccuccucugccccagcaacacaggcagccaaucaagaugggcucagagcgauugcuccaaugaaagcggagaagugaaacuagggaagaagaagaagcaguucacccuccccacccccaccccaccccacccccgcugggugcugggcucacuuccuccuaggccuuagaggagggugguguuccagcucaaagaacaaaauggaccuuuucguuuccuguaucuuuucugcauagcugugagcugugccucccaucgaaccacagauaacugagcauuucccgacacuggaggaaaacaaacaggcaaccuggcuggccaggugccuugcccagugccuggccaugagccugcagggguaggcagcguccaucuguaaaccugaauggggcccaagcugggugggggcugcuaggauggaauucaucaaggugucucaugucucccuucauaauuacauaccagacaggaccucuccuguuuaggaucccagagcaaaagacugagggguuugccugccagguccugcucugauagucuuguccuagucagccguugggauaagucccacagaucaggaacggggccuuccucugcagucucugccaggagaucaggagcugguugguggcuucgagggugacccugagccacacccccuauaccaaauaagagaggaguucuucacugaaucucaguuccuuggcaggaauugcuucccagacccuacuugacuauuuuuggagcucucuccugguuucauccuggacccuccugagaugugcuuggugccuugagggaaggcugggcagggguagguagaugguggccagggaggggcugcugauacugauggcuucuccccucuuggccuagaacuccggcagaguuccucugucucgucuugccgauugaagguccccguuucuccaauuucucuccaucuucugggagguagcaggaaaucagaaucaugguugguuucaaggccacagaugugcccccaacagccacugugaaguuccugggggcugggacagcugccugcauugcagaucucaucacuuucccucuggauaccgccaagguccggcugcaggugaggauggagugaggguccugaugcugucuaaucugcucccucccugggucagacuccuuggcagggaugaggagccuggagcuggcgggagaucagcagagccaucucccugugcucacaaccaccccaucuuggucuuucagauccaaggggagagucaagggcuagugcgcaccgcagccagcgcccaguaccguggcguucuggguaccauccuaaccauggugcgcacugaggguccacgcagccucuacaaugggcuggucgccggccugcagcgccagaugagcuuugccuccguccgcauuggccucuacgacucugucaaacaguucuacaccaagggcucagagcgugaguaugcggcaaggacagacugacugaccuuagucugucugugcagcucaguggcuccuuuagacuuuccaagaaccccgggaagaucagagguggacccugauuucuguuaucugagcaccagggcugucuccaagcaggaugugagcccaugauggucuuuaaaaccaucacggugguagcuggccuccugggugacacuuggauggaggcuugaaauaggggagggacugggccagaagcacaauggagaggcagccaccacacccucuagcccccacaaccacauucuuucuucuuacuaugcccuccuaggaggggaggggagggggucgagacaggagugucaccuugcagcucuggcuggccugguguucgaacagcucucccugccucagccuuccaaaugcaggcauuaagugugugucacaaugcccuccccaggaucgcucuccagggagaaguagagcuggggcuaagaaucugccucuggacucagcucugcuaggaaaagccucucugcuuggucuuggguuucacauuugauaaauggaacugacccugacuuaccaaggcugccgaguagcguaaaugaacacauuuaugugagaaagcgccgucuccauuuuguguuacauccugguuguaacccugcaagagugaucuagagccucucucuucccguggcaugguggucuggcaagagcaugaugcacuugagugcaagccugcgggccacuaaccccgcccccaccccucuugcccacagaugcaggcaucgggagccgccuccuggcagguagcaccacaggugcccuggccguggcuguagcccagccuacagaugugguaaagguccgcuuccaggcucaggcccgggcuggugguggucggagauaccagagcacugucgaagccuacaagaccauugcacgagaggaagggauccggggccucuggaaaggugugugcuggguguuggcuuuucuccccuccucuccuccaugcccugggcucacacagguucucuuuucuacagggacuucucccaauguugcccguaaugccauugucaacugugcugagcuggugaccuaugaccucaucaaagauacucuccugaaagccaaccucaugacagguguguuagcgccacuucaagcugguagggggcgucuaguugucuaaagacugcaucuuguuauccugcuugccucguggguuuuagaguuuauauuucuuaccauucaaauccaacaggguaaaaaccccacuuugcacauaaacaggcgagaucaacaaaaagacucugaagucccccuaagagagucuagcuguagucugucuuuaaaacaaugagaccccucugcggcaauggugggaugcggcugggagagcugacagccucucccccugcuucauggcagaugaccucccuugccacuucacuucugccuucggggccggcuucugcaccaccgucaucgccuccccuguugauguggucaagacgagauacaugaacucugccuugggccaguaccacagcgcaggucacugugcccuuaccaugcuccggaaggagggaccccgcgccuucuacaaggggugagccucagauccccucacagaacuccagagaagugagaugcagccaaaugucagacagcccauaguugcugucaccucuguuuuuuagaaguuaaaaugagcauucagacuggggguuggggaugggugggucagugguggagggcuugcuuagcaugcuuggagacccuggguucugcuccccagcacagcaggaguagggagcuggguacucgggauucuugggcauguggccauggguuggguggauggaugagcccagugguuagaagcaggugguggagggaccuccaugacuuguguuugcucucucuagguucaugccuuccuuucuccgcuugggauccuggaacguagugauguuugucaccuaugagcagcucaaaagagcccuaauggcugccuaccaaucucgggaggcaccuuucugagccucuccaugcugaccuggacccugcuucccagcccugcccugucuuuuucuucauccucugcccagucccauucucuucccauuuccugcaccccgauuuacuucccaccucaccucccugugccucuguacugaugacucacagugaggaggccugacaccagacccugagcccucagcccuuucuacagcuaagcccacaucuucaucuucauccccagcccagcccagcccagcucagccagccuucacccauaaagcaagcucaauguuggugucuucuuucucauauguuuacagaggucuugguccaagggaccuuuucaggaccuuggcaggcaggugaggaccccagugucuuuaaaaagggaugugacccacauucugccuguaacaucugagaggggcuggagggucuuccagucuguuccuccagacccaguguuggcuccagagaucaguggcacagccaggggacacugcagccuuugucccuccuacccuuuccugaacaccauguaagcugucacucaguaccugguacucccacccacacuggccaggccugucuaucugcagaguggaaguaucccugccccucccacaucaacuuguuaggagauguagggaaacuccagaaccuuccauuuugggggggagcuuacuuuacucuguuuuacacauagcaacccaccuccugaggccauagaccuacagaagacaaggcaggcuggccucagcuauaaucacacccugagacaugcucugaaccggggguggguggggacagggcaggucugacccauugaagggggcucaggcucccuagccaagaucuagccuguagggguguuguuguuguuucaaacggggcuucacacuagcacacuggccuggaacucgcuguguagucuagaacucaugacaauucugccugaguuucucaaggcugggauuacagccaccuguagcacccgaccucugaagagccuuucugauggaagccuuaccuuuucccccaagacuggggaccagucaacgcuuagauugucaggguguuucagucaguccucuuucccgccagcucuccucagccaggagagggaggcaggaccacucaaggagcaggaaccaccggugaggucccucccagagcagggcggggccugucaagucuccacgacccauuuuauacauuucagacaucuccuacgggucaccaucgaacgccaaggcaagacacacagugcuggguccuugggggauugucuggcagcugugaaacugggcccagacaauaggauguccucucggccuaaagugauggcuucugccccuucaccucuuuagcagaaugggucagagcuaaaaaguuagaccuucccagugcuuggcaagaggccaggcuguucgauuggcucccagagaagagcaccaguucuccucagcuucugguaaauccagccccggucucgguccugaggcagcagcaagccgcagugaggguuggccggcgugcagcuggugcuucagcacacaagggcacagcaaaugaggaucuggucauuguguuagguccuucaagggacaguuuacuaccaacagcugacaaacaggucaagagagggcacaguguguccaauagcuccuucacuagacaugugauauaggugugagaccacuagacuccaugacuaggaaugcugucaguuggccugaggaaggggcagcagucuuuagaaaacagcauagcagagaccuuagcaaugcuuccagagggaugcaccagacgcccugcuuugccuucuaaggcagcccaguuacuggcugccuuagaaguuacagggaucucauaaagggcaugguggaggccugaggccaagcuucccacagagcccuccaggacagaaguccuaguuccccaaccucucuacagaacuggagggucacccucagagcaggagguuacagucaccuucgugucaguccugccacagggcagugaacacuccaccgucuggucccacaggucuguaaugaagggguugaagucuuugcuguaaaaacuagagccuggcaguggagucuccccuuuaaucccagcagugggggaggugggggcagacucugugaguucaaggucagccagggcuacacaaagaaauccugucucaaacaaaaacaaagauggauccugagggcuggaaagauggcuuggcagucaagaacacuagcaacucuggcaaagguccuagguuccagacccagggcccacacuauagcucacaaccaucuguuuaacucgaguuccaggaguucuggccuccgagggcacugcaagcauguguauggcacaguaacaugcaggcaaaacaacuuuauuccacaaaaaggaccuagagaaaugaagugacuugcccaggaaucugaccgaaggcccacauuugacuguuaaaaugagaugcuuccuggcuggagccccagccccagagucuuuaucuccagguguuuuuuggguuugguuguuuuugagacagaggcucucuguguagcccuggcuauccuggagcuugcucuguagaccaggcuugucucagagaucuaccugcaucugccucccaagugcugggauuaaaggugugcacugcaccaccaaguuuaggccucuuaucucaggguuuuuucuguugcugccuucaugaugguucaagauggcuucaggcaguaggauaacuugaucccaaggguuuggggacagcagggacaagacuguauguguucaaaaguaaaacacuugccaagggcuacauucccacuuuacaaaacaaaagaaucuuguagcugggcauggugacacaugcuuauaaucccagcaugugggaugccgagguaagaggaucagggguucaaggucagccccagcuuuuggaaacccugccucaaaauuuaaaaggacaaaagcugggugugggacugcaugcuuuaaaucccaauacucagaggcaggucgaucucuaaaggcauaggugugacuccggaagccagaccuccuccugaccacaggacaaugaugcugugacccucucuauaauuuaacccugaguccaccaagcgguuuucacaccaaugaccccagucuccuaccuguaggcaggcuguaagcuccacuaacaaggucaguuaacagugcaagagucaggaguucaagugcccaugucucgcaggcuacuggucagaggcagccuaaaacccaucucauagacagggaaccaaagccaggggcagagaucagagcucuccuggcacuguguucuggguguggcuguuaacugaagcugugagucuauauggaguagccuaaaguucuagugacagcuuagccacggacacaagcgcugucccugccugugcuuugcuuuccugucuauguuucucaagacggcacaguccacagaugguuccuucuagagauagucuguugugagaugucaggagcagaaggaccuuagaggucgcaaagcccugccuccuguugccaagauggaagcaagaaacucugaagccucagggaacagucugugccuaggaaggcaaaauggggccuugggugccuagcuuuugggguccugcaggaagcaucccuccaacucacuucccaucauagcuauaggauaggaaucuuuauuaugucagccuaaggucucacgccuccccaucuucauaggcugugggaguugaguggauaggagcaggcaaggcccagcuagcccucuccaucccuguuccugcucaggucccccagaauuaggucagcaaugccuggcgcagcaucugcuucuucuggggugugaggcggguggggaacuggaugucaaagaagaugaagaggucucccuucuugcugggguucucaggcaguggcauccccucaccuggcacaaucuugaaguacuuagggcugagacagggaaagaagaaaggaaggagcauagaugacucagcagugucggaugggugcacgcuacuuccugcacacuugcaggagccucagccauucuuacagcuucccacuagcuggccaggucucacacaccagagcgggugggagagagcugaaggagagauugucuuguuccaaauacaacacuccucaaaacccuugcucaaagugaauacccugcugacugacccccgggaauugcacagcccuccccaggaagcaaagccaaccuggggugggagucaaaccuucccuucucugagacuucucuuggaacaagaauugggagcuacuauuccgugcucuguugaaaguuuugaggacggagacaagagauugaccaacacuggguucucgggccuauauagggguuucccauggguuagagaaaggccaucccucuguagggugaacacagcccauggcucaggcagagg

SEQ ID NO: 3962 - RNA, 1308 nt, Mus musculus
cuggguacaucuccuuuuauaacaauacacauuccacaacaaauggccugcacuggacccagcccuaaagauuagugcuccauaaauauuugcccaaaacuuucuuucaaagaaaaacuuuaaaagaucaaauauuucagaaacaaagccuuaucccuguccuagauguuccccuaaacacauacacacacacacacacacacacacacacacacacacacacaccuuuccuuuuacgaacagggccuugcuauguagcucaagcuaaccacagacucgcuauuuggggauuacagacauguaccaucucauccauaucuaaacugucacaaagucccugagaugugacagagguguucagagauggagaucagucagugacaaaaacccauaugauggccaaaaugaaaacuguaacauccauuaguccaggucauuucugguucacacaccugugguucuucaugagacucaagauaagguccaaauuguccuuugucuucauuucauagcuagaaauucagacaugacccaagaagagcuaagaggcaggagcauuggacgugggaagcccacugaugcacuuaggugugucugaauuucgucuauguccuaaccagcacaaagccagauagggcauacaagaggagagaggugccccuuuccuacucuaaacuaugcagggaaacuguuugacuggcaucagggugggguugccucugcgcaugccaggcuaggaucccgcccacuuacgccuucuugaucugggcaucuucugaguugcgggugaccugaagcacagcauaguaauccagccccauggcugguaccaaugggucuguuuuuccucagacuccagccucuguuaguuugcguucugugguugcuccugacaaccacgaguggcacccugggaauuguagucuuuccaucuugaacaaaugguccuggggcgcucauaacugguuccgugaucccgaaaaaggucacacagcucagaaacuggaguucccgagcgccuuuuugcuuauuuuuuaguacagaaaucaccuuuaauuuaaaauauucagaacaaagccgguuguaguggugcaacaucuuuaaucccagcacucagcagagguaguugugggcuggaggcuagccuaauguacauaaugaguuuguugugagucuggggucgcccagagauacgccgacucgguuuugguuuuaauaaauuagaggcuuuuuauaauaaagaaaagaaaagaggaaaggaaaggaaaggaaaaaaggaaaagaaaagagaaaaggaaaggaaaggga

SEQ ID NO: 3963 - RNA, 4277 nt, Mus musculus
uguucuuccgcgugugugcucccgcugggucggcuuccugcggagagaacagggggcguccuuauugccuacgaauccccgcgucuggggcggaacgcgcucgcacgcucuucugcaccugcgggugagcacugcgcacgcaucccuacaccggaugcacaguggggacggcgggagugcuccugaaacugggagaggugcuucaggggacuuggaugccuguauuucucuccuuccucuuccuugucaugccuuacuagaaggccuugccaagcugucaggcaucuagccugcccuuauuucuaagcauggguugaacucauuuuauucaaggaguaccgaggacaacauguauuggacauauacugcagugcuauuuacaaagucuaccuagugaaucuuaaagcgauuuuauuuuguguguguguguguguguguguguguguguguaugauuuguugacggcccuaccuaauaauacaggucuccaggcaaagacauuuacccuuuuauugugccuccguagcggugagguuuauauagagaagugcuuaaaucgucuugugaccuaccccuuuuccucaugauaauagucuuaaacuccuaacaugggcugcaaagcuuugcugaucaaucauuuacuuauuucugccaauuuucauuuccugcucuucugguuucuccaguuacugaaguguuuuacgaggcugagaaucaaauucaauuuacuuuuccacguuggacauuuguacuacuaccaaacuacauuuucagcccagucaucgaacuugugauuccucucaugugucuaccucuagccagaaauaguuuucccauguuuggcuaacucauucauccuugaguuucauccuggaagucagguucucuagaaagucuugacagauuagaccugccucguuuucccagcugucuguacauacuguuguaaacuuccaguuuacuugccuagauuguaaacuccaugagggcaggaauugucucuagcuuggucuuguuuguauacucuuuuuuuuuuuuuuaaagauuuauuuauuuauuauauguaaaguacacuguagcugucuucagacguaccagaagagggcaucggaucucauuacgggugguugugagccaccaugugguugcugggauuugaacuuccgaucuucggaagagcagucgggugcucuuacccacugagccaucucaccagcccuuguauacucuuaauauaguagccaacacacaacacaguaaccaccuauuaaugaauaagacagaaaagaggcauuuagcgccuuuauaccccgucguaacaaacuuuuugcaaagguugaaguuaucucuauugaagccuuuccugaguucucucuugcugcauucuguaggguucucucuugcugcauucuguaggguucugaaacagaugaucuuugggaagcagucugggcaaauaagcucacauuuggauauugcugacuaaacagccucauaccacacagacccaucuuuugccucagccuccacgugauuuaugcuacagcuacacugagcuccucaguuccccccaccagucaaaccugcauguacuugggcugucuuccaaguguucaaccuuacucuucugaagagaagaagaaaggcuguuucuuugcuuggguuuuuuuguuugcuuguuuuguuuugagguagaucagaaaugacaucuccaaaaaagauggcauguuuuguuuaacuugcauuccacuagcagacuccauugagcuuagauacuuuuaucucaacucaucaaaccauuuugcaggcccuuucucugucaggucaugugcuggcggcccuaugcuaaaucaggccuagcaucugacaauaaagagcuucgucuccuaagggagacaggcauauaaguaaggccaugcagugcaguuuagacgucacuguuuaugaacaggaagaaauguauaaucauaccgguacuuuaaccuugucuguugauauucuagguuccucaagaugucaaccucagucccacaaggccauaacuggacucgcccggugaagaaggaugaugaugaggaagacccgcuggaccagcucaucacccggucuggcugugcagccucccacuuugcagugcaagagugcauggcccaacaccaggacuggcgccagugccagccgcaagugcaggccuucagggauuguaugagugcacagcaggcaagacggagggaggagcugcagaggaggaaagagcaagccagugcucaacacugagaccuuauaccaucucacacagugggccugacgaaaucagcacccagagagaccugggaagaagaaacccuaaguaauagaagugguguaaaaucuggggacagucuucgggacaggauugacagccagacccaaugagguugcacacgacggucaccaugagcugaucuauggucagaucacacauauccuccacauucuuguucuaccaauauuuguguuuacaaccacacucccuccacccuaccucucagugacugugugccaaguacuuuauaaguacauacggguugcccaaucaggccuucauuuuccaaucacaaauuuaaccacaggaaguguuucuaaggcauugcguuggcgaugugcaauucgaagaguaacgugaccuucccguugcugagagacucaggggacaggcagaaauaaagcaacacucaaaggagugaacucgguuuccgcagugacauaagugccucuaucuuuccucacuucuucaguguaaugggucgggggagcuaguagggaaacacccucuuuuucuuuuuaaagacagaaucuguguagcccagacugaucuuagacuuacauuagccaaggaugaccuuaaaugcaugauccuucugccuccacccccaaagacugagauuacaggcaugugacaccacaucugucagggaaacauuuucuuuucauagucugccccucaccaaaccaacacaaagcuugucugacauuuuggaaguauguuuaacauuaaaauacagacuaugaccuuuagaaaauggagccacuaucaacacagagcuaguuuggcaguacugacagugccuucucucaguguguuguguccugcuucuaacagcaacaguugcuucccaccacccccuuuucuuugagucaggguuuauuuuuguagcucuggcuucccugguacuuacuuuguaggccaggcuggaauugagcucacagagcucugccugccucugccuucugagcacaaggauaaaaggcacauguuaucacaccuagucugcuucucauuuuuauucagugaaaccaccaaccuguucuauguucuuggcagucauuugggaaugggaagaggguuggaaggugaccuacuauagaaccuuaggcugcuuuuuuaucauuacuaacagaaaguuuucaggcaucuguauguuagcaguccaagucugaaguuugguagacccuaaaaucuacuuugaaccuugugugcugaaauuuuaggggaagaacguagagaaggcaugagaagguuaaggaacaguaaagucauauuucaagcugaagagcaagugacuaaauagagcugugucucugaugguccauuccagcuuagagcugugagucaaguuguguacaccagaagcaucccaaagaugggcauugugugguggccauaccuguaaucccaggacuguggagacaggcaggcagaucgcagugaguuugaggucagccuagucuacauaugaguuccaggacagcaauagcuauauauugacaccuaucuucaaaaauaaaaaaguauaauuccagcacuuggggggaggcagaggcaggcagauuucugaguucgaggccagccuggucuacaaagugaguuccaggauagcaauagcuauauagugacacccuaucuucuaaaauaaauaauaaaaaauucugaaugugaaaagggagucaguugaguggaacugaaugaaguacacuuuacuuauuuauuuguaacauaggaagaacugccaucuggagcaaaugaaaaaugcaucagaaucaauaagaaaaagcaacuagaaaggugaacacuggcuggguguggaggcccuuaucuaccuacaaucccagaauuuggggggcugaggcaggaggcucacacauaaguuugaggccagccuaaacuauguaguaaguuccagucuggccugaacuaugaaaugagauuauuaauaauaaaaaagaacuaauauacu

SEQ ID NO: 3964 - RNA, 19702 nt, Mus musculus
auaagcaagcucaagcuuuauuggagcucaggcauaaucuuaaaccauucagauaugauugaacaauuacuacaguucuuaugaccccaaagucugacugcuuacagaucaaaggaaaucccugccuugguucagccacgucugacucuuucuccugccccauuacuguaagaguaaaaaccacaggccauagauuuuauuggugcagcuaucuucagaaguagcauuaggacacaacaaaugacaagagagguuggugaaaacaaagguacugcgagaagaugcuuggaggguuggccuugugguuccugggaccucugcucgacuuaauaucauauggucauacucaguacagcuuugucagugugggagcagggucugguucugaauucuugaucuagcuuucaguccuggcugcccuguuuucccuuuggcuuaagucaguuuuggcugggguuucugccauuugacagccuccagaaaccuaaugcaguuucuguuuguuccuagccacgagguuucuaugagaacaguuaauuaguucaaguuuagguuggagaagcaacaguggaaacaguccugacaccugggagcugaggagauguuuuagucaguaaacaucacauaagcacggggacacagcacccagauaaaaaguuggguaccacagcaggaaccuuucuuuaaucucagccuuuggaaggcagagacaggaggaucccuggugcucgcaugccagucaguuuagccaaaauggugagcuccagguucagugagagacaccaaaaauaaggugaagauugauaaaggcauuaaggcuguugagcucuggccuucuacauucaugcacacauacaaauauucuaacaucagaagucucuuggcaggcagugccagcucuggauuaucuaucaccuuagcucauagaacagagauccucuuuuugacucuuagaauaugagauccucuuuuugacucuucagagauaaccaacuucaucucuguucuaugagcuaaggugauaguccagggaaagcaagauagauaaugaauugucccaaauuguucauucacauagcugucaccaauuccacauaaacucauaaugcacucuacagaagaugcugugucacagaguugucucaaggaaacauccuggaggaacaaaacaagcaaagccaguucuggggccaaucaugucuuuauuagugucugugcugagccaauggagcgcucacauaugcuaggaauuuuacuaggcacucuagcaacugagccagggauuuuagcuuuucuauuggcaauugggacaggaugauggaauaguuuggaacaggaucaaauggagagauugcuugcuaccuauagacaggcacaugagggguuccccaggcuggugccaaggugggucaggccccagaacaagauaaugccgucuccccccagcgggaaggaagagaauaagcuucagauguuaacagucgagcugagcuccugggaucagaaaggcauuuccuaauggaagcaacuuccuaaggccggaggucucaaagaacucaccucuucccacagcuaggaaaccuuaggguuagcucagcuaucauagggaagcuacaagugaggaaaaggugccaaauuccauguuuugguuaaggguauguccugccaguacuaacuagacaggcaaaguauucauuauaguugaaaucaagaaacuuuacuccauaaaaagccccaucgugccuuuauccagcaagcuccuucacauagagcuagaaccacuacaaccaaccccugccacaacaccaagccaacuguuauuugauucuuugggcacccagaccucgcuccuugccccgacuuauccuuaccagacagauaacuguagcuuuguuguuugcucucuugugagcuccauuccucagacacuuagagccaaaugaaguuauguuugcuauguguagagaaaauucacaugugacuuaugggagugccuggcaauggguguauggacuuuuggcuaugucugugccugagauguuagcuuccuuugagacggaaaagaggauaaauggugggaguaaugggccaagcguagagggcuuaauggggagaaaggggucaaaaugggacaguuuagaugguagcuagcagaggauccagaagaaaagggucuucuuguguucuacaugcacauccagaagucagagccccagggcucagaaccaacaaggcgaccacauaagugaaccaagagcagcacccguggcagccccagcaagcaugcccauggccaaaggggcgccugagcuguagcagggguccucucgaacuaucacgugugucacaccaggaccuguaagaaaagccacacaagucggggucagugccagagacuagucuaaucucaaguuaaggcaugaacucauucugcuccccagaggaacugagacuuugagagcacccuccacugcagccuacagaucauacauaugccacggauggugacuaugggacuggagaugggcugcaggaaaccccaggaucccuaagccccuggggauccaugcagcccuugggaauggacucuaguaacuaagaccuugggaauaggaagagugucauuucugcaauagccaccuggggucgcuagcagcacaagauuaucacuguuugguagacuggcugaguggggccagcccggagagucuguuuugaaucuaggaucugggagggugagaucugcaaaauauguauacccucaaagggugaagcucagucuucacugauggaucaugggcaaggccuggcacaggauuguggcaggagguagacuggcaugcuaggggcacuuaccugcauaagguggcccauaguagcugcggacauauguggcuucaugugcguuggguggcaccaccucauaguaguccugauacgggcuguagacgcguaccugagaaauccagucagguugaaugcccagggacuuccuggucugggcuugguccugacccuuucauucuguagccacccuccuccccagggcuaaagggaaaagguauggccuccccauagauuccauaacccuucuccccuaaaacauccagcucccaauaaugccuuuucuccuaccuuggccuucuauauugcccaauuuucccauugcucaacuuucuaagucuaacaauucuacaaugcuauucucagagaaacccaacugauuauucuccuagucaagggaagagaacuauggcaaagcccuaggcaugaauuagaggaggacuggagcaaaggaagaaaagaguagucacugaaauaacuaccaucuagcaucuacugcauagcgggucccaagggaggugcucccuagugucaccucugauccuucaaggcaggcauugcuaucuccauagcauccagugcuauggaugaggcacagagaaggugagaguccugccuuccccaucaggcuccuaccaaccucccagauucuagcucagaagcuacccacuauaggaagcccuccugggcucagaaguauuucuuccuagggucucuaacuuggauaguaccccuuaucuuuucucuuaaccuuucuggccuguucccccaaaugugugcuacuuaauggcaaggcccucaacuuguaucaccugcaagggacagugaugacaggaaccaguaauacaugcacgauuagcacuaacugucaauccaaaucuaccacuuuaacucaugggguagcugacuuggaaggggucagaaucuguucucuccugggacuccccccuagccccauucucacuguaucucucacuaggcuucacaccagaauugcccaacucuagaaguccguuuguguccaacuuaauuaauacaaauggacugugcccucccccucccucucugcccuguucuuccuguaaauguucuugucaugaacuggaaccaagaaaucuaguggggcugggcaguggugacacacgccuuuaaucccagcacuugggaggcagaggcagguggauuucugaggaaaaaaaacaaaacaaaacccgaaaucuaguggguaccauacuuaaggguuccuuuuccuuuuuacccccugaguguguguggaagcauguguguugguaucaggaccuccaaaaacccgugacaucacauagguaggacccacagaccuguugccaaggcaacauccacuauauucccagaauuggcucaccucucaccuuuaccuguaauuacgucaucacccauauauaaagaaaggccccccuggucucucucucucuuccccccuucucguucugcugccaccuugccccucucucucucucucccaauaaaccucacauggaacuguuuggccuggcauggcccuucugaagcugcacagcguucaagaucauaacagugugugcauguugaagucagagagguugcugcuuggagucuuccucacucacuuucggcuuuacuguuucaauaguuucucauugaacuuggaacuugcugauucauccugacuguccagcaagccccuagcagcccuguuucuucuccccagcacugagauuauaggagagcaaagcucuuuuuacauagguccuggggaucaagcucaguucuucauggcaagaacuuuacugacugagcccucuucccugcuuccucuacuccaucuuugagacaggguuuccuacggccuagcuugaccuugaacucacuauucagaugacauuaacuccugaucuuccugccuccaccucccgagugcugggguuacaggacugcacacugagccuggcucuagaacguuuacucuuugggggaaguggguguuagaugcauagcccaggcuagccuugaacucacaaucuccagccucgcuuucugagugcuaggauuaauaggcacacauuaccaaacccagcauuuucuuucuugugagguugggguuugaaucuaaggccuuaugaauguuaggcaagcaugugccacugagcaacaucucgaucucuuagcacucuugucuuugcauacgggcuuuucacaaggccacaaggucucaggauuuuaucuucuaaauaugcucuucugacaaccuauuggccaaugcugagggaguuaagucauuggcuuuagcauccuggacauuagaagugaucuugagggggaaauguacuucaaaggaaugguuggggacaagucagaccagaaaagacugaagaauccuuaaggaagacagggaaucaauauuacuacaucagccuucccugaugcugcauugaguugguaguuugugaggcucuggaguggauggaaaauacaaccucaugucucuuuggggcauguauuccuccuacccuccagcucugggaggcccagaagaaaacucagagcaccuagcaaccaguugguaaccucagagacuuccugaaacugaagccugccagcuucucuuauagcccagacccuccuaugggaggagacagugcuguccaaucacugaguuacacgaaaauaaccccuuggauguuguguucuuagauuuauagucuuucaaaucccauuuuuaggcauugcucauugaaguuccaggccucucugugaugaguaacagugacccaguuaaauaaccucccagagcaccagggucucaguaauaccuggagagucaggcagaacuacaucuguugacuucugggcucaguuguucugcaugcucuaaucacaaggaacuucacccauccccagugugauaggugggaucaacccagcgccucacacacgcugagcaugugcuuuaccacugagacacaacccuaaccccaagaguuagucuugaacaugcagaucaggcuagggguauagagagaguuccguauuaacagcaguguuugccuagcaugugggaggcuccauuuucaauccccagcaucacaaaaauacuugcauauaaauauaacauaguucccaggccccaccuaggacuuaggagauuccagcacgcagaggauaucaacauuuguugucguguaagucccuaagugguucuaaaacugcaucauugaguaagaaaagaguuugcaguugaccauuagaaccacaagcuccuauguuggcucacaccagaccaggugcuaugcugagacugugugcuggcugaucgucauugucacuugacuggacuuggaaccaccugggagaugcaccucuggggaugucugugcuguguuuccagagacuuaacuaaggaggagaggcccccugaaugggacagcaccacccuauggauugagguuccagacuaaauagaauaagaaaaugaagccagauggacacuggcauucccuucucggcccagaugugagcaagcagccucaaguuuccaccaccaugcuucccccccguggaggagcaugcccucaaacugaaccaacagaagucuccuuccuucaauuguuucuugucagguauccguccauugugauaggaaaaguaacaacuacauccuaaauccaagaaacacccaggacagggacagauccagaccaugucccuuccugucuuuccuuccucauucagugaccuguuuaugccagucccuuaugaaggggguaaggaaaaacuguccccaucacugagcacucaaugaggccaugcugugcaccgcaguccuguacugggcuucagcugggcagagcaaaugagaccugguccuugccuugaaggaaguuccaguuucagacggucuaaacagaaauaaaguggcucugagaccacguggaaugaaaccagugcuaaaaaccagugacagaggacuguacacugggugacagugccugaagcccugggaagucuucacugaggagguggcaggcagccuuugaggugguucuuuaaggaugagcaucagcuggccagcugaauggagaggcugaggguuugggcagcagggacagcaugagaguuguuaggaugaggggagaaccagaguagcagcagcggcagagggcacagcaagcacaagggugacaugugacaagcaagucuagccagauuccaugggcuugaaaaccagcugugguccaaugaggaaaggggagccauugacguccacaaacaugaaaggaaugggacagguggcuuuggaggcucauccugauggucagagaggaggcaggaagggcugagcuugaacuuacccagauccgccucucaaccuuacagggguuccaugagagggucguacaccugaccuuagggcaaacccgacggcuccugggugggacgguggcuccagcuggggccugcuccagccacagaaacccaagaagggagagggagggagaugucagaugcccuuuacaucuuaagagacuaggagauguuaccaggacccuaccagaguccugugccagcugugccugugcuggggacaucagagaggggagagacguauccuguuacccaguggaggaccaauggccuccuuccagcucgcccacuucagucucaggcacauggggaucccaggcuuuaccccacaacuccagucucaucugugacuguauccccaggagccuccucccagaaugggguacaggucacuccugcauuggcuggaggacagagaagcccgcagacacagaugugaacguacagaugcaaauacacaagcaaacacaagcaccagcucuaguaagccagagcucaaagggauauggaucuggggagcgaagagagggcacuucuagggccaggcagagguaaggggucaguagggcaggcagguguacagguagggagaaggcaggcagaaguaaacggucaguacagcaggcagagagggagcaagacagcuucauagagucacagagcgcagaacggucagcccucaccuccuuccucacgcuguccucaaugccacugacacagagggcuuuggcucagagggugcuuagccugaccuggcucccucccuggugauucuuguuccuccuccuaggcuuccugcaaucgccucccaccugagaacacaagucugcccccaauaucugacugugacccucaacugcucugauagccuucccaaaaaaaagucucuuccuuccuaagcuggcccugaugaccuuagaggucaucgcuccagugccacuuccuccaugguaaaccuuccaaccaggccagacugcagccauuaggugcacacauuagcaagcauacacaucucucuucccugccucugcucauguagcuccuccuaccaacgccagcuuccucacuacauccacuaaccgagucucugcugaggcuccuccaacaacuuaagauugugauacggaaggagccaccuccaguccuuagaccucagcuucccccaucuguaaagugggacugauagcaccaacuacaaccaucccccaagcccuuguuggaggaugaaaugacauaaccaucucaugugcuuggcacagugccuggcucucugcagguggauauacccaggaggguuucuaacugucuucucugcugcuucccagucgacacucucuccaggugagagaggucucagcuguuccacaggcagaagcagcaaguguggagucuggagucugucaggugggggccgauguugggccucaggcaauucuucaaacucucaccuccaccagucucuaggcacucucaccugcacagcccaaaugccugugcuccccagccugucagccagcgaggcuuaguccacacccacauccuguugccaggagacuggccccacuuccuagauggucccuggguauucacacuuaaccccuuacuguuuguuccuaucuaccugccugcuagccuuuuguguuucuuuuugagacaggaucuagcucuaugccccaggcugaccccaaacguuuaauuguccugucucagccucccaaaugcugggauuauaaguacacacugguuuguaauagccacagaccagcuuuuugaaaauacaagucaggagcugggcaaagcagaggcaggagaaucuccaagcuccaagucagcgggggcuacacagagaaaaccccagacucagaaaaaccaaaccaaaccaaaccaaaaccaaccaaccaacaaacaaaaaacaaaacaaacaaaaaugucugguacugugagguuggcucaguuagugaagggcuugccuugcaagcacaagaacccaacuuccauccccagcauccaugugaaaaucaggcauggcuucacgugcccaggcccagagcuaugacagcaaacccaggaggaucccuggggcuuguuaaccagccggucuaaugaaacuggugagucccggaucccggugaguagcucugucacaaaaauaaggugaauggcuguuaaggaacaacacugagguugaccucuggccuccacacaccugugugcacagccacuaauacacacgcacagcacgcauacaaauaaaugaaugcaaagacuguaaaagacagagcugagcugaccaguccauucuugccuuucgcuuccaaacugucagcggcuuaugggugcuguuagcggcucccaggauccuuaaagcaaggccuggcaguucaugcuuguaauucuagcucuugggaagccggggcaaaaggaucacugcaaacuugaggccacucugggcuacgugaugaguucaaggccagccugcacuccaaagugauacucuaaauaaaaaauaaaagauaaccgauauucuuagcacaagacagagccucaacucccagcucuccuccacacuccuugggcuucaggcacacugcugucuuaacuccuuccagccuuugcacauucuacucccucuuaccuggaaagcuauuucuuucaccauaaccccaccuuucaccccauuaugucucuccugcaagccccaccuucaccccauuaugucucuccugcaagccccaccuucaccccguuaugucucuccugcaagucccaccuucaccccguuaugucucuccugcaagucccaccuucaccccauuaugucucuccugcaagucccacccucacccuguuaugucucuccugcaagccccaccuucaccccguuaugucucuccugcaagccccaccuucaccccguuaugucucuccugcaagccccaccuucaccccguuaugucucuccugcaagucccaccuucaccccguuaugucucuccugcaagccccaccuucaccccguuaugucucuccugcaagccccaccuucaccccguuaugucucuccugcaagccccaccuucaccccguuaugucucuccugcaagccccaccuucaccccguuaugucucuccugccagccucagguuaagcuuucagugagcucacaccuggaucacugaaaggcucacauacugcacaguccugccagagcggugacugguaucaacauggaauaauuaaccaauuaguuguuuuauaucuggccccuucuagacugaguacaggaggguagagccuacaucccuugguuuacuucugauccccugaccccuggcauggugccugacacacaguaagaacccaauaccuaucuguuauguagacaaaugagccucagucuuaccaucugcagagagggaacaauaaccucacccuugaaggauugugcugaguggcaucauaucugauaugugcaucccucuuuucuagcucccguguaacccuccagugaggcuucaugguagcuucucucccuacuccugggagcaccugcugacuccucccuucuccacaggggacuccaggggagagagucuacaugaacuuuuccacucuagacugaaguaauaggcagagaccgaaucugaucacccaugauuccauggcacauggggcagcgggguggggugggggugugugugcagggacucaccgggguggaauuugccuccaucagggcagucuuccaugcucugcaaagcaagauccuccagaugaugagcgauuugcaggguacguguauggggaucccaccuuuuagcuacuccucccccaccuagccccuaguccccuuucccaacuucagguagacaaagcaacucucuauugcuauagucacauggaugggcccugagguaagcuaauaacucguaguccagcgaacccuucaguuauccuaauugagcuggggagggcagggugucucuucugaaccuugcacgucugggugauacucugccugcaacccaccuccguguuccaacuugcacagcuucacaaagccaugacccaagccucaggaaugcccagaggauacaggacaauugggccuuugaugguugccauggcaucuggcugggguagacaaggcagcucuaugcuguugcucagagcauagcugccccuccacccacacacucaucucuuuccuucuccuccaggacagaggcccagcugcucaggcugaggguaggaggggaaagaguguaugggaauagauggcacugaagaagauacccuugucuucccaggaugggcugcaccuaauaucagggugcccugcguagacacugccuugcugaaggcaggucuaggccuaccccccagcucagagucccauccaccagggcagcucuuagagggucuucugagaugucacugggcaugucagcuccuuucuaucagccuggaagagggaucacuucacaggcugcaaauuaucugauucuaaacguccagagacccagcaccuauggcaggcgugccuccaucccugaguucucuggguaugcaccaguuaccaacaguuaugcuguugcccucugaucucuucuagcugcaccccgagaucccacuccacacacccccugaaucugcuuacauggcaucaucccgggucucagcgcacaggugcaggcgggaacccucccgcagguucacugucagcaggccaucucggcuccugcccucugggggcugcacaucuggaagcagacacacacacauggggaucccagagaccccaggaaaccacacacaguggcagacauugacuucuugggguccuguuugcuagucauuguuaaucccuuauccuacauacuuucuugggggucugcuguacccugcacacccugucagccuucccauauuacuuccuagcacaucucucaguuacucuacuauggccuaggucgugguugaaccauuagauuagcugagugacucuaggccagucauaccacuucucugagcuuauaucaucuuccucuacucucuagaaccugcagguguuuuaucuggaaccaccuauaagagggcacagcacaggguaagaacucaaccaaggaccagucuuaggaccaaucucuuaaugccuagcuaacugaccuacauuuggcaggagcucagaagcaguguuugugggagcucucuggaagcacccaagagccuuccaaguacaauucuuagacauagggaagacccugacuacgggcagaguuccaccaaagaaacacuucuacucacccugacacucuuggccgaccuuuaugucucggacauugaaguggaugacuacucgguccuccucguccugugccgucucgucaugguaguaacccagugugccauccaaccacagagcgaaccaauuccgcuuccagcggcggaggauggagccugcaugagauuccggauccaccagagaaacugagcccugagcuugcuaggagcaagagccccaguugggcucccagaaucccuucagcucugggucccauuacugucauuucuuuccugccucucuacccucuaaaaugaggacacggccucucuuuuucucaucucuccaccaccagccugacacacauuaguggcucaauaaaaguguugaacuguaaaagacaacucauacuuaugggagcuuccaagacaagcccaagccucuucaaaggcaaacaccucucccugcuggaagccucuaucucugguuugagugaccgucauuuguauccucucugacucuugaaccagauuagggaucugccccuccccaccugcgauccuaaaacugaguaggaccugucuuuggugucugccauacuaaaugaacugagaauggacaagggcaaggaacgugagggcuccuagcccaaagaucuccaagauaguagccccucuucaguucauggcuuugguuaaaugggggcaggggugcuguagccacugacucuaggccuugguucaaagcauuagaggguuucuuaagcaagguguggaggcucacgccuguaguuccagcacucagaggcugaagggaaugcaaagcccgucuggacuacagaguaggacccacaucagaggaaauaaauaaagcaaggcauggugguacaugccuguacucccagcacucaggcgguggaggcaggaguucaaagucauauuuggccacacaggaagcuugaggccaacuagggcuacaugaaauuuuauauuccccgcaaugcgucacaaacuccccgaaagagggcuucuagggcuaugguucuaaaguagagcuguaucuuacucugcucgggccguggacuguguccugccuggguuggggcugcuaugaacacacagggcaucaaacuuaucuguacccugagggauguacaguuagagucuagggccagcauggggugaggaaggggcggggguaggggaagacugacagucaaaacaguuguguuguaaguuagagugggaacugagaagggagccucugacccagcugagugcuaccggggcagagaggguuagaggaacaacuagagagggcucaucaaagagaaaccugauuggucuugaaguauacaguuuugcuaaauagucagaaaugggaagccagaggucuuggugcaggggagaaaggucccgcccaccaugaugugugggacacacugccucccuccucccugcccagggaucaggugcaaggcagacaaggacuugacccagaaucacucacucugucuccacagccagccgccccucaccagggccauuucuucaaaaggacuuuccaggauggagucggguggaaccugucagaggagccaggacacacagaccucacaauucagugcagcuccugaacgagaagccccccagcccugcccucccuagagagucuggaaccacucaaggcugcguuaguaaacaaacaggccaggcaccgcuggcccccuccuaaggcucugcuccugcaaagaauggggacacugucccaguagggucagcaggcagccacccaauaggacagggaguggguggggaugggagcccaggccaggcugaguuccagaaccuuggcaaggcccuguuccaugcuccucuggccugaaugaggcagguaaaggccagaaugaggaauuuuuaauguucauaaaauguuagaaaauggaauuaggaaaugggaacaguacaaagugucagucagagcaacgaauuuccaugacaggaaaagccuuuuucacauucggacaccacaguggccauuuuugaaguacaugaaauaacaacuaugcugcugagcaccguucgcuugcugcccuugucugccuuuaccugcuaucucacuugagcuuccuauccaucuuugccuucaugacuguuucaaagacuguguggaaacgggcuuggagagggccaaacuacacagaaccccuuaauuacaaagcaauggaggcaggauccacacccagucacccgggcuccucuccgagagcuuuaaagagacccaauggcagucggauguaguuggcauaguguuuaauccuagcacucaggaggcagaggcaggcagagcucugugaauuggaggcuagccuggucuaccuaacaaguuccaggccagccaggccuacagaguaagacugucuuuaaaaaacaaaacuauccugggcagugguagcucaugccuuuaaucccaguacucuagaggcagaggcagguggauuucugaguucaaggccagccuggucugcagaguuacaggauggccagggcuauacaaagaaacccugucauggaaaaacaaagcaaccaaauaaaaaaccaccacacaauaugcaggaucagguuggcucagaauucuaacugugaagguggagacaagcacugcuagucuuuaaggacccccagguaaccccaaaguuugucaguuaucgcaaaccuccacguccccagauacccuuguuaaugaagaccuuuaagaauacuuuacagguggacgaacugagggggacagggacaagugacacaucccuguaugugacagaguucagacuggaguugaggugucuuccuucucuuauuaagaacgacuuauuuaugagcgggugacccacagcccuucccccaccugcucacaccuguugcugcgcaacuagggcuggcacaccuagaguagaagccuuggccucuuguguuucuccgcuggcucauuccccucuccaagcucugacguagaucuuacaagagggucgaguguacaaucccucucaaguuccccucgaugcacccaccuguucacaccuguuguggauacugcugccacaaaugcccgcuacucgaugaagcugcuacccaaaccggucgcaccugcgcucugcuuacccccagagauccagaggcauuucacuucccaggcacugcgcagugccuggggcauagcuccccccggggccccgcccuccagacccaacucacucccagggagggggcguggcguggagaaauucaauaaccgagccaugcugggauuuguagucugcaguucuacacugggcagaagcagcccggaauaacaauccugugcugaucccagaagaaguaaguaauuuuauuuccuuccucucuuuuuagaucugccuauauuuccagggcuguccucaaaugaucugcugggcagcugggacugcagauguguaccaccacacucaauuuauuuuucuauuacauuuauuuguucgccuauuuuucagaaaauacuuuuccccuucuguuacuagagauguauuacagguucugcuaaaugccgaucuacacuccaucccugacauaaaagacuuucucuuguagaacuguguggcuggaggcuuggggagauaccucagucgguaaaguggugcacaaggggcggaguccagauccccagaacccacauuauaaaagccaggauggcaguccuggggaggaagagacaguuggaucccuggggcucacuggccuuccagccucaccugaccaugaauccuaagccaccuugucucagaaaacauggcagauggcuaugaaggaaggguggcugugcacgugcacacacaucaucaucaucaagagagagagagagagagagagagagagaggagcuugaagccuggcuuguaaucuucaagagacaaaggcaagcacuagaggcaggaggaucaucaaaggucagcagucuaagagagacuucccagaguacauaaugagcaucucagaaaacaaaaacuuuuagagggaaaaauaaaaacaaaaaauguauggcuuggggucucaagccggggagagagagagagaaugaaggaaaggucaugccccaaagggcaauagacacguauagacaauugcuggacaaacugccccugccccgggauacccaaggacaaggagcuaaguucagccgaagcugggccuggguguacagaugugcagucuccagguaccugguaggcucagacgcaagagguugagggcuagccugagcuacagaaugaacucaaggacaaucuggccaacuuagaacccaucucaauuuuuuuuguuuuguuuucuuuuguuuuuccagacaggguuucucuguauagcccuggcuguccuggaacucacuuuguagaccaggcuggccucgaacucagaaauccaccugccucugccucccaagugcugggauuaaagguaugcaccaccaccgcccggccugucucaaaauuuuaaaaagaaaaaaggaaaggaggaggaggaggcuggagauauagcuugguguagagggcuugcccagcauugguggaacccuaggucccauuuccaguacugaagcaaaaacaaaaacaaaaaaaagccaauuuccacugagcagguggcuggccugaagccacagcuacuuuagagucucagucuagcaaugagucucaaccuucaaaugcugugagccuucgguacagguccucacauuguggugaccccaaccauaaaacuauuuaguuacuacuucacaacuguauuuuugcuacugcuaugaaugguaauguaaaugucugauaugcaacccccaaaagggucgugacccacagguugagaaccacuggucuaaaggaugcuucaggaccaggagagcccaggaauucaaggccagccugggcuacacagcaaguaucccaauaauaaugaugauaauaauaauaauaaaacauuucucugggccaucaagauggcucaucaggcaaaggugccugccaccaaaucugaugaccugaauuauaucccuaggacccaccaagaggaaggagagacaaaaaguugucucugaccuccacaaguguaggguuauaccugugcacauccaugcacauauagagauaaaugucauuuuaauuuuuagaaguuugcuuucagggggcuggagaaauagaaguucagagcacugacugcuccuccagagguccuaaguucaauucccagcaaugacauaguggcucacagccaucuguaaugggauauaauucucuuuugaugugcaugaagacagaucacucauauacauuaagaaaagaaaaaaaauaagcuaggcaugguagugcaugccuuuaaucccagcacucaggaggcggaggcagguggaucuaugaguucaaagccagccuguucuacagagucaguuccuauauagccagcuagggcuacauagagaaaugcugucucaaaaaaaccaaacaaaccaacaauaacaaaaguuuguuauucaaaauguaagaguggccacacccacaguugccagagacauuucugauccuauucagcaacuuugugcuuccaaauuguauaugaagcucuauuccuucucagugaacaacuagaaaggaaacacuuacaugaaccccaacagacugaacauccuugucccagcccuguagccguauccccccccccaccccaaggcuaguccuauguaaagaacccaaguccuuuacagacugaagaaaauaauacucucuggaaacaaaaauaaguggaaauuaugccugaguaggaaaaaaaaaaaaaaacagagugggguggaccauauuugggaggcugacacagcaggacugggaaaucacagacuagccuuggcuacauaguaaagccagacugggcuauauauuagauuccucacuaccacuucacaaacaacucuucaaacaaacuacacaucacaacacacacacacacacacacacacacacacacacacacacacacagagugcagagagaagccaggcuccaucccgguuucggauguuagcguucucuagcucuguaaagcaccacagugcuauaacgcagcauggagcccucccaauacaacucuagcuaccagucuacuggaggagacuggaggugaaaguagccaaugcaaagaguguggcuuacccaggaggaagucgcucuuugcccaagggguucagaaaggcuuccccaaggaagcugaggggucgugaaggggaaguaacauuuccccaguguggaucaaagaaccucacauaagcacugcuggaaaguccaggucuuuaguaggcuuagaagaugaaugagggguuggggagaagauguggguuggcaagggauagcgcugcagaggguaccaggcuagaacaaggacugggaggcaguggaccguguguauagugacugccugggggaaauacggucaaaacaggggguuaggucauaugauuagcggguuacaugguccuguccccuggauccgacccuccacagucgcuacuuugacuagcucaguccauuccccaccucugcaggagcagagaaucccagagaccagggcauuaccuauuugggaagccccccccuuacuucuuccuaccccagaaacucguccuuaccgggguugccgggcucaugguuccugauggucagagcugcauccccaagaagguuccagaaguggggcuugacucugccuuagagauaaagggaucaggaaagagcuaccaagcaggcgcugaagggagagguagggagggaccgcaccaguccuaaagaaagucacccucuuuuccagcccccucccgggcuuuccuggcugagaucuccucuguccuucuguuuuuggccaagucaccuggugauuccgaggugguguugauccaggucuccaagauaggguagggaggaggguggaauaaaggagacuggagauggggcaaggcagguucucuggcccaguuuagggcagggcuaaguuuucauucugaggccuagcaggcuguguccaucuccaucuccccagucguggcugugcggccuggcuccuuaagucucccuucuuggcuccccggucucuuuaaucuugacccagagccaccccagugcuucagcc

SEQ ID NO: 3965 - RNA, 17602 nt, Mus musculus
aagccgugacgcgaggggaggggccgcgcagcuucccggccaggccggcgauucauucaaaaggcgcgcaggcugcgcggccggccccgagcgcucgccuagcggggccccggcgccgcgucggacgcugagcgaagcuggugcugcgggccagguaaggagggugcgcacggcccucagccccgcuccgcugcuccgaggaaguucuccugagcggcggaugcgucagccccgcucuccugcccagucccgucccauccuggugcugucuacgcgucccggagcccccgggcugcgcguccucccggcaccgcgcgcggcgcagucugucagaaggugcgcgagaggaagcagcggaacuuggcgugcaaggggucgggggagcccgggaaacuuggacugacaccaaaggccggcugcgggacgggacggcggcgccucggugcggcugcagcgcggggcggccgggaaggggggggguguucugaacggugucagccagugacugugggugacacggcgcaugaggcggccuggcccgggcgaacguguggcugggacacugggcggugacgccgagccuagcgggcgacacagaggggcucugugugugaggcaggcagagugugugugauuguguaugugagagaccccaggucacuggggucacuguguguggccggccuguagugugacccgggcuaguugugaguauaagguagaacagaggaacccuaaauaacuuaagcaagcccugaaucacggggucauagggugcaugugggacgggguggggggggagggaggagagagagagagagagagagagagagagagagagagagagagagagagagagacugucugccugccugccugccuaggauagaguaagacaaggaggaaccugacaccuuccaguguuugaggggccaaggaagaucaggagucuagggaauaaagaucucucuccaagacacccuuagaguucaguuuagugaguuugcacgcagacaugaccuagcagaggaagccagaauugggugggcuagccccucuggcacagagaagaccugagguggucucagucuccacuccacuccacgcucacacacacacacacacacacacacacacacacacacacacacugaaguccccaacaucuagcaaggcacuguguauucuguuuugugaucagaucuaccccugcuaagccucagucucccagucugcagagaggugugaauagccugugaaucaucacuuugggauccucuauuguuuuugggucagucuucuccauucuccucuccccuccagacagaaagacugcagugggggugggggcaggcgucugcuugugacacaauggagugguccaagguucccauguguuggugaacaguuggaaacagucuugcucacaguuggucaagaagaugucaggcucccacucaaaagccacuggcccuuuagauacugaaaccucaauccaaagacacuucucuacccaggucuccuuuuucagcccccugguuggaaagagagggaauauuuguucuccggcaaugaauggucuguucugaucuggucuuggaguucuugcuuggucucuggaaaaggccauucugagacuccugcucccacaagaggggcagugccucaauuuauguagaauggguggcaucugggcucccuagcuccagagguggcaguagcgaugggguaccacaucugauagaaguaguauguggagggucuguuuuuggugacccucuggaaggggggcuugacauuggggugggggacagugacaggcuuuccuuuaaacacuucauaaugugcuguuuuguugaauccuuacagcgguucuaagauguggugacucuuagaggaacugaggcccagagaaccacaguggcuuguccaaggucacauagacucaggacagugccaggacugggauucaagccugccugugaggugcuuggagaggaucaccacuuuccugguaguugcucuuggcauaucugagcucccaucuaucagacuugggcuggcaggccugguaggccuggcacaggugccccaauugaguuuguagugagauucgcaugcccacguggcuaacaaauugcaagugggcguuuuuagucuucuuguuccuucuccgccucugagccagagaucaccaggaagaccuaucuccugccuuuuagagccugcagcuggucuuggaaacauguauccuggcucugaaguaucuggaguagcagcacagccuggggugcaaggauggugaccuucaucauacuuaagauguccccaacccccuaucuuugacucucucauuugcugugguggagagcaaauggagugaccuugugcuuacccuacccagucugggucucugucuccccauucuucccaacaacucuuucuaauucugaucauugcugugcucagccuagagcugaggcuggggaucagggugucccucaguucucccuggaaugacuggagcugugcuuuuggggcugaugaaaauagcugucuuggucuccaggggcugagcccaaguuauuuccauccccagcccagagguagaaauagcucagggccaggagaaggagagaggggagaaggguuaacuaaggguuaaucuucccuucuggcccagccucuguggagccccccagcucuacuguaugccccacccaagccaaaccauucugggaacuugggccucuggggaugaaaguggggccacgcuggguuucuauuuggugugguaguugcuacagggaggugccugugucugccauugguaggaagcauagaggggcccaccuuacagagccagcaggcucagccccuccauauacugggagagacuaguucaaagaaugacagggcacauagccccuagcauugcgggcauagcucuccuguccacuuuccaucuugccacuugaucccuggacgcuuggcagcaagggcagcagguucuaucacagcuuugcaaucuucugccccaacuuuggcuuucucuguguguccagcugcuuuuuuguuuugguuugguuugcuuuuucaguacuauauggauugaacccagucuugcacaugcuaagcugguagauagagacagcagucagcauuacaucccugcugugugcucagccccuaaggcuaucagaucuuugccccuguccuccagacaguccucagucuuuguagacauaggcaaggaaaccaggauucagaggagaagacauuuuagagacccuagugccacuggaaucuacagccaggucuauggccuugaagcucagacuucuuuccugagccacccugggaaagacgagcacucuauaaauaaacugcccaugugugccugguugguuagcacagcuggagggggauggagaggcauuguguggucaauuagaggcaggguccgagcgugaguuuggagaagggacuaaacuuggcccugugcauccucagccaugagaggggacugagagccuaugggcccugcacucugcuuccuugcugcucccucaggcagccuccucaucacugggaagggucaaaggagccuagaacuuauggcugaguggguccuuucauaggaagacuuccugaagaccagaguggggcugggcucagggcuacugguaaagaguugcuguuagccuguguggucuggaucuuacccacaccaugaggucagcugaguaggcacaauugccccaaguuauggacugcaugugaacgguugaacuugucugcccaguccucuaccuuccugacucuguagucucaguacacacaagccucugucggguuccucacagcaugcuuucggcacccaaucagccacccuggauggccuugacuggacacucuuuguuuugagccugaguucaucugugacacuggagaggcugugcugugagaacgugcuucuuggccaccauugcuuaggugagaucccaaauauccacauccuaugaggcccugaaucacaugagagguuaaguaacuguucaaggucacagaucuacuuagugacagagccagagcuucagccuagguggacugcuccagagccuggucacauaugccacccagaccucagcaccauaccccuggguagggccucauuccccagcacccaagccuaaggaauuggagagugaacugcaguucucugguuucuccucagucucucccuacauuucugcuccagucaaccaacuugggaugauggggucagggcuuaugcugagcagucucuagaccauccuggcucauuaucaauucaaugcaaaguggagguguguggucagggcuguagccaagcugacuucugugggggaggaguagcaaccagaauaagggaugaacugaguguuuuucagcaccuucugggcccugcuauccugucuuauggccaaaggagguaguccagguauggccgugguucuuaaagguugguguggguuaaaucaggcccuugaaagcaguggagugucaggugugggcgacaugggcaagagcugccugcugcuugucuccucuccaggguugguaagcuggguuaccuuccagaccuguuuccuuucaaacaaauauuacauaaguuuguuuacucuauacugacaggguggugguguggaagucaggacaaccugcugcaaucaguuuuucccucccaccauguggauucugguaauugaacccaggccauuccguguugguggcaagugccuuaacacuuacuggcccuagaccaagcucuuacagguuacucaacuaccucagccuccuuuuugcaaguauggaucauggaagccuguguugagagauccagcgagacucaggcuggagagggaugggacaugugagaggguccuugggaaaccacagaccuguucuaggggugacugccuagucucagacacucuucucgaucuccagacuugucaggagggagaagauugcauucauuuccuacucagacuggaggagcugagagccagaucuggcugccucagcccuuuccuuagccuuaaggaggcaauuagcccuuucagccccuccugcccccuuaccaccggagcugcugaaauguaggcccaguggcagccaggagggcugaggaacagaaccaugcccaguuccugcugcuuggaagugugugcggaauaggacucugaggguccacacaggagaacacucuagugugagugaccuacguaguuauggcugcccagaacuaggaagaaagcagggaguggggugcccuucuuuuucauaggcucuagacagcuuuuuguuuaacucugggccuucagccucaacagcagcucuggaagcugcucuuccugccucugggaauucccagauuuuccaucuucuugcuuccuauaguuugcagugcuuuucuguaugaucugguacaaauuagcacacucuacaaauaagcaaggugcgggccguucucagaggcccugaggcugccagguggggaacacacaucuuuugggcauugccuacaucuuucugguaaaccuuaaguugagcccccuuccacacacgccuacacuagccuuccugcuaccagauuggcaagcacucuugaaagggccugccugcagagucagaacuaggcuucagaguugggaaggcagagaugaggcaguucuggccuccaucccugcuuuaguacuuacaggccaugggacccccacaggugacuucucucaaccuguuagcucaagucugaaagggacuagucacgucuaugggaauugaggugagccagggugagggauaguccccaguugagguuggcccacuucuguuagggaagccagcagugcuucgcagccuuaacuagugcccagugugggcacugcccuacuucagccccaguugccagggaaccacuggguccuuuacuaaccuggauuucucuauugauguugcuuuuguugcugccuggugcagccacugcugaggaaggcuuguguccagcuguguuuccaggcaacccuugccucuagaggcugcagagaaggccacgggcuggaaagcagaaucugccuucuuaccugcccuaccccaggugggcccugauccccccucccucucucucagugcccucacuuggcuggcagccuagcucaccugccugcccagaggcaaaucacucaguguuuugcuuccucugcuuaacucuucgggguucccauaggcucugggaaaaguacaagcucagcaugaccuggacucugcuugcagucuucccagacuccucuccugcaccucccaccccuaccuuacuaaucacugauccuaaguacaaaagagaaccuccccgcccuucacacuuacaggucagacaugugcauuuccuuuuuaaacauuuacacauggggaaacugagucaugguguaguguaguguguacuugugaguguguacuuacucugugccaguccugcugagaacuaaaugcgaauucucuuuucaugcucacaugaguccucuguaccggcuccauagccucacagacagugaagaacaggggagggcaggcuguccccagguuagcagacggcuucagaaccaaguuaagagaaacccugccagcugggcagugguggcacacaccuuuaaucccagcacuugggaggcagaggcaggcagauuucugaguucgaggccagccuggucuacagagugaguuccaggacagccagggcuauacagagaaacccugucucgaaaaaacaaaacaagagaaagccugccucuagacuccuuuaccaguaguguguguucucucuggcccaccuucucuggcauaacuaauccagucuacugaagacauuucuucugcuucucaucuccaguacagcacacagccagcguagcccugggcauaaaggacagcuuguggugagaaagaggcugggcaaauggcaccauagcuaaggggagguagugguugggggaaccuccaggaggaagugacuuugaacuacacucuggaggaagaguagguguuggccaaaagugauaggagggguuucugagcagaggaaacaguagguaacucaucucugugacuugaaagaagcuucaagaagcugagaaagaaaccuaagguggcuggcguaugugugcauauuuguguaaggagguuuucagagguacauggggaagccauacugagggugggagagcugacucagggcacacaaacaucugucaggacaccuaggcugcagguacuguuaaccagaggucagaagaagagggcagaggccucgggagaucucugggaguaugcuaggggggcgguggcugaggccagggguaaacccacagcuucaguucuaggaaagaggaagcagccuaaggcugggggguggggggcaggcagggcaagcaguacaacuuccucuuucugagaccucuaggacccuccucccuuggggaacuucuaccgcagcuucuacagcagcuuggauccugcuguagcuuugcuagcuggcuugcacucaaggaauuucuguucucauuguuugggcacuuuuguagagggcuagguuuuuuucuuuuaaaaagccccccuuuuccccaggcucugagcacauuugguagaggcaucgggucccaugccuggguuaggugcugggcuuuguggugaguaaagcagacccccugcccugacugcugacugcugucugcuugggggacaugcugugaacaagcaagccaacaaauacuuaaugaccaccccacgggguggggggaggaaauccugugaccagcuucaugacaggcuucugcacaggagauaaacaacccauccuguggaugaggaaacugaggcuagggaagccgggagcucaagagucacaggggauuaguagcugugaggaugcucagggcuaggagauuuggaggaguggccuuugagggaacuuccuucucugcuggaacucugccucuucaacuccguguggcuagagugccucuccuccaucagguacccuggagcuggaagggcuuugugggcauuaccguuuacucuugggcugcaguguucccauuucuggcaucugucuuccaggagguguuaggcugugggguaucacugaguguuuggccuucuagaugagagaaguauggagaagggcucuacugaccccuccuagccuaggagagucugugagcuuguuuucccauggguuuccagggcaguguuucggauccuagaggacugggaggcagagacugaagcagcaggugugcacacgugugcaugugccugagcaggcagaagggggugggaguagggguucagucugguuagagagggggcaugcagccagacugcaguaagugccagguuugugguaauuagaaggugcauaauuagaaggcagggggugcugaguggcgggcggcugcuggugaauuugccuuagugggcccacuauggcuuggaggcugggccucuggacccucacuuuccuccaggaagucuccggaucacuugguuucuggccugucugcagaugaacagcuuuguggccucuccuuguggcucaggucacucaguagguacaguuaggguccggguggucuugggccuuuugcaucugggguuuuaccucuuacuuuucauccguuguccuagcugucuaaacuuccuggggaucugaagggcugcuggggcuaggagcaugcuguggagacaaccugaagacuugggguuugugguuaggucugugguggugagauccuuugaagaacuggagaggccauaggacauggccuugaggggacacagagccaggguagaguuaaaaggcacuggugcagaaccuggaaggcaguuuucugaccaaauuuaaggaaggaaaggccaagggaugaguccggagugcaccugcugaguguugacugccacauguggccuuuaccuacucuggagccuggccuucccugucucugguuuuccccuuaguuggccugaggcccaagaggcgccugcugccagugaccuggagagucccuggaugaugugauggcagcuccucccccauccccuggguguaaccugaaccccuggcccugcuaaggucuuuguggggccaggcccaggucggguggcagauagguuuccucugcuccacucuuauuuccagccgggaagccuggcucccagcagaaagggggcucugugaccuggaacuuccugcaaauaauaaguccucugucaggcuuggcaucaagcauccugugagcccucauccaaugguguggaggagcgcuaggccugugagcacccuuggguuucagaaguugcuaauagcuuguauugaggcuugaugaacacccuauccuagccuaugacccugaagccaggucucugggaaauacauaugaacuuucuguugucuaaucugaaucuuuucugccacuccaaccuugucuacuagcuagagacugcucuagagguagugcugucuuggcaucaaagggagucucacucagccuggggccagugggcuggggagcuggcauugaugguucucugaaacaucucagaguguccucuguggacuuugguguuccuaauuuccuagugcagaggcaugucuggcauauaggaguugcugaagaggcuccagcuggcugaaugcuagcuauggugacacucccaggucugccaugacacaugggcaggaagagaugcaagcacauaugcccaggccucccugggagaaguguagaggaggaacaggugacagagcgagaaggggugugacuuuuagaaguacuuccacauacaggccuuugagcugggcgugaaggauuagggccuuccuguagcagaaccugcaagaauuaaggcagugugagaguggucugggagcugugggaaaccgggcuagaggcaguagccauuuuaagcccagcucagcucuuccccagcuucuuuccucuuggcccucucugguuccuuucauauaccuggcuguauauggaaggggaaggaagcacuuccuccucugggaagccugaacuagagagccaucagcuucccuccagucucugccuguaaggcuggcccuaaacaugucaguucuauuucugcucagaccugcaucccaccaugugggacaaaugcuugccuagcacccagcaguaguucugucauugugaauguggccaggagggagacagcagcugccugccuggucuggcugcucuccugagcuuccuuuaucugcccuaggucaaugucacuccagggccugaugaugaagcggaccuugcugugcuggccccugucuugccucuuuguggugaguuggggaaggguccagagaaacuagaauaguuggaaucugagcaugcaaucagcacuccaagaguggggggaaugcagguccugcucugagccucgggcucuggggaacuuaaaugcuugucuccuucugggaagaauucaaggccuucagaccugaugaagcaucuacuaguacuaccuggcauucgguagugaugcuguagagacagacacaaucucuucuacucaugacauccaaaccagagaauagagcuuucccaagcaauucauauaugggccggagggauuuccuagcauuuucaggcauggcaagagggcaaggugcuugccuccugccagugugggacagguggaggauagguggggaccugaaagaaauugaauaacucaugaacuggauguaggcccuauauuaguugaaggaagccucgauucuggggcuagagucagagcaccuacagacuuguagccucaggcagaucugaggucugaucuguggugaucuuucugcuguaauucuggacucaggaagaacaagccaacgucuccgagagguagccugcagccuuagcaguuguugggagccaggcugacauucuaccuucaggguaacuggcccuggagcuuccuagcccuaguagcugcggccaaguuggaggacagggcuuucccacaguaggagucagggcaagcagugcauucaauugagugggaagcaaagggaggccauccaagaggggcuagcaguccauaucuagaagagcgcuccuuuggaacguggcauccccuguuuaggugcaagguaugaaugggguggccuuggcacagcggaggucacagagaaggauguggucucagacucagcucugggcccagaauaguaagcaccagcugcagacuuggcucuaggcaugauaaacagaggggaguuaaugacaugcucagcuucagggugaggggaggcgugcagcagaggggagacaaucucagaggaauucggaagcauuuccuccucgucugucuggggugaggagguguaacucaucugaaagggcuguaauucagaggcucaauggcuugagguccugauccugucuggggcuuuccaguauuuuccagaagcagauauaauucucuuuacccagacacuggcagugcagcagaacuggcugaggcaggccccaaagccuggguugggagccuguguagucugcgauucaugcucuguucaggaaguagguagugagcagaugacccugcaggccccauguuuuaacauugucuuccucugucaccauguccucuguuccaccugcauucuuccagcugcugcccuggccucuggccacuccaacaccaauaacuccuuggcuguguccaccuggcaaagagccugacccagugagugaugugcuguccugucccgggaugauuccugagggcagaggggaggccucggccuggaugcccaggggcuucuggccuggcuucaggcuuguaaucuccuuccucucccacaggauccaggacagggcacauuaugcagaacuugccccccaggaaccuuuucagccucauggaacuccuauccaugccagccucauuaccgaugcagccuucaaaagaggcuggaggcccaggcuggcacagcaacucaugauacaauguguggagacugccagcaugggugagcacagggugaaguggggcuuaugcuggggucuugucccacugcucccucagugggccucuuuccaucugugacauggauagggggaccguugagggcacuugguaggaaggaauccaauuuuuccuaaggacagguuuuuaucucuggaccucagugacaucuucccucccugcaggugguuugggccacagggaguuccucauguuccgugucagccauguuccaaggcaccuccaaguacugguggcugugauggugagugguagguggugggguaggaaaggaagucagggcacuugagccuaggagugccugcagcauccauguagggaagugggguccucuuccagccuauaggggaacaggcagccagaaaucguucagcaguauauggccagccaccuuccugaccuuugaguaguagagacaauccagcaucaggcagcugccauuauuaggaucagaguucauauccuguucgguccuauugucccuauccuuucuguaagaacccuaaagaugcaugagccagccaccccuugaggcuauuaacucaugugcucuugugagaaggcgaaauccugugucccuuugcccaggaguguaccauguauguguaucugccuguuccauacacguguaugaggggcagauguaggcugaggcccaaggaagccucacuggauagucgacuggauggacaaggaagaguggcaugagcuggccuuugucuucuuacacauauguggcaggguaggcuguauggggacuucaguuuucccccagcuucauguucagauucuuggacgugcugccacuauuccugcucccagccuucuauccagaccuagcuggggcucccaaggcagggccagggcaagaucgccaccaucuugucuguggugaagugggcagaugcagcaggucaggcagagagccuuucuggggcugagaaggggugcuaccagcccagcaacuucuuuauguuuuucucugcuuccuugcuuucaucccgugauguucagagucagggcggcggggccggcguggcgucgaaguggcagcagguaccaguagcaacggugaaccucggcagcccgggaauggcacucgggcaggcgguccugaggagacggcugcccaguaugcagugauugccaucguuccugucuuuugucucauggggcuucugggcauccuggugugcaaccugcucaagcggaagggcuaccauugcacagcccaaaaggaaguugggcccagcccugguggaggaggcagcgguaagccccugcugggucgacauggggagacuaggcuuuagagggacccuucauggccugggauugacaggggagggcuaaucaggaaggccuccuggaggugcugugcagcggccuugggcaacagugacggcugacaaggauggugauaggggcugcacuauggcaaugggcagagguaagacagugagugugucaaguggaguugguaagauuccugcucugggugaggcccugcuccaccauaggauugagacucuguaggggccacaggcuauaguuguuugguucaaaaugaccuguggccucuggucugaagcaugagagugcccuacaucagguggggcuggcagagccacugcucuggcaggcacuacgcaggguucagguuucagcuccacuguaguucuagauacaaguacuggaaucagagggagagggccuugagcucauuucuucucuugcuuaccaaugccucaaaguguagagaucucauggacacauaugcacugcucugggccgucaggaaccuuauggccaagucaagagaaauacaacaucucccaugcuugcucccaggacccccuccagcuccuaacccugaaucauggagugagcggguaggaagauagcacauuagggccauuugacuuuggacuguacuuuugcuagucuagcgaccuuaacugcugccuggguauacaauuuuggaaauaugcuuacuggcuuaggacccaucacaacggcccauucucacauccuugauguuuaaacccaaagcuguuaaauaguuuccuggacaggauggugugcagagagguaauaggccuggagagguguugagaguucugagcauggagggcccauagcucccuaaggccaagaaagguccagugacuaucugggagagacuggugcaauaugcagggauaugguuuucagaugguccugagaccacugagcacuuggaguuucugggugcaggauaacaaagaugacagcauacuuuuuugagucuagguagcccacugguaauggacuuaguuagcugucuugucaccugagcgccacaguagauuuugcugcaacucaaaguaaggucuguggcgcccucugccagcagauccugguguagccuggagucccaucuugccuagaaccacggguuccuuuuuuuuucuccagggauuaauccugccuauaggacugaagaugccaacgaggacaccauuggaguccuggugcgccugaucacagagaagaaagguaaagagagagucucucuuucauccuaugccugggagcggaaggucuuuuccuagagccuuagcuaauacuugggggaaucccugcccagcucugccuccaaagccucaguuugaugggggcucugacccugggugcugcauuuuugccuuugaucuugacugguaagggauggaggaagggcacauaguuugggcccuaggacagggaugugggaguaggcaggggcuauccgcugagaugggugggaugcuccuguaauuuggagcuagguucugacuccaccugcccacagagaaugcagcggcccuggaggagcuguugaaagaauaucacagcaaacagcugguacagacaagucacaggccuguacccaggugagggauggggcccuuagauaauuagcuuaccuccuggggauuuccucuugggucugcucccuuucgugccaccuuuguuccuuuccuugaugggcuauccuuuucuggcuugcuccagugaucauuucugcucuuccuccugcaggcugcugccggccucacccagcauaccccacaucugcccgcaucaccaccaccugcacacugugcagggccuggccucacucucuggccccuguugcucccguuguagccagaaguggccagaggugcugcugucuccugaggcagcagcugccaccacuccugcucccacccuucugccuacugcauccagggcucccaaggcuagugccaagccaggacgucagggcgagauuaccaucuugucugugggcagguaaggugggcagacauagaguuguggaauaacuugaaggccuggaugaaagcaagucuguggguuagcuuagugcugacuagccuuuccugggcaucucuggguaguguagguggccaaaagggucaucauuucccagcugugcuaugucacauggagcucuugggucccugaggcacacacagucuugguguuaucauacccgggacuucuuagaccaagggucugucuguaccccucuaacuagaugugggguugcugggagcuggauacaaauagcuggggggcugagaaggacuccugaguagucuaacaggcucaaccugugugaucuuggaaauugcagggugaccuaguaggagcugccuucuuuggccuggguuuccccucugaugagggguguugguaccaccucucccuauagguuccguguggcucguauuccugagcagcggaccaguucauuguuaucugaggugaagaccaucacggaggcugggccuucagagggugaucucccugacuccccacagccuggucuuccccccgagcagcgggcacugcugggaaguggugggagccauacuaagugguugaagcccccagcagagaacaaagcugaggugagugcuuggaguuguggggggggguagcaccugggucaacccugacagaagagaggcccaugaaggcaguggcggccucuugacucagcucugacccuuuaauccugacccccaggagaaccgcuaugugguccggcuaagugaaagcaaccuggucaucugaugggcugucuagaauuagacacucugcccuguccugggagguucugaaggcuuccugcaggagggagagcugcagcugggacugaggaccaagaugcaaaggccaaguccuggaggugggaccguccgccccacugaggaggcagccugcggcacagcacgugagcaggagaucaagagcccacccuaucccugcagucccgguuacuuccaugcagggugcuguaacccugugccugcccugaacacaucauaggagcccucugucccuuagaggucugguuugguggaggagugguaucuguaccuggccccaagcuugugccuugggaacuagccacucuugcccauguccuggacccuggaugugacucccucucuucuggcaggcccuauagagggaagggguagcaaagagcccuguacugguggcagaguaccuggguuccaauccugggcuuaucccuagguacguaggggaggagaacucaguucccaggaccucuccagcucuuugcagauucugggcugaguccuguuggggggagcuugacuuugcuacccucccauuaguagcuuuaucuggccuguuuuugcugcuuccugggccuuggccuucauggcucccaugggacugucuauuauggugaugccuucagaagggguuuaaugcaugugccugccccuacccugcuauuuuuaaugaaacugaaaaaugacuugacuuggacagggcucucuggugcagagccucaguccacccugcugcccucaagcucuggagcugugggaagaggagacaggcaggcuagggagugccuguggccugugguuuucaaugccccugugguacaguaucugccugaguuuuggguagcaggggugacugccaauccagccugucuuagucucugcucuggcucagugccucguuauuuauguggggccgugcaggcgcggggcccacugcccaucccauuucuuauuuauugaaaccugcuguugcccugccccuacaucuccagccccacacacuugaguaauaaaagguggaaaaugucgucaugaggugcuuccuuuccccguauccucucugaaaacugcucaccuccagggcccugccaggugugcacacaucguccucccccucaucagcaccuuccucugaaaccagggaaauaggcagagguggcuccucgucucauccucaccgagguccccagaggccagguuccccaauagaaauacaggcugagccauaugugugauugaauguguucccauagucauuccaaaaaguugucuaaaaaaggguaaacuuaguauuuuuaaccaaguauauccagaauauuuucauugcaauauaaaaucauuaugaaaauuau

SEQ ID NO: 3966 - RNA, 62428 nt, Mus musculus
caaaagggagcagagagcuagcugcuuagagggagggaaagggagcuggagcgggagcucgaggggaggcaggcgggccgccgggcuuggcaggcggacuuugagugcaggaaccgagccuuaggccccucaccggcaggaccgcgaugucccuggccucucccgcagaggcuaaggcugggccuggggucgccgcaggggcgagaggggccgcccaggauggaacuccugccuuuuguagccgcggaaacuugaucuucgacugauaaaccucugcucacgucuccgcacccuccuccacagccgccgcacgcugcgggugcaggacccaggcucucggaccguggccacugcgcgcccucggagugggagugcaggggggguuggccgcggcgucccgaggccagcccccccggagugacuagcaccaaccauggcggacgggucaccucgacccccacuuuaucgcagcgucucguuuaaacugcuggagcgcuggagcggcggaccggggccgagggaggaggacgcggacaccccuggguugcggcgccgagcuucgugccggccagccgcggcagucccgggccagcccucccggcgcguguccaagcuggcgucggggcccccggccgcccccgcgcagccgcgcccgcuccgcagccucucgccaucggugcgccagcucucccggcgcuucgacgcggcgggucuggacgacgacuccacugguacccgggacgggggcugcuccuccggcaccacagaagaagcugcggaaggcucugaacguggggccuggcccagcgucacagagaugcgcaaacucuucggcgguccgagcuccagacgacccaguauggacucugaggcccuggggucgaccagccccgacagaguuucgugggagcccccaacucgcgauccccggcaaccuccgacgccaccuccucgaacgugcuuuccucuggcuggccugcguucugcgcggccgcuguccgggcccgggaucgaggggaggcgacgucggcagcaccagcaacaggagcgggcgcagcguccggcggaugguuuacauucuuggcauagcuucucccaaccgcaggccggggcccgggccuccuccuccuccuccauugccuccuccuauccugucagccgcagccgggcugcuaguuccagcgaggaggaagaggagggaccgcagucgcagcuugggccucagaguccggccuaccucggcggccacucuucgggcagugacgaggacccaaauggugaggauggccgucgcuggagagggagaggucuccggccuggacgcucucaguugguucacggcugcagccaggacagugacgagcuaaauccgggaggcuugggaucagcggggggugucgggagccccgaaccuccgacgucuccaagaaccucaauggaugagugggguacugguacacagccaugccucccagguccccaagagagcuuaaggccuauguccgacacugggggugcaccuuuccguguggcuaaggugagcuuuccugcguaccuggccagcccagcuggcucccgaggaaguagucgcuauuccagcacagagacccucaaagaugacgaccuauggucaagccguaguucugugggcugggguguauaucgauccccaaguuuuggaacuggagaugggcuucuucugcggccccagacgaggucccgcaguaagggaccuguaggcacugccaggccgcugagggauggaggacuggaccuagauaagaaccgacaacgaaagucccuaucgaauccagauaucgccucugaaacccugacgcugcucaguuuccuucguucagaccuuucagaacugaggguccgaaagcccagugggggcccugggaacaggccccuagauggcagagacucaccaucagcagguagcccaauggaacaaucggaguccacacugucucaaaguccaacgucacccaccacccggcccacccucaaggaccugacagcuacccuacgcagagcaaagucauucagcuguucggaaaagcccauggcccggcgccugcuccgcaccagugccuugaagccuagcuccucagagcuccuacuggcagguucuggggcagaggaagacccauugccacucgugguccaggaucaguauguacaggaagcccgucagguuuuugagaagauacagcgaaugggugcacagcaggacgauggaaaugaugucugcccuacaaguccugacugggcaggggauaugacccaagggcaucggucucaggaggagcucucuggcccugaguccaaccugacggaugagggcauuggagcagacccugaaccucuuggugcugccuuuugcagcuuagauccugcaggaguguggcgaccccuuuccucuacuucagcgcagacaaaccaccaccuuggggccgggacagaagacagccugggugggagggcccuugugucuccugagaccccuccaacuccaggugcccuccgcaggagacgaaaagugccaccuucaggcccuaauggaacugaacuaaguaauggggaggcuagugaggccuacaggucccugagugacccuauuccacagcgucaucgggcugccaccucugaggagcccucaggguucucuguggacagcaaucuucugggcucgcugaacucuaagacagggcuuccagugaccccagcuauggaugagggccugaccagcggccacagugacuggucugugguuagcgaagagaacaaggacuaucaggaagucauucagaguaucguucaggggccuggugccuuggggcguaugggagaagacaggauugcuggcaagacccccaagaagaaaucucugagugacccuagucgccguggggaguugacugggccuggauuugagggcccaggaggggagcccauucgagaaguggagcccaugcugccuccguccagcagugaaccuauccuugcagagcaguggacagagccggaagacccugcuccugccaggggcagggcacagucagagaggucccuaccugccccaccugccuccuccacugcccaccaugacuuccaucuugaccccaagcugaccaguguucucuccccucggcucacccgucgaggcuccaagaagcgcccagcccggagcagucaccaggagcuucggagagaggagggcaaccaggaccagacugguagcuugacacaaacucggucuuccuccaaacauguucgccacgccagugugccugccaccuuuacaccuauugugguacccgagccugcgaugucugugggaccccccguggcugcgccagagccugugggcuuuccuguuagaggccaucccgccuugcaggcaccaucacuugaggaugugacuaaacgguacaugcugacccuucacucuggugacguuccugccccagguccuguggaccuacccugcuugccuccuucugcaccgcccuccacugagaccaagcccucuggggcugccagggcaacuccagaugagccagccccagcgagcaagugcuguagcaagccacaagugguaaguccuuuggaaggagacugagggagggugcaugagagccaugggcaccaaccugacaggaacugaguacucauuaggcaggcuuccagaaucuguccuggaauagaguuaauggcaccuggcuccuguuaccucaggaccugaagaggcuuccggaugcugccaguguggaagggucugucugucugccccaagguguucugguggugguugcaaaggcccuuggaauguuucucagaguccuguuucuuagauucccaugguucuuugcuagaaaugcacuagaaguguggaugcaggugauaacacugagucaaggcucuggccucaaugcccgacucuuggcuggucucauuucaggccaguucacacgcucuugccuugaaaucuguuccaaaaccugggagacuuagggaccagccucacuuuagggaucagcagagggcuucagggguccgacuccaagcuuguucuaguuucugaccuuggccuuucuuguggcuuaaccuccucauuuauaaaacugggucugagggauguggauguugcagauccacccagguggaauccugcagaacugggagaguccguguuuugaguuuggcuaguccccaggaccagugccaacacacuagucuucagcuggaggagcuucgagguaaagucgcuagggaaguguggugacagaccggcuucugcugagccuugguggcaaaggccccucagagggauugaaaacaguucugaucccuguagauagggcugccucugugacucaggguggauagucugcccccucauccugccugccugcaucuguucaccuucccaccuucuuccuguucaucccgggccucgaaggcucauucccacccuccacaaagcucucccaucucuuaucuugcaucagcuaugccuggguuuuggcuguggauucagacuggcccuaggcagcaucugcccuggcaugggagaguugcagcuagcuuugcagcucugggcuggaagcugagcucagggauggccugggguuaugucaacuguggccugccucagcucccacuguguugcugacuucagaagcugggaaacccuacacccuggacuaauuuggucacuuggccuuucagagcucuucagggcccucuaacucccugucucugauucucuccccuccuuucuauuuccccaucccagguccuagcucugcccuuccuuaugaaaggggcuaaggauggacagucagggaguuggcagacgggacuuuuggaccuggcuuuccuucugagaccuacauuagccgagucugagcaccggggccagcucugugaguggaggaugggagaagggagucccagcuuccuuuuccauguaaugggguccugugggaguauagugggagcugaggcgaucaccuguggcaucugggagacaggcacugaggccaaggaggaaagaguuuccuaggacuggcuuuuguccugcuucaaauucuccauauccucccuuccugggagccgugauacggagccauccccucacguacaaacuucucuuggcccuacaagagguuucucugacauuucagguccucccacuucuccaggcccaguuggauguucucucucucucucaccccuuagaagagagaagggcgcgucuguaauuaguagagucagacuggagagccacaggacuuaccccgucccuguuccguggauugcucucccuuucuguagaguggagauaaugggcugaugccggggaggcucuguaggugggcgguggugugaccauuuccucccuggggccaggagggaggacagaacaggcucugcugucucagcuucuucucgguggccagguuuggcuuccuccucccccacugcugucuaagcacuggucccagggucaccugguggacuuuauuaggcucagaacacauuugccaugccucauuacucgcccccacauuaagccuggaaguucuaccaucugcuaccuugaaucucuucuuguuauccuuguccuucuggcuucagaaagauggggagcagcuguccacuccccccuuccugcuggcuccucuugagcagacaauguucccuugucucaagcuuggggcuccagucacgaucccugcacuguggguggggacgguguggcuuggccuucagaaugagagggggacaagaggaguugucugucauguuccagcguaaagcaguguaaagcgcucagaggaaaagacuggggucucaguaaccccagacuucaucuugagcagugggcggucccucgugcucaaguauuccucuugagucagaacuucuccacguuauaaggagucaggaagcucggguaccacgcacugcuuagccucugacucuuaucuggaccugggcagucaacuuuaggacuuaguuuucccaucuuugcccugagaacuugggaagccugaucuuugagguucuguaggaggggcucguucugcagccuagguaagggaaugggguugggagagucaaugugaccagaggagagagagagucugcucucuguguaccgugaauaugagcagcucugcuugcagcuccccgagacugugcugugcaagccuucuuccuguuucuccuauuccaggccucuggcuucuuccaguuagcuccauaguuaccacucuguuguccacggaccucccuuugcaccaaggcauuccuuuguugagcuucagaguaaucuugauagcucaugucuucugccugguaccccuugacaccugaaccaucuuuagcccagaaacagguagugacucgucucugagaaucgucgauagcugacuucaugggacuuuucauguugaagucgcugucgcacugucugucguucauugcgugcucauuuugggguagacaccagugguuucuuguuauguguaagauggaguguucagaguauuggagucucucugaauccuagcuuaucagugucuuaaagagacuggaucaagggguuguucccaguuuccaagugagacuggccugccaucugagaaggggcauaagucaggaacaguuggggcaucacuuacacguuguauuguagcagcuugaauguguucguggugauauuuaauucaccagggccuggugugagguaggaagaauucugagacccaaaaagggagaaugcugagcccaaggucacaccacaaggccaggcagagcuggacccaagcccuagaaccucuggccuuguuccucucccacucaacagcagcccuggcacccaccucagccugcccagaugccccugcguucugcggggcugggcggcagcccuucccaccacuuuugucuggcuggcucccccuuggcggggacuuguggagacaaguuuuccuccugccccuccuuggcucuuuacugugauuccuccccaccccccauggaaacugcuuccguggggaggggaugaggugauaaggacuuuuggaauucugaguaguaccaaauaucuauaauuaaagucuugucacccagcaggagggugggaugggggaggacaggcaaaaggguuguccuuuucaggguuuauucccugccccccuucuuuccuaggacccugugguauuggaggagaaagguugcucuccaggaaugagagcccacccagcggggaagaggugggggagggaccagaguugagugugacauuuuccagcccgacauuucuggaaacagcuggaucugagacgcugcagcuaauccuguccccagcccccucugccaguguuagggacuuguccccccugcuuuccuuccuccccggcugauugcuacugcagugggauggagccauccccaggcagccugggaacagaggugcucucggcugagaaucuagaagaaguuuaggauggcugucugcuggcugguagaggaagcuggugaagugaagaagcaguuugcaugcaggccuuggauccugggagaaggacagguucuagaaggagggcauggcaugagcaagaggccaggaggaggcuuuuccggacaaguuguugcaauagaaguuuggauuuagcaucuaugcacuauauauaauaucccaagcacccggucgcugagucaggcaccauucuaguguagaaaaagcaacaguucccaaaacagaggccugcuuuuauggcccuuccagauugguaaggacacauaucuccaaaggaggacacugucagagaacagaagguucgggggagaaaaauaaaacaggguaaacaaguugaagauaacagacugggguacuauuuuagaucauggggucuagagaggccugugagcggaggugguaacaucugaaguccaaaagaaaugggggaggaagucagguagcuuucuugggguccaggguuggcagggaagcagacuguggaaagaaaggaacacagcaaaggucccgaggaauggacgcuggguagugaggauagaucuuguaagccauugggaagacuuggcgucuaucugaagugagaacuagcuagucagcgucagagggcucggaguaagauaaugacccaagaugcuguguggagcuagauagcagggucaagcauggaagcccugaaaccagucagaaggccacagaaguaagcaaugaugccagcccggggcuaggcagagauguggaggggguguuucaacugaagcccaggagucuagacaucuaguacguaagagaacaaggcgcuacugucugcucgauguaguagugguggcacaugccuuuuaucccagcacucagaaggcaggggcuucugaguuugcgaguagccuggucugcauagcaaguuccaggcuagacagggcuguguaauaagacacuguuucaaagaggaaaaaaauaguagagagcccuacagcuucuggagggccaucuggguguucagaaggcuggcaugucaugaacuggggcucagagcucagcauccuggcacuacccuuccgccuuuguccaucccugggaggcuccagaguagaagcuacuccagcagcuugugagguaugagaggaaccacugaggagggcaagaugacaaacugcugcccuacagggacuuaacucagaggcuaagagggcaccucgggccccagugacucgggugguagcaccauguacggcaggcaggugugugacaugcacugcagccacugugaccccuccccagcaccaacuugugucucuggaacggggagcuuuugccaaccacuacagcccuggcccucccaucuaaucccaagcugggugaagaagcaggcucaaagccagaagaguuuugcccagggcuccauggcucacaaguaauguggcccuagguguccugccuccaggucauacauuggccucagaauucccagugagucaaguuggcagagauggugguggcaguccgggggaagggggagccuguguuucccagaaagacuuguaacccuggcacacucauugggaaaugugcccaggaagccuggcgccuugcuggcaggcccugaaaugggggccccggguccucuggaaagcacaagcuagucagagaggaugccuucccccacaggaccugauaccccaccacuucucaggccucggaggccuccuaggaguggacaaaggcugaaagacagugccaggcugcuggacucugagccccaguucgugacaugcaggcuguuuaaacucccagauggcucuccaggagcuguaggguucgcuggggugaucuguaguguagggccucacuggguuaucuggcagacugcggggaggucugcccaaggaguuaggagaccagggaugcagccgccucucaccauguccuuccuaugggccuuacccuuggagucccauacccuuggagccacgagugccuucgugaccuugagccccacgauuaagcuuuccagggaugcuggggcugccgcagcugugaugggcaagaacaucuccugaagaccaggaagugcugucaggcugggccacacacugcugaggccucugcuccacucucuagcugcuuccccuugugggacaggccauggugcucucugaggccuguaucccaaauagugaggcuucugugcacaggacauuaggacuuccagcucagggugggaaacacagacuucuuguuauguauuuuaaguguuuauguguaugaguguuuugccuccauguauguaaguauaugcaccgugugcaugccugaugcccaaagaaggcagaagaagguguuagaugcccuggaacugaaguugugaaugguugugagucaucauguggguacugggaacugaauccaggucuuccgcaagagcaacgagugugcauaaccauugaccugucucuccagcccagaucagcagacuuuuaaaaccaucccugggcauggagaggcugagguggcugcagagggacuugaggugggacagacaaacggaggcugcuaggcaugguguguugcugcaguaacagauuaucacaggucaguggcuucaaacagcauuucauaguuccugagguuggaagccugauaugggauucauggagcugaaauguaggugcuagaagggcuguuuccuucuuggguuuagaggaaaauaaguucccuugccuuugcuagucaugggugggugccagugcuccucgguguggccucuaacucagucucagagcuggcaacauagcaucgccaccacucccucacccagaccuuccaccugggugacucaggacccuuaguggcacuugcagagucccuccugccuuguaagacaucauauucaccaagguccccuauaggagcugguccuggggaugucucaggcccgcugcauuuaauucaaccuucauuucuuuccguguuucuuugucuucuccugugaagcagucaacagugaacccuugauggccaguggggacacacagggaagguuugcauccaggagcuuuuggcaaggaucucagugucugaggcgcauggggcccagaggaaggcugagcccagaccuggaagggcagggacaaauaugucauugaguccuuugggaauaggcuuggccucuagaggcggcuugccugagguuuguugacuagacaucgaagugaagcaucucccaagaagggaaguuugcugaagagcucagagcuggggaaagugggagccuugggagaagccaugauugggccagacugucuucaccaagggcagagcugggagcugggggacagaugagaaagugggaacuacgugcuagagaucuguuucauccugaaguuaguaugugguuggaauuaaaacaagcacuuagaaauugccgcagcguaccggauggggcaagguccaccccaaugucauauugcugccuaauaaugcucaagaaauguuaguucugccaagcucgcaagcuagcucggcagguaaaggugcgagccacuaagcccaacaagcugugcuuggucucuagaacucacggugugggagagaaccaacuucuacaagcuauccucugaccuauauaggcgcuaugugacaugcauggacacacguacacaaauacauacauguaauuuuuugggggggggguugguuuuuugagacaggguuucucuguguagcccuggcuguccuggaacucacucuguagaccaggcuggccucgaacucagaaauccuccugccucugccucccaagugcuugggauuaaaggcgugcaccaccaugcccggcuuaauaauuuuuuuaaaaagcaaucuuaaugucucccuuuggguguaagauacuaggauaugagucugagauucugggauucagccauggagcagaggacaaagcuguagacaggagaccacaugccucaggagcuugggcauuugggguuggugaggaaaggcagggaccagccugcagaucuguggccuccucucucugacucugacucuucucaccagccuugccugagauggcugagcaaaguuuggaaggcaaagccaagccaaagcccgcucugggucagagcugcaggccccaggauuugcucccuuuucuggucccagagucugagugccugguggccaucucugccuugcuccucacugggugauuuuuaacaauguuaauguguuaauauuuaacauuggaccucagcugugagccucggcuuccugcucuauaagauggaguuucugaggaauuaugaggacaaaaugauaaaguuaauaaagccuucucccuaggacuccaaggcuagacugcucucagaaaugugccugcuugguguguacucugaguugucacucucagaggguaguagcccuuuaguuaugucaugaagcguucugaccaccaccauccccccaagaacccugaccucuuaacuugauuguguugguugauuugagauugauguccuuugucuuggaauucuggagggagggcaaggcaggcaggucuggagccagugguaaggcugggaggaccaaugcaagggagcaagugcaagguuggugucaguuuccuguuuauugguucccagggggugacaggcccugcucuuugcugcaguguggagcaggagagauggaggccaugcuccuggcugccagccagccccagagcugggccuccugggauggccgagaccccauucccccaccccuggacaaacauucaguucuuucccaggacggggcacuggagguuaaggaacagauguggaagggaagggaagaugagaaggacccucccccaccccaguaaaaguccuguggacucugucuuucuuggcugcugguuuuuguucugguacaugguugucccccuggacggguguguucagaugccaacgccuugacaaaccaggaggucagaagggagaggaagagagguagggccuugggugccagagucacccaucuggaaagacuccagacaucagcuuugccuucuccccacucccggccccugcuucauuaagaaggugaaagucuugauacccuaugauaaugaguccuccugccacugccccagcgcugccuggggauugccagcauggggguggggggcagucaccaagaguuccagaaggaggggaagugaugggguccacuggcauuugggggaauugaucaaagccagggcagcaaaagaaagccauuguaugugucagaggccaguggagaacagaggucucgggugaccagcacauggagggaagcuguacgugcuggggccaguaugaaggccuugggugcugagucucaccccuaggcagggggagccaugcaggaugaggaacugaaggggcacugcagcuuuguauggugauggugcccugugagguucagacuggaggaaguggcgguggugacaagccugagcccagggaugcaggaugugccaaagaagacuguguagagagaauuuggaguuccagauggaguugaauuugggcucacaagcugggaugagggaguggggcagggugaagggugagccaugcccccuuuaccaggcacaacuucucucuggagggguaaagggcccugaacccugacuccgaguccaguuuacuacuccuuguccaacuucaggcucccugcuggguggagguacccugccacucacaggaguuccuagggaacagcuaggcuacaacuccaguccgcacuuuuggaagaggccccaugaaaggagcaugguuugagagcaggcagacuuaccauguugauuuugauucaggccaagucacccugccucagucuucccaccugugaaguggggaucccagcuaugguucuugaauauucaggcucucaagaggugggguggaguaaguacuauggugguuaguaggcagccugguaacacuauccacagugggaccuagggucagagcuaagaacccuucugauauuugucccucgaccacagcagugcugaacuguggcccugaggaggccuugagagaaagcugggcugagacaaaagggaguagaaagacucagcuuggggauugacgugagccuguuuccccaucagaugccugugagaccccugcaaacuccuugcugcucacagggcccucuucucagcucuggccugcaccagucacuuccaggccucuccccaaggccagcgggggcguugccuggggcgggugcggaauuuccgagggaauggcuaaauucagcccuagcuaaaaauagucuggggccuggccccaaagcuggaggagcaggaggaggaggaggaggagggagacaaggaggaagaggagaaggcgguggcgguggcgguggcugcagaccagagagaguaauuuccagcuaccuucuugcccugccuccaccaucacuggggccugggccucuuguggccucacagacaucugcuucuuucuccucacucacauacacauaggccuucucgcuucugggguuucugcccccgcucccccacaacgucucaugcuguaccugcucugaguccugagucuugugcuguguucaguugaguccccaccccuggauggggaaaggccucugagaauccugaucaggacugugccccucccccucagcuuccccugaucuaggaugcuucuacggcccuagcugggcacacuuggaaaacucugggguaugaagauacgagugugaaccccuggaucccccaguuagcucuggcaaguggcugcccgugccaaaccauccuuccuggcacacaguggaacugcacuguaaacuuauuuauuaaauccacguagcgagacccgaggaagccagcaaagcccugcuccaaccuucccugaagcccucuauacuuaugccagccuuggauuugcucuuuggggagaccaagaaguggaagcuggcacaaaggccguagggacaugguggcaaucagacccugaggcuagaggcgguaagaggccuggcucaggucucggagaccgugacugguggcauuuauaaccuagguugaccuuacuucaaggcugggcugugaguuucuucagguccacaguaacucucugggcucaggucgggugugaauuaucacagcaggaaagcuugucaagaguuugacuagacacaggucugggcacuucugguuuuuuguuuguuuuuuuauuaauuuuaugcucaauuuuauauucaggagaucuagcgggucuccugcaugcuugggaagugcucuaaccacuguguuacaucuucagcuugcucugagcacuuuaucuauauuuccucacugagucuucacagcagcgcuguggggaguagggacugccacucugcccggaugagccugagcgugacacugcggagccugcagacugggacagcugaguggcuaagaaggaguucacacucuuggccccacagcucuagcaccuccagguguucacugggacccuggcuuucagaacucccauugcuacggugagcucaggacgugacaagaugcauccacuggauucacagccuguggucccagcuccaggaacuagcacauagcaguugguaaauaguagugaguagugagccuugcacugacaggcugguuacaagcugcagagggaauguguguuuccuguauucguugcgcccggggacucuucuuuugacguuggagcagaggugagugguguggagcuccuugcugguggagagcucuggcucuggaguuugggaaggugcugagauggccaggaaggggagcugcuaggcccagcagggcuggcgcaguccugccugcaguaucuggaaagcagaucucuugggccauggccggggugacucaaauggagaccaaaaaaaccuuccauauuuggauaaagagcccagagagacucaggcugacucccccauccaggccuccugccuuggcuucuucugggcccccagcccugaguccugucucucaaguuuaaguccuggguccaggcaaccaugugcuucccuccccucagucaucaggcucuucuaccuucugcauggccaggccuaggcucuggguaccaaaucugugcuagagcugggcaugaagagaagagucccagcagaaaccacaagcauguaccaaaaccauucccucacugagggcugacuugacagcagauuccccucccccauccaacacuaauaaagccagagauagacagcacacaggcaucaugcacacaucauacacacuccuuuuagguccccagcagguucccagacccacaaccugugcuagugucagaagggaggacccagccugauucuucucagaccguccucugacagcaauaguggaaucaguaagagugaccagaugucaugugagcaagugacacaaacaggccuuauccugcuaggggauaccuacagaauaauuuggcucuauacagaagccucuggauaguugacagggugcugggugggucaguagacuccagaaccaggacagugggaagaggacuucauucccaugaggaguccagcauccucgucgugauuggucggcugucucacggccgacugcgcuaccacuccuaacuucuccuuuucuccuguuuuugacaugagaucucacuguguaggccuggcuggccuggaacucucuagaccaggcuagccucaaaugcacagagaucugcuugucucugcccccaugucuggcuuacuccuaacuuuucuagucaguccugguaauugacugggaucggcuuuaggugaaccuacggaaccuagguagccauuaaaacccaguuuagccgcuguccacuggguuagccuguggcuacggcgcaaauaagaaggggcuccagccccaaggaaccugagaacugugacucaggagaccaaggcagaugaagucagggguacccaggacccucagagcagaaagaacugugaaggcagagcucugggguggagcaacccugguguuuuugggugcugugaaaguucccugcucuggagaggaguucuguagucccucagagauucaacagccaggccugcauagcuggacuugaucccaggccaguauuccuuaguuuucaaaaagaauaaaacccuuucucuacuggaguccuggcacaggacugugagacaggccagccacuuaguugugagaggacggggggggggugucuuacugccuggaccaccccuccccauacagugccccagaacugccuuaggcccaaugggggaaaaugcucguuagggcagagggaaucccugguugggguauagagagcaaagccgaccugagcucggguucagccagccaggugcugcgggacuaggucuccagaggagccuggcagacugcuucgcuuauccuuggucauacccccugcucaggcccucuagagcuagccugaacuaucuuggucaggaggacagccugugcgagugauaaaagucugccugccuucuacugccaccugcaaagaaggacuuugcaggaggcaggaguugguagcaggccacacuuucggagcaggcagccgcuuuaguacuacaggucggggugagcagugagugacacauucuuagaagccguaggaaucuuggcuucucucucugaggugauuuaggugagaaucuggaaggacuuugucagaguugaguguaucaaugaagguuucuaggaacaagccuggggcuggcaagcauguggcccuucagggcauggcugugccguggugcauaccagccuaccuggcuccugcacaaccagacccccacuucucuaagaacacuggauggcacugggguguagugacuuguucuuguaaucccaggacucugaagguggaaaccgaaggaucaggaauucaaggucauuuuagccaauaaugggaaguucaaggccagucugggcucuagagacccugucugaaaaaaagacacacagcuuccuucuuuuucaaauccuguucaucuucacugugugaccaugagcgcuuaaccucacugugguucaacacauggcguagguacauauaaaauguggauaaugacggcaccuauuacaggguugcucugagagcuaaaugugauaacgucuggcggcuggucuggagaucaguggugagccauaaggcaaguuggaagggauggagaguggugaccugcccugccugaggaaggaccacagggauggagaggggcgugcuuugagaugggguagugacaguggcuuagugcaguuugguagaaggaugagcuagcugaguuccugguggaaagcuuugaagucccugaugcagcuguuccuaggaaaagggcucagaucggguacagagcagggauguggccuugguacugugccuaauucucacugguagacacccccacgccccaguguagcuacccauuccuaucaggauagcugaccccggacccagauguggguguaauugccagcaugacccuguaaauuccgacuccaaagccuucgugcagaaugaggacucauuuccaagcaccagccagggaagcucagcccucaaagagaugaggauggcccuuuggccuaaagaaguguucuaccugucucugaggaaggggcaaagccaggccuuggucugccgagugagcaguugggcuuccuggagaguugucaccugagagacuggacguguuagagacaccaaagacagaggcugugcucuuagggcucagagaacuggccuggaucacaucggugcuagguggcagccaccucgggaccugguucuguguauagaugagaggcacagcucagugccagggaugucaggaaguggucugagccagggcagagauccauuggacuggaucuaaccgagcagacccaacagucccugcccagagggaggaaggaagaggccacucacagcagccuuccauauacuuuuuguacugcauagugucuuuacggugggacauguagcugcauguggugcgucguaccugcgauuccugcgcucaggaggcugaggcaccagcaucgucuuaaaaguugaggccagccugggcuacaucauaaaacacugccccaaaacaaaaacaaaagcuaaagcuaaauaaggcugaccucaguggguaaaggcgcuugcugacaagucuagugaccucaguccagucucuaggaggcacguaguaggagaauugcaaguuacccucugagcaagcauauacacaacacacacacacacacacacacacacacacacacaguguaaaacaacaacaacaacaacacaguaauaauaauaguaauauugaaaccacagaguauuuucaggucuuuugcuguuuaaacaacgcuucagcacaggaguuguacugcaugauuucacugugggaguggagucccuuggggcaugagauggcuaagacaucguguguuugugacuugcauuuugauguuucuacaugcuuguaccucuagcgaugugaaggcauggccuuacaaaucugacuuuuggacaauuaccaguacccaugacgucauaggugcccgugccgccaccgucacacuguccuaacucacguuugucccauacuuuuccccugcccgugugucucucucgguugauuguuggugcccaguguagccauuucuaggaagcguuuaaccucugggaaggaggauuucgcucuuugacugaguuaugauuugcaagugucuuucccugauuucucaccuggcuuuugucuuugaauggggucuauuuuuguucugcagaaggccuuguuuuuaguuuuggucgaugugcguguggagggcagagggauuuuguagcauugguuuccuuuugucuucuuugagucgguucuggagaucggcaggcuuuugccguaaccaacguuacccacggggccaucuuguuggcccagagagguuuuuguuguuguuuuuaaacguggucuaauuuaucaagccauuguuuuccgacuguuggccuuggagcccugguuagacagucucccaccccucugaugccuuaugguuuuuguuuuacaucucaguguuggauccacauggaguuuauccugcugugcagugggagauacggcaccaacucuguuugcuuccuccuguggcugguauuuugagcugaggagucauaguuguguuaucuuccugaaaggggcugugaaggucugugggggagugaggcugugacuuuugagggucagggacagaaaggaugaaggagcuggaguggcaccagaagaauucgguggcauuuggaagugagggcacaaguuggcguuacagcauuccaaauccaucugugcugugugacucugcagaaguuccgccaccucucugagccuccagcauuguagcuggaggggacccuggauagcauccugacugcugggcugauggggagggaggagaugggaugcagaggguggcuugcuggaacuugucggaaguacacggaaggcuggcagccgagcucauuguguuccuggagugggcaggugggaaggccaaggggcgggcgccuguuuaaaaauacccacugcagccuggcacagcaagccgggaggggcaggcccucugcccgcccuccagauccaggaacggcaaggguuaccaugagcagacacauuauacucugucucaggagagcucuuaguccagccgucaccacccugagcaggcacccucauccucuccagagacacagagaugccagaguguggagaggucacaucucagaagcuaacuaacuccgccacugcuguggacuuggcuuuugauuucuagugaguccuugucccuuggaguccuaguuaucuaucaaagagcacaguuggccucucccuggcugucucccccauccaucagaacagagaagagagauccugggagccauuccucacucccuuuauaauggggauacugaggccauggaggggccuuggauugccaucuccugcuucugggcuucuggaccuuccucccugcccccagcauggccuauaccaacuccccacccccacuccagggccccaguggucaaauuccagggcugccauugccauggcaacaaccagcucacaaggccucuccucugggguuuuccacaaggcccuuguccagggaggaggcagaagggccucccaccccuagggacuagggagucaggagaaggcuggggaggaggucaggcccagcugguuucucguuuguuuuccaaacaagaaaaugggaaaggccguuaggacugccagcagauaguugucuguugaggcacagagugggauggacagaggugaccaucuaggcaggggccuugagagccacagagaaagccuccaaccuuacuuagagaaucacccccauagaaaaacccuagaccaaacauuuuggaaugguaggugggggaagauccucccaacaucccagccauucuauuggccuugguagucugagcugguacccagacauuagaggguccagcacauguuggcccuuccuccauaggguaagcuguucccagaguaccaguggagggagugacugagcccuucaguucugugggaugugcaagcaaggacugccagggacuauuuuggaggaggcuaaacuggucguucuuagacaucugccuuucaagagucucuuagagccuucuuccugauguaacgauucagccuuauuuauaacagccaguauuuguugaguggcgucuugacuccugguacugugcgaaauaagugcuuucuaaucccugcauuauagaugagaaaaaucgagguacagguuggucuucugagucagucagccaucaagagugucccuggcuguguauuauucuguccuguucccaugcccuaggccccgccuaccguugacauucugguggcuucuuccaggugugucccuuuucucucugucuuuaucucuuucucuaucuuuauuuuuagaugacauugaggcaauacaguuugucgauaggagugcccuaugcuuucauuugauaauacaguggacuccuucucuguaacuuuucagaggucuuccuaagggcccaugacucaggagcccucccuucccuguagcuggaguugacgcgggcuguguagguagaguccaugugcggagagcccaggcugacacucucaggcuaaccccuggcuggaagaagcccuccuccuggcacucuagacagauguaaacugucccaacuuuucuacccaggguccccugggguggaguccugccugcuuggcagaucuugcuugggucgccagugacacaagguaauaauagggcccacccaggagauuauuuugagguuaaagccaacaccugggaggugcuuagucagcagagaguggaaucccuccacagauagaccugcuauuuuuagaucuuugcugucuuccuguccuugggcucuguaaaguuaagugauuuauccaaagucccagccacuuaguggucaguggcugcaggaggauucggguccagcccacugccuagucuugagaacccagcaagucacgacuugcgcugagucucaguguugucacugaguugauauggagucuuaggagacuuagugcugcgcuguucugcauacuccaugguaccgaguagacagcacugccacuuucuguugacagcuacaagucuggagacucugaagacucaaagccaaagcuucaggagugguccucugagccgucaggaugccuuccuaggguggacuuugguccugggacgugaagccaccccacuggcugacacuggcugaccucagaugagcaucuucugggagcuucucuguucagcucuagggcugcucacuaauugauggggaaagcacagaagagccuagaagcacaagcugcugguggucagcagaaaucacaucugccaguguggcccaggccuagugguggcccuugagcccccacugggaaggaagcagagcaaacuggccuggugugaugacagaaacuucugucaggucuggguugagcccgacacacuaggguugauguaaccacuugguaacaguauacccuggagggcacggucggaguaaggugaggucacaguauaucccagcuacguggguacuucuggccaagugaagagacccuaaaacccugaggcccuaccggacuauggugguacacgccuuaauucccaggaggcugaggcaggcagagcucugaguucgaggccagccuggucaacagagcuagcuccaggacagccagggcuacacagagaaacccugucucuuuaaaacaaacaaacaaaaaaacaaacaagcaaacaaacaaaaaaccccugagguccugagacauucugugcugggaaguaauaccauucguccagcagaaaggaauggcgcccgcugagugguggcagcuggcagcgcacaccuuuuuccugacacuuggaaggcagaggcaagcagaacucugugggaacuggucuagaaagugaguuccaggauaggacagggcuacacagagaaacccugucuccaaaaaacccaaaucacaaaacaaagagagagaaggguguuggugguggggucugcccuacugcccuuucauuuuaggagguugaucauagacacccguggccuccucgcugugccuauucauccugcggacacuugcugucuuugucucuauucacaccugugugcugacuguaugcccuggggaaacggcucuaggccuuaguggugccuccucuauccuggagcucccagaucuuguuacugcccccuggugcccgagguagcguccucauaggucuguagcauaauaaaaaggauggacugauuugggagucacaacggggcaguugguggggcaguuggcgccugcccuggccugaggugagguuggugagggaggagauuuaaggcucccuggaaaaagcagagaauagauuaaaugggacuugacccagccaagggcaaggugcguguggggauggaccccgugcugagggcugggagggcacagcagcaggcggaacucggccaccucauuucccggggccuuugguggccugagcagaaggguuucuggcauugucuaaguggggaagauggcgucuuuuggcugcgggcuuugagagucccuaggauuuauacacagcccagucaggcccuguccuuuauucccuggggcacuggccuggggccggcuuggccuuucccagggugccuggcccaaggcccaaugaaucaucuuccgcccuacaggcaagacaccccaucucuaucaacaguguacaaauggagccccccgcccccaugugccuggucugaagaaaggagggaauuggaggggcuggaaucaaacccuagaaacuuccguucccacgacccuucaccccagccucccuccguacuaccaagauggguggagaugguagggagccauucuuuguagaacagccacugagcuguagaucuggcauguuccagguagggaaauagacacugaggaaagguauuuacagcuacaugaagguaggaguugaaguucagaccauguggggccccggccggccuggguagcauucugaacaugguuuggauauuugaauuuuuagagcuguuagggaaagucuccuggaagucaacacauccugggguuccaagccaaggcagggcacaguccugugugcaggacuggcagggauauccuaggagccccuaaaauacaaacuuagaauacagauuuguuagcauucuccuccaaggucucacacucaguuaugccuggcuccugaccuguaaaaugguggcuacgggggagaagugggcagagagguugaguucagaguggacuggcucauccgaugcuuuucacgucugcugagguccgacuuacccuccagcccccaucuccuacuucuguuaucugggauaaggaacuuuucuuuugaaaccuagaagauucagcuguauccucuugaaacugaaagggguggagugacagaaaaaaacgaaaagaaaaaaaccccacauuaaaaaaaaaaaaaucaugcaguuaaauucaaaccacaugcccuacaaucccaguccugcaggccucugcugccaccuagcagugcuugguggaagugcaguccuagagccccagcuuccucacuugggcuucaucagccaugccuuucucccaguaugaccucagucacccucugggaaccuaguggggaauuuagaacccucuugaacuuucccaccuccuucaucuguuuacagaaggggaaacuaagucacagagcaggaaggccagccaauagguacauguuauguacccaguguaugucuaguuuauacucauuccuguuuggauuauucuuguaguccuggggcaggcagacauugagaccucccuucuguuuccaucuaugucuuagccauccagggaaacgaauacagcugucagccccacuuccuaauucagggugccccagguuuggccugacuucuuauuuaugugcccugcaacuuagugaagucuuucagcugcugauacgccauuugcuugggguuagaucuuagccuaggucaccccacugaaguucucaguacacauccuguaggaaccggugucuuuccuagaccacggugcuccugggaggucagagaggugcuccuggauucuguuacugucuuggcaaaguauagaucuguaguguguugaagacuggacuggggaguuaucacagggcacucagggacagugugaggccuacauagggcuguggagagaaauuguaccucagguccccaucgaggaccucgcaguguaugcucuaccccaggucugggaugggccaggaguguuguggucagggauuuucuucuaggcugagagaugggccagccggguuuagccaucagaagacagccuggaauccagccaggagagcgagggcuaccucuugcuucuuucacagccaauagaucucuguuuuauuuuuuuacuacugccccugcuggggucccaacuugaccccucugggccaacagaugaaauguggguucaugcagaaaucagccuggcuucauuucucugccaguagagcaagagcucuagguccaagcacugccucuuccugucugcagggcccuggcauccuugucugccucacugggccucugucuccuuuucacugugaguuucaugguagucagguggugccugggcuagacucguuccucucagacuuagcaguuaauauugauguuuggcucgggccucgucuaagccguuaguuggaacaucuauacauggcauguggcccgggcucccucccaacauguaggccgggcuuuauggcuaugcaggcugccaggcuucauggagcaagguagucccagguacugggaggcugaguaggaaaaguucaggaccugccacagcuaguucaaggguaaacugggcagcuuagugagaccccuuaucaaaguuagaaaucucuagaggaagccagguguggugacucgugcuuuuaguccuagcacuugguaaacagagucagaggauuuuuguaaauuacagccuagccagggcuacauagugagaccaucucucaaaaauaaaugagugccgggcgugguggagcacaccuuuaaucccagcacucgggaggcagaggcaggcagauuucuaaguucaaggccagccuggucuacaaagugaguuccaggacagccagggcuauacagagaaacccugucucgaaaaaucuaaauaaauaaauaaauaaauaagcagggacuagaggucuggcccggcaguuuagcacuuguugcucuugcagaggacuuggauaugggucccagcacccacauaguaguccacaaccauccacaacucuaguuucaggggauccggcaccuucuucugguaaccgagagcaccaaguaugcaugcggugcacaaacauacaugcagacacacacacacacacgaaaucuaaaacuuuuuaaauaaauuaaauaaaaacaaacaaaagaacaccacaaugguggagugcuugcaugacccuggguucaauccccgucaucacugggacaagccagaagagcaaguuuuagguguccugugacuucacuucugcuagugaucuguguccaagagaguaacaaagguccauccagucuggagaagaggggcccuggaccucaugcugugugagaagaguguuugcaccauguuggaggaagagccuaccagauggacaauguuguggacacgagcuuugacagauaucacccgacacaucaccccggggugacugugaggacaggaggcagucauggaaaggacgcaguccauguggaacccacggcaaaugcuuuguaagcgagggcuagugguguguugcugguuucuguuugggauuauuuugaacguagcugguuuugaucauuauugaaagacccuucaguuuuuaaccucugccuagaaccccaugguucguuacaacauggauugcugugcaguuguggcuacagauaacuaaggggccacacagaugggccgugcuucauguugcuccuaaccccgucuccaguugcacacaggacucugccucugaagcaggaaggcgcuuuagcuccuuaggccccagagcuuucccuccaagccccagagcucauccuccagugacagccccacccggggcagccaguccccagagaucucuguggcuuggacauuucccuuccagcugccugugaggccugggaacugagaaaccuuaagaggccucuccuuccagaaaggagggucuacugauggcaggaagugaucuagggaaccaaggggaguggaugggcaauggaaagggugguaggaagcgggggccccaggaaaugaagugucuuccccaauccacauacuaaguagcguagcgaggauuugaaccugaaauacacagcuccauagccagccaucuugggcuccauaccacggaauccuuuuguaacuuuugucuccuugaugacggagcaucagagguggcagcagccauugggaaguagauggccuauaggcugcgacuguguaguaccaacuccacuuucauggguauggguggggcaggagagccagacagcacaucuggguugguaguccuugauccuggcauggcccguggcagcauuguauucaucuuccagaauguuccugacucaagggaaccucuuuauaucauugacucggaaagaagagaccagagaaaggugacucaggcagccagugugucucggaagugcaggaagcuugcaggcuugaaggcagccagcuggguccuaccuuaccagcaggacggccucggccucucgaagcuuuccugguuuauaaaaugggagaguuacaagaaacagagcucugguguauguagguuggugguuaaggagccagcgcuuacaaagcaaugaugaaucuaagacccacgcaaacaguauuugucauggagaaagauccuccaggcuccccgugguccagugugggcagcucugggguccagagaucuuuuuuuuuuaaagauuuauuuauuuauuauauguaaguauacuauagcugucuucagacucuccagaagagggagucauuacggaugguugugcaccaccaugugguugcuuggguuugaacucaggaccuugagaagagcagucaguucucuuaaccacugagccaucucuccagccccuccagagaucuuuugacaaagacagcugggcaggucugcagacccuucccaugaagccugaugacaccugcuuuccagaccugugucucccuuaggaguugucuuugcucuuuuugauauggggcuucccugguuaucaaaaaugaccuugaauucucauccuccugccuccccagcgccgagacuacaggcaugugcucccaugccaggucuaugcaguccugagguucaaaccccaagcgucaugcuuaugaggcaagcauuggacuagcuggcuacaccccagcggccuggucuugggucauuucuuucaggucuugucuuccuaaugaaacccuggguguggacauaaacauccucccucccucccucccucccucccucccucccucccucccucccucccucccuuccucccucccuccuccuuuccuccuuuccuuuccuucuggugugcagguggugcacaugacacaacaugcaugugacagaggacuguuuuuggagauaguucucacaguccuuuuuuuuuuuugagguagcuccagcuaguuggccugugagcuuccagugaucacucuugucucugccuccugucucaacauaagagugcugggauuacagauggaugcugucccaucuggcuuuuaugugaguucugguaauggaccuuaagucauugggcuugaauggccaguauuuuuaaccauaugcccagccaucucccagucuaagaccuuaucuucaaguuccuagcacagggacugaagaguucacucagcaguuaggagcacuggcaauucccagcaacuuccaguggcuucugaccaucuauaacaggauccgaugcccucuucuggcagccagguguacaugcagaccgaacccucauacauuaaagucaucaucaucagccuagcacacugcuuagcugguaccugguuggugauugaugaguguuuauuaaacuagucaagagaauggugugacaaucagagcagcagcccauccacuaggugcagucagucguguguucaucugccccugacucaguggccugucacccauccacgugcauauucaucucucaccauuccagcuauucagccgcuaccaugacucucguuaguccacucuaggucuagccuuugucacaucugguccuccagugguccagcaguagcuguaaggucuggugggucucagagggcggguggaaugaauggugucuggaggcaagcgagcaggaagccaggauugccucagagauggcuggggaaguugucaacagaccugguggaggucgcuagaccaggauucccuggggcugacagaggguggucucagagccagguacccgguggucuggugggacugagcccucuccugacaguugucucuuaccuuccccuaaccgaggaggguguggacagcucuuugguggggaaggaagaugucugaggugggauacagaugugguauggaaaaccagacagguuuucauacuuacagaaacucuucucagggauagcaauauggcccaggugguaaaaucucuugcugcugagccugaagacccauguucaauccccaggacccauguggugacaggaagaacacugacucccaaaagcuguccucugacuucugaacuccaccaugaacuggggcacauauacccacccccaccccacauauaaucaacuuaauuaaauucugugacccuacuccaaacauccucagagcucuaagagggugauuaaauccgcacccuggauugaugcucagaggagccacagaaccauaccuugacuuggugcuggcuacgugaugcccucagccucaccccaguugacccuguccugaaggggcucuaaugauucccugccucagccccugagccgcugcuccucuccuuggcauccuuuugcucucugcuccaucggcacccccagugcuauggcaaugagcuuggaccuaauuagccauugucuuaggguuuccauugcuguaaagagacacuacgacucuuuuuuuuaauuagguauuuuccucauuuacauuuccaaugcuaucccaaaagucccccauacccuccccccccacuccccuacccacccacucccacuuuuuggcccuggcauuccccuguacuggggcauauaaaguuugcaaguccaaugggccucucuuuccagugauggccgacuaggucaucuuuugauacauaugcagcuagagucaagagcucagggguacugguuaguucacaauguuguuccaccuauaggguugcagaacccuuuagcuccuuggguacuuucucuagcuccuccauugggggcccugugauccauccaauagcugacugugagcauccacuucuguguuugcuaggccccagcauagucucacaagagagagcucuaucuggguccuuucagcaaaaucuugcuaguguaugcaauggugucagcguugggaagcugauuaugggauggauccccggauauggcagucucuagaugguccauccuuucgucacagcuccaaacuuugucucuguaacuccuuccauggguguuuuguuccaaauucuaagaaggggcaaaguguccacacuuuggucuucguucuucuugaguuucauguguuuagcaaauucuaucuuauaucuuggguauccuaaguuucugggcuaauauacacuuaucagugaguacauauugugugaguuccuuugugauuggguuaccucacucaggaugaugcccuccaggucgauccauuugccuaagaauuucauaagcccauucuuuuuaauagcuggguaguacuccauuguguaaauguaccacauuuucuguauccauuccucuguugaggggcaucugaguucuuuccagcuucuggcuauuguaaauaaggcugcuaugaacauaguggaacauguguccuucuuacugguugggaccucuucuggauauaugcccaggagagguauugcgggauccuccaguaguacuauguccaauuuucugaggaaccgccagacugauuuccagagugguuguacaagcuugcaaucccaccaacaauggaggaguuuuccucuuucuccacauccuugccagcaucugcugucaccugaauuuuugaucucagccauucugacugaugugagauggaaucucaggguuguuuugauuugcauuucccugaugauuaaggauguugaacauuuuuuucaggugcuucucugccauuuuguauuccucaggugagaauucuuuguucagcucugagccccauuuuuaaaugggguuauuugauuuucuggagcccaccuucuugaguucuuuauauauauuggauauuagucuccuaucugauuuaggauagguaaagauccuuucccaaucuguugguggucuuuuugucuuguugacggugucuuucugcccuuguauuuggagcauagauauucagaauugauaguucaucuuggaggauuuuaccuuugaugaguaugaaaugccccuccuuaucuuuuuugaugacuuuggguuggaaguagauuuuauuagauauuagaauggcuacuccagcuuguuucuucauaccauuugcuuggaaaauuguuuuccagccuuucauucugagguagugucuaucuuuuucucugagaugaguuuccuguaagcagcaaaauguuggguccuguuuguguagccagucuguuagucuaugucuuuuuauuggggaguugagcccauugauauaaagagauauuaaggaaagguaauuguugcuuccuguuauuuuuguuguuaaaguuggcguuuuguucuuguggcugucuucuuuuagguuuguugagggauuaccuucuugcuuuuucuaggaugagguuuccguccuuguauuguuuuuuguuuuuuuuuuucuguuauuauccuuugaagggcuggauucguggaaagauaaugugugaauuugguuuugucguggaauacuuugguuucuccaucuaugguaauugagaguuuggcuggguauaguagccugggcuggaauuuguguucucuuagugucuguauaacaucuguccaggcucuucuggcuuucauagucucuggugaaaaaucugguguaauucugauaggcuugccuuuauguuacuugaccuuuuucccuuacugcuuuuaguauucuaucuuuauuuagugcauuuguuguucugauuauuaugugucgggagaaauuucuuuucugguccaaucuauuuggcguucuguaggcuucuuguauguucaugggcaucucuuucuuuagguuugggaaguuuucuucuauaauuuuguugaagauauuugccgguccuuugaguugaaaaucuucauucucaucuacuccuauuauccguagguuuggucaucucauuauguccuggauuuccuggauguuuugaguuaggaucuuuuugcauuuuccauuuucuuugauuguugugccgauguucucuauggaaucuucugcaccugagauucucucuuccaucucuuguauucuguugcugaugcucgcaucuaugguuccagauuucuuuccuagguuuucuauuuccagcguugccucacuuuggguuuucuuuauugugucuacuccccuuuuuaggucuuggaugguuuuauucaauuccaucgccuguuugguuguguuuuccugcaauuuuuaagggauuuuugugcuuccucuuuaaugucuucuaccuguuuagcaguguucuccuguauuucuuuaagugaguuauuaaaguucuucuugguguccucuaccaucaucaugagauaugcuuuuaaauccgggucuagcuuuuccaguguguuggggugcccuggacugggcaaagugggagugcuggguucugaugauggugaguagucuucguuucuguuaguuagauucuuacauuuaccuuucgccaucugguaaucucuggaguuaguuguuauaguugucucuguuuagagauuguuccucucgugauucuguuacccucuaucagcagaccugggagacuggcucucuccucugaguuucagugguaagagcacucucugcaggcaagcucuccucuuacagggaagaugcacagauaucuggcguucggaccucccuucuggccgaagaugaaggcccaaaacaggaccuuucccagaagcuguguugcuuuggccggugugcacacucucaccugugcagacuacuuuucagcggagucccagaaccaagauggcucccgcuguuccugaggcaaaggccucccgggccagguggacaccuguccucuggccggggagguggucggaugucuggagcccgaaaagggcgcugccucagaagcucuguggcuccugucagcuucugugugcacacucucaccugugcagacuacuuuucggcggagucuacauccaguuucuuaauacccaccugugcuaaugccugacucgacacuacgacucuuauaaacucuuacaaagaaaaacaucuaauuggggcuggcuuauaguuucagagguucaguucauuaucaucauggcaggaagcauggcaguguccaggcaggacauggugcuggaaaaggagcugagaguucuacgucuuaaucagcaguccgcaaacgacuuuaccugagcauaggagagaccucaaagccaccccuacagugacucacuucccccaucaaggccacuucuguccaucaaggccacaccuccuaacagugccacuucuuaugcaagcauucaaaagugugagccuguggggccaaauuuauucaaaccaucucagccauccuuaacaaagcggccuuuggcauuaagccccaccuguaaggggcuggaggcuuccugggacugucucccugcacccauguacucgugucuuuugaccuucauucaugcuguguucuaggccuggcuccucuccgggagccuccucugagugcuuuccccccugcagagguaaccuuugcuaagccugggagccugcagggguggaaucacuccucugaauuuaauccggcugacggguagauggguggcaccuggccaagaccccaaacugcacugccucucggccacuaagaagaaauaaucagguagucugagagagggccaaauggaggcggaacauugauagccaaagguggcuacagcgaccaagcaaccggcccgaguccaugggccucugugugcaugcgcuuaccucugagaccuggugcccugcccggacaugggcauucuuucucucuucccccaacaugcccacccugaugaggaagaagaggagcaagcuguggggaggaaguaugggcaaggcaguccuuugggaagggaaaaggcagguggauucagcugcucucuggcucuaaccuuggguaggguuugagauccuuugggcgagaggugaaucugcuuuucagcacauuccuaggaggugcuggacucucaguccagaggcagaaaagagccugucauaccccauccuggauucguuucauucaacagacugaaugaaugguugguuauucugauccagcgagagggacccgguagacauagcaagucccuucacugacacaauacagauuuauuaagcacuauccaguauuggcugugaccggucugugcugugccugcugccugggauccuagccccuggccugcccuuucaggaguaguugagguauaauucauuugugacaggcacaggggugcaugcugguacugccagugcucaggaggaggcaggagaaucaggggcuucuugugggcuuguuuucagugcugguaacugaaccuggggccuuauaguccaggcaagagcucuuccagugaagaauauucccagaccugcuuuguuuugcuccuaagacggggccucuuguagcccaggcuggccuugaacuuauauauagcaaaggauaaccuugaacugcugagccuucugccuccaccucccaaguauugggguuauaggcguucgccaucuugccuagacagaaguuauaugcacuuaaaaaaaaaaaguucuggggacuagacccauaaccucacacaggcuagacaaacccccugccacuaagcuccaucccuaccugggucaugaguuugaggcuaaccugagcugcguaggaagacucaggcucaaacagacagcaucacaggaagaaagaaagcccacccgccguuugcucggugugcagacggccucaaguucaaucuucaguaccgguagcaaaacuuaaaggugcuagggacaaacuaaguuggugcauuaccuguguggcauacacaagacccuggauccaagcgggggcaugcuacaaaccaggcacgguagugcaugccuguagucccagaacugggaaggugcuuacagaggagucaguucaggguccuccuccacuacauggcccuuaggcuacaugagaccuuggguggggggggucccugguaugggugccaggguccaacacccucuuccggucuccauagacaccaagcagguauacaugcaggcaacacacucauacauguagauuaaaaauaugcaaguauuuuuuuuuaaguuccuuagaaugggguguggagucugggcuaaugaagcagggcuggauagagggaugcagggaccuccacacugaaaagaugcucagaaauguacccaugcugacuggccaaggggaaaagcaaagcuauugagaccaaccgucuguuacguguguucagugccuuggcuuaccaagaacccuuaccucagggagccagcagucuccugggugaaggugggcaucaauccauuauuacagacuaucugugguuaagauaagaaaacugaagaucuuggagaacacagaacaggcacauaacaccuaccucgaagaccggagggcuuccuagaagaggugacauuguguagagcaguugagugaagacauugguugcuaaggagagggaacgggcuuaggucaaggcccccaggcaagggagaggugacuuuucuagacacagagaguuggcuagggugaaacaaagaaguguguaggagugggaacaagggugagccuagcuugugugaucgagguucauuaacugcucaggaaauccagagagaacggguuggagagagggagucagaugcaagcuuggugagugugggaacccacaauguugaaggagguggagcuagugaggaguaagacacaguauggacccccuuccuggugcccagugggauuuggugucaaaguuguuucucaccacaccccaguccuacuuaaauggacccuggaguagauucuagccucguccuggcauuuguggaaggagccagaagauggaggaucacauuuaaacaaaagccaggaaguugguggagggcagauuuggggguggggguggggcuuucccagugagggucuuggggagaggcacuggaagggaacaggacuggagccagguagagaacaccugggggagauggugguagggauaggggugacuuaaugugggugauuugugugacagccucucucuaucacacucaaaucccucucucacuggcuggggccagugagguuuucagccaucccguauuugauaccuacauggaacggugccugcgucugccacacugcaguuguugaucaagaaagucgcauuauugugaaagauggugggucaggcuccugggugucaggaauuggggaucuguaugugagagugcacuugacccuacccuacccccccccccccgggccuguucuaugccagcucuauucauccauggcuccuggguguagaucugugugugcgcacuagauacacuguggacgcgucuuuauccgcgagugugugugacuuguguccugaggcgggggugcgaggucccgaggcacugagccuguugcgggagaaggggcggcgcgcagagggcgggacucucccccugcgacgccgcgcgcacucccugcgcggaggaggccgcagcgccaccgcgggcugcgcccucacugacgcugcuacucaagccgccaccaccaccgcggcggggcuaaggcccccgaggagcgcgggugggagggggcccuccgacucugcgcaguacccgccccggcggcagcccggccgcaugcuucagauggugaagacccuggcccaguucaccaucgcgcuggaagacaugcgcgaucugggcucggccgccgccuccggggaguccgccgggggcggggacgggggcucugacaccgcggaggagccgggggaggcccagguacugggagggggaggggcagccgggaacuugggucuuggccuaggaugcugcagacccaggagaugggguagcguaggccgaugcuggagaacagggccuggaacuuagcucagaaaccaggaccugccugccugucagugcccggguugaggagagcugaccucagauguaggcagagagauugaugagccuccuccccauggccaaccggcacagccaacucuggcugcacuaguuggguuggcagggucaaggcccaagacaguacucucuugucaaaugggucaggugaaagcagauuuguuccugggacaccuuggguccccaggaaagccagauuuacaaccucccucaggguugaagggccccaacugcaccaccacuuugccacugggacccuggggccuguccccaucucugccuccaguggccuuucuggaaacuggaggaggcugggaccagggaugcugccuuguuuuuguguuugucugggcccugacucuguuccgugcuaugggcacaauggggacuaggccuaauccggguacuguacuguguuuugcauacgugucuccaaugcuccaggagucugggcaaaagggccuaccucgcagcuggauaacuaggcuucauuuuugucuugauguggggcaucuggccuucauagccucucuaugaaucuuucuucacgcugucuuuggguuuaaugacaggagagucccccuuaccaaguuccugccguguccaccuucccacgggcccccuugguccccaugccaggguccugucuguggcuacugaaggguuaggggaucccgagggaagcaggcugaagggcuggccagccuggaacaggugggccugccgaucugguugacagcugcuuugucccuccaucuccugcuuccccugucccccgccccccugcacugcucccguguccggacacgugcagagggugcuccacgcagugacaaggagcuggccuuguuuucugugcguuaccugacagcugaaugacagcccacugugcuuugcaguggggaggaggccgggagaggcggcugcauugcagcgucagcucccucuacccccagucucccggccaaccggcucagugccagcccucccccucaggaaacuucucugaccaugacccagguuggggguggcuggccagugagugugggcaggggacaguagcaguguggcccaaagccuggucuggcucuccugucggucagaaaaccuccagugaagucucagggaaguggaaugagaagggacagcuagggucgcuguguguggggggcaccucccugcuccccacugcagaacauggagccugugugguaccaggaacaaaggguuuuuauuccuuuucaugaaggaggauggcagcagggccacgaaagucacacaguggggaagagcagagcuggggagcucuguggcccgagguuccugguagugggagcauagggagcugggacccuagggcucugcauaaggugucuaaagaggcccugggccuugucugucacuggccgaaugaucuugggcaagucacaucacuucucugacuugacucgucugugacgccugugacuuggaccugcgugaggcugaaaugaguugcacguacuuaugaggugcugggguguucugggagcggccagcaaaggagcagacgugggagacccaaagccgcuuucaguuuuuaaggcuccagaagcccucaguauaaauggccugcuccuaguuaggggucucuaggguagagccugagaaacacagccuagcacugagcuuggagaaguggaguaagccagccuccugugucccaaggagacggcauccacgucuccauagagcucagagugagcguccacuucugagcgugccuccucaguuaucgaggggccaggcugaucccccaguuccagggucagaggagaccgaggcauuccaggcuauguacugagccacagaguaaggccuugucucaacaaacaaacaaauuacaacaaauagaguguaauacuaagcagcacagggacccuggguggagcaguggcaauggcagguccccugacugaggcgcugaaguaaggggugucgggauaagaacugaggaaaugcccaagcauaagccauuccagaauucccgcacagaaagagcauguugaaucugcaggccugauggcuggagccccaagcauggcccagauacguguguaggccccacacccuugccuaggcuagucuagagagucaagugucuguaugggguucuggaguggaguccuugccaggauguaggcuggugggaugggugcugucugggagggguuccuggauaugguuggggaccauggaaguuggcagcaggugagcucugccgcagggaggggguggggcaagcuuagacauucccaagcuugcuucuaacaaaaucuucccauaggauagagcuaauaacuuugacaggggcagggaccccagugccuagugacaugggugcugaugcugagcaaccucacaggacucuugggcccuguguaugugagcaucagugguucccuguucugaaaacgagcgacucggcugggcuguagcucggcaagugcagggcuugccuagccugugcaccaagcucuggcuuguucuacagcagugcauaugccagacgagguaguaaguaccuguaaccccuagcacuagggaagucuccacaaccuggucuguguaagacccugccucugaaagagaaagaggguuggugagauggcuugaagggcaagcaugaaggccuguguuuacacucccagaguuguaaaagcuggacauaguagugugugucugugaccccaccagugugucugugaccccaccagugugucugugauccccucagugugugugugacugugaccccaucacugugucugugugacuccaucacugugugugugaccccaucacugugugugugaccccaucacugugugugaccccaucacugugugugugaccccaucacugugugugaccccaucacugugugugaccccaucacugugugugugaccccaucacugugugugugaccccagugcuagagagcagagaucucugagcucucuggccacccaggcugagacagugaagcuccaggcucagugaguaacucuguguuaaaaaauaaauaauaaaauaaaauaaugugaagagcaaaagaagauaccucauugaccucuuauguacacacacacacacacacacacacacacucacacacacacgaagagaagaaauggagagacugugaacacacaaguggacaagagagccaggagaagaagggcuuggagccaggccugguguagagagcucugugaccuuuuaaugagacugggauccagccuugucagagcccuggugcuuccagcaccaacuuuacuucccugggcuguaguuucuucuucugaagcagaaagugacagccucugcucugagggaugcugugacacagccaggucaaacauguccucauagcagcaaacuggaacuugguauuuucagagugagucucuagaguggguguagcccagaggcaucuuccuuuguaaauacgagaguugauuguuguuggguuuugccuuuguccagaaccuguugggguaggaaaacagggauccacuuggaaggguauguuugagacucaggagagcguucccagcagagagugccugagcaagggucuggcagaauggagguccgggaugcuuugggaaacugggggacaggaagcuggcaaggaaggcccgggaaaaggccagaugggcucucucugugugcaggugugccugaauguagcagaaggugacagaggcuaaggggaacaaagauccacucaccuucuacuucuguccccgcaggacaugaggaagcacgugaccaugacccugcuggacacagagcagucguauguggagucacugcgcacccugaugcaggugaggccacggccuaggccugagagcagcaccccaaguguggacgcacacaggugggaucacucacauggacaggggcugagaccaaagagcugucugugagccuggguguggccacccccugcaggguuggugagacuagaagauccagggagaguaggagucucuacccuagaguuaccagguccccucaucaguccuggacccaguuuugagguguguaccuuuuugcccuuucugugacuagaauuaaaugcuagguaucugagagcaggcccugguccagauacaggaagcccaagggugugggaaagaagagccugcugagugcacauggggugcucuagagcagggcucucaaccuuucuagggaugcgaaccuuuaauacagucccucacguuguggugacccccaaccauaaagucacuuuaauacuacuucauaacuaauaucgcugcuguugugagucaucauguaaguauauaauaugcagaaugucugauaugggacccuugugggggucaugacccacagauugaaagccacugcuauagaggcaugggaggugccugaccgguguucuaucagggaaagcuccccagagaagaugcagggggauggcucuguucugcagagggcaugcacauuccgagagcuacauggugcgguguauggggggguugguucuuggguaauguugcaggagccagcaagggucaugccaugggguccuugaaccccaggagaaggauuggaucacaguuggguuucuggagagucaucagaggguuuugagacagguaggcaugagguuggaccugugcuuugggaagucugcaugacuacuggaaacaugaguggcagaagaagaagcugucccagggcacagagcuccaguaagggugcagaccauaggaaggacagagcggggacagacacuuaggagguaaguuccucaggucgugggugggggccgguguuuucaggaacagugggaagugggcgugaggugggaagacagggucuaugcuugggccccuagccugggagaggugagcaagauggggagggugccucuguggcaggaugaugggcugaggcucagcuguguguguacagcagaggccagagccuggguguaugugcugaaauggggcccacaaacacaacugaagaugagcuuacacccugcuacagcucagggggacaggacauauccagaaccacucacccuuccuucuuucccuucuccccguccagaucugcacagaucccuacaguacaccaaacccuagucucugggcagugcagaggccuccauucagcagugaaucucaggggcaugagucuuuuccccggagcucagggacugaguauucaggagaguggcccucaccagccagacaagucacacugucaccaccagaaauggcugcugcggugugugagguauauggguaguacuccacuagaaaaggagggugauuccaacacacgcuacggcacugaugaaccuggacaacacagugcuaagugaagggagcgcucacaaccaaccaguacuggauggcgugugcuccaaggugcucgaaguagucacaccuucaaagauagaagguuggguggugguagcaccgucccggggaggcuggggcuggggaagggugauguggggaguuagucuucagugguccagaguuuccagcuggaaggugaaguuggcauuuacacaacaguaugaauguaugugugcuaagcugaauacuugaaaccgauuaaagaggggcuaggaguguaacucagaaaagugcuuaucuagcaugcaagaaacccugggugugauuuccaggccugcauaaaccagguuugguggugcacaccuguaaucccagcacucaagaggaagaggcaagaggaucaaaaauacagggucaucucugacugauagauaauccaagggaguucaugaggaccuguuucaaaaccauaaaagaaacuaguuaaagugacaaauuauauaagaaauacauugccucugguuuuaucaaaauauccaacgagcuaagaacauagaacuaggacuucccugucguaugggcucgaggaaugugagucuggguuuggggugcccugcagagaucugagggguggguaggauuuuagcagagagccuuguugaggggaacaggcagaggacacaaccgaagcaaagaccaggacaguggaaaagccaccaucaucccccagaaguggcuggugugguugccaaggagaaaggaaagaagcucggcaagggcuaggggaccccaagaugugagacaagaagagagucaugcaaggacccauggccauccucuggugagcuggaggcaguacaaucagacaggcaggcaggcacgcacgcaggcaggcuuuaaguugcuuguccccuacuggggacgggaguuugagucucuucacuucucuaagccucgguuucgccugcaaaaugaggcuguucauggauuuucccgaagugaagauggaaagcuggugcugccucucauggcugucaacagggaguggggaccguggaaugcagagcaggugggccuggaaccaggaucgucugggcuccaggaggcaagcaggccuggaguugaaggcacuaaauugagauuucuggguggaagggagguggaggugagcaggagaguauuaccugaacccaagggcuggggcuuccaggagcauggacggaagauuggucccuccagaguucuggagccuggcucuagugcucaaauuuugcugcacuucuuggucagcuguguaaccuggaacagaugguggaccccguugugccucuccugccccggcuguagaguggcaaucaugauagcaccuguuccaaaugcauaucuuaugaaagauggguguagcaucucacauacugccuguacguguguucauauguauuuugggguguguguguguugugugugugugugcaagcucagauaaaaacaaacaaaauaacaaaggaaucccuuaccaaggucagcagccagaaggaggugggaucugaacccaggccauaacucuauauacacccuuggccuggguuucacccccauccuugaguucugucuugaaccccaauauuuucaacuaagacacugcccuuuuuuaaagcagccuuucuccccuuggcccccuacgcccucuacucccugcuuccagaguucuuacucccuucugguguacuguggaauagcuuguuuauuucuuccauggcuuauguacucccugcucagcuucugacucuucuggugugggguuucguggcuccugugaugugccugcuccucugcggugugacccagaaguaaauggugucacuuuugcucugggaggaaccacagauccugacauguccugguucuggcuaguaccggccagagaguccuauauaaggaggccagcugcuagcuacucaagucacccugcgccuuuucagacucuucagccagccaagaguauucuguucagcuuugacuuuuucaaguuuguuuuacaaaacaagccagauuuuuuaaaauguuuaauauaaauguuauuuuauaaauguaacaucacauaugucuuucaggaaaccucuucauuuuuuggcuugcaguugcaucaugggccaguagagggcgaucucaccaugaaaacgccaguggaggggcauggcuguucaugcuuaggaaacaccacuaaauguacauuuguggugaaaaacagaaauuuuaggcacagacuuucuuuaguacaggccuccagucauuucagaauuagcuuccagugcccugccuaccacugcuuuauccuaaaucccaaggcuuucucauggugaagccaggguuuguuguagaguagguagcaugccauaauuuaaucagcaucaggguuuuuucccuagaugguaacuuaaaauaacaguguaucuuagauuuggugaaaugugcuuuuguuuuuuguguuucuuuugacuagauguaagcucuguuagaucuuuucauuggcuaguuuuuugagagaaggucucaccauguagcccaggcuggccuugaacuuguggugauccuccugccucagucuccugauccugagacuauagguguauaccauuguguuuaucuuuuugguucuuauucacuguugucuucucccucuuaaaaccgugccuggcaaacucaaucaauauuaucagugagguggugcugacuccuggaaagcgccccacucuccccgucuucuugcuuuccucucuccacgaucuuuucgugacuccaucaugcucccucugugcuccuucucguccucugacagagcccugagcugggcauguaguagguagcauuugggcgacagagucuuccucccacugcugagcuccuggucuaaccagggaggugcaguggcaagucacugagcugcaggcccgggugauucccugugcagaucugugccgaccggugcagguaaggcgaggguagcacuggaggagaugggcugacccugugcauccugcagggcuacaugcagccacugaagcagccggagaacuccuugcugugcgacccgucucugguggacgagaucuucgaccagauccccgagcuccuggagcaccaugagcaguuccuggagcaggugcggcacugcgugcaaacguggcacgcccagcagaaggugggagcccugcucguccagucggugagugucccugccucggaggcugcagccguagaccuugacuggaaccgggacaggggagcuggcacugcugcugaccuggaccucaugcucagaugggugugacauugaugcucgccgcggucuggcuccuuuuuuaauaacugugguucauacuguccggcgcuuuuugcaugcugggcauuauccugcauaguauauauccuagggcccuggccucucaugucaccugccacgcuccuccuccuaggagccacagcaucccgugagccccucacaguccuuccgugguagcuccgaauuccagaagagccacaaaagcaaaguuuaaaacaaaaacagaacagaacaaaacaaaaaacaaaacaaacaaacaaagcugagugguggugauacgugucuuuaauuccagcacucuggaggcagaggcagaugcaucuuugugaguucaaggccagccuggucuauaggaguucuaagacagcaagggcuacacagagaaacucugucucaagcaaacaaaacauuucauuuuauuaaacuccugcaaacauaauguacuguuucuuccuaaauuggcauuuauuuauauaaguuuaauuauacucaaaaaacuuuuaauuuacauuuuuuaauucccaagaauucuuaacgaugacugauaaaucauagccaaacucaaauuaaguguuaccuuagagccauguaguuacaaaagcaaaacuguagagaauccuuccagaaaauuccaugccaaaaagaagaaauguuccacauagcaaauuuaaaaaguccucuccccuuugggccguaagcuuguuuaaaugugcuccuuaugacgcagaguggggucuuaaccuauguacguaggccuuaguuuguccuugcuccuuggaaacuggugccaccagguaggauuaagugcuguugccuucacucucugucuggaccuggcugcugucugugggcugacagggagcuccacaaggcaggcccucccucaucggcucagguucagcccugccauguccagagacaggaacauuuggcaccuuagagaaucagggacuccaagaucuguaucuuagccuguccuuggugcagcugaaacuggaacccaguuguccucucuuguggaaaagcccucuccuccgccccccaccagcaccuaccaucagccaaccagcaggauuagccaccacugugaacccuguccugagccaggcuucauucugccaggagagagccccuaagucaggcagcaggcacauuccauaaaagcagacugcagcucagugccaagggugggucuauugugcugggagggauguuccucauggaggaacgaacugcacaggcagagucccagaagcuacaauaauguguucacuccuacuaccaggaaggucugaggccugccuugcugguuuaaugggauuggagaccuggugauagauugucuggaagugaaaacaaauaacaacaaacaaauaaacaacaacaacagccgcagcaacauuaaaagaaaaacaaaaaacaacccaggucuugucucagcacacaucuaggcacauguauuuguauguauguauacauauauguguauauauauauacauauauauacauacacaccugcucauucagucacguucaugcaugcaacauguaugaauuuugagaaagacagagaagaccugccugaccauuucaaguuaaauagacagaagccaggacagggugaagugggugagggacaccugagccugccuaaccugcuuccucacccacaguuuuccaaagacgucuuggugaacaucuauucggccuauauugauaacuuccucaaugcaaaggaugcugugcguguagcuaaggaggccaggccagccuuucucaaguucuuggagguauguggacugggguaggggugaagcuaacaugucaggcuagcucugggcaucccaggagcucuugaccaaaaacauuguggugcuugcaagugugucagccucugccuuugggcucaccuggagggacuuggcuaggagcgugucucuuccugccgugucaguccucaugugagaacucccuccacucugccuucgguuucagcaaagcaugcgugagaacaaggaaaagcaggcgcuguccgaccucaugaucaagccugugcagagaaucccacgcuaugagcuucuggugaagguaaccacgggccuggcuggacagggaggcccugggggucggggggaggaguaugucuguucucagacuccaggcaggaaagaaaguccuccuugaugccuauaccauggucucucaugcuccagcagucaguucaauaccucagggcagcuaaacaggucuccauucccgccccaggaccuucugaagcacacaccggaagaccauccagaccacccacugcugcucgaugcucagcgcaacaucaagcagguggcugagcgcaucaacaagggugugcggagcgcugaggaggccgagcggcaugcccgcgugcuucaggagaucgaagcccacaucgagggcauggaggauguacgugccccacccugccgugccccaacuugucccugucugugucuucaucugucacccggauuguggccauccacguccaggucuguggucagcuugcuucugugaccacagugccccacccuucuguguccuccuccuccuccuccucugucugaccuugugucccugucuggcagcccagugaugcaagcgaggacaggaugucgcucuggcugaccucguucauagaguggucaaccgaucacugcaggguuaauagacuaauaacuaguucucuccuacccaccagcuccaggccccccugcggcgguuccugaggcaggagaugguuauugaagugguaaggguucucccauuggcuguucccccaaguaccuucaacccacccaaguucacucucuggcgccugcugcccucugguuccugcuccccaagcaccacacaaugggagcccugcaugaaucccgauuccacauaagugggggagagcccucaccccucccuuggauuugcuguuccuggggaacuaggguaauguaggucggccucuagacugugcacacugagccugaaugccacuuuggacccuacagaaggcaauuggaggcaagaaggaccgaucccucuuccuguucacagaccucauugucuguaccacccugaaacgaaagucgggcucgcugaggcgcagcuccaugagccugugaguggccaggguggggcuggguggugcaggcaggagagccauugaucuauugugggcucuacucccugccccagccagagcaccccauuggcuacccacagguacacagcagccagcgucauugauacagccagcaaauacaagaugcuguggaagcugccacuggaagacacagacaucaucaagggugaggcuggcugagucugucagggguucugcugguggcuuuccccugagucugccugccugucuguugguuugucugcucuugugacucaucuuucaucccauaugagagauugguuuugaagaaccggguuaguuuccaugcaaaucauccucuuagugcccuagcaaguucuccaagaguuggccguucugugcccugugacucuaaaccagaccucuccucccgggccuguuuuuuuuuucugagagcuaccuguugaccuuguuucugagagcuugggucuggaagugcucccauuugccagaccaaucccgugcucagcugaaggcugugcgcuaagggaagugugucuguccaagcuugaccuuguuugauguguucauggcuuuccucuguccucgccaggggcgucucaagccaccaaucgggagaccauccaaaaagccaucagccgccuggaugaggaccuggccacccugggccaaaugagcaagcucuccgagagccucggcuucccccaccaggucugugcccugagcuaaggcaguguuggcugggacuuccccugaccuugccugagggacagacagucuuggcuuuugccugagggagcaguugguccugucacuuaucugaaggggaaaauuauagucuugcucccacuuaagggaagugacagguccggggucugagggaggagaccucugagggggagaaaggcccaucccugucuguggcaggaggaggcugccuuccacgguccccucggugcaggugcccauguggugacaccuuggccugaggccuggguucuuuucccacagagucuagacgaugcacugagggaucucucggccgccaugcaccgggaccugucagaaaagcaggcgcuaugcugcucccuggccuucccgcccaccaagcuggagcugugcgccacccggcccgagggcaccgacuccuacaucuuugaguuuccccacccggaugcccgccugggcuuugagcaggccuuugaugaggccaagaggaagcugggugagccagaguucauguuggugucuucucucacagucccugugcaguccugacuguagaagccaggacucucugaacugcccuccuguccuccagcggccgauagggaagguggccugagacuuccacagugaagcagcaggcuggacauuugcucuggcucccagcuucuuccugggggggaaggaacuccuggacagagucguuuggggacagggaccccagcauacgccugaaccaccaagaccuuccucuuccucaguauagacucagcuaaguccuggaaaguuauuauuaagucuacagcuuagagauccagggcuacucauuguacagaaaggaaaacugaggccagacacaaacggaguaauccaugaccucucauucuagcugagcugguacccggcccucccuagggagacuggaauggggagggaccagagccacuguaaggugggugcuaagcagggguucucuccuuuugcccugucuccucuacuacagcauccaguaaaagcugucuagacccugaguuccugaaggccaucccuaucaugaagacucgcaguggcaugcaggugugugugugcgugugggccauguagacacgugucuacucaaagcuacauacauguguaugagguuuugugcuguguaccaucucacauauguauuuuaaacauugugauuauuccccguguuugaguauauacacaugcacauuacauguguaauguguauggcaugugcauaugugcacaggcuguagauuugaagucuaguucauacaccuauaugaguuuuaauaucuaaccaguaguaccagagucacauauuaauuaaacgcauacacucaugguccuauugggaguacauguauguguacauacagguuugggcgacuuuucuaucgggcauggugcauuugacugauguguagcaugguacagagauggaugcaaaccugccgccccucuguucugccggggucgguccugacaggauucugucauucaucuuucccuguccacugggguuucccacaguuuucgugugcugcccccaccuucagcagcugcccagagccggcgccagaggucugggugugcaacagugauggcuacguaggucaggugugccugcuaagcuugagggcggaaccagauguggaggccugcaucgcuguuuguucugcccgcauucucuguaucggagcggugccaggccugcaaccacgcugcccgcgguaaggcucugguggcgaaccuacaaugccacuagccuuuggcccaguacauugaauguugacccgguggcguugggcggggcugggaggugggcuguccgugggcggggucggacggggugcucucucgggcgccuccuaguggcaucccuuguucuuuuucccuuugucucuagagagcagccagagcccuugagaaaccccccagagaccacacuggaauccacugggccagagcuagauguugaggccacagcugaggaggaggcagcgacgacgcuggcugagccagggccucagccuugccugcacauuuccaucucaggaucgggccuggagauggagccaggcccugcuaagggugacccccagcccgaguuggugcccuuugacagcgacucugacgacgaaucuucacccagccccuccgggacucuacagagccaagccagccaaucuaccauuuccuccagcuuuggaagugagugugggguggggauugagaggacagcaagugaggggacaccagaggaggcaaaggcuggagucgguucacuagguguuagcuucuaccaagugggggaugggaauaugaagacucagacacaucggaguccuggggaccuucgaguacaguuaaggaagauggguauuggguagaguggcuagucccuccaucuagauguggcuggacuuaagacagccaggcaaggacugggaaccuguagugagugcugagagugagcaggggaaaggccuuagcagauacggggaccagggguaggagcgauguguccaggagggacacugaggccuagaaagaugucggaucucugcccgguggaggggaauagggacagagaucuuugucccuucagaugaagagaccccaagcuccaaggaagccacugcagagacgaccagcucugaggaagagcaagagccuggcuuccugucacucucuggcuccuuugggccagguggucccuguggcaccagcccgauggauggaagagcccuucgccgcuccagccguggcucuuucacaaggggcagccuugaggaccuguugaguguggacccugaggccuaccagaguuccguguggcugggcaccgaggauggcugguaggggcagggggaguccuaaagcaaaagugagggugugggaguugggucuagucucgggggucuugccagcugaggguaccagagggcuugaaacccaagagaaccugugucaguaccugguggaggggagguggaggcagagaggguggagccagguggaggcaugacaccugggccugggagauuugaccacuugucacagacgcuccccuaacccacaguguccacgucuaccaguccucugauagcauccgugaucgcaggaacagcaugaagcuccagcacgcugccuccgugaccugcauccuguaaggccccggguugcccuucccacccagaaucaucuuagccagcacauaggcugccucuguuccucugccccagcucugcuggcccccuuuucugaggaagaugcagaauagaggccuggaccaaggccagcugugcgucucccaaacucuuggcaggggugugucaguauggcuucuuggccucagguucccccaacguugagaguagagaauuuaaaaaaaaaagggugaucucuuaggcacagagccauugugccugugacuuccuuggcccuggggugcccauuucagucugugggaagcaccuuacuguuuccuuuuucucagguaucugaauaacaagguguucgugucuuuggccaauggagaacuuguagucuaccaaagggaagcagguaugguccccacacaccugccuuuacccacuggugguaacugagcucucguuuagguuaaugggaacuucugagccacuggccuagacauauaugagacucugggcaauuucuagggccccccauaucuugucuuauaagcgggaacauccacaccucuucagggaagacugagacuucaaauucgggacugcacuaaguuuuuguuuuauguuuucuuuaacccauuccuuccccagggcguuucugggauccccagaacuucaaaucgaugacccuggguucucaggggagccccauuaccaagauggugucuguggguggacgacugugguguggcugccagaaccggguccuuguccugagcccugacacauugcagcuggagguagcagggcugggggacagaaugagugauuugggggugaucuggggucacaggagagggagauaagaccagagggacagagaagcaucuagcuuagauguuaggaccuuucacugagcacugucucuuaccaggccagucucuaccugucucugguccuuauuuguacucuagcuggugaggaagacaguaaguuccuauaaacguuagaauuucucaguuauguuccugcuguauccucucagugcaguauugggguccuugugacucagaggguccuugauguuggcauugcugucaucccugguccuuaguccugcuucguaaaccagaagcuuggacagaaccuaggggccacagauuuccuuggguuucauugaguugaagguuaaagccuggggccaggcccuggcucugugacuaugugaccaugggccuucuuagggugugaucuuccuccuaggcuaauaauuccccaucuauccagggagagaccagugacuggucuaacccccacacgaacuuuagucacucaagugucauagggaaagggcaccccuuuuaacuucuggaggaccaagugggcaagcuuugaaauuaaucaaccagacccaggaccaagacugccucggcucucgaucugggcagguaucuagagaacuagucuguggagagcuauauguaggaugggcaagggcggggccaggcaggaggacccugggcagcuuuaccgacuaccacacggucucugaccuccuccccuacagcacacauucuacguggggcaggauuccagccgaaguguggcuugcaugguggacuccagccugggugugugggugaccuugaaagguagugcccauguaugucucuaucauccggacaccuuugagcaacuggcggagguagaugucaccccuccugugcacaggaugcuggcagguacugaccccccacucccauccugggggaggccuugacacggucagccuacaggcucaaagaugcugcuccccccuccccaggcucagacgccaucauccggcagcacaaggcagccugccugaggaucacggcgcugcuggugugugcggagcugcugugggugggcacuagugccggggucgugcugacuauacccaccucuccaagcaccgucagcugcccgcgagcaccucucagcccagcuggccugugccagggccacacuggccauguccgcuuccuggcugcaguccagcugccugaaggcuucaaccuucuauguucaaccccaccgccucccccagacacaggugggucugcacauuccacgcccauccaggggcucugcuaggggaggcuuuagaaggguggaaaggcagagagcuagaagugaagccccuuacaagaaauaggcugcagagcccucaaaugagacugugugggugcucuugugugugugugugugcaugugcauguguguguguguccccugagugcaugcaugcauguguaugaaguuguuguccagggaagugucaugggagucaggaagugagcuauaagcuaaucagggagagauauucauggaaaauagauuguuguguguguuucuuaaauguaucaggaaguaaagcagagcuagaaaugggcaggaaaugggcucaggaagugauguccagaacaggaaauagaguaccagaaaaagaggauagagaaucacacacacacacacacacacacacacacacacacacacacacgacaggaaguaggauuagaaggugaaauagggaaaugagguacuuacuucucagaggucacaaugcuuuuauaggacaagaaaccuuguugccaaguagaagugacugagaaucaggagucaguagagccuaaugugggcccuguguggaucuagaaaaaagcugagccauguuaacugggaaagggcauugggugcaauuaugcauuauauagcaacagcucauguucugagagcuguguguuuagaugauuucauugcugugggugugucauagaucacuuacagaaaccuagaugguguaagcccacagggcugugccuuaggauagauauaaauggcauagccuauugcucuuagagccaugaugaguaaaacacaagaauaagucaagggcaugagaacagcaugcaguaaacccgaggcagacaaggccgcugccacuaacccugcuugcuguuuacacuuaaaauauuuuuuuuuuuuuauuuugagacaaaguuucucuguguugggugucuuggaacucacucaguagaccagguuggccuugaacccaagagaucaaccugccucugcucacaagugcugggagcaaaggugugcgccaccaccaccuggugaacuuuguucuucuaugaaaguaaccagugcuuauaacugcugagccgucucucuagauccuccuccuccuccuccuccuccuccuccuccuccuccuccuccuccuccucuaaaaaucgaucagggccuuugacugaaccuggagcucauccauuaggcaaggcugaguggccagugagcccccagaccuccugucucugcguccccagugcuggacuuacagacacaugcccacuguacuccaggcuuuggaugggugcaggagaugugaacucaggcuugccaugcaaacgcuucacagacugaagugucuccagccaccccaccccagccugugcuuucuaaucaggcaugacaucagcuuuuagccacuuuccaucuuuauuauugcugcacauauaaggucgucuuuauauaacuacauaaugaauuuuggccaaugagacuaaaaaccccuuaucaccuagggacguuguggccaucuuacuggcaaugagucacaauguucacguguccaaggcauaaacagaccuacugugaguccauaaaacguacauaaaaguguagcacauucacuuaugugcagagcauauguuaugugugcagagcauauguuacuggcuuguuuauuuucuauuuaucuuuuccgggcuuuuguuuuuguuugggaauugauccagagcaguguacaugcaaagaccuuuuccugccccgugaaugugcuaagcuuguuuagcugucuccagaguauacaccuacugcuuacaugaagaagguuuauuagccaggugauguugccuuugcucccagcacucaggaggaaucucuugagcucagggccagccuggucuacagagggaguuuaggacagucgggcuacacagagagaccccgucucagaaaaaaggggaaaaaaggccaaaguucaguucccaauacucaaaucagguagcucuccgguacauacaaacacauacacacacacgcaaacauaaaauaacucuuaacaaauucuauaaugaugaugaugauaaugaugauguagauccaugcaacaggcaguggucacacacaccuuuaaucccagcacucaggaggcagaaacugaaggaucucugggaguucaaggccagccuggucuacagagcaaguuccaggguagccaggccuacacagagaaacccugucugaaccaacccccccccacacacacacacacauacaccaaaacaguagaaagcugagggcuguggcacaaagcuuuaaucccagcacucaggaggccaaggcaggcagaacucugccagcucuaggccagccugguccaaggagcaagcuccaggcuagccuggacuauauagggagauccuguuucaaaacaaacaaaaacagauugaucaaggacgacguccauccaguguagacaucuggccuccacacacuuguguguacacugugugaugcacacccacaugaauauguuuguguaccacacacagagaaagagcacaaaugcaccugugugugugugugcacacacacacaggcauaauaagugugauugccaaguaaguagacuuuucuuucaguauggaaaaucuugguuaacaggaagugggggucccccacaggaagugugugccuuauuaucuuccugggauguaggauguagacggucaagcaaugauaggacaugaagcuacaaguugccucagguaaaugaucccuguccuuguuccccaggcccugagaagcugccuucccuggaucaccgggacuccccucggcgccgaggccccaccucagccaggccuaaaaugcuggucaucagugguggugauggcucugaggacuuccgacucagcagcggggguggcggcagcagcgagaccgugggccgagaugacagcacaaaccaccuacuccuguggagggugugagccugcccucuguggcccaggacucaccuguccaccugcccucagccugccugucuccucccaggccacaugcagaccuugagcagaguguccaagcaggggcauaccauucggacucugucucauccuuguggaagcaucccugguagaaggccaccagcgaggccgagcaaggccucugguacccacugacuacccuagagcuccccuuugggagcaggguggagaugugggggcugcccaggaacugucccugaagcuucuaccaaagacacagccaggccuggaccccacagggcuggggaggccgugugcaauauguggagagcucucuggggcagugcgaaggcuaaggggcggcaacccuuuucuauguacaguauuuauguuacuuucuagaugaauacuuuccaaagcacuuauuuaugcagugaccuggggcaggacgugaugugaggaaaagacaggaggaaaaaagccuguuccugccugagaggccacccuggagcccuaaccaaguuguccuggaaggaccaaugcccauguguuacacacacgcacgcacacauacacacacaccacacucacacucacucugcauguucagggcacuaagacacugucccuuaaccaagcuccagcccucccugauggcgcugccaucccaauucugaagcaaagccugcucgauccgcucacuggggagcuuccagggguuagcauuuccaaggugacgccugagguuccccagugugggaacagugguaggucugggaccgggcuuucucagguaagagaaaagggccuucaguccucacagcuggcucaagccccagccucugccuccccaugucucaugcacuggcacaauggucaccuuguggggaccuaugaguccccuuucucugaccacugaaucgagucccucucuguaaacacccacgcugccaagggcagccccuucaggaaggacaccccacccccaccccccagaguugaggggcuagacauaaccuuuuuaacugagaaggccgucgucccucaccgccaggcugcagggagccaccccgacccucagccccuugcuucagcuacaacuccaaaggucugguuucagauaggguuuguuuguucuguuugauuuuguuuuucuuuggggugggugggucauuguggucuuagaugauguuucucuugcuaccaaacagccuuguguuaacucuccucagaugaugaaauuuaaagagucaauaaauagaaacacuaaaugauggcucccccgggccuugggccaucauggccuccugccagcugucucccuaaggacgagggcucccugacucugccucaauugggucaaagggaggagauaaggaaguccugggugaugggguugacacugaaccuguguugucacgggcagacugcggcugucugggcuucagucuccuuagaagaacccaggaguucugaauguuagaauuccuuacagcucauaugcguaucaauggugugucagucuagcccucccgaguccagcuagguuuggguuugggugucugacccagggcuagaguuccugucuaaggcgccuguggagcagaacuaccacacaagucgggcugauucugguccaaagagaugugucauuacacaagacugcaaaggauuuaagugcccagcaacauggggcugcucucuaggggccaagagccccccacacacacaccauggugucuuccccaugggacuaaguggcccucacagcagaggucagguuaugccgaaucucugcuuaggucagcccaaaugacucacuucaaaauucacuuuccuggacuggggcaauaauaguuuagugguuaagagcacggacugcucuucgagaggacccagguucaguccccagcagcucacagccaucuauaacuccaaucccaagggaaucaaaugcccuugucuggccuccagggauacggcaugcauguggccacaaaccuccaugcaggcaaaagacccauacucacaaaauaauauauuuucaauaaaagaaagucuguuuuugcacugaacagauaguucaguugacagacuguaugcuuggcaugugggaaaacugaagcaggguauucuugaguucaaaaccagcuuagagaaguuaugaugauaugugccuauaaucuuagcgcuugagucacuggccagugggucucugugaauucacacccagccuggucuaccaagcauguucuaggucagccagugcugcauggugagaccccuuccccauuucaaaacaaaaugguucuacauggcaagacacacacacaaagggagaaaguguuggugugugcuuuuauuaacucgcgugcaucccucaggggucugcugggucuucaacaccacaggacguguacaggacaucuugcuagcagcauuuucgugaggagacgguugugccuguguggaauucaggaugaaauggaaggaacacaggcuuugcauggaacggcuucucuuuggaaucuugucugauagcagccaugugaccaggccaaguuauuuccuucucaguaauggggucugauaaccucuuuuccccuacaggaugguuggcuagugcauguaguucuugaaaugcaaagagguccauuucuggcccuuaaaucuaaagggugccugcgucuggagaccugagcuggcggucagagcccagugaucuacauguugaaggcccaccucaggcuccuccccgcugccacuaguccaguuauuugcauuucugacaguggcugccaccuuuagugcuucagucauuucugcuacuccaggauuucugccucaacagaggcccaaagcagacuucacuuucaggacuagauacauagggcugggucugcgccauccucaccgggaauauggcuggcacauagcacaaccacuuagaagacagccugccagggcaugggcuggccugaggacagguguccaucuggaucaggcacucagcaugaguagggcgguccugaaggaacaggccucaggcucauccccaagggagucuccuggaaaaauuacaaccugggcuguucauuauuaguucuccaggggcacaggcccaccgaaggccaauuaaauuaaaaccuuagcuaggacccagguaccaguauguuuauugggagccacugauacauagcacuuauaugaggaaguacacaguguacagcucaguauagaacggccaagaggcauccaucaccccaacagcucuccuuauacucguggccacccaggcuugagacacugggguguggucuucccagacagcauagagaacugccuuaaagggcaugauugugggugagaggaagcaggaccaagguuuggugugaagcaggauuaugcaaggagggguguaacaugcaggggacgggauauaagaugcaaggagggccauaagagccugaugugaacggucuguuguacagacagaaugagagaaggcugaaggagcuuggauggaugcucugagggcaggguguguucucagcuucaucccuaagccuacuugcuguagcaagcaucaauaagugcucaauaaauguugaauucauguuuaaugaaauaaacauuggagaauccaggugagacacag

SEQ ID NO: 3967 - RNA, 152 nt, Mus musculus
gaugggucaccagcagcucuacuggagucacccacggaaguucggccaggguucccgcucuugccgcgucugcucuaaccgccacggucugauccgcaaauacgggcugaacuugugccgccagugcuuccggcaguacgcgaaugacuaag

SEQ ID NO: 3968 - RNA, 39220 nt, Mus musculus
uauaaaaaacaacauuuaauuggggcuggcuuacagguucagagguucagcccauuaucaucaagaugggagcauggcaguauccaggcaggcauggaacaagcagagcugagaguuccacaucuucauccaaaggcugcuaguagaagacugauuuccaggcaccuagggugagaguauuaagcccacacccacagugacacaccuacuccaaccaggucucacaccuauuccaacaaggccauaccuccaaauggugccacucccuggugcaagaauauagaaaccaucacacauguauauaacagcaauuauuucuacagcauuuacaguuuguuagauauguguagguuauauuuaaauacuauuccauuuuauauaagggacuugaguaucccuggaauuuaguauccauaaaagauccuggauucaauccuccuugaauacuaagaaacaacuaaauuucuuuuuucaguuuuaggccugauucccagagugggagcaaacagaaucuguagaccuuugucugagauuggguuuauuuuuauucuuucuugucuccuuuuuacuuagaguuucugaucauaacuggcacuaucuucaugacuucccucaacaguugcacuaaggcagucugacagucugcuuuguugugcagacucccuagggaucugacauuugcagaauuacauagaaauaaauccugagccagucauccugaagacugugcugaauaauguggcugaaaggcaaggagaugaaugugccuaaccuugaccccucaauaugccuaaugguccugauaguccuugcaguccaguggaauuuguguuuaaauuaugagaaccugcuuaugggcuuaagcuaaucucaauuaaaagaaagaguuaauuucuauaaugaaacaaauagaaacuguuaaaagacuauccuugccaaaaaaaaaaaaucuucaauugcuuuuauauuuauaguacuuucaaauggucagcaggcuuuuucauugaucuaagcucuaugcucuagaccaggcuggccucaaacucacagagauccuucugcugcugggauuaaaagcaugcuccaccaccgccuagcuaaaacuuaauguuuuauccacuuugauuucuguggaauacaaacauuaguuucuucuuuuuaaaagugugcugaaaauguaguuguguuguuagagccuuggcuuaacauucaugaacuccugaguucaguccccaauaucaccuaaaccagaugugguagcauaagcccuguaaucccaauacuugggaaauagagucaagaaaaucagaaguucuaggucauucucagcuacauaguaaauuugggaccaaccugggcuacaugagacccugucucaaaaauaaguaaaauagugauaaugcuaacauuccuaaaacaugucaaagaauacucaucucacuuucgagauaagcaucuaguuuuaucagcuaagcuuaaauuguuccuaaaagaaaagaguagggcucaaguguuaaugucagguauauuaguacauuaucugcaugagaacucguuaauaagcauaguuacugugaauguguuuucugaugagcugauggaacuugggaaacuaaguaucuccuuacagcugugagugagugaggagagaugacauuugaauccagaggugucugccucugcagcccucagaccacaagcccuugcucugugggguuucucuguguucuucuaaucuuggucaucuuauuuacuguguaguuugggguuuuuuucccaaucaucauuggauguuuuauuuucaguccuauuacugguuguguuaaaucuuuggguacuaugugacuaguuaacauucaaauucccaaacuuuugauauuucagcagcuuuauuaaagguuaaaaacaucacuuucugauguuugacauguguacaccagugaaagcauugcaguuacaauaauaguuuauguguauacuaaauauccuaaaaugcuauguuuauuacucucacaaacuuuccucauucucuuucauaaucaugcucauuuuccuuccucaguuaaccacugaucuauuuucugcacuuuagguuacuguguuuucuggaauuuagauaaagagaaccauaugaacucuuuuguguggaccuuugaaaacucaguguaagccaggcaugguggcacacaccuuuaaucccagcacuuggaaggcagaggcaggccgauuucugaguucgaggccagccuggucuacaaagugaguuccaggacagccagggcuacacagagaaacccugucucgaaaaaccaaaaaacaaaaaaaaaaaaaugauuuuguaaugauuuugaggaucacaaguguuguuguaugcugaccauuuucauugcugaacaauaguguguuguauagcuguagauguuugcuauccuucuacucguuggugggcauuuggguuguucuggacuauuacuguaauuuuguaagucuugaauuuguauagggcauguacuacuaacauaugcuuuugaauaugcuguauaguggauauauaguuaauguuucaagaaacuaauccuggugacacaggucuguaauuuagcuccuugcagggcugaggcaggaagaucacaaguuaagaucuguaauagccaaugagcucaaggccagccuggacaauuuauugaaacccugucucaaaauuaaaaguguaaaaagugcugggaaaaggcugacuuucugagacaggaucuccauuuauagcccuugcuggccuagaacucacuuuguaaaccaggcuggcccugacuguucuuccuuccucugccagguuugcggauaaucaacaccaaggcuguucuccuuuaaauagacuuugaucauuuuauuuggaguuuguuguaaaaaaaauucuuuguucuauccaacuuaccaaaguuacuggcauaaaguugcuuauaauauucuuggcuauucuuugaauauguagagugucuuuagugauaucagucaccccucuuauuccuguauguuuuguguccucuucuccccacccccaucauucuguucuaauggaaguucaucaaauagauggcuuucuacaguuagcaaacuuuugguuucauugcuuuuuuguuguuauuguuuuccuguuuuauuaauuucugcuuagauuuuaauuauuuccuuucuccugcuuaauuuggauuuaauuggcucuuuuaugauuuuuuuuuucuucagguagaagcuagggauguugauuuuagacauuuucccuuuucugguggaggcauuugguaaacauuccugcuacauacaucuguaggcucuuugcacaguuuugcuacugugucaucauucaguucaagaugcuuucugacugguuuuucagcccuugaauuuuugaauguugaaaauuuguagaagcuuucuagauauauuuccacuuuagauuucuaauucacuuauguuguagaucaguaacauacuucaguucuuugaaauuuacugagacuucuuuugugacccagugugugauauauaaagagugugcauucugcugcucuugaaugcuguguucuacaaaugcaguuacaucuuguuggcugauggcacugccuaugucuuccauauucuuacugcucugugaugcgcuaugccuuagggaauacaagucgugucccaaaccugugugaguucuagagauacguuucucuuguccuucuagaugguucuauuucuggcuucagcuacucuguucaugcacauacacuacucagcugaagacuugaggcucugcagauuucucaggaucucuuucugcucuccuuguuacugugcuauaaacccuagccaccuuggccugcaugaucuccauguuccacucaauucagagggcacacuguccucagcuuggaaacuucuucugagcauaaguugugcagacuuuuccauuccccagacacuacugucuuucauugcuuaauggccuaugucuugaaaacuuuuaaauuuuugaccauauuuuauguuauuacauuuauuuauuggugguagggcauacuaaauuaaucaaauagaggucaaaggacagcuugcaggagguggcaaguaccuuuacccacagauccauuuuacaggcccacaacaaauuuuuuaaaauuguuucuggcaugaaauucaaaucugguccuuaguauuccaucuugcuuugaacagaaguuuauauauuaucuacuuagugcuuggaguaagguccugugcucugcaaguagaguucagagguucugcuaaucaguuuucugcaaguagcugcuuuccucuguguugggugucaacaaauucuucaucugacucucugugccucauaaaaccagcaaaagauaaugauggacugaguaccucccauuugccaaguguaugggguuuaagaugcauuaccuccuuuaauccuucugauagcccugugaaaaaguacuugucuucauuagaaaaauaguugucuucaaaagagaguugagaucacuaaaguuuaggaaccagaugacuugcccagggucacacacagcaaguaagugauacagucaguauucaccuccagccagucagucacugcuuccugucugggagaaccccagagcucguagcagaagacagccgcuacagaaacucacacaggguucuucuuacugccuuugcaggaagaguaagcuuuuuacaacauuuaagaaaggaaaaauguaaguauggcuaagaagaauuguuuugauugaagaaagaaggguugagaguguaguccuuagauaagagaguaaggaagagugggauuuuagauaggcugggucaagaaaccaugagaacaaugaagagggaaaaggaagagauuagucuaagauacuuuaaaaauccucuagaaccacacaaagcaucugacaucccuguugucacuaaagccuucuaguccuuuccgugagaaucagacaugaacuaaaaacagaagguaaaggaauguuuaguaucaguccaugcuggcaagagaaaguucucuggacugauucccaguaccaaagcacagcacauguuagcauuccauauauauuuuuggaaacuuguucuacccauuuuuauaaauaucugaguguuuuguguaauacagugaaaugucuaacuuucccuagaguaugaaagaaaggucuucugaauauauaaaauauguuuaagggaccagagagauagcucaguaauuaagaauguuuguccauccuuacucucuaacguucuugguccuauugaagcauuucaguaucuaagcauacugaaauguuaauacccaagagaaaagccauuacguacguauucuggucacacgaucaguguggcaccguuuuauuuguuacuguuguuguuuuauuuuguuguuucuguuuuuuaaauaaacuaucacacccuccaaaaaaaaaaaaaauguuuguccugcuuuugcagagaacccauuucccagcacuacaacaggaggcuagcauccaccuggaacucaauaccucuggccucucugcacauacacaauuaaaaauaaaauacaucuuuuuaaaaaaugaaaaauuucacuggucaugguggccuuacgaauaaucuauguacucaaaagaaagaagcaaagaauucuaaguugagaccagccugaaaugcauacauuucuggccaggcuaguauauauagugauacucugucucaaacaacugaaugaaaacuaaaccucuguacccaguaaacaguaacucccaugagccaccuucagucccaauaaaggcugugcugcuaggacuuugacugcucuucacgcuuccuagaaauggaguugguuuaucuuuuugugauggcuuacuuauuuagcacaaugucuuuaaaguacauccauuugguagcaugugucaggcagcauuccuuccuuuuuaagacugaguaauauccauuaucuguguauacugucuuauuuaccuaucccuuuaguaguggaacuuaggcuguuguaauauugcugcugugaacaugaauuugcaaacaucuguuuuagucuuuguuuucauuucuuuagguguauacccaggaaauuuuuguauacuccuauuuuuaauuuauuaaggaaacuuaccauuuuucacagcagaugugcuauuuacagucccacuacugguguauaagguuccagcuuugcuacauucuuagcaauacaugcucuguuuuccuuaugauaaagacacuaaugaaaauggaguagugucucauugggguggauuuuguugauuauuucuuguuauguuuguuuuggggguuguguuuugauugauugauugauuguuacagggguucauguagcccagacuggccugaacucaacuauauagccaugugcuaccaagugucacccuguagccuagacugaaaucacacuuaaagcaguucuccugacucagccuccugagugcugguauuacagacaugcuccaucauaccuggcuucauuguaggggugaauggaucucuuauagcucaugcuagcuucagcuuuguggccaaagaugaccuuacauuucuggucuucuugcuucuguuuccugagugcugaaauuggagccaugcaccacuugguuugggggaggcagaggauggaacccaggucugaaugcauacuagccaaguacucuuauaaacugggcugcaucucuagcuccuucauugugguucugguaaugucuuucaguaacagagcacuuuaucuuauuuaauucuacuacuggucaugauuuaagcucuguguugggcaguauauuuucuaaaaacaauguguaaagcauuucuacuugucauaguuaccagacuguuucuccacauucuuuguaacauacagcagucuucgauguucccucauguuagcauuuaaaaauguuaagaggccuuuguuugccaacauuuaacagcaaaaaguuaaaggauaaugauaauuuacuucuuguauaucugaguuuuauuuaugacauggucucauuagcccagaauccacuaccuggcuaaagccagccuugaauuuuuuguuuuuguuuuucgagacaggguuucucuguguagccuuggcuguccuggaacucacucuguagaccaggcuggccucagaaauccaccugccucugccucccaagugcugaaauuaaaggugugggccgggccuagcaaacacauaaguggaugcucacagucagcuauuggacggaucacagggcccccaauggaggagcuagagaaaauacccaaggagcuaaagggaucugcaacccuauagguggaacaacauuaugaacuaaccaguaccccggagcucuugacucuagcugcauauguaucaaaagauggccuagucgaccaucacuggaaagagaggcccauuggacuugcaaacuuuauaugcgagggccaaaaagugggaguggguggaugggggguccgggggaggguaugggggacuuuugggauagcauuggaaauguaaaugaggaaaauaccuaauaaaauaaaaaaauaaaauaaauaaaauaaaaauaaaggcgugcuccaucacugcccggcugccagccuugaauuguaaccuccacuucccaaaugcuugaauuacaagugugcaucacugaaguguuuuacuuuauugguguguguguguguguguguguguguguguguguguguguguaccaugguagugugcccuugagaguuggcuuucuccuuccaccacaggaucugcugauggaauuugagucaucaagguuagcauggcaaguaauuuuucaaaaccaccagccucccagccugguguuuuacucuuuuuaaaagaugcagucucgggcuggagagauggcuuagcgguuaagagcacugacugcucuuccgaagguucugaguucaaaucccagcaaccacauggugguucacaaccauccguaaugacaucugacucccuccucuggagugucugaagacagcuacacuguacuucuauauaauaaaaauaaauaaaucuuuaaaaaaaaaaaaaaaaaaaaaaaagaugcagucucagcugggcgugguggcgcaugccuuugaucccagcacuugggaagcagaggcaggcggauuucugaguucaaggccagccuggucuacagagugaguuccaggacagccaggacuacacagagaaacccugucuugaaaaaccaaaaaaaaaaaaaaaaaaaaaagacgcagucucacuauguagcccguaaauggucugaaacuuuguagaccgccucugccuccugugugcugggauuaaaggcauguauacuacaucugaaacauuuuacuuuuuauuuuuaaaauucucuggucuuuuauaauaugugagguugaauagauaaacuaauauuuugaaacaaucugauuuucaauuuguuuguuuguuuucuaccauuuucaugaaauaagcaaaguagccaauggcuucuaauuuuuccuagcuuaaugcagaugcugaaagagaagaaggagaagaguuugaagacaacauggauguuuuugaugacagcagcuccagcccuucuggcaccuugagaaauuauccacucaccugcaaaguuguuuauuccuauaagguuuguaucuccccuauauuuugcugauaguaaauugugacaacucugaaaauccauggaacugcaucugcuuacacugugcuggcuagcacaaagcugccaucuguugacagaaacagggcauuguggugaaauauugagucucugcugucugacuuuucugauuaaaacccuggcuuugcugcugugagcuacccaaccauauacugggucucugguaacguguuuuuuucugagaguuguuuauuuauugaaucauaggaacaguauuuacugugaagacuaaguaacauuuccauagcaaaacaaugagcguaguacccacauccuauaaacuuucaguucauaccccagcuuggcauagaucaucuguuaggaagccccucaagauuaaggccagaggaaaaaugucuuuuuuuuccucuguagcagcuguagggaagaauccaguacaguagcuaguggcuacagaucaaacuccaagagcacccaacuccugcccucugaacaucuuuguacuggucaugccuucugccuagaacuuuuauuuccucaagucucagcugccuacuucucucccuuggagcucagcucaaaaagcaccucccuugccaggucaacaacuagagcucccuuugcccuuacagaggauacaaguucagcuccccgcauccacacacagcaguucacagccacuuguaaguucaacuccggaccucuggccuccaagggccacuuacacccacacaaauaauuaaaauaaguaaucuuuuuuaaaaaaaaaugucuuucccuuaaaaagaaaaaaaguaccuccuaaagucgcuucugaacauguaaucugaccacugcccucugucaugucuucugaagagucaugcauggcuucacagcgguaauacguucugaagaguguagcauuaagugacuucagugucaugcagacaucauagacacaucuuccacagccuaauagcagagccacugcucacugagaugucugcucuguauccuuuacugcugcucaugaggccauaauaaagcaaaugaugcuagguccuccggcgucagcucugugguaaagguuuuagguaggagguguguguccucauacaucacucacuaagccccugugacagugccugggcacaguaagugauggaagaaugagaaaaugaacaugcaagggaggcaugaacaagcgaggccucagacugccccacccccacccccguaauaaggcacggcagaagaggauagugucaaagauaacaggggacaguauagagagaaacuucaacuguuguacacugauaccccaccucaccccugugugcugaaaguuggccccaucuacucaguagcagucauaccugggcuuuuuuugagauugccauccauuuguuaaauuuaaacauguaauuugucuuguuuccuaaaggguuaaggccauguaauuuauuuuaauaaucuucugaaaauuuggaaucauccucugagacacuuggaaaggucuuucaaaguauaaagcuaaagcucaaauuauuuccugaucuuacuucuuauuguuauguuuacuugaaaguucuagaaauaagauuugugauacuuaaagguagaguccuacacccucaccugauuucagacagcucacauucuuccccaucucuucugcugauauauccagucauuuuccuaugguaaaccagacuaagaaaacuuguuuagggaucagaaguuuagcucaauaguagaauacuucacuuucaugcaagauucuagguucaaauccccaacccuaggaccagugcuugauuugauccccagagucaagcacauaauagaagagaccucauuaccaaaaauguacagauacacauuuuugaaaaaggaucugauaugcugguucauaucuuuaauguuuaauacucuggagacagaagcaagcagaucuuucugaguuccaggccaaccagagcuacauagugagacccuaccucaaagaaaacaaaacuuguaauuaaugugcaucucuacaaucucugcgcacauucuucagcuuucuacagagaauaagcaugacuuuuuaaaccaggaaagcaaaauacagaaauguaaagauaagugagacugaauuucugacuuauugaauauucagacuuaaaggacacaggcuuaagacuauauauuuaguaggcacuuuuuaacuguuugcugucuauaguugggaugacagaagaaagaaacauagcccugcuuuaagucauucuaaacggaaacccacagggaugaacuacuagcuggagugccacacauggaagucagugucuaagagauacagggaucuuacggaaguaaaagggaagaggcaagaaacuuaugauggcuguucugggagaacaugagcggugccacaaaucacaaguagcaguaagagcugcgguaacugcucguuccuaacuucuuuaguaacccuaaaggaaaagauuaucaaaugucccuuucauuuaacaaauuuuauguaaacaccucuauuuaccaguagggguuuuuggcuguuuuuuuguuuuguuuuguuuuguuuucucuguaggauuguggcacugaccaaauaaggcccuuaaugggccuuaaauucuaguuggggauaagauagggugggaagauaaaacuaaagaucaaagauaucucucucucucucucucucucucucucucucucuuuuaagauuuuucuaaacuuuuuugaaugugcauuggcuuuuuaccuacauguauagcuguguggaagugucagaacuucuggagcuaaaauuacagacaguuguaagcugcucuguagguacuggaaaugaaacucggguucucugcaagagcaaccagugcuguaacagucccucaacaacauccuaugguuauuguccauagaaauagacugaagcuggacuuaacacucagcaaucagaccuacucuuuugaaagaugggggugggggcuggcagacagagaacaaaggaaggaaacaggcaagaaagagcacugugugcucagagaacaggagagaggguucgcucaaggcuuugagaggcccacaggucccacucccuguagaucuuacaccaucacucuagugcuugcuucuauuggcccacugcugcagagcuagacaugggccuccauagauugucacaggacaacaguauguuugaaggugcccugaaccucaugucgauagugcauaccuuuauucccagaacucaggaggcagaggcaggaggaucucuugagaucaaggccagccuggucuacggagcaaguuacagaacauccagggauacacacagagacacucugcaucaaaaacaccgaaauauuaaaaaaaaaaaagugaaaauaguaauaacggugcccugccccucugccuuccuucacgcaccuucaagccugguuccauugauauacuuaggaaagugacuucauuacaaagggccuuugcuaguacauuuacuagugguuuuguuugguuguauuuuuguguaugguauuguguuccuauugaaaggauggcccuuuguaguccaggcuagccuagaauuccucuucuugucucagccugggauuaagacaugugucagucacccugucuggcacacaauguaguuuuagaguaacaagaaaauuccacuggaaaaaaaauaugaagaguaaauaguuuuuuuucauauuuugaagucagugguaauguacuuaaaaucuguugcuggaguauuaugaaggguccuucaucuucaguccuguuuugcgucagaaagcuaugacaucauccauaaucugagcuuuaaugagaugggaaauacaccucaggcagugacucacuuucaacaucgcauaccagugaugcuggaacucaguaaaugagugcaggaggaucagaaauucaggcucuucgagguccucagcuacagauugagggccgcuugggcaacaugagaccauauauccaaaaaagaaaaaaaaagugacucgcuucauuacuuccuuuuguuugcauaauuuggagauguuuuauacuugagaucuggagaaugauaaggccuugugugguugugggauuggggaaagcuuugaaggcuucuuacuagagaaccggaaggcaaaugucacaugugccagacaagacucuucaggaagccuugguggaggcccucccuggaguucccucuggagcaucugaguuuccuccaggcucugagucucagaagaagacaugguggugggugccagcugcggcagaagagcaccuacagcuaauggagaauaucuguguggaucagcccagacuccacaucaagguggagcaaaacccagcugcaaucauuggcuugcucauaacuuucuucuuuuggccaugacuuuucagugcuuccagaagaguccugggcauugcucaagccccaugcaguccauguacauagugucuguguuccacugcaugcauguccauucaagugucuucucuguuacucacaccucaggucaucuugguuccgugcuuauacuugccacauugaccaccauucuucagagaauggcaagguuggcauuuggaguacauggagguauuaugcugaauagccuacggcagauaagcaagcuggagccaacccucugcuuccagcagggcacucugcucacugaaccugaucaccucuugaggauccaguuucuguugcaguuuuauuuuguuuaguuuuuggaaguaaaacuucaccucauuaugauaguuuuacaacacugaaauuuuguuucucaaaaucauuucgauauuuuggccccuggcuuuuguuaugaccagcucacaucugcucuuuaucuaaccuuuuugauuuuguucauggccauccuacauugcaggcuucucaaccagaugaguugaccauugaggaacaugagguguuagaagugauugaagauggagauauggaagacuggguaaagguauaauuccuuugcucauaucaccccuucuugugauguuucaggcauuuguuuugguucuugguaugcucugcccaaauucuguauacaaaccuguuuuuuuuccccuugucauuuuacccaggcucgaaauaaaguuggccaaguggguuaugugccagaaaaguaccuacaauuucccaccucgaacagccuacugagcaugcuacagucuuuggcugcuuuggacagucggucacacacauccagcaauuccacagaagcagaacucguuucaggcagccugaauggagaugccagugguaaagacuaaaauaagacacucaaucugguuauguuuuuuacauaaauuaauaccugaacauuagccuucaguagguuuaaaagcaccuauuccuuccuauaauugauagcacuagucuugaucaggagaagcauaaagauacucucagugaauaaugacuuacaacuuacccugucucgugucaugcucacuaguugucgugaagcaagggugguugugaaaucaguccaucuugcuagacacguuauggguacaccugcucuucuguaguugggaguuugaagcaggaggcuuauugcaaguuugagaccaggcugggcuacagagaagaccuucuuucaaaacaaggacaaaagcagugcgccugccugucucuuaccaguuugucuuucucuugcuuccagucuguuuugugaaagcacuuuaugauuaugagggccagacagaugaugagcuguccuuucccgagggagcaauuauucgcaucuugaacaaagaaaaccaagaugaugauggcuucugggaaggggaguucaguggucgaaucgguguuuucccaucggugcuaguggaagagcucucagccuccgagaauggcgacacuccauggacaagagagauccaggcacgugcaaaggagcaagaucgauaagccucaccuucauucuucuccauaguagccaaguguuuacauaacugaguuuagaaauuagaggcuugucaaaaccuuguagaaaauggccaccuuacaucucacucucuuucccacacuguuuucucugaauucauuaaaauacuagguuucauaggacauuugaaaggugauuuugcuagagagaaagaagcaagggagaggguguauuguuuccagcuagcuuccacaacagcccuuaaccaggcugccuuaccauaugagaaccucugucucucccagguucuaccagagcucuagggggcucauuuuuccuaccacagcuaagugugguuuuacaggaaagugccgguuuuacuuguccucuuguuccagcagacaugacagauggaaggguaaggcaugggauugugacugcuuuagucugacauguagaaaaccuagagaagucagaaacacacacagagacaccauuuguucucacagacuuaacugacuugccugauagacuaaagacaaugaaaccccagacuuggaaaugguuuaagauagcgucaguagaaaaauguaaugcaacacaaaauugaagcuucaggauuuauuuuagcuccagggcaggcaugcugagcagcaaagcagcuaagcucuccuuccugaguagaucgccuaguaacucugccuccuuugcugcagaucucuccaucccccaagccucacacaucccugccuccacugccucuguaugaccagccacccagcagcccguaucccaguccagauaagaggagcucccaguucuucccccggucuccuucagccaaugguaagagcucugggcaucugccccucaccacuuccaucuacacuagcaucuuuacuguccagucaucaaccucuuggauucucuuccucagaaaacagccuucaugcugaaucaccaggauucucacaggccucaagacagacuccugacaccucauauggcaagcugcggccuguaaguccccuaucuugaaggguuauagauugcauaguucuuccaaauugaaaaugauaaauucauuuuucccacaugguccauuuuguuacugaucugccaugcaauacuugggggaaguaaaaagaacuauaagaaagaaaggcuauauuuuuuauuguacucccagccuuuaccggcugagccauguguucccugccccaccuccccucuacccccaccaccaccaagggaagaugcaugacucuuaacucaaaaggggaaacuaaauagucauuggauauggaugggaagagggaauggguagagaauggguaggagaggaguugaggagggaaauggagauggugauuagauguggggagagaagaaggugggagagggcugggagggagaauggaaaucuguggagauaacucugauaauagcuggaggccuaggacaggagaggauacagguugucuaacccuagcugaaauuccuaucagagggugauaaagagacugaaguauguaccuccuauagccaggcaggacuuauagaagaggaaagaagacaucaaucuaccccaaaaccuccaaccgaaaauuuguccuaccuauaagauuuucagaaauaaagauggagcagagacugagggaacagccaaccaaugacugccccaauuugagacccaucccaugggagagagccaacccgauacuuuuccauuucaugaggucccuuuuaucaauuguuagagccugagccauugguguucugcucaggaaguugucuccuguaucagugcauucaaggcuauuauauuagaucuuuaauccacuuggucuugaguugucuucagcgugauagauaugggucuauuuauucuucuacauggagacauccaguugaaccagcaccauuuguugaagaugcuuucuuuuuuccauuguaugguuuugccuuuguccaaaaaucaggugucuguagguguguagauuuguuuuaggggucucugauuggauuuuauuuaucaaccuauauguagguuccuauauuuuuaugggaauugcauugaaauuauagacugcuuuuguuaagauagccauuuuuacuauaucaguccuacugauccaugagcaugggagaucuuuccaucuucucagaucucccucaauuucucucuucagggacuuggaaguucuugucauacaggucuuucacuugcuugguuagaguuacaccaaaauauuuuauauuauuugugacuauuauaaaggauguucucuaguuucuuucucuuuaucauuuguauaaagacgagcuaaugauuuuuuuuucuuaguucauuuuauauccaaccauuuugcugaagguguuuucugguagaauuucuggaguugcuuauauauauuaucauaucaucugugaaugucaauacuuuuacuucuucauuuccaauuuguauccccuuuaucuccuuugguugucuuaauguucuugcuagaacuuccaaguacuauauugaauagauaggaagagaaugggcagccuuaucuugccccugauuuuaguggaauugguuuaaguuucucuccauuuaauccaauguuggcuguuggcuugcuguguauugcuuuuauuauguauagguaugagccaugaauuccugaucucuccaagacuuuuaacaugaagugguauugaauuuuaucaaaggcuuuuucagcauuuaaugagaugaccccaugacuuuucuuucaguuuguuuauaugguggaguauauugauguuuuuuuguauuuugaaucaccccagcaucccugggauugaucauaauggaugauguucuuaauguguucuuggacuugauuugugaguauuuuauuagguauuguugcgucaauguucauaagggaaauugguaugaaacuuuucuugagucuccaugugguuuaaguaucagggugacuguggccucauagaauuauuuuggcaauguuccuucuguuuuuauuuuguggaaugauuugaggaguauugguauuagcucuucuuugaaagucugaaagucugguagaauucugcacuaaaaccugggcuuugauuuguuuuuguuggucuuuguuuugguuugguuuaguggguugggagacuuuuaaugccuacugcucuuccuuuagggauuauggaacuguuuaaauaguuuaccugaucuuggcuuaacuuuggcaagugguaucuguguagaaaaacauccauuucuuuuagauuuuccaguuuuguggaguauagcuuuugauuccuugauccacuggcuucauucauucagcugauaugcauugagaaccuuguuggaguuaugggucucuguuauuaugggaaggcauuggaaggugaagagcaggauagcauuuuggcugcuuauacuuuuuuuuagaaccuuacuacuggcugggcaugguugcacaugccugaaauuccuaacauuugggaagcugagguagaaggaucaugaguucaaaaccagccugggcuaccuugucucaaaaagaaaaaaauucucuggcagcguaauagagagaguggagggaagcagaaccgaugcagggagccacuaggaugcuagaggugaccaugcagcaaggcugccaggcuccgcagagggcagggaguaaagaggacucgucuguccauacacauccuuguucugucucagcugcgucagcugaagccauugaacucacucuucccgcgugaucuccuccacucccaugaccaugaaagucauuccccuaccaacagcucccacguucauguuccucauaagcuucggguuugugggaucccaccucagauuucccaaaccugcaaacucagcaauggaaguaacucucuucccuucuggacuuguucccucuccaucuugccacuccauccucccuguccuggaaucauuucuccugccuuacuggucccagccuccuaccccucaacccaagaacagugacagguccugcuagguuuacucucagagccuuccacuagucugcgcuauucaggugaccagugaccagugucaucuuccaaagaacucuagcccacccaccgacagucucuuccuacgcaguugagucauguuuucccacccauaucugauacuccguacaaccaaccaaaaccucugccuagagaauaaaguuucuuauuuucuuucuuucuccuuuaacuucuuucuucagugcugggaauugaauccagagccuugagccugcuaagcaagcacucucacuggguuacauuuccagucccauguuauuugguuugguuuguuuuuugagacaaaaaccucacuguguagcccagggcugccucgaucuuucugcaguucugccucuacuuccugcaugcugggaucacaagugugugccacccugccugacuauccugguuucuuacuaaaacuuaauaaggcccuucacuaccugccccaccucuccagccuuguuccccauggcugaccuuggagacaugauagagcaguuccaguccccauacugugccuucucuuugccacucccagcuuuacuuuggagaaguguuuaggacuacagcaacuagcaugccuugguaccuccagcauaacaagcagucugaccuagcauuucaugcagaauggggccugcuguucagggcagugaacacauucccaggcccucaggugucagcgaacauccagaggagcauuggagcguuccacgugcuagccucugagucaagaggccgauaacccuguaauugucucuugcucagguucgggcggcgccgccaccacccacacagaaccaccggcggacaacugagaagauggaggacguggagaucacacuggugugacaguggauuuaccuuccguuacugcuacaaucaaggccaggcuuggaguuuggccagucucauuuuuuaggcaccuuugcaugaugaugacucuugaaaggagcaaaaccaaggaggauucgaugggacugguuggccugauugugccuuuuuuguugucguuuuuuaugucaucucuccuaccauagcacaaaucauagcggguccuagaagcagaggggagcagcucucaugccuuauaguggcccauuuuuauaugagacucaaggccaggccuagauccagggcacagacccagaauuaccaauugugugaacucguacaguauauuacuguggccaugcacagggcuguggcaaagaucucaucuuuccucaaguggauuuugcucuucugauuguuauucaaaucaaguugacuguguaaggaaauccaggagaggcuggcuccuccccagguucauucccauacugaaaaugcaaccuuauugagaagaaaguggacugccugagcuuagcgccaauugcauaaugcacaucucuuccucaacuaacagauuuaaaauaacaguguccuuuguauuaauauuuaugccauucauuuaguauuagugggcuaaccuggaggggcugaggccacaucuuucccaucacauagacuagaagggaggcuaaggaagaagcagaaauggagcuuccacaucugaaaugagccacuuuaauguuccuuuugucuuuggguauguuuccucuugguuuuuacaguguauacccucugaccaguauccuuugaauccaagugucuggcugcauugaggacaaaggccuacauugcucagcuucucuacuggagaggcccuuauauuauuuuauucccaagccagaguauuggccuagacaucuggguugugauuggugcagaccagcugucgccuucugaaaguacagcuucaggucccacugcccugacauuuguccagagugaagaaucuaugggcccuggaggaagccugcuuucuguggaaaggauacaggacuguacaccugcccaggugagaccaaggaggcuagcaccuucugcaggucagggaagagccucauggcgcccuggccucagccuagaaggucaagcacucuguggacgguagaucuugaccuagggaacaaagcaaugcuugccaauccucuuuuaccuuggcugggaaaagaaauuuacagauuuaaagguuguaugaugcuuugaaauuuccaucccuucugagaaucucuaaaaacuugaaauggucacauguccccgugggauuuuugacugauaucggagcugaagggauuuucagucauuugaucacuuuagcaaugauacucugaugaaucuucuccaugaauuuggauuuuugguuuuuacauuuaucuguugaucuauuugaggucuuuuuauguuuaucaaacuuauucuuaaguuuaaaaaauuaaaaggguauuuuaagauuuucaaauuugcugaucuucaaagugcuuauaauagagcaguuccugcuaccaguccuguauucuguuuagcuaaccaaauuguccuuggauuugaguuucccacaaccucagaguuauuugaacucuuuuguuauauuuuaaaauauuuuuuggaagagcugcuaauuuuauuuuaagaaacaaaguuguaaaaauaugccuccuuuuuaaaaauaaauaaauaaauaacccuucucuccaggccgaauaacccggcgucaccaugcacaggucagggcucaaagggagccuccgugcaggugcgcuuucuuuacaguggcuguaaaaaguuuguauuuauuauguauaaaauguugaauaauaaaaaaugaaauuaaguuuugcaaguguccugauaaagaguugauuaggcaggcuuugagagagaggaugcuucuugugggccauccuuaaaccacguaucaugugcccagagcaggaagugaguccacccagacaucacagacccugaugcuauucuuguccagcaagagggaagaaaagacaggucauguauuugaggccaagaccauaaaacaaggcaugcugugaucuaguuacaggcugagucucucuggcuuccagacaaccacaagucaaggaggaaccuugguguuccauuauggguucuggguggccccgccugugcaauaaaaccuuuuacucacuaagccauggauguggaggaacucacagauccagcacuuaccuggggcaggguuaaaaccuuuccuggcauuuuccugggcauguauuguuuacucugcuuauuuagagcaggauuagauaauacucuggaguuuaugucaucuuuuuauuuacuuucuuucuuuguuuuugucauugucuuuuugauuauguguaugauaugugagugcaaacaugugugugugccacagcacauuuggggaucaggacaaauuuugagauggcucucugcacuuugccuaggugggucuuguuuuuuugcugcgcugugcacccuaaccuagcuggcucucauguuccugcaccacccaucuuauagaagugcuagguuacaaauaugcaacacuguaaccuguuuuuuguugguuuguguucccccugagggcucuguggguugaacucagguggucaagcuuauacagcaaaagcuuuuacugagccaucuugccagccauguuuuugucauucuuuuugauggcugcauauuccauuguuuggcuauauaauuaaugguuccucuagugacggguauuuaaauaguaucuagccauuugcuuuuaggaaauugaagcuaacaucauuguauauacuucuuuauaaauuuguuaacaguguaaauguagaauuugacagaaaggguuaaauguuugccaaauuggcuccaaaagaacugcaugaguuuuuuacauuuccaucaaaaguacauggagcaacauggacauagaagucagguuuggguuaguaaauccugccugagccacguggggcagcuacaaggacugauccuguguccugcagccugaggagaagccuucauucaggaaggagacaaaguauguagcagaggguggcauacaaacaccaucaacacuaucaucucucagccuucaaggucuucaggaagaagggucuccuuccauccccuagccucuuaguaacccacagaaagaauggaguuggaagugccauagaucuagaagacuauaaggauacauuuugugcagugaaagcucacucucaagucugacacuagucuuuuuaauuuaggccagaguuuagccaguuguccuaccucagugccauccauggugauuuccuuugucacaggagcugaccagacugucaagccacagacucauuguuaauucccugaccccuaccucucuaagcccaggcccuaagucaaagucaaugcaggauaguaccuggcuuuagcccugccacuacuuaauagaacaucuuuuccucccagcugccacuaccccauuuuuagaaacgaugcagugaagugacuuugaugggcuuauccaauucucucccuagaucaguuagauacaggagaaagaaagaaaagaaaaagaaaaauuaaaaaaacaagaaaaugaaaauucagaucccuggacucauccccagagacaaggcagccauuauggucuguauuaggaugccacuccuggaccacaccagucauacugugcaaggauuccagccacagcuucaggauuugguucuaauuacugcccaucucugaguagccuuaggacaguaucuggcugcaaugagccucugcauuuauuuaguuuaaguuggauacacacacauaccacacacacagugucagaaauaaaaccaaauuacagaaauuuuaggucaaggggagaauaaacauuuuucuuccugaaauccugcaacuugacauagcaaguuuuguuuccuccugggauuuugcuggguuugcuuuauaaaagcaugagcugccaagaacuacgagaacaccaaagagugucuuguuccuggacuauuuuccuuuggaucaguggccaagaaaacacauaggacuccuucaugucuuuuccugagaaugcuguucaaggaacauguuucuggaauguuauccugaagcauaauagagaaaaccugugaguuaggguucacagguuuauaugccagacacaccaguaaggggcagggaaagaacuggguggagacccaugaacaaccucugccgugcauggauuugccugccauaaucuaagucucagcccucaacuucaucuuuaacuuggaagugagaagauaauauaaacugccucagauccaggaagauuuaguaagaugauguacaagugaacuaaagauaguuacuaguggauauacuugcagcagacauggcacuuacccacgguauaucugaaucucacaagugggccuacaccugguuaucaggauucuucuagagacugucuacagggcacuggaggggcuucucacaucuuaggcgagagacucgagaacaggcuugagcuagcacuggcaauaggaucccuacaggacuugucucuucucccuagggucucaggaucagaaaggguugagccuagccaauucaggcagcaggccucacaucuguauaucaaccccugaaggacguuccauaguggggagggguacauaacagccuggaaaacauuaugacuucccugagauucauaagauaggagugggagaagaagcuaaacugguuuccacaagacuaggccaguccccucuacugaaccugagucuaguuuuugccaaagagaaucagaaaguucaccaauauuuugcuguuuuggccucucuaaaauuaaaaaaauguuugaacagucuuauguagccuaagcuguccuccaaaucaugaugaccuuggguuucugauccucuucuaagugcugggauuccaggcauaauauacaauacucaguuucaugugaugcaggagguugaauccgagcuucaugcaggcucagcaugcauccugccaacuaagcuaagccccuuucauauaguugugcuuugugaugcuaggcaagcucaggcuauucuaauuuuuauuaggaacccuaggaaucucuccuuugcuggccuuggcucuuccucaagagaacugaaggggcagagaggucccuguacccaggagugagucacauuuccuagguaacucuuacgggucauuaaaauaguucacuacugccugagguacgauggaaacaucugcagggacuuggcccagaugcuguggcuggaacagcagucucccaggacucacucucaaauccuagcacaugccuccagagguaaucuucagcucagaguccaaggugaaagagcauuugggagugucagguuaggcacagcucuguguaccccugguggaaaaacccugcccaguugagagccucugucucuugaaauuuugguuuuguggugcaggggcuagagaaaugauucauagguuaagagcacuugcugcucuugcagaggaccuggguucaguucccagaagccacaugacagcucauaaccguccauaacuucaguuuaagauguccucugugggcaccaagcacguacacaugcacuuauauacaugcaggcaaaauauucaaacacacaaaaaaaguuguauaaaaagagaggauguggguugaagauguaguuuguacauugcuuuucugacccaaacaaauccccaagguuccagucuccaacaccauauggggauacauauuugggaggugaaggcccaggcaggaaggaggucacacucagcuacauaaaugaguaagucugcaaggagugaugcgggaaccauucagcuguguauagcuguguuaccuugaaugacaaucuuuucucacuuuagaacgugcuccaucacaaaugcuuaggaggaacaaauaaggcucagaagccagagcaagaccgaggucugggugauccucaguaaugguggccacugggcgaguuggucuuucccagaagaaaggcagaaagaaaaaaaaaaaaaacaaaauaaaacaaaacugcugaccaggaaacuagugaccccugguggccacugagagcugcgccaaggggauggccaaggcugaggagcuggaaugucccaucccuggaaccuuccacuguugaacuugcaaagcaagagaauauaaccacccaggaaguauuuccuggggccaggacuggaggcagggaauacuguucucuuacaguugcucccaguuuuaagaagacaggcaaacuagaaguaggggaccaaggccucuuacugagccugacaguuaaggauaggcugucaauaaagaggucccaaaagauaaccugaauugucguugggagagacaaggacauugaaggcagaggaaaaagcauguguaggaccaaagugacgaacuucucugaaggcagaaaggggacuuuuggccaugcugaccaugguaccuuagaugcugagggcugaggcagucagugccugccaccccgacacugaggcugaggccagauuuccacaaauucugagcuauuacaugugugccugacuagacaggguuacaugacccuguccaaacaacaacaaaagcugaggaaacuguaucaggacaagucuaggggagugaaggcaccuuuagagagcagcacuaagcgcagucgccccagagacuggcacuguggcugcaagggcagagguaacauacaagggaaggagauaguggcaggaggccacccaucauccaggacauaggacuacagcucagaccauugucccaggcuccaggcaggccucugccagcuauuccgaugucacucugguuuauucacccuuuccaucagguccacucccuagaugaaaagcugcucuuugcugcccuugccugagccuuucuucauguuaucccacagcuagacuggaacagcccauuucccagacagaagcucugcuacaaggcccuagcucuauggaaaaagaagaggcuaagucuaagugucucuguacccacaaaugcuucaaagaggcaagacacggcuuagauacaguuuuuaacacugaagagaguaaacaaauagauuuuaaaaaacaaaacuguaguuccuaacccacacuuugauuuuuaacaaacaggccagguccugccuggcccucacaugaauucuguaguagaccccaaccccagcucuggaguccugagcacagggaagcuguucucuggcuucuggcuucagaguccaacccauacagggaacuugugccacucagugccagagcaccaccuuccugccuugguccacacucacaacgugguucccggagaagcaccaagccacggcauuaacagcagugcugaagagggaagacagaccucaggagggcagcaggagcaggcaggcagccuuacucugacccuggacauccaaccagcaggcgguuugagaagccucuguaagcccaagacaauuuccuuaucuauaaaaugggcucucaggaugguaguaaugagcccaaaugcaugcgaaaggucuggggacauaucagaacauggaaguuugcguguggaaguuuucaguaggcugcucaccaguggggucccuguaggcuggucuccaguuucccgguguucacaucccagauguacaggucgccguuugaagagccugccagugcauagcuucugucagggcuguacaggucacagcagaacaagaggagaagaucagaaguguaggcacacaaacacaggccuauguauaggcaugaccucccagacgcaccugaacacagcuuugguccagucagaacugcacuugaagccaucugcccugaggacagaauaggacugcagucagagaagcugcaaccaguguuccagucuuccuccagaugugaaaagggaccagcacuucagcagguucuagucuagagguucuacgcuagagugccucccgggacuuugcuugcacaggagagccccaacuggcccaggccaguaccugaacaccugucggauauugcugauucgcaggucgauaaccuugaguguguugucucgggaacagcuaagcagaugcagcuggucauagcugaggugcagggagguaacccggcccugcacggggaugaccuggaugcagugagggccccugugggguuagggauggagagggacgcggaagagacauccuuagacacuuuggacaggcuguauguggccacauucccagguaacauagucucgagaaacccagggcgugaaucacuggggcuaaggcugacaaaacuacugccccuucccacuguggauuagacaguuggaucacuaaagaguaacagugauagccagauagggugacacuggcagguagucacagcugaggucggagaaucauaagauccuaaguucaagaccauccuggaaaacuuuauugagauucugucucaaaauaagaauauaaaaagggcugggagcauucuccuagcagacacaaagcccuggguucaaccccuagcaaaggagcaaucucaaaaagaggcugcagagaccugcaaagcucuagcucugccuuugucauccauucaugcuuaacgaugggcuuauuacuuuaaaaagcagcuauucuuuuguugcuguuuuuuuuuuuaugaaaaaguggugauaauauuaaaaaggugcuugucuguguuggcuguaaggccugggaaggaguccagugcugacuaagagccgcuaagaagguggcacagcuucccagacaugcugaacccucaaagaccaugcccagcugaggccacccacuggcagugcuugucugacagccauacuauccauaacccugccucccacagccagagaaaggaacgaagacucaguggccuccaccacccaggccuguaucaccugcugucccagaaccggaucuuuuggucauuguggccacugaugaugaugugguccccgcacaccacgucauugcaguaggaaaguacauugauaguccuggaaccugagggccagugggaagagcucagagucucagagagucaucaggagccacuacauuugguggcuguaaggucaaauagggaggucuccuuccagggcucaagcuaucucuaauuuaccuaccaaaggccaggguuaccaagaaagcaggaaaggagcagcagugacagagaaggaaaucauuagaaggcugagcccaaaugaauaugagucccgcggcuaccacaacauagcaagguaagggccccgaugacugagagcugggggcaaaugggauugggccucacaguaggcgcggcccaggucccacuccuucacuguccggucucggcucccagucacugccuggugccuuguuagcuugaauuuggcagcagucacuuuguccuuguguccggacaauguuuccuguccccauagaaagcacacauuaauccaagccccccaaauaaccacucugcaaaucuuaaguaauaacccuuuaacccuuaggcaaccuccccagcugggccucaccuuggacugagucucucccaccuuccagagcugggcagccugguuguaaguagcugccaaaaccugggagcccuggagagagggagaaggaaaggcccuggacaucacuagaucaggucagagagccaggguagaggcugucuccaagcuuccuugucacugaggcgagccauggcuccaaggggagcccacugcccaguguggagacugcagugacaucuaugcugugggacaaagucuccuuacugaggggucaaaauccacacuggugaugcugccgccagcuccuuccagggucugguuggccuccaggcgaccugauagaacaggggaaaggacggggggugggggggggggugggagggggugggguggggaaugagauucuuuuuucuuuucuuuuuuuuuuuuuuuuuuuuguuuuguuuuguuuuguuuuguuuuuugagacaggguuucucuguauagcccuggcuguccuggaacucacuuuguagaccaggcuggccucgaacucagaaauccgccugucucugcccccgagugcugggauuaaaggcgugugccaccaugcccagcccaggaaugagauucuuagccuuacaaaauagagaaacucagacacagagcaggacacagaagacagaauggcuggucuggccugaccuccucuaacugcugguauaguccuaggggcaacuaguuaguucacaaugcuagagggacugucccuaagucauacugcaggccaggcuuccagaguugguguugagucccuuucccuagagagcacagguggacaguguuucucaccucacugauuucugguagugcaagugagacuagaacaggauguagcuaugccaggcacauuggcacaguuuauaccagcacugaagaggcaacggcacauagauuuuuguuugaggccagccuggacuacauaguaaguucuaggccagcaagggcuacacagagaaacccuaucuaaaaauuaaaaugugucuugguagacccagggacuugcccaacgcauggcucuguaugccuucaggcuggggucaggcuggggucagaggucccccuagcuccuccagcagcagccgucugggcuuagcccucccuguucugcagguuugaagccagagcuuguccuucagagcaauaagcucagcaccaggcuucccccagaaguccucuagccaguguucacaggaucauuccagcaggggaggacggaggacaggucuaagacccuuaccuaccuccuacaacauuccagagguggaucagccggucagccccuccaguggccaggaggcugcuguuggggccaaaacaaacagcauugaccucagagagaugggcauccuguaaaaaaaaaaaaaaaaaaaaaaaaaaaaaaaaaaaagugggcagggcuggcugcaccccauucuuccucauacauggcuccuugugcccacucccagggcuuuucuacaccuauucuuggacuggcaguucucucugagggucucugcaaaccugaguuucaaaccuguccccagauggucuuuucaacaaugccuagaccccugcuaccccaugucccauguugggugucugucuccuuucucucucuaguugguguuccacugcagaaugcuguguggcucccaccacaggcugagggcaaacuccuccagccuugcuuuuccggcccacuugacccaccccugaacauuccuaucagcaccucaggcauguggcccagcuccuuccuuaccaagacauccugagccugggagggaauuugggcagacacacacacagggaugcuuugguaccgcugcucaggugcgcccccaaccgagugaccucuucuuuucuugaagcugcagagguagggacagaaaagcauccagcaaagccugcugacaugaggacuuuaagcucuccugaggcagcaacaagaagcagacauggcaagcagcaggaaauuacccacagcacaguaaacaagguccgcaacgcagccugaccacuguggggaugugggcacuguacacugagcccagcagacacagacagggugauggauacaggaagcauuacggauggcauuaccauugcuaggcuaaguaacucugaacaaaucuuagacuuuuuugagcuucaauuucccaacugaucaaucaaucaaccucagacuggcccucaguccccuacgaacaaggacagagcauuaugaaccuggaaaauaguuauaaagaguuggacuuggggcuggagagaucgcucugcaauuaagagcacugacugcucuuccagagguccugaguucaauucccagcaaccacaugguggcucacaaccaucuguaaugggauccgauggccucuucuggugugucugaagacagcugcaguguacucacauaaauacaauaaauaauucuuuuaaagaaaaaaaaaaaaaaaagaguuggucuugagguauccugccuguggaguccaacaagaugcacagguagauccccagcaaccacaugguggcucacaaccgcccauaaugagaucuggcgcccucuucuggugugucugaagacagcuacaguguacuuacauauaacaauaaauaaaucuuaaaaaaaaaaaaaagaugcacagguagacagguaccaaaggauggacagagcaaggcugucuaugcucaggaagccuuacagggggugccggucccuucacacauguauacacacacacuuacuccaacagccccuucaccacauccacacagcgggacagugucagggagguggccgaggcagaccuggggcagaaugaagagacacacugagagccuggcucacgguuguuccaagggcaaucacugaucccuguauuuugcuagggaccuuuggaaaagcucaugcucacucgcucaaggcaggaacuagaacuugacuccuugcagauuaggagaggaugacacagacucacccagaaggguggagggagggagaaccuuggcaaugaacaccuccccgaaucucaccaagacgguaccaagaguuucauucccuaagugcucaccaagaaaagcuccugggaacgccaggcaugguggcacacaccuuuaaucccagcacuugggaggcagaggcagguggauuucugaguucgaggccagccuggucuacagaggggaggggaggggaggggaggggaggggaggggagaucccgggagaucuccuguggagagggcuaaggaagagacagagagcagggcaacccccagcuugcugagcagccccccaaacacccaagaaaguguuuaugcugggauaucuagauucauuaggauugccaggaauuuggggaaccagcauuucaugaugcuccuguuuuauucacugucccagggacaugggugccuggagggaagucuucuggaaaagagccuucaggcucacaaaaaggaaaggaggggcagcccaaggacaggccaaucaagauguaguggaagccacaaaagcuggcacgugccuguaauuccagcuauugggagguaaaaggaagaccaggggcucaaggucacccuugacuacacacugaguuugaggccagcagagaggcagccaaagagucaagcucccaucuggucucaagugugaacacacuuugacacaggcucauacucagguauguucccuaagugugcacacaugcuuaugccccuguguggacauacacauacacucccgugcucacacacgcaaaccuaggacaccugagugucccaggggcuuguuaacuuuccuaccagugauacccuuuuauaagacucauagcucacccucaagggcacugguucuuggaaguagagaauaggguaacacugccucauggcacuggaggucagaccuguacuggcauguacacaggccuuuccaaaaucugauccuggaagauguggacagccuccuggguggggagccagcucaggugggaauaacugaaugcucaccugaaaggccucuuccauuuuucacaagucucacucucugagaacucaggcagagcggcaggagcuagagccacagucucuucuuucgucccaucuucuagaguguuugggauccugggagagagaagcagcucaagaagaccaaaggggaagcccgucccucccugccgcagcacuaaagaacaggugauaaacgcuagcugcuaaguauuggcuuuugugaccacacauuaucucuacacgugucuagugaccugaccugugcacacaggcaccugguguaccuguagccagccggaguaggguaugaguagacugugggucaugcacacauccuagggaagcuccccaauacuagagucaucccuguccccuccccauucuuacucgcugaugcucacaguccgcuuagccgcuuucuucagcuccugggacaccagagccugguuggcccuggcagagagaaaagcauccuaaaggcugaaggaggugcuucgcagauggggcaccacagccuaugccgauccuucugaucagugagagacccuuaccucccccacacucgcccuccucccuacaccuuuuaaccacgcgaguccagauugccuccccaggggcguggcccagaguuuucaccucucucuacgcucauuacguagauugcgcucagcggcggcgcgcgccuuacgcugcacaagcugcuccagcaagucgcgugccucuuccuggagccugcgcagugccgccuccuggugcacagcuugcuggagcagcgucucauaggcuucucucugugcugcguucuccgcuugccguuccuccagcugccgggacugcugagcccgcgccuccuguagcugcaccacgcaggccugcagggcuuccaaccugcagaguaaacaucagcuggugucuuuguggguccucuaacgcugaaccacacacaggucuagggauugcuuggggaccagaggaaagcucuaggggguccuucccauucccuugcagggguagagaccaaguccgauccucaucucaccuguccugccgcuccuccagcugugacugcagggugucuagggcugcgcucuucuucaccaccugguaggccaucuggggaggacagguggugguggcaugggcacuuuugcagggugaaccuagccagccaccaccucguugcccgguuccugacaaggaaguccaggcugagauaaguuuggaucuugcauaaagaugcccugccuucgugggauaauucucagaccgagggcucuagagucaguacuagcgauguccuuuauuuucucggugcaccugcaguagauauuuaaccugcagcaggaggaaucuguuccauuuugauaccuguaaaauggcagggaagcgcuuuccuaaucacaagguaagccagaaccuacuauuaggagucuacaauaauggcagacuauuagcuggcacuugucaugcuuugccccaagcacucuacacacacugacccggccuccacagcacuaaaggaagcacuuccauuuucauuuucauuuuacacacgagguagccggaaaaaaaguuacacggcuaaguggcagaccugauuacuugaacccaggccaccuaauuacauuaagcuccauguaaaguaaugguguacucaggggcugcaagggaugugaguucuaguucccaucucccaacaucuggcuuccuagcccauccccuaccacuggccuaugcaggcggcccucagaagagaaacacacaagacuuagaacaagaccacgggagagcaggagccagacucaguccuagagcccuggguugaggagaucucagcaucccuucagcugacagcuaagaacugagaaggcuacagggaugcagccucauccaugggcacagccuugcccuggugaggaacaaaucccagggcaaagcugugcccuccaguguggagaccaggacaaacaccuguggcucagaaacugcuggcagccagccugggggcgggcugcugagggggcuacucuuccuacuaacuuguucccaauucuuucuccucagggccugaggagcaagccagggcugcucaccuaccuugacacaacuccucauguaagaggccuggagagggggaaccugugcagccagguguagcccuggcuauccugaaacucacuuuguagaucagguuggcuuuugaauucacagacaucugccuuuaccacuccagcucauuuaucauuuucaucacuaagaaagccaguugccaucuccaucccccucccuugucacuugcuuucaaaguucaaaugauagauagcgguagaaacagauuagugguugccaaggauugaagauguuccagugugaugaaaaagagguaucaagaaaacgaucuuguaaacaaacacugcaauaucaggaugguuacaugauaucaucuguuuguaauaaugucacaccacugucaaacuauaaccacauagcacacuggggagaggcccucaaaugucuucauaacccgcucccaccuuguguugggcaggugaggaggcaugcuauaaugacuugugauuacuggcucaucacagucuccauggaaacccacaggaccaggucuuguuuauggccacacucccuguucuuuggauuguuaguaaauaguuguuaaaggagugaaugaagaaucccugaaaguagauuuguguggguaaagguucaaguccaggguccacaucucuaagcccuaguauacuccucugcagcuauaacaucauggaggacugacugagauaaugcagcaaaaacauuaccacucacugucugccuucuggggaccaucucucccuuaccccaacauucucagaccggacccugcuuaccucaccacagaccagcugcagccccuucuucuccugcugccacuucacccucagagaggcuggugaugagacuuggucagggccugucccugagaccuccucccugacaaccaauaagaagaauucauggccccuccgcucacccuggugcccaaaguauucccuaagagucccccccauaaaagcuugagaagccauucgcuuucucuugggguaguugggagccaaccagagaacaaguagucucagaaauaauaagcuacccaugaccucucugcucuaugaugguccagaccuuggauccccaucagugacacucaagaagcaccuguuagcacaauggcacuugcuuguuuucccagaacucauggggcuaaaacgguauucagcgaucaaggacagccugggcuacagaacgagaaccuguuaaaaauagcuuagggcuggaaagaugguuccuccgauacaguucuugccacacaagaguggggaccugaguuugggccccagcaccuacauuaaagaaccuggcacacuuugccaagagcugagaaaguugaguccgcuagcuauagguucaguguaagaccuugucuuuaaaacuaaggugaaacacaauuaaggaagacacaugccaaccucuggccuccacagaugcacauacaaguagcacauaaacagaccaaggagagccuggugugauaagcuggcacacaccuguaaucccaaccggagagaggcaggaaagccaggaauucaaggucauuuccagccuaccugggcuacauccucuuaguucugucuccaacccauucccugcucuuuggaauagguaacaagccucuuuuugaaguuaucagguaaggaacaggaagagggacaagacucagaagggggaaacacgagaacaggauuggacaggagacaaaugcacagagaagcgucgggguuaaagauauuaagguaagcagccagcuuggggaggacucaagaggccuccacugcccucgcucacauccccaggaguuacagacugaugaggugccaaggcugagcacagcaaagaggcaggcacaagcagcucugaucacucacagacaacucaccuccaguccucaugucggguggagauggcauccuuugguucggacuucaacuuuucugagaacuuggcuagcaguucagccuucucuaggagaugguuaucuggggaugcaaaagggugagccuguggcaaaggcagagccgcuugccaacaaacucccgacauacaagcuaccucauacugggauggcugcaggagcccaggggucuugggaauaaagaagccucugaaggcugggcucugccccuuccugggggaauaucuguaucuggcaaagccucaucacagcacaggcccacaagcccacccaggagacaaggacagaaagaccaccaaugcuggggacaaacauggcuagguagcacuugaagagagaacagaaggaaagcaaggggccugggauuaguucaccucugccagggacaaagucuggacccagagcauguugaaauaaacaaaaccaccuguguauggccuccagcaagucgcuuccccuccaagaccucaagguuuacaguuaaguaauucucacuuccacgcaacagcuucccccaggucaauauugaaagcccuugagcaauuaucgaacaaaucuucccaagauaggugguuagaccuuggacccccucacccacauuccuuccagcuguuuuguuuuguuuuguuuuguuuuguuuuguuuuguuuuguuuuaaaccaauuccaggcagacugaggcugcuaaccucaggccagauccucaccucccuuccuucucugucugagguuccuggacccugacaaauucucaaaacuaccugagaccacaaggcauugcaagcaccccuaccccggcauacaaggucacaaugugccucauuugcaaguaagaaaucugagguaaaggacuugaauuaccccaaaccacagaccugggucucuagguucccagucuugcaguucuccuggguggucccucccuuaaaccgauagucccacugcccaucagagcaguuggagaagugggguugucuggagguagagguauccaaccccaagagagggccagcccucacaaaguuccaaggaaaacaaauuugauugcgugggugcaucaaaauuagcaccaagugaggaagaaguagggaguaugguuagacuuucagccucaaacacacaaucacaguccaccaaaaggcaguaaauacagaugcacuccaguguuccucggauggagugcacacaucuccuccuccuagccaaagugcccagaaauaaccacaugagaauuuaacuuccgccgcgcgacaaacaaccuaaaggaacccggagccccauucgagcuacgauccgcuaggcacugagguacuccacgaacguacgccaguauaaccuauccguaccagaaccuaccagagacuuucgcuccuuccuuucagcuaccguggcuguucuggccacgccugccuucuuuaacugggcucugggaccaaauggacugaccaggccuugcccuagggacggccugaaagaaggacucgacaaaaccaucacugagacagagcuugugucuaggaugcucaagggaggcagagcugagucuuuggggcuaagcagcaccagagcuggaaacagcaggcaagccaaugcggagaggggcguaacagguuccaagacgcaaagcccucgggaaccgugacggcgccgcugcccugagucacaagucgaguggcgggacaagcccucuccccgagcggggagucccaccuccucaaagccagucauccccgagcccccagggacgcacucacaagccggcacuagcuccaggaagagcgccuuuugcgugcggucccgaugccgcagcugccgcacgauguggcgcuuccagacagcggcgggcgcgcagggaucgcagggggcgccagguccugccauggccgccgagucccuagcggccgcgcaaagcuccagcccgagcaggggggcggagccucccggggacuccaugacgucagggcggcagcagcggggaauccccgggcuguaccaagcgcuuuugucggggagaucuggacaccucaaagcaggugcugcugcggcccagcaaaaacccucagucccagaggugugcguuucugucccggaguaagcagcagggau

SEQ ID NO: 3969 - RNA, 8510 nt, Mus musculus
acccagcuucugggguuuuauuuccaauucuccugaucuuuaggccucggugucuccacgugucaggguggguccagaugauaucagucugaaggucucuggagcuggugcagggaguugagagcauuagggagcagguaaaggggauuagcuagcucuuggcagguucugcaugacacccccccacacacacaccaacugccuggucaaaaucucagugaccucugcaucuccccuauuccaggagccucagugcugaggagcugaaaguccccucaagcacuugccuucuuuaugcaggugcaagugagagccagggucgcucagggucugcccugaaccccgaguccucacuuucccugaacuccccuugcugauuacccccucauagaaacucuaaucuccguagcccauggcaccugcucagugacaagcuuuuuggagcugggagccauaacagugccagcccagcgucugagggacuuacagagguggcacacccaccuuguggguagacccucacuguagguaacugaccaggcacagcaagugucuuucuuugcuagccuuugcacuguguaaucuugcaccagagucuaacuacaccaugaucuuuccuuaaccuuuuuuuuuuuuuaaccaacgaguuuuggacaguaaguucuccucugcucuacccauccucuggcuggguuguaguuuugguuacuugucuaagggagaaaggcaccuauacccaagcccaaagccucuguuauugucauucucagggguuaauguuccagaugaggaaacaggggugugugugugugugugugugugugugugugugugugugugcgugcgcgaucugcuucuaggcacagaacuaagaaaugguauuguuuggauuugaacccagguccguaccuucacucuucuuaucucucuugcuuagggauguggugccacaggauuugggacugcuuucauguucaggaggcugucaggagccucagagccagggacaucuaaauucaugggauggggauccaacaugggcaaauuaaugugcaggaugaagugacauccuucuacuuguccuccggcaggucaccugcuauuuuggacccucaagacccaaaauauuugcucuuaagcuuggcuccugucaucuguuccucacuagcuggcuguuuuccccucagacuggcaccucagggccggggagguccugucaguuugucuucacagccacuuucugcucucaccccagccuuaucuccccaccacucaggacuggaggugggcaugagaggcuuagcauucugaugcugccugcaaccugccaagauuggggcuaucagggcucaaaaagccaucaggcuacgguugcuagcuaucucuaccucauggccagucccugaagauccaucucacagagcaaucuuuggcuuugcugagguccccucgggccuccugccagccugggaguauugguaucacaaacaccccgaggcuuggggaagguggacuugggcagaggagguucaaagaguucgugucuggggccucccaagcccaaauccagcccccaaugccaccuacucauucccagacacuucuaaagaguguggguucagagggugugcgugcaauuagcugacacuuccuaccacacugauggaaggccuggguaucugaggucauugcacaggacugauggggaccugcaguuuuguuuuguuuuagaagacuuacuuuguagaacaccuuucagggccacuuuguagaacacccaucauggcuaccuguuugccccugacuuauuuuuuauuuuuuuauuuaccaaugauuaaaccuagggcucuaccacaaaguuacagccucccuaacuauccuggaacucacucuguagaccaggcuggccucaaacucagaaauccaccugccucugccucccaugugcugggauuaaaggugugugccaccacugcccggcagccuuuaaaaacauuuuggggugggggggcaaagucuuacuuuguugccugugcugguuuugaacggaauaugcagcccagggaaagccuuaaacuuugggucuuccuccccagucuccugaguagcugggauuauaggucugugcuaccacauccaguuuccugcuuauuuuaaaagugggcaugauuuacaaagaucucagagcccugagcacuucagggaaaaaaaaaaaaaagcacaucuauuugugaaccuacagugcugagucugcgguuuucuuuuaacaccuguaagaaaagaaaucuacaugguggagauaagaggugacuucugagggaccagggggagaaugcagagggcacagaaggagccuggguggcagaggcuugguacucuggcacuggugggaauagccauuagcagacucugguacuacuaggucagugguagucacuuauugcuccuaauauccagaggagcacaccaaaggcuuucccugcucgucucuggcccagacagugacaagacugccaugcucauacuggccuggcccuagcuuucacuggguagaugggacagggcucccagaauggaagaguaggcagaagaguuaguggacagaauuuacaucaggcuacagaguagagcucugguccacucuauucuacagagggguggagggggccugugcuccaguguucugcagcccugugcuuuugagaacuggucuucgccuaggggagguguggguaaauggcugagagcuaaagagggguggguuuggaagcugccaaauagggauguaagagguugcuggcucaggaccucucucuggccagagugaggcugaaguggaaauuuugccaaauucuggccagccuuugaaccuugagccuuuaaagucggaucaacuuccggcuggguuugcacacccuacuggaaaauugaguuggguguguggaggaggcuuguuaugcucuugguucuuggggcuugcaggcugucgccauuucuaauuuaguuacugaggggcugucaucccuauuccugcuaguuagucuuucaauugucaugagggugugugcccacccuugaaucucugaaguguugugugugugaauaagcuguugcagaagcguguaccugcaagggugggagcgaagaguagagaagaggcucucaguuaacuuccagaaucucucuuggcaccucaaccuuacucugagagcccaggcuacuuuguuacuucgcuaugugguuccugcucacagguccccgguccucugauagucuacaucucuccccggacuuugccccuuccccggggcuuacgggggcgggcgcuaggacccggcggggcggggcggggcggggcucggugcucccgcaguucuuaccuccgcagccuggaaaauaccgagcgaggcgagcggagcccgggagccccgagccuagcgggagggaggagggcggagggggcgcgcggggcggggggcgcggagcggggcggggccggcggcgggacccacugcuccuccccccaggguccccgcgcggcccccggucgcccgggcagcggaggcagcggcggcggcggaagagcucgcacaccggccccggcgggccccggcagagaagcccgcacaggugagacuccgccaccacacccgcccccaccacggccccgcgcggcuugcugcugaguuaguugugcgaguccggccagcaccgcgcgaggacuccgugccagacccgcacuugcgaucccccagagucccgcccggcucucgcgggcuccugcacccgcuacgcagcaauccuacugccgcuccagggaaguaugaggucgcuccuugugggaggguggcccaagugacuguccugugccggugcacaaccgccuggggccaguaccugcccuuuucaagcuguccgcugguccgggaccccggcuagccccacccgcgcccccagcgcacugacucugguccccaaaccggucuugcaggucccaggaagguggcgucagcaucugcagccgcgucgacguugucugagccuccgcggaggacccaggagagucggacuaggaccagggccccgggccuccccacgcucccuauggaaaagccagcugccucaacagaaccccaagggucucggcccgccuugggccgugaaaguguccaggugcccgaugaccaggacuuccgcaguuuccggucagagugugaggccgaggugggcuggaaccugaccuacagcaaggccggcgugucugugugggugcaggcuguggagauggaucgaacucugcacaagaucaagguaggauugcccugugguaccugcagccuccacuccucccgaacugucucucacaggaaucuccucgcccauacucagaccagggacccauagaggggugcaugugagcucagagucuccuaauauaaaccagaggacacacaugggccauaugacccggguucuaaccuaggcaugccuguguguuugggagaugggugauggccagguacacuuaggggaauagugucucucaaaggucugucuuucagaguagcuucugcuuggacccuuaguuugacccacuagguaggugaacggcccacuuccuccuucacccgggguucucuagcccgcgaugggucuucugcucuacuuucugcacucuugggugcagaggaugagauuccuuccuucucaauuccucuaguccucucugucccugcccaguggcucuaucaggcucugagccugcagcaggccuuuaggacuguggcuggcagcuccugacugcugucuugcccugagccacccugggggugcacuagaggaggcagggucuuagugucaagggaaaccagcucagaaggcagauacguacucaucagccccucacugccaucccccuccucccugccccaugauucucuucucucugucauggcaggguagcuugggguuugauggaggcagagauucuggucuagggggucucaguagcuguuuguuacacgugugguuugguugugagugccacauugcagggugugaacuuccccuuagagagcucuuggaaggccauucccuugcacccuccugcugcucuggaucugucacggaugcauuccuauucuuaggguccagggcacuggacugucuuaacagggucccuucugucuaggaccuuuauaccagagccugaggugcuggccuuuuuccucuggcccuaugcuucuuuuugccuugcccuaaucauuuauagcuuuauccaccugccccccccccccacacacacacaacuggcuugcucuuccugcugucccuuugcccucugugucugucuccgucugcccuugcuaacugacucuuucugcguuuccguggcuaccuccuugcucugagucucuucccaggcuuaaagacccugggcuggagcuucuucaaggccuaguguaggucugagccugaggaguagggcgggcagggcagcuggcagugucagcauguugcugauugcaugugggcuccuccccacaguguccaccaggguagugguguuggggaaagaugaaccugggaaccgagugaaagguggugggcugacugagauaggcugaaagccagcagugugcagaagcugggaaguuuggcuucccccccacaggacuggcucguguguguguguguguguguguguguguguguguguaugggggaguguguguacucccacccuuugucaauagggcggagcugccuccuccaucuggcuugguuaaugaauaaacccagccuuacccaggacuggaguuggcaggucuagagaccagguugccucaaacagaccccuguggcuagaucaggcuugggaagggagaauauuugaagaagcuaugguguuaaugggccucugggcaagacagauguucucuccaacauaccaguucagugcuuuacauacugaacaaaggcuaaaguauuagacagccuuuuguacaaccugcuuuguaacccccuccuccuacaacaggaugcaggccaggauacuaagaaccagagaaugccagggcuaugcauguggcuaaggagagagagggagagagagagggagagggcacuuagaguuaacuuggguuagucuccacgucuaaucuugucucuaacuuuucucccauacugccuuagccccauuucccgcaguagaggaggagguaagcagaaccuaggcccagggaggaggcuggcaccuuaguuauagguaucaccaguggccagacuccaugccugguccucucagcacagcagcuagaacucugggagaugagcugaggucucugagcugccuauccccagauuccaggacuuccaguugccacacaguuagccuguuucugauaagcgcccugcucccaggcaagcauuuucuuuugguuaucugauuuagccucaggccaguccuggggagucuuugguuugucucuguaauguuacuaugaaagaaacagaccaaaagaaagcugagccuacaaccgaggcaggcgugcagcccaggucaguaugcuccagaguugcuggcccucucugaugaauuugcauccuugggcaacacuggccuuuaacccuaucaauaacucuuugaagaauuaaaggacguuauguucucauccuccuacucuuguuugauggaugacaaagcugaggcccagaggggugagugacucuugccaaggucguacaucagguagaaaccagagucccagggaucauugggucauugcaggaagcugggacuuaaccucaguuguuuguugaaauucuguuuccccucuuccccuuucuagccccucuccccugcaccagggcaugcccugugcgugcucucucucucucucucucucucucucucucucucucucucucucucucucucucucaaaggucccuggaagccaccauggcucugggcccagcagacagcuaggacaaauaaaaggggcugauggaggccuaauccuacuuuuucccucccuccuggccucuggccugcucuggcuucaggccugcacugggcccuggguuaguggacaggaggcagacaguuccuccugcaugucuaggcgcugcaccagaggcagaugcugaguaugaaccccagagccaaggcagagggcugcuuagaacucagacccagguuucccaaagcccaggcuugaagacaucuaaaauauuuuuucagucauucaaccagggaaucaucuagaucugcaucuuuuugcuuugugugacugaagcacaucccuucugcucucugggcugucuggucaccugccauuggaccuuucugauuuaaaggacuucugaacucaguggcuaagccagggcacacagggaagagaacagggcagcucuggcaagcaugcucuggaugaccugugugcaagucuucugaugcuuacuguaugucuugcuaugugcaggcagaggacggcuccuggguucuuucuaaugcuuucagaacuugcuggagagaggaaaggcaauuaugggugcauccagacccacagggcauagguuuguaagcagcaggagugacccaagaaggaaccagcaccuaugacaagagcagacuggugucaguaucgcugagggcuuggaguuagaacaucagugagaguuccugagagccucuugccacaggaaacugguuaauagggacuugucuccugauuccugguccugugggcuuucccucuccuuuggcgaaagcucuagauauccucuccuggccuggacucacugucugucugucccaugccacaggcacuuggcguacagucuucucaaucuaguguccuggucuuaauacccaucucaugaacaccacauucuccugugacauauggcucaugcagggaucucuggggaccuuccuuaccuuuagagucugggacucaaagccauccugggaaagacaaggguauauagggccaucauccugugagguaggacucuuugguccaauggaguagauguggaaaauggaggcucagagcagggguccaucuguacaagaccaaacagaaguggcugaagcuggaggagaacugaaggcuuugccucccccugccccaauaaaaacuguuuucucccugggcaugguggcgcacgccuuuaaucccagcacuggggagguggaggcaggcagauuucugaguucgaggccagccugguauacaaagugaguuccaggacagccagggcuauacagagaaacccugccucaaaaaaccaaaaacaaacaaacaaacaaaaaccccgucuuuucucugccgcuccaccuaguucuuucagcccugugagccuuucugucuccagaagcccauggagauucaccugccuuugggucucugugcugugucauugugagaggauaccuuggagggaacccaaauggguaaaaguccaguccucacugugugaucugcagggucacuucgccu

SEQ ID NO: 3970 - RNA, 10971 nt, Mus musculus
cuuuuuuuuaaagguuuauuuauuauuauauguaaguacacuguagcugacuucagaugcaccagaagagggccacaacucucauuacgucccaugugguugcugggauuugaacucagguccuuugguagaacagucaguguucuuacccaucgauccaucucaccagccccacuuuuuuuuucuuguuaccuguggaucaagauguagaacucagggucagagagaugccuuaccgguuaccaggaauggaugcucuuucagaggugcugaguucaauucucagcaacacauguugacucacaaccaucuauaaugugauuagugcccuuuuuuggcaugcagguauacaugcagauagagcacacacacauaugugugugugcacgaacagaaauaauauacauggggccuagcaaacacagaaguggaugcucacagucagcuauuggauggaucacagggcucccaauggaggagcuagagaaaguagccaaggagcuaaagggaucugcaacccuauagguggaacauuaugaacuauccaguaccccggagcucuugacucuagcugcauauguaucaaaagauggccuagucggccaucacuggaaagagaggcccauuggacacgcaaacuguauaugccccaguacaggggaacgccagggccaaaaaaaaaaaaaaugggaaugaguggguagggaagugggggggaggguaugggggacuuuugggauagcauuggaaauguaauugaggaaaauauguaauuaaaaaaaaaaagaaauaauauacauuuuuuuuguuuguuuuuguuuuucgagacaggguuucucuguauagcccuggcuguccuggaacucacuuuguggaccaggcuggccucaaacucagaaauccaccugccucugucucccgagugcuggguuaaaggcgugugucaccacgcccagcaauauacauauuuuauauauaaaaagaaaucuuuuuuaaaaaggcauauagaacucucagccucuuuuccuucaccaugucugucuucaugcugccauguuucccaccaugaugacaauggacugaaccucugaaacuguaagccagccccaguguuuccuuauaagaguugccauggucauggugucucuucacagcaauagaaacccuaacuaagacacacacauuuagacaaaauacucauacauuuaaaauaaaaauaaauagcaaguaguggugacauacaccuuuaguccuagcacuagggaggcagaggcagguagauuucuaaguucaaggccagccuggucuacagagugaguuccaggguagccagaaucacacagagaaaccauguccugaaaaccaaaauaauaaugacaauaauauaaaugguugagauauuguuauuaucacacuaaagacaauuuaaguuuuucuguaucccagagaaaaaucugucaacuucuauccauguccacucucaacauaaguugacagaaaucauuuaagccuaugaaggaugcaucaggcuuuuacaauguguauuucucaaaaauguucugggaagccaauaacaaucugguaaggucuggugacuccugagaucucucacagggcccuguugguauuaccuuacagccuggcuuccucucagccuuggauguaccucugucagccuggcuuccccucagccggggggauaccucuaucuagcuagccuugucacaggaaccacccugaguacacuucagauucgcuugggaugggcaguuguccagaugcuagugguugugaauccuggagugagcaacucaacaagaggaaaggggcugaagggauggugcuucagcagucaugagcaccuccuacuuuuccacagggcuagagauuuggucccccguguucaguuagccuggcucacaaccaccuguaauuccagcuccaguggaucccauguccucgucugaccaucacggacacuguauacacauggaacauguacauaaguaaaaauaauaaaagaauuaaagugaagagaugaaugaaaacagcaaagacuagaccaaaugacucaugggagcccagaacaggguggagucaaccagagaaggaagaaagcaagugcugaauggggauauuuuauuccgugcuuaccaaagcuucuauguggggcuguggacgaagacuguagagacuacccagagucugaccuagggagaggccaacucggauaccccuaugugcgcucccagaagcuaaggacauugagguaagaucuuccaaguggggagaggaugacaaggacauauaggguacuuggcagguuugugcuaagaaggaacauauuucucagucaaaauuuaaaccucuaaaaacuucccacauuauauuauugaaugaauaguugauuggcuguguuuguguguguauguauguauguauguauguauguauguacguauguauguauguauaaguaaguguacguggggauucagcucuuuacugcuaccacauggguuccagggauugaacgcaggucauuagauuugauggcaagggucuuaacaugcuaauauaucucgccagauccaagagauuuuauacuguccuucagcacuguccuucaguucuuuuuguuuuuuuguuuuuuguuuuguuuuguuuuugguuuuucgagacaggguuucucuguguagcccuggcuguccuggaacucacucuguagaccaggcuggccuugaacucagaaauccaccugccucugccucccaagugcuggguuuaaaggcguaugccaccacagcccggcuccuucgguucuuuaggucauuauuuuuugggguagggggacaaacaaauucucacuauguaucacagauuggccuagaccccacaagccuucccccuucccguccuccauguccugggguugcaggcgugucucaccaauugcagcuggacuuguuuuguguguuuccuuuugagagguuucggucgggucgggugcuuuugcugcagaugccacugucaggaugggcugucagggcagaauggcuuuuggagaccaggaaaggaaaauacugaggaagcaaaacuuuacaaagcagcacucuuucuuguguacccucuaaccacaccauccugugggcugucacuugguccuccugccaaucuggagaacuuggcagggcugggucaccaccucccucagggcuaacaggauuucuaggcugacaugaugacccagcugauacagaguggagugccgagaaccuccugugacaggaugaaggaucugugugucccuggcccuugucaagguagcaagcagcaggaaccugaacuauuuaacuaugugucauaaagucuggaaauaagaugaaagcauggggcaucccaucuucucuagguuggaaagcuuugcuucuuuuauaaccccccuccccaaugccauggggccaugggauaaaagagucuccuugcugaccucuauuccagcuucagggagccugaggacaugaaugcugaaggagaagggacugaucuaaucuuucacuauagggacagagagucugagucagggaauaaaugaagucccuccccccucuggucuaggucucccuaacuuuagcucccucugcacagacagaaagacauggccuggaaacagacaccacucuugcuuuuggucuacauggucacaacaggcaguggccgggacagaacagaccuacucaacguuugcauggaugccaaacaccauaagacaaagccgggccccgaggacaagcugcaugaccagguucugugggagugugguccugaugggagggugauagagggcagggugggguuagugagcagccagacacacccacacccugagcucuuguuggcagagauggcuugguggaaaguagugaggugauuuucugagggcuguccccagaagaggacacagugguggcaaugaagcaguugaucauuagaagccucuaauuagaggccacgugaggucaugugaugauaaucucuaucucucucaaauaagggcccguggaagcacagggacucacucucacagguuagacacaccugauuuuuuuuuuuuuuuuuuuuugagagcauugguguuuugccuacauauguguuggauccucuggaacuggaguuacagacaguugugagcugccaugugggugcugggaucgaacccaggaacagccagugcucuuaaccacugagccaucuucccagcuuccaacaugacuagcuuuuaugguaggguucagguaggauuguggacagauccucuagaaauuggagggugcaagaccaccaaagagaugguaucuacccucuauuccucaagagugccagaugcagaagugggaaggcccucugugaggacagcaguucacauggucuauaagcauuuaugccagcagacagaagcucaguguagccuuuuugucacagauguguuuagauccccuuucauguucuggaaaaaaaaucauagguuaaaaacaaaaaccuggccaggugagguggcacauaccuuuaaacccaacacucaggaggcagaggcaagaucucuguguucaaagccagccuagucuacaaauugaguucuaggccagccagggguacagaguaagacccugccucaaaaacaagcaagcaacaaagcaaaacccauuuguaauuauuuauuucauuguauaacaguucauuuuauuauugauugcuaucaggacugauauauauauauauauauauauauauauauauauauauauauauauauauauauauauauauauaucguauguguguguauauauauguauauguauauauaugguauugaacauagggcuggagagauggcuuagcagucacuagcacuuacugcugcugcagaagaccugaguucaguuuccaguauguacauggcagcucauaacuaccuaugagguaccauaccuaccaggucuagaaggguugauacccucuucugguacauacauucauguacacacauaaaucuuuuaaaauaguaaaaaaaaaaaaugaaaauaagaacauagacuaugauguuugagcuuuauuacauguguuuuucuaucuguauaugugugacacacacacacacacacacacaugcuuaaucaugugaacacacauaugugccauauaguacaugcguggaggucagaggagaacuuucaggagucaguucuuucuaccauguaggucugggguugaacucaggucaucaggcuugcuggccagugccauucuucacucacugagccaucuuguuggccugguuuuguuguuguuguuuuguuugugaacaaugaagccagugguggugcacgccuuugaucccagcacucagaaggcagaggcagguggaucucugaguuugaggccagccuggucuacagaguuccaggacagauagccagggcuacacagagaacuccugucucuaaaauauaaaaugaaauaaaagaguaagugaacaaauggagcgacugguaccccauguagacuagcuaucaggcugcugccgaacucacagucagcugcuucuguuucucaacugcacugcagucacgggauuaaagguguguguguuccaugucaugccuggcuuauuuuggaguggcauuuuuuuaaaaaagauuuauuuauucaauuuauguauaugaguauacuguagcugucuucagacacaccagaagagggcaucagaucccauuguagauuuuugugagccaccaugugguugcuaggacuugaacucaggaccucuggaagaccagucuuaaccgcugagccaucucuccagcccuauuuuagaguuuuaaaagauuauuucuuucuuuguuuuuuguuuguuuguuuguuuuuuggagacagggucuuacacagcccaagcugauuuugaaggaugugacuaaggugaccuugaauuccugauucucuugccucuacauuuuucccccagugcugguuuuguaagcaugugccgccaugauggguaugcuucauuuguuuuugagauagagucucaucaaugcuaucugggcugcucuuggauucaugauccuccuccauccucggucuccugaauucugggauuacaaggcauguugccaacaugcccagcugaaaagaguuuuuauaaagugugagagaugcuucauaaaugagcuauuaucccgaaaacaaggcuccucuagcuucuuucuuauacugugaugaguauaagaguaguccuauacgcuagagauggaacuucugggggucuaggauagaggggccuuugugguaaguguucaacagaaaagccugugugaggcagggaagaagugaggaccaggugaagcaaggcuggaaggugacaugcgggacagaguaggguagagggacucagcccugugucuuucccaacuaguguaguccauggaagaaaaaugccuguugcucagucaacaccagccaggagcuacacaaggcugacucccgucuguacuucaacugggaucacuguggcaagauggagccugccuguaagagucacuucauccaagacuccugccuguaugagugcucccccaaccuugggccuuggauccagcaaguaugggugcuuccuucacaugcuucagaaaggcuaacuaaccuuaggcucagucucuuuagcugccaacauuuccuuuaccuagguggaccagaguuggcguaaagagcguuuccuggaugugcccuuaugcaaagaggacugucaccaguggugggaagccugucguaccuccuuuaccugcaagagagacuggcauaaaggcugggacugguccucagguaaggaccucuggguagcgagaugaauguaggguuuggaaagggggagauuaaagauguuuggggugaccagaggugagguuugacccuaggucuaaaugucugugcccacuaugauucugccugcaggcauuaacaagugcccaaacacagcacccugucacacguuugaguacuacuucccgacaccagccagccuuugcgagggucucuggagucacuccuacaaggucagcaacuacagcagagggaguggccgcugcauccagaugugguuugacucaacccagggcaauccgaaugaggacguggugaaguuuuaugcuuccuuuaugacaucugggacugugccccaugcagcaguacuucuugugcccagccuggccccagugcugucauuauggcucccuggcugagaggucagucuuccucucuagauuucuccucuaucuacccuuggucugguucaacucuucaaagaauaaggaagucuugagccugcuuccaccccucuccucugucauccaguuccugauccauguuggggguugggguuucuacaaucauuuucaauaaaucuaugacacaucugggccuaaugaauuauugucacugugagcuugugaguggguggggacagauccuuuccagucagaguaaauaguguuucaaaacucaccaucacuauacaaauguucauuguaaguucccuccuccuagaagguggaugaaccgagcgucugugcuucaguagccuguaggaaucuaguugcuucucaaauaacaggaagauccaggauuuuuaaauuauaucauucucaagcauuaucccaucaugggcugagaacauaacucaguuggaagagugcuugccuggagagcuugaguccaacaaaaacaaaaauacaucucagggggcuggagagauggcucagugguuaaggccacugacugcucuuccagagguucugaguucaauucucagcaaccacaugguggcucacaaccaucuguaaugggaucugaugugucugaagacagcuacauugugcucauauacauuaaauaaauaaauaaaauaauuaaaaaaaaaaacaaaaacaaaacacauucccuauucccaucaugugucugcuuagcucuguucucagcuuacaaaggggaagcuggaaacgggaguccagcagagauucuggagaaagggguaaaaauucacacugccuacuaugauauagauugacuggguuggggucccuuggacgaggauaguccauuaggaagucaaucuggaagauacagaagaaacaaaagcuugcauuucgcccagugcuguauccuacugaugaagccaaagaaacuauuaguggcuucccagaggcagaagcacccucuagccuucggcuaaauuguauuuguguuuauucugagugugugccuaggugugugggcugcauggaugacuuggcacagguguggaagucagaggacaacaugcaggagcucucuccuuccaccacaugggucccugggguucaacucaaagucuucaaacuuggcaaaagcgccuuuaccuguuaagccaucucaccccaaugacacagucuuuagcaucgccguccucucaggaagcuguaaauauauugauuuuggagggucgugacagcuuuucuccaacucguucuccuuucuuucuuugaggccacaucucuuauguagucuuggaugggcuggaagucuagaccaaggaagcuggcuuacaacuagguagaguuccauuugcuucugccuccugugggucgggaauacaggcauaggaaaguaagaccccacugcacacccccgggaucuggggugggcguccuccauucccggcgggaggagcuggguacagauuggaggauguuacuuuauuuaagcccuggcaggaccaggagaaacagguagguggguggaggaucucuguuuuuguauuuaucuguucuggaaggucccuacagacccgucacgucccaggcuuuguucuagauggguuaagccaaugcaaauuggcuuauccucuaaacagagggaaacuccucaggguugaccccaggcucggucaacagguucaauuuaccagagcgaaaguucucucccagguuaaagggaugcuccugacagacucuaggaguuggugguuguaggcaagcggcuagaggccugcgccuuuaaggagccagggggcagaggggcggggcaggaagagaaauccuuggagacgccaccaccauccaggucuuuuuuuaggggggaaauagggcgggccaaagcccuguuuggguuccgccccgucuucucccgccggguccccuuuuccgccccaggggucgguggaugggaggucuuagcagccagagucuuaggagcucccugcucgcaccuggcccacggaagcgcaaguuuguugauuuggagggaguagccggagcgggggcggugcuaauaauacccguucaguccccagucgcgcuuuacaguuuacacagcugucaccuucguuacuccuuaauuaauaauaaaaauagccgccgucccggagcgcacgcugcaugccaggcccugagcuuuacaggcagagccccaaugagcccgcccucguaacguuaccccaguuaucgaaagcgagaagcucgggcgcacugaagagccaaggcugucccgaggucacucugcgggcgugcggcggagaccgggacgcgggcggacgaggcggggcgcgggcggggcggaaggcgcggggugcgcgguggcggcggauggccaucuuaaguggccgcggggaguccagggaggcuuccccgggcuaggagucaacccgagucgcccuagagguggggccugcguucgguaguugaggcucugagacuugagggaacuuuuuuucuagguagucgaggggguccuccuggucugggacugcaaaaccugggccugcggguguggggcguggugccaggcaauuugguggagaugggggaaggguuuugccaggcuggagggccugcggggaccggugcgugaaaggcaccucgagcgcgcgcguauguguggggugggguaucggaucucuuugggaucuugugggaugugucaggaaucguuuugggggguucaggucugaaggggccucugaccuuauaggaguuacgagaacuuguucucuuggauguuguaguaguuguggaugucuauccuggagccuugcuuuccgaaccuugaucccgcaaggcugugggggugccgaguagaagagauguguguaguagaaucagauuugcauagggauuaggggucaucucauugcgaaucguuggaaggauugaauucaccagcgagaacuuggacucacaaguugucccggagcggguaccggggaacuggaucuucuugagguggggggacaaaauaauugugggacuugggaggugcuggucuugcggguccuguagggcugucggagcaucguccuugccgagagaggcugggggcaggggcggcccgggcucugggccgaguggagggggaggggaccggccagcuccuagcuccguucccgccccucccccgccgccucugaacaaacuuuucuuucucuucaaguugaggccggcgcugcgggcggcggcggcugcgcggagauccaggcgguuggcgcggccaagcguggaacccacauacuggguucucucgggcugguggauccuuagucccgggacccgggcccaaccucgacuucaagcuuccccgggcggauggcgcggagcggcaggcaucggcggcgcugagcccugcgugggccauggccucagugugugggacaccgagucccgggggugcgcuaggcagcccggccccagccugguaucaccgugaccugagccgcgcugcugcggaggagcuccuggcucgggcgggccgcgauggcagcuuccuggugcgagauagcgagagcguggcgggggccuucgcacucugcguccugugaguagggcgggcacacgccgaguguuccuugguugugguggcaaucgugguaguggggugacugua

SEQ ID NO: 3971 - RNA, 29911 nt, Mus musculus
gccaagagacaggcuacucuuccuuugguauuuguccuccccucucccuaaggugaaggcuacgucuauguuuuaccuuuagucuuguaagguacagugcaguuccucguccugcaccccuacccaaaccccaguggaaugagaaaucccccaauggcuguguguggaugcacaacuucuggaccuaacuccuagagauccuggauucugagggaguuuugcccugaauucagcaaccuaggugguagaggguagguggacugcucaaaagaaaugugacugugccacauagaagacagcuuuuagccuccugcaucugaaccagguaugaaucuauucccacagguccuuccaaccugcuccaucccacuugucaccaguucuacccucuggugacagaaucacagaccuaagagcacagcacuuugccccaagugugcgcauuggucguucugccccaagagguucuggcacaugcagggagcauggcuucaggguuuuguuugauucuaauuuuguucuuuccaaguaccagucucugagcuacuggagccaguguugcggaagugccuuccuggcuauuuggggucagcucucgcuuggcugggaguuuuguacacgagccaggcagggaaguugcuccuuccuguggugagauuuucuuggggccaggcagcuauccuggcugagccuuagagcuccaagaagcuauucggggcuuaggagccagguaggaagaucuaaauuuacugaaaacgaaccuguacaaguggcuguggcugugugugaaggcugguguuaagugauacaccugaccuuggggugagggaugggagugggggagcuugagagaaacuacgauauuaaugggccagugaggcacugaauguaaaaaggucagugguucaauuugggguucccaguacuaauaaauacugccuccuuggaguuuguucuggagaaaggaaaguuggcugugaaggguggaaggggcaagacagguacagaccugugagagacucaucuuucucaccccuucgcuaaccuuagagagaggggugagguagauagaggauuccugugaguuuggagaggggcccauucggaacagccugcuuucgauugggauuccuagcuaagaaagugaaagugaaaauaggugcucgauuuccuagaagcugacugcugccugcccuucccagaaggaggcuggcaagcuggcaaacggacuguugcuucccagguaagucccuggcuuuuaguacuuucucuccuuccuaaggggguauaaguuauauaagugcuguuuggagcugguaugagagaaaauuguuacuauuaacaccagcagugccuuaaguguggauagcccagcugguggcuacaggucugcccucuaaacuaccagcucaaaugggugucaguaacacugccugagggaaagaacacagauguagggcuagcugacuuuuacuuauuuuuuuccagaggaagucacagacaccagacuugcuugcaagucaucaugaccaugagacacugcuggacagcaggugggacauuaggcuuuguggcucuuaaaggaauggagcuauguggcuaacucugcuacccaacaccccccaccccaaggaaguuccauccaauucuuccauugcuguaagcgccuauguagcuacuuugguucuggcuccauuucaaggcuccuuugcacuacauucagcagagccgaggggugggggcuaaacggucuccacccacucagguuccuggugagaaccuaggaguaucugggucgaggucuguuccuacccagguagcagcuuguccccaacuaagaugggugcuagaaagcugagcuucaguuuuauuuacagcuguaacuguuuguuccucaggccccaguucuugguggguccugcuuuuguauguccaugucauuuuggccagagccacaucugcaccucagacaacugccacugucuuaacuggaagcucaaaagacccaugcucuuccuggucuccagcagucccaacuaagcaguacccagcacuggaugugauuuggccagaaaaagaagugccacugaguaagcaacaaguaugggagcccaagaggauacaguugccagaagcaggcugugaauacagaguugggggguggggguuugacuugggaguguuacuuccaaccugccaagaagcaccaggccagaccaacuugucucuguguucaccauucuacugcccagcuucccagaugguuccuauagaagagaacucagacauaggcaauguagaaccucacagggccuagguugcaauuuuccuauguagguaggacacaggucuuauguuucugauuuaugacuaaguggagcuuggcaggauaggggccucuguuuuauagaauaacuaacagucaaaugugcuccuagauggaacucugaccuuguccuguacugccugcagccgcuuccccuacuucagcauccucuacuggcugggcaaugguuccuucauugagcaccucccaggccggcugaaggagggccacacaagguaagggaccuagcaguggggcuacaagaaagaccuuccuccuccccaacuccggcaacccucucacgauuuccuucugcuuuccagucgcgagcacaggaacacaagcaccuggcugcacagggccuuggugcuggaagaacugagccccacccuacgaaguaccaacuucuccuguuuguuuguggauccuggacaaguggcccaguaucacaucauucuggcccagcucuggguaaggaaccugaaagaaggcauccagggaugggaggaacgcuacuaccuggggaaggaaggauuggcuuuuccaguacaaccuguaagcuagugacuguuuugagaucuaccagagguggaagcaaggaacaugggacugcagugacagcaagugauggcaagagcucuuccuuagcucugaccaugugugcauuuacuucuccaggauggguugaagacagcuccguccccuucucaagaaacccucucuagccacagcccaguauccagaucagcaggcccagggguugcauaaagccaaccacaccaugaccuugaccagagccuggcucucaucuaccuggaggguggagucuacaccauaggcugugauugccuuucugcugcugaaccucaaacucaagcuucacuucuacccuagauuaucauaguaauuaaguccuuagaguucuuccuguuuguccuccuguccauccauccaguuuaccuuuucugaugucuuauucaucccacugguguucuggaaccucugagaccugaugacaccuuagccaagugauagcucugcuuacacuuaacgugaaauugagaugccuaucuggcagauuucuacauccuguaccaaucaaaaagguuaacccgaagccuaguugagauauaacuuuggcaacauccacucagcucugaccacuaucugcacugacuucaaucuuuacaugugauuuuguuuuccuaguuugccccuaauguacuguccccaaggcaaggacggaacaguggcugcgucaggucacaacuguauaugucagucugugucucugcagggcccacacugaguacucauaaagcugcagcagcucaaggucucauuuuuauuuagacccugguacuguccucaggaacucugccugacucaggcagcaugagacacugccucuugccaaauaaaaauucagaauaacaugaaccccugcaacaguccauaauacuaguuaggaacaggggccagaaagaccaaacacaggcuccaaagagcugcaauuuccccuuuuuccucauacugacccaaagagcuuagcacucaagggagaaaaauagacuuuauuuacaaguaauaacauuuagaaaagauccauccccggcccuuaaaaaccuccccaucguuccauauccuaccccagugcaagucuggggaaggugaaguaugagcugccauugaaggcugcccccuaucucaccccugagauccagaaccuaucuguccuggaaaaaaagcauccuccaggcagcuguauauggaaauagguaagaacagaggcuccuaccaggucaugcccaauccugggcuucaagagcaaagaccccugcuaaggcccagccaccaggaacaacagagaagcagagccugcuucuccaauggucccuucuagguccagagacuaaggaagacugggcuaaagaauccagucucaaucuaguuagauggaaaaguagacuuuuuuccaaaacaacaacggagggagaaaaaaaaaaucaggaggcaagauagggagaagaccacacacuguccaagcuccaagccuccugggccaucucugaaagacgccuagaaggcaccaggcaaaguccagguagcaggccagggugcaggcaaaccucauugucuuggggaaggcuggccgccauuggccugggagcugagagaaggcacugagggacagcaggagggaaaggaccaagcaaggucagugcugacaaugcaguggggccacguaagcacuggugcugacucuuuaaugcuucaccugaaaaggaaaagacagucacuuggccagauuaaguccuguguugccaaccucuauugacuaguucacaaaaccccuggcuggaccucuuccuuuuuggggucucauaaacaccuacauuaaguuaugaguugccagccacaccuaagaaaugugggguccucaauuaugaguggcuagccaagacagagauaccucuugcaucccacccuccuccagugguuugguuugggcuugccucgaaugcugcccuauggaguagucuagaggauggucuuccuucuacugcguuaccuugcccuuggcccgaggagugguggcaacaguagcagugccaguuguggugguggcaaugcguggagaacggcggguuccacugcgaggauugggggagaccuuugcuggggucuucuuugaagcuccucgccuuagaagacuauuucccagcuucuuagguguguuaaggaugcugaaagccauugacugacgccgguccgccuauggggaaggucugucagacugcuacuuuugagcucugccagcaaggcuucacuuggccuuccuucuuccccuuggguccuggacuaaccuguuugagaacuggagcugcuuucuucugggugucagcagugcugcucugcuuacguccuucaugccggucccugggggucauggggcguggaaagcagcugguagcuuucuuggacugugagacaagauaauugggcagauaauggcaaaaggacaugcucucccuacuucugacaaaggccuuuccaacggucuguauaucugcccuuggaaagagacuucccuaucacuaagauuuggugggcugguucaugccuggguauagugcuaaagacaaaauagaugcacacaucaucuaccucaggagugccagggcccuggugggucucagaggaaacucguuugcgcugcugccugguaguuaugccaacacccucagcaaucugagcuggcugcaugcuggcucuacgcaagguuucccuggggucuccagucuucaucuccucaucagugaugguggccaggcucaggguaggcugcaugggacaagaggcaacagucaaugggcccaacuguauagagcaagaacuagggcuaaagcuggauucuuaaaacuccuuccuuccuguuguucauguugaccuauacuugauggauagcuaacaauuccaagcacagucauaucugacuucacuccugagugacagcuauuccaugaccuuccaguagaaugaccuucccaguagaccaaaaauaucuaugacuagauauucaggcuagccacuaaagucaguguggaaggucuugaggugaccucacaucucacccuggacuccagaggguagcaggucuucaggugcggggggcauacucgguugcgcugcugcaacucugcgaugcgguuccaaucauccagcugcucgggcucauccuggcaagugcccauguagaagcuauuccucccuauggagcacagaaaguuagggcaaacacggcagcuaauacaccgucuacuaaucuggccaggcuuuuguugccacuguucacucccaccuuucugggaguggggacuucgggcuagauacacaaguucuguauugauguugcacagcaaaagugccguaccaaaccauuugucucauggaggugcuuucucaggggagaucagaaagaguucaugaccagaggcuguagcaucuuauucacuugccaaagcuuggugccccacaccaagagaaacugagggucaugaauugauaaccggggagggucccuagauccuaaggacaacuuccaagaaacugcugggcagccugacuuuaccaagcccacuguuucucagacagcagccuggaggacucccccaagaaucaacucgcacuaggaacuguguggaaaucuuaacuagugagcaucccugguucaguguguucccuugcaguccuagauaggagauggcacaggugagugaggggaagcagcucuggcauaguaaggaggccugccuugagcuuuuggaagcuugccucuuuuccaggccaagauuugcuuccagucuagacugggauucugguaaauuccuguaauuuccucaccuuggggggccccacuggacauccuggccugggagcgacgagcagagcuucgugugguaggccgguagccaggcaggcuaagcagagcggaguugccaucaucaggagaacccaagcgggccagagacugaguggaggaaguggcucgcaaguuggccugggaagcaggagcagacugcgugcuguagaaggaugaguuggcgcugucuggcucuuccaauucuaauuucuagaaggacaaaucauugcagcaauacuauaaaccagcaccaccucccucugccccaaagcucucagauaccacacugcuuuacacugcguauggaaacaggccauacagccagaagcaucuuggaagaugccaagauucuucuaccacaacauuuugaaggaggcauuauuagccuauuucagagauaaaagcaaggcgaguacccucuacucacacagcuaggaaguagcuaggcuaagagccagaaccccuaucuccuaagcuaucuagauggauucagcccacaaccucugcugucccuagacccacgguuccuggggccuaaacuaauuauccccaaauucucaguaguagagggcauaaaagcaccuucccaccuguuccucagcccacuagagacagggaaaaaaagagaaucuaagccuagaagcagcagaccauugagagccacaccaagcuacauccuggcugcauggcgugccagaggcucggaaugagcuguuauuuccucuauccugcucugucuuccgucagacaggagagaggacucuggcugaguucaauuccuagcaaccacaugguggcucacaaccaucuguaauaggaucugacucagucuucugaugugcaugaaaacugagcaauuguauauauaaaaucaaucuaagaagaaaagagaccauaaacaaaucuaugcccuuuuaaaagauguuguucauaccugaguguuccugauuuaugagcccuggauaaggaacugguguuaauauccaauaguccuaugcccaauaaccuaaccuuggucauagugauguugaugauuugugugguacggcggcgagcagagcgggucuuacggccggagucagggaaggcaucccccagagagucaaggcuagucuccaagggggccugaccccgagcaggagugggggugaaguagaggcucuccagggauuccacuuuggggggcaggcgcugggagauaggugaagcuggcucuccagggacacugguaccaucugguuggguacgaggcagcuugcuguagcaaaagacauuugccgagaugcagacccugagcuagaagacauuaugucugucuccuugccccaaacugacuuaaucuuauuacagguaaaugugguaaaauacaguaccacuggucuuucagagauagcaaaagggggccuugacaguccacucuuggcugcuccuaacccuuuccuauagcagcucucagaucucucuaccuuagcccaaacccugcucuucaggucagacagcuaugggcccagaccucccccccagcagaugccacaacugcucgacaauuaauggggccuacccuaaaccccucugcauguucuuccuccucuaucuccuacuuuacuaaguagggacaccuucacaugaacauggguguaauuggacaucuucuaccauacacaaccauggucaacauccaagaagcucuccuagcugcacacucccuucccucagccucaguucaucucaccuagaccuagacugccaugagacacuauaaaguagugauaagcaagaacucaggacaggcugccaggcucagaccuggcucuaucacuguggaucccccaaaagcccaauucuaucuguuuaaggagagauaaugaauagagccuaaaaugguugcuaggagaaagcugaaguuguaauuguuccaagaacugggaacacuggcacacaguacaguacacauuugauagaaacaguaacuguacugcuaaccuuugacuucaauacugucaggaaacuaagaugcaaauccaaccuguaguccucaauuucagcacuucugaaguuuaucagucuuuagugcagucagccucuaggcucgcaggccuacuuggccucgcauuaaaggcugcucauccaccucugcauagcuguacaguuuaucaaaacucagaaaagcuucccccaaggcuuuccuaacugccccaccucaccucuuuuucacuucuacuguacccuaagcaggcaucugucguagaagaaccacaggcuagaacagcgcacacucagugaacaggcacaggauagagaggcaugucuccuaaccuagccacacugcaugggguucccuccuccaaacucagauccaggcugucaauacuuaaguccagcugggguuucacuugaggcucacggcucuuuaaggcaucaguugccaccuggaauuugcccaagucacgaagcugcuggucugcaugggcaaccuaggaaguaaaauaaaaagccuagaguagggguggccuuggagaggagauauggaguacaacaguacaggggugaggugcuucuguuuaaaguagguucuuaccugggccuccaggcugcgcaccugggcuguaaggugacggcaggucuguucagcuuccuuggucuucagcccugccugcugcagcucacggcccagacguucagcuucagaccgcagcuccuuguucuccuucugcaguuccuccaagucuugaagcuguuccugcagcuuuugguucugcugcuucuuggcaucauaaugggucuuggcuuucuccaucuguguggacagacaggguguguguggcagagccuagaaagggucaggaagaaaggcagagcaggacguuccuggccccucaccuggagcuuguaaugcucagcugccugcuccuucuggcucagcugggccugcagcucguucagcugggucuggaggcgcuggaccucuugcuggcuuucaccucucugggccuggaaagccugagaagucaaucaaaacaaggaaauucugauuacucuacccaaacccacuggccuacccuugcugcucagucuccacagguacugcagacuccucuaauauagucucaggacucuuaggacaccuuggcccaauacacacauucccuccaacugcagccuacaaaacaauuacauucucccucccagaccaucugcuggcucuaaugugucucacaguucugcugccauauaugaggccaagcaccaaguaucucucccaagggaacagaaucugaucuucagagaauaccgugguauagagagcacagugggagacaacugcauaugcaugucaaugucaggaacucacuucuccaaaccacuccaagaaauaacuuuuauccuuguuuuagagaggaaaaaagagaucagagauuuagacaaacugaccaaggucauccaccuaauccacaacuguggaugcugguucacuuacgaugccagcauugccuccuaaggggaccauaacuccucaagagcaggcucgcagguaauucuguuaaccugcaguaucagcuuuguucacuacagguacuggguggcugcaucccaccuacacucuccuacaucugcuagcucauaaccacccucaaaaggagcaugauggaccuacuuacuguucacuguuguucaacaguccaugggcaaggaagcucagagauccacuaccugggacccacuaugugcuacacagucccaguggaacuagucccugauccuuugcccuuaacuaagggaugggaagcuuagagcuacaaaaagcaaacacuggaacaaagaugguaacaagauuagaagcauuaaaaguguuaagugcuggucauuauggcacaugccaaguaaucccagugcucugggcugcauaauuagacccuaucucccuuaccaagguggggaaaguuuuuuuccacagaacuuucugggauggaggaauugguccuauucugucuugucauuagccauucaccuacugacugggaaaaugugacuaggguaaaucaagaacuacaaaaaugucaagccaggcgugguggagcacgccuuuaaccccagcacucgggaggcagaggcaggcagauuucugaguucgaggccagccuggucuacaaagugaguuccaggacagccagagcuacacggagaaacccugucucgaaaaaaacaaacaaacaaaaaagcccccccccaccccccgcccauuuugaggugcuggacuggaaacugaaccuaggaacuagugcucuaccacugaacuauaccuaugccuugauuuuuuuuuuuuuuuuuuuaaacuaaaaaggauaguggcuguaauagaaggcuuuucugugagagauuccugaagacaaagucaauguuucugaggcccaggauaguuucuugggcaacuaacccccccccccccaagccccaggcuccugcucuggccccaaacuaacauggcccaagggcuuagagaagaugguccuccacccugucacacaucugccccaccuuuagcuucuguugcugcaccuugcuggcuuggucaugcucugucagcuucuuacuuaguucuuccaccugaggagcagaaaaaaacaaacaagaagaugaagauguaauggcuaaucuugguuuucaacuagaccacaucugcaaacagcuaaaacccaagcaacugggcacagcuuaugagggauuuuucuugauucgaucauuugagguaggaaaauccaccuuaaaucugggccacaucuucugguggcagcccacauaaaaggacauagaaggaaguuuuuguacuuugccuguuugcccucacucucuuguucugcauaugcauaaccagcuuaaagauuucuaaguuugccuuggaagaauuaaaaccaaaauucaaguaccuucuuccccugaagaaccuugauauacacauaaaaguucaguccuuuccccauugaggccguuuacaaggguaauuguacaccagagaaaguaaacaacccaacauucugggucuacuagauauugguucuggauuaaugcugauuccaggagaccccaagaaacaguguggcccuccaguuaaaguaggggcuuauggaggugaggugauuaguggaguuugggcugauguccaacucauagcggggccaguauuccagaauguauauuggguuagauauauuuacaaguuggcaaaauucccacagugcuucccucaccuguggagugagggcucugauaguugagaaggccaaauggaaggccauuaagaguugccucuagcagggaaagaugcggaggugaugguucccaccacaucucccuuuaacucuuaucuggccagugcagaagacagauggaucaugaagaaugacaguuugacuacugcaaauuuaaguagugacuccaaaugcagcugcuguaccagauaugguauccuuacuugagcagauuaacacaucuccugguacaugguauguugcuauugauccaacaaaugucuuuuucucaauaccuguccauaaauaccaccagaaacaauuugcuuucaauugacaagcacagcgguauaccuucaaaguuuuaccuuaaggagacauuaaacagcauauaugagcaggaaguagcaacuacuuuggacuuguugguaacacauggauaucagaggauagggaauaaauccaaucaaaauuaaagggccuucuaccucaaugaaauucuuaggaguccaguggugcggccuacagagauauuccuucuaagugaagaauaaauuauugcaccugacccuucccaccaccaagaaagcagcaaaaacauucagugggccuaucuggauucuggagacagcacauuucucacuugaguguguuacacuggcccauauaccaaguuacuugaaaagcugcuagcuuuguauggggccuggaacagcagaaggcucuucuacagguccaggcuucugugcaggcugcucucugucuaccacuuggaccaggagacccaaugguacucaagggauuuggaauaagguucuaccauuaucugcaggcaaguauccucccuuugagaaugccuacugucucuauuaccguuacaaugccuucugcucccaagcuugcaccagcagcaucauagaguguguccuaugauccacugacugaaaaagagaagacuaggacuugguuuacugaugguucuguacguuaugucggcagcauccagaaauggacagcugcagcauuacaacccuuuucugggacaacccugaaaaacagcagguaaagagaaaucuucacaaugugcagaacuuuaggcaguacauauggccauccauuuuguuuagaaggagaaauggccagaugugcaacuguucagauucaugggcuguagcagagacugauuggcuggaaacuuggaaagagcaagaagaaagauaucuaggaagugaagauacguguguccuauguaaaugcuaaucaaagggugacuucagcuaaggaguugaauaauaauucuauggacaaucagccucuuuucuccauccauuccugucauugccuaaaagguccauaagcaaaguggccacagugcagagauggagguuaaacaugggcucaacaauacagacuuccaucaccaaggcugacuuggcuacagaugcugccgagugucagaucugcuagcagcagaggucgacacugagcuuugccuuacuggagagagaauuauucugguuauggaugugcauuuccugagcaaaaugcuucugccaaaacuaccaucguagguuuacagaauaccuuaugcaacaucaugauauuccacacaguauugcuucuaacucauuugcagccagagagguacaacaguggcccauguucauggaguccacucaucaugaucuccacuguccugaagcaucccuucugagagaaagacggaauggcccuuugaaggcccaguuacaaugccgggaggguugggguaggguucuccagaagguuagguacaugcuuucagucagugugcaauauagucauguuguuauaaaguuaugaaaaccagcuaaagcaguguuucucagccuuccuaacguugugacacuuuaauaccacuccucauauuguggugaccccuggccauauaauuauuuuugcugauacuucauaacuguaauuuucuuauuaugaaucacaaugccaauaucugauaagcaaugccacggaagggucauccaacucccaaauacaucuugaucuacagcuugagagcggcugagggaccagcuauagaaacacggauuagaacugacagaaguguuuuuucauagcuugcuaaaauaauguuuguguauguauagacguuuaaaauagauauuugucucuuauuccuuaguuuaucaugugaugcagcauaaaaagagauaguaucagugguaauuuuuaaguugugagacacuagaagaaugucucucauggaacagugccaucuacucuaaaauauauaaugcauuugcaguuguacaugggauaaauauugccugauaggcauaacuaugaucuaguuauuuucacuugggaauuuaaugaagcauaaggagauaugaccaugggugaagcugacaggugguggacuuguacauaauggcuaaucuuggcuuugaacuugaacaucugcaaucaaauaaaacccaagcacucgcacacagcuacaaggguuuucuugacuagaucaucugaggugggaaaaccacucuacaucugggccacaccuucugcuggcagcccauaucaaagcacacagaaguaagcuuugcuuuuugccuucuugcucucaaucuugcuggcaaguuuaucuauccuacuaucuauccuacugcugagacauuccucuguggguauuagagccuacuuuuuugggacuccaauacagaccaaagaucagcugaaggaucagcuuuauggacugaauugccaccagauuauuuucucuuccaucaaaagacagcuauuguugaaacagccagaccauagcauguaagcuacuguaauacaucuccuuuugauaaauauagacucaaaucaguuguguuccucugaccaaccaaaggguuucucccacccauuauuauccucaggcccuuucucuacauagguaacauccugcuguccaaagguugucagggccugagguggccccaaauagauguuaccagggucaccugaccaaaccaccaccaaaauaaauaccugacucuucagagucaccaucucuguacaucucuacuguauccuacucccgagcccaaccuagaaagcuuggggcaagaacagagcaccuaugggguuuggagagaugauuaagugguuauacauucuaugaguucuuguagaaguucuuguguuugguucccagcucccacacgccagcucaaaaugaacuaucacuucaguuucaguuucuaaaauccuuuucuagucccuguaggcagcaggcaugcauagaaugcauauauauaccuauauaggcuagcacucauacaaaagaauuuaaaaaaaauagaaaagaacagaacaccuacucuagugcuaaaacauugucaaaguacauucauuucucccuccucccccaaaauagccaaagcaaagcccccaaaccucuuuccaaucuccaaggcuguuagagaggcuagcagcauggccacugugguuagcacugggagaaaagaaugcuggagacagaagcagggcagcacacaaucccaagccccucccccaacuaccacaaagagcaaagggaucauaacagccacaagcacccauguuuccuccaagcauuaugggaacucaggcaugaacaggcagcagaggaaagaggcaaaaggcuccauugcuaacugcuugcuuuccaauuugauuaucccauuuucuuagaaugccuguagagacuaggagggagaguggagaaagugauaugggguuggagagauggcucagaggucaaggggacugucuucucuuucagggguccugaguucaauucccagcaaccacaaggugguucacaaccaucuguaaugagaucuagugucgucuucuggccuacaggccuacgcaggaagauuacuaaguaucaacucuguagccuaccaacuagggaggacagagaggccugagaaggauggaggcagagaucucuacuccacuucuacuccuccuguuccagaaagcucuaugugaguauggcucugcgaugaggcuccaggguauaguggcugcaucuucugagcugguugaguucccuauccuccaagggcugccucauuugucaccuucauaccuuggaaacuuguagggaagaaggguaauaauguaaacaaagccauauaaaucugugugcuuccucuuggauuagucuccuuaacucaaaacgggacuugggagguuuuguugucaccaggaaagaugacaccuacuucuugacucugauaggugaaagaaaggacagaaguggagaggccgaccugggauggguaggaugaggccacagagagggccuguaacacuguacuccuggguagccugggccuggacuccauggcuugacccugccuuucacaaacaguucacaacaggagcuggcggagcaagcugcagccggggucaugcaccgagacuggucaccgcuuaagcagccagcauuuaucgagaaccccaggcauuaccugcuuagucugcucucuuugaaauaccucuaguugcuccaccugugcauggggagaaguaauggagacagugagaugcagccacugccagacugaccucacuugggcucugauacuucacccagagaaugggaguguaggccaacuggauucagguaacaggccauauuaagccugagaucacaacacuugggaggaaaaggcaggaagaucaagagugcaaggccaucuuuacauauauagugaguucaaggcuaaccugaguuauauuagauccuguuuuaaaacaccaaagaaacaaaaagcuagucaacuuacuguucagagucagcuuucaaagaaaaggaggccauagguauuguccuuauuggaggaugggggcggggggugacuggggaaguucaaacaggguccaacuaugcaaccccuauguggccucaaaaacaugaucuuccuccugacuuagccuccuaaaugcugggaauucaggcaugcaccaccauugucugccauuucauuaacauucucuuucacacaaacuugggauucuacuaguuacuacuuuucuuuuucugcuacucaguaaacaaagguaggcaggcuacugcaguauagaucugggaugggaggcaagaggagggcuacagaaugcagagcacauagcauggacaccuuaccugggcagugaguuucugccucucuucuuggaaccucugccuuuccucuaggaccuucaccuuggcaccuucguacuuggcagucaucaccuccagcucccggcuaguacucugugcuucuugucgcauuucagccaagugggucucagcaucaguacgcacagcagccaacuccuggacauauuucucccgggcuugaucuaguucuacuuccagaaacugccggccaagguuggcccgcucucccagcccccgguucuccucugccagcaggccaugggccuucuucagcaugcucagcugcucugcauagcuggccuucucugcccgcagcugcugggcugcucgcuccugcucaacuaucuucugccgcaaagauccgagcucuccgagcucccgcugggcccgcaucagcucugccuggagcccaccagcugccugcuugcucugcucgagcuccucccggaagcgcuucucggcagccgcuugcucagcuugcagcugcugacaaaggugcuuggcaggcagcagcucacuuaccagggccugugugcuggugugcuccagcugcagggcagagagagcuugcuccuucuggaaaaacuucuccugccaggccuucaauucuuggcccaacuccucagcucgcucugcuugugaggccaacuccugccgcgaguucucugaaacuacacgcuguuucuccaccucuucccggaggcucuggaccuccucucguagagcugagcugcguucugcugcccuggcacuauugcuggcuguuucuacuugaagcaggcgcagccucucuuccagcuucuggcucuucucggauucagcuacaaccaggcgcuucaacuccuugcucuccccuuccuucucuaggacuuggcgauucaggauggauaccuccucuuccaagcugcugauaagacugcuuuuucuuucagccuccugcuggccccgggcuaccugggccuuccacucuuccucagcuuugcuaugguccugggcuuuagcacggagggcuugcaacucucucugagcugaagcugaggcagccugauuaugcccuagcucucgagccuucucuucuaacuggcccugcagugucuccagggcuuugucuugcucggcccggcaagcccgcucagacuugaggcugugugucaggccuuccaccuguugcugcugcugcugacacugcugcucuagcuuacugaucucugcccgaagugccugcaacucagggccuggugcaucugucuuuccagcugucuccgacuggguuccugggccagaagcaucuucuccacuggcacccccugcagggugcucuuuuucuuucuucacuaacuguauuuucagcuguuccaaagucuguugaagcuccuucagcucuguucuuugagcugccuccugcccucgaaguuuggcaagcucuuggucugucccuuccuuuucugucagggcaugggccagugcuuccuguagggcagcaaacuccacacgcugcucauugaggguguucugcagucgcaucuccagcucugccuuggcugccuucuccugagccaggucagccugggccuggccccgcuccugggucagccgugcuaccucccucuccuguugcccacgcuccucuugcugcuggcccuggcucuugaucagugcugcccgcagccucuccaguucaccgcccaucugcucagcuucacgcuccauagcuuuuacugcugcguguguacuagagaauggccgucccugcuguucuccuagcuggucagacgcucuguuugcagcucucgggggcucuuugagcagcucaagugaggcuguuuccugcugcucaccugccuugagcaccaaggucuucagacaggccaccuccuuguuaguggcagccaucuucuccugcagagcugagagaucaucuaccagcuucugugcucucacuuccuucuccuggaccugcuggauggcuuuggccagacuggcaugaagcugggcuagcugacucugcugcuggccuggcuggccuucacuguggaucucuacugccuccuccuggaccucuuggccagucuucuccccuuucaaagccaucagcuguuccuggaacauggcaccguaccuugccuccucuugcugucuagcuucaaaccgcuucugccggcucucaaccucucugaugagccgcucacacucacucucagcucugugcugggaagcuguggccucugccagcucaugccgcaaggcuucagucucagccugaugagccucuucaagcugcuguauccgggccuccagccccuuucgcccagccuucucuugcucuaacuccuucuguucccgcucccgcugcuccaucaggcuucgagacucugccuccaucucaguggcacggcacugcugcuccuucagggcaucugcagcccugcguuucucuucuucaaggcugccuuugguaaucuucaaagacuccucaagggcccggagcugcuccuggagcugggccuucuccugaaccaccuuuucucgcucaguuguuuuuugcugcucagcuuucagcugggcuucuagcucugucacacgagcuugaaccugacgcuguuccuggugggaagcuucaaugcaggcaugaagcucuccuaucuuuuggcucagcucugccuuuuccugcugagccugugugaccgaggucugcgcauugucccuagcaucauuggcagccugaaguugcugcugcagacucucuagcuuggcauccuucuccuucuccacuguuucuagcugcuggcgagcaguaucccguucccuuagagaggccucucgagccucagcaacgauggccaguugcugggcgugauccugucugguugccuccugcuccuuggcugccucuucuaauugcugcuccuucagcuucaggcugcugcucagcugcuccaccugcuggcggaggcccugggcagccuguucuugcucuugcauggucuguagcaucugagccuguuccuuuuuggccuguucuuucagacuggccagcucuugaucucgcugcugcaggguggcauugagcccugucauagaggucaacugggcagugagcugagccccuugggccugggaggcuugcucuaacuccucuuuggccuggcugagguuagagacggagcucugaaggucagcaaucaagcuggccagcugcugcuuuucgucuucaaagcggcuccguucagcaagcagcugggcuuccugcuugccacguucacacuccagugucucuacgcggguuuggagcuggguguugucuguggcaaguuuggcugccucuugcuuuagaguguccagcuguugggauaaagagacaaaauggggaucaacccuaucagagaacaccaagaaucaacccuaucagauggccuuacugucugucugucuguauuuuccuaccugcaaggcgucuccuagcaccucacccuucuccggggcugggcucuccugcagccgaguugcuugaucuuccagcugggaaagcuuucccugaagaauuucauucuucucuucaagacauuucuuggaguaagcaagagacccguguaaacagacacgaagaacagucaccagagacucaauuaucuuguccccuagauuuuccuuugcccuggcucagaagaaaauucucagaaaccaugggucugagcugggaguaagggcuccccaaaacucaagaaacugagacuugaaaaugaagaguucaaaaaccaaccugugcucaccagacccugcaugcauaucaacagaaaccacaggucuggacuuuuugagaacuugacuuucuacucccaauuacauucauaaauuuaagucaaaauauacaaagccuacauaccauguagccuuccucagacaaaccuugacucagauacuacccaaaugcuuaaaaaacaaccccaggcaucaagccagccuagccucaucugccccagccugacaucaacucccccucaacugugggcacaaaguaacaugcucuuuaaucccagcacuugggaggcagaggcaggcgaauuucugaguucgaggccagccuggucuacagagggaguuccaggacagccagggcuacacagagaaacccugucucgaaaaaccaaaaaacaaaaaaaacaaaacaaaaaaacaaaaaaaccacucaugauuccagacucuaagugauaggcccaagagcuacuagguuaggaaguagcagagcugggcucuuaguaacaacgguaaugcagauugggcaccccaagucugaaaucuggaauccaacaaucccaaacccaaaaccuuuugagcuccaaacaagauaccaagaagagucuuaaaauuuuaacaaauaauuguggcagaaucuuacaacucuggcacacaggagaaaaagaguagagaacagaguccaaaaccagcuugggcuacagagcuagggacuuuaaaaaacaaaaguucagagugauuuagauauuagauaaagggaugaacaacuuuaauacugucuaugcaaauauuucagaaugaaaaaaaccuaucucugguaugcuuuugacauuaagcauuucagcaaagaaacccgaccugaaaucacaacuaauucacuaagagcucaugaguugcccuucaaccacacaauaguuaacaaagcaucagucccguaagagacagauuaacuucuccaagauccacacuucacacaucacagaguucacaggaaugcugcacucugaguauaaaaccacuaccgccgggcagugguggugcacgccuguaaucucagcacuugggaggcagaggcaggcggauuucugaguucgaggucauccuggucuacagagugaguuccauucugaggacagcuaggacuauacagagaaacccugucucaaaaaaaaaaaaaaaaaaaaaaaccaaacaaacaaacaaaaaaaaagaucacuaccaaacccugagaaggcagcgcucaucacuccaggacccaacagacuggugaacuacauguaggaaacgugaacagcuccagagcugaggguuaccuuauccuggagggcugugcugagcucauuuuccagacgagccugcuucucugcccacuccugagaagccuugcugugcuccucuaucaggucguugaaugcacccugaaguuguugcaagugguuugcaaacucucgaaccugagauauaaacagggugaaaaguuggcaccucuccgcagaaauuccuugaaacccagaccccggggccuccaauaauccuuccccaccuucaauccaauuacagccaauuacaucucucauccagaaacauacaccaucacuuagagcugccugagcacccuucaagaaaccaauagcaaggaaagugacuaaagcccaaagccagguucuagacagucuucucaaccuucuugggcaaacuuccagaccaccucagcccugaggggccucugcacagccagccccacucaccuuaaaggaaagguccccauucuccucagaaagcuggcuaaucuuucgauccaucuggcucuucucggucuucagguucugacacugcuucaaagucucaugcagccgcacagugaggcugccaggagaggaacuguaagaauggugugguccccaccucgcuagcagggagcggaugcuggaaggauggcagggagagucauaccuuucauucuugccucggagcuccucaagcucacugggcuccugggagcuggcugccugcuucucauucagcagagccaggugaucaaugcgcugcugcaucauggcgaucugcgcgucugcccaggacagggagggagacagagucagcaaagauccaggggacagaagacagcaaaggaagcacaguauccgugccacagaaaagggacacgggaaaggaacugaacccagugucuaccaggucagacugauguuugugccagcgaugagcuugagacuccacugucaacagaagggacaccauggcaggcaaagcugucaccaagacaucccaaaugcuccccaucaccaguacccacacccucugucagguacccacccuucucagugaggagcuugaggcucucagacagcuccagcuccaggucaucucuguugcuccucucgucugccagcugcuucuucagucgucucaucuggaacuguggggucugcaguaugucgcccauaggggaggauggagagccugagaggaagcuggaagaggaaggaggagaugcaaagaugccagggugagagucuaaggugcaaaguaaccaacagcagcuagggauggggcagcagugaccauaaccaguguuugguuagggaggccaaugugccuggguucuuuaucugccaggcuaccuccugucucagaagaugaccuggagaaccuuuucuucucccuccuccaugccuuaauuuccuggcuuaagaaugcaaacauguggggcuggagagacggcucagugguuaaaagcacugacugcucuucaagagguccugaguucaaaucccagcaaccacaugguggcucacaaccaccuguaaugagaucugaugcccucuucuggugugugugaagacagcuacaguguacauagauauaauaaaaagaaugcaaacauguauuuuccaaggaagaagggauuuccauaaacagugaccugcucuugagggaaggcuaacuuaugacagaucccaaaucuacaugcccucaaagcaauuccuacugcuguaaaaggcggccuaacagcucagccucccggauccaaggaccaacuagaaggaugugacgcuaccaaccuagggagacaggccuagaacauacuuguucucacuggaagaugaagcaauccucuguauuucuaggaagcgaaucuuccucuuggucugguggcuggguggagaaagcucuucugagagggugcuggcauggguguaaggaacuacagguaagaagcagacaaacaaaccaggaacaguuaguaagggggugaacagcucuucaccuucuauaauagacacguuaccuuaguaagugugacucuacaaaagacacauguaagcucaagaggcaauuccuaggcagaaccugaucaacgagaucaaggucuuugacuaaaaucaaggugcaacuuccacuuccucagagaaaaguauucaaaugagcaugguggaaugaggaagcuccccucauacucagacacuggaacgaguccuauugccaauacuacagaggccauaagagcccagcaccaagucugccacagacccuaagagcuuguauuggugccaccagccucuguggcacucauagcucucauaucaccaagguauagaauaaugucuucucuugguucccacaaccacuuucucaggacuuuacuaccucgaaccacuccucuucucucucuucccagagauuugaugggcccuuuuugcucugcccagugccuacagauucaauggcugacaagcuggccugcaaaucuacaucugacucaagagaacuuucuuacauccuagacuccuauucuuaacaucuucaccucaugaacucaaacaugaagaaucccaaguucaauagccagaaaagaacuugcccaaaacuauggcucagagucccaguagcagcagcugaccugcucaugagacauggcgaacucucacucugugagacacuuauaucuacacuuagucccuguacugguuuguauguaccugagucccacauagaacaugagcugcaugaagggaaaccuuuuucaagguuuacaaaagauguuuaacuucaacuucuaagccuacaguuuaaaagacaaaaaauaaggguauggagagauagcuuagcuggucaagcagacccaaguucaauauccacaugauggcuuacaacucgaaguuguuacuccaguuccaaggggaucccaugccuucuucuggccucugugggcaccaggcacacacuugguauucaaauacacaugcagucaaaacacccauaccauauguauaagauaaaguaaaaauaaaaaguaaaagguacacagaacaaugugagaaguaagugggagucaaggucaccagaacguaagaggcgaucacuuacaagcauccugagagcuacugucgggcagcauggagccacuccagauuguuuaaggugucagcacauggcucagaaaucaccuuccaucacaggugacuccugcauacuaacucugugccaugcugaggucagaggucagcaguccuuugcucagagagaguggaucuuuacaaguggcccuacucaccuuucuccaagaaacucucuaaguccucaguaagguuuagcgacuccucaugauccagcauaaacuucaggaugaccgcuaacucagccugugccacggggagagagaaggagcaucacugugacagcuguaaagggagggcucaggaccucccagcagugccuaccccggggccugcugguucuucuccacccucucuaaagcugaaacuucauggccugcccacaacacgcugguucuaccuguucuuccccuaccagaaagcuuuuagacaucacuuugcugacuaaaauaaguggaguggcaaacacacagauaaggacacacauaggaaaagcuguaaaccuacaccaucuccaaauacaggacaauucaaaacauguacacuaaauaguuggggaaugacauuacugcaguaucauuuccuucuuuguacuuaaacauuuucugauuuuuguuuuuuacucaaugaaugguugucaauauuacaaauauuaccucuuuagagaauaauaauuuuuauuuaaaaagaaacguuugggugagggaagcccaggcugggcuggcaagugggauaaaagcacaaaagccuaccugaaccccauauucaaacugcucccagucccggagguuucuggagcucaugguggacugauauaaaaacagcauuaucaucuagaagccaaacagagaugcagugacugagugcaguagaucucuuucuaguguuuccacucugagcuguuuugaguuagucuccuucagaaguccuauuagcagucucaagucacuauccuuaauagucacagggggagugauggcucagugguuaaaagcacuggcuacucuucuagaggacccggguucaauucccagcaaccacaugacagcuccuaacugucuguaacuccaguuccaggggaaucuucaucuucacccucacacagacauacaugcaggcaaaacaccaaugcacagaaaaauaaauguuuaaaacaaggagucuccuuuuuuuuccaaaauaaauccaagggcucacucaccaggcaggcaguggugacucaaaacuuuaaucccagcgcuugggaggcaaaggcaguggaucucugaguuugaagucaaccuggucuauaaaaugaguucuaggacagccggggauacacagaaaaacccuguuucagggaugacgauaauaagaauagcaauaauaauaauuaaauaaauucaggggcuugaugcucauagugcaaaaauuucuacacagcugaauuccucaacuuauggaacauaacugagcauaaaacuuaagggauuauucacaccagaaaaagaaaugaagucaacuaaacuugaaagaaaaauaugaugaccacugagcaagaaccaaucuuccauccuggguaucaguguuggucaaguaaaguuguuugucaaagaucacgggcuuacagaauccuuagacaaaaauggccucugauucagccaacuggcuggucucgccucuacaucugaagagccccagaaagaaagcauucgacacuccuccacauucucugccacccaagucuggaaucccacagguaccuuggccaguuccaucucggaucccucuaucacuuucugcacagauaccaggcauuguguagaugaaggauguuuccgauuuucugcaaugacaaccauguagcaaacacuaaacucucaaaacucaacuucagaaacagaaguacagucuccaaggagacuacccccuuauuccuacugcucucucucucaccugccuucuuucuauucccaucugaagucagcucggcuuuggggccacccaaugcucccauggauagugcuagaagaaaacugcuaggccauuagcaaaacaacucaagaccuauacuuaccugucagcuuauuggcuccaucccuuagcuccacggaaggagccagagacaugagaucacucuagaguccugucucaacuaaggcugaagagagauggucuacaagugaguccaguaagagcaaccgaggacaccaugcccuuaugcugccagagcuguuucacaguagggagaaaauuucaccugcccuauaauucucuugagguagaaaugacaggcaagcagcucaauguuaaagaugacaauucugcgauacaaaaaugaccaggggggagcugacaugcucugugccccaaguuucacaaauauucuuauuuaauccuccacuaaccugaugagcaauuguuauucccacaacacagagacagagaaccugugucuaaaaaaaaaaccagccccuuuacuucguaugcaagcaauuaccuaagaauaauacuuuucuugcaagggaaaggaguuuacuuacaaagguaauaacaugauccuuuuccuuccuuucucuucaaaauagggagaacucugauaucaccaaagugguaucaacccucucagcuaucuggaccugacacggacucuaggacugaagagacauuuuucuuaaaaguaagcugguggugcaguuaacucaagacccagggaggcugacgcagguguuugucuuucugcuagaguuggggacccuaaccuuuuugcagccagacacccaugacugaguccccaagucccaggagcugaagcucuccagccaguuaagauacuuacucuguagaaaacugcaaacaaagucuagucuuuccgguaguggcugcuguaggauuuguugccccucuuuagugucauggcuaaagcaaacaaaaagcaaacauuaggacaagacuacucagccauuugugccucccugcuucccuacagccuccccuccccuuuaggcccagucuguucuaggccugggggcaggagaagauucaagaacacuacuuuacucugaugaaaauguguggcggguaagaaaugcugacuuggagcaugggguccuucuauaaaacguggcacucagcuaagccauuugcaguacaacaaaguuuugugggaaccauugagaggaaauggcaaaauguuugggaagcuauguuaaacagcuagaguggcucaacucuaacaugucagaaaacaugggaaacacagccaaaguagaguguaagagaagcccaugagaagagaaaacagggccaaaauaugaaacaaugggugaugcugaggcucugaagugacaggacaaaguucccacacuccacaguaggcacaggcagacauggugcagaagaaauggcgaaagacucuaagagguggugcuaagaagcacucauccuugaugagcagccuugccuuccccaaaguguuuagcagccaacgcacagaagagagaaacaagggagagagugugaugguuuguaauguuuggcccagggaguggcacuauuaggagguugcccuuguuggaguaggugucacuguaggcaugggcaugaagaccucuuccuaguugacugaaagcgagucuucuccuagcugccuucagaacaagaaguguuaacucagcuucucuagcuccacaucugccugggcgcugccauccuccugccuugaugauggacugaaccucucaacauauaagccagccccaauuaaauguuguccuuuauaagacuugccuuggucauggugucuauucacagcaauaaaaccuaacuaagacagaaguugguaccagggacuacaguauugcuaugauaggccugaccaugcuuuuauuuaaaagaauguuuauuuugggacuuuggaaagcaguggagucauuuaagugggguuuaaugggcuauccuaguagguauauggaagaguuuguugcugagagugaucugaaagguacagaucccgcccaagagguuucaguggaaaagaauuucaauauauagcauagaaacucauuuugugguauuuuggugaagaauguggcugcuuuuugccauugugugaagagccugccuggucaaaagagaaaauccccaggagccaaugucaaugcauuucccacuaaaugaacaaacaauaaaaaugcccaguggccugccaauccguacuccuucccuuaagaacaagccuccugauuuagagcagcuccaggaggacgaccagaaagcuaacagucacagcacccuaagaaugcccguuuccccaaaggcaacugcucugugucauuuguaucugacacagauguaaagucuaauaugagaucuuaauaucugguagucuaaggcuaaucagacagcacucuacaguagaaaauggguacugaauuucucuuugaaaaaaauuuccuccaggaauaaacuagagugacuaaagcaaggacaaaucccuguccuuacuucuggacuguggaguaggagcuuccucacaaacuuucuucuggaagagcagaggga

SEQ ID NO: 3972 - RNA, 28264 nt, Mus musculus
cucaauauggcggccaagggacucgugugcugucugucuacugcucaguuuccgcccauucaacucccggcguugaaacgucaagaacgucauucgaauuccguccgucgcguugcucugcacgucacggguggcgggagcgggaaggaguucguaauucgguuagucugcucuggugaggaaagugcugucuaucgcgcagcuuccaucccuccguccgagcagccucucggaguccaacccuucacaucugacagucgucucugucccuucuucgccucggagcugcuaacuggucucgaaccucucagcacuucagcuucuagcggcgaugcaugugaucaagcgaggugagggguccguggggauggggaggaggagaggggacccggcugcggagagcccagcggucacuaucgccggcccgcccgacccgcccgacccgcggcgccucgccgcuucccgcgcuucccgccgcgcuucccgcccugucugucagcugggccugugucugcucagucuguccccauucucuugaccuuuguguguucccuuugacuuugacuuugugcucccuuccagacucccuccaacccugucugagauuguucccgagcacuguuauuccuugccgccauccucagagguagcugcuuuuggcuccauuuuuuuagaagagguugcaaagacacgaaaaagcaccccaacacccccauuccaccccagcuaguaguuggugagguuagaauugaaacccauagcucauaauagcccugugccugucuuuccucauuucuuaaacaaaauaacagacaaaagaaccgcggagucgaugaucugguguaggaggaaauaaggaaaaaaagaaaaggcaggacaccacauuuuuugaacaucugucauuuuucuggucucuucugaggugggaguguaguaucaucucuccugccucugcauuuuuguggggagguuuuuuuuuuuuuuuuuuuuuuuacauuguuuguucuugggacaggguuucucugacuggccuggaacuuacucuguguagaucagucuagccucaaacucacagagggcugccuccucuaucauaggucgauagacaaagacuuuuaacccaaauagacaaagacuuaauccgaguagacaugauuaaccacugagcagucucugcagaccccaaagacaaucucuuaauuguuuuaaacaguuuuaaaagcugaauauacuugauucuuugguauugcccgcuuaauaacugcuaaugcuaacugugauuugauuauuuagauggccgccaagagcgaguuauguuugacaaaauuacaucacgaauccagaaacucuguuauggacucaacauggacuuuguugauccuguaaguaaauacaguguguaucagggguucuuugcaugcuaugugauuuuaugucacuuaccucuagcccuucacuuaacuauacuucaguguuaaaugugaauuuauugccugacacuuuccuuaauuuugauguguccuucaaguucucauuuccuggagaacucagaacaugaacuaagaggggacaguugaugugacuacuggucaggcaucuuguuuauccguauuuagccacacaguguagaaauuaguucuauuuaccgucaucuggaauuaggagugcuguguaucuuacucauuuaacuuuuaagagucucuaacaguuuuauacauacauauguaaaauacacuuuugucauacuuucuucagugaccucuuaucuccuuccuacagccaucuucuccauaagucucuuagugcuuugugugagugugugcauguguguuuauguguguguuugugagugugugucugggucccuaucugucccacuucauuuacuuagaguuguugugugaacauuggucuggaauuaauuuacuugauugagcaagggcagcuuaccagugauugugccacugaggguuaagacuccuccagcaaccauuauuggucugcagagaucuccucagggaaggguagggccccaugaacccugaaugcugaugggcccagucuugucgugcagacagccacugcaacuauuuucaugaggguuuuuuuuuucccccccuuuggacuuaguuuaugucucugugagugucuaccacaugugugcagguaccugaaagggccagaagaggguauucuacccaucuuguggagcuaguucaaagcagcugggaaucucccgugaugcauguuggaaaccaagucagguccuuuggaagagcaguacacacuuuuaacugcugagcuaucucucuaacccucaugaauaccucuuauucuugggcuagccucagugugucauuuuucuaacuagguacuuaauacaugcuuaguuuaccagagugaaaaaauaauuuuauaccuuaaaauauauuuauuauaauucuacacauuuuggauuuugagauaguaauuaaaauaguugaauguugauauugggauggaucuuaagaccucauccuauuucgucuuuauucuguagauaagauaggucuaaagagagagaggacacugcuuaaauuaacguuagugcaaugggaaacaaauggaguaccuugguuuuuagacauucuauugccucaucuaacagcacauguccacaugcagggaugcauuagugggcuucagcuuuccaggguggauccuguugaggacgucugggugcuaguagauguagcacauggaugcuauacuguuccaaguacuacauaacaucagaaacuaugugggcuugacugcuuucauacuuaucugcugagucaagaacaugauaucagaagcaaacuggcuuagcuauguuauaauaccagaggccccacccacacucagacuacuuuugacggagauaggcuuuggccaacuuucccuguuaagcuguuuuuaagaaaaauuuaguaaauauguagauagaacuuagaguuuguuuuucuuuagaauguauggugggcugaggagauggcucaguggggaaagugcuugcuuugugagugugagacucugaguuuggaucccaacacccauguggaaaagcccggugugcagcaguguguaauggcagcucugggcagcugaagaaagggccagguccuagguguacagcaagauggcaaguucuaagcucaggaagacacugucucaaaggacaaggcagcugccacgagcucaggggaagcaccucuuucugugcugauuccuggaccacguguguuaugugcuuguggguugcuuuuuuuuuuuuuuuuaaagauauuuccuuuauaaacauuucaaaugcuaucccgaaaguucccuauacccucccuccacccugcuccccuacccacccacuccugcuucuuggcccuggcauuccccuguacuggggcauauaaaguuugcaauaccaaggggccucuuuucccaaugauggccggcuaggccaucuucugcuacauaugcagcuagagacacgagcuccgggguacugguuaguucauauuguuguuccaccuauaggguugcagacuccuucagcuccuugggugcuuucucuagcuucuccauugggggcccuguguuccaucuuauagaugacugugagcauccacuucuguauuugccaggcacugagucaagaacgagacagcuauaacagggucccuucagcaaagucuuucuggcauaugcaauagugucuggguuugguggcugauuaugggauggauccccaggugggguagucucuggauaguccauccuuucuucuuagcuccaaacuuugucucuguaacuccuuccauggguauuuuguucccuauucuaaggaggaaugaaguauccacacguuggucuuccuucuugauuuucuuguguuuugcaaauuguaucuuggguguucuauguuucugggcuaauauccacuuaccagugagugaauguggguugcuuuuugucauuguuguguuuacuuuauguuuuuucuuuauucuuugaacauuuauccuuacuccugugaaagaaaauaauuguaaucagcuucaauuaagacauaacuuacaaaaaacgauucuaguuuuaggccagccaaggguacauagugagagagugucuggaaacaaaaccaaaaaucaacaaauaccaaagcuguguuuuaugcuuugggugcuaaugcucuuuacaucuucagugucuuuuuacugaaauaaaaauaaggagagcaguugaauccugaaaucaacucuggccuccacacgcuccugcgagguugagugugccuacaccaauguguacccacacaguguaugguagugggagaugccuccguugggagugcuugucucggaagcaugagggcauuaguuuauauccccaggacucgugggaaaagucaggugugagagugggugcuggugggaaggcagauacaggggcuccccgaaguucacugacugguuaucuugcucaaacaguauacuccaggaucagugagagacccugccucaaaaacuaaaguaggauggggguuggagagauggcucagcaguuaagagcacuggcugcucuuccaguggacuugcguuuagugcccaguacccacacggcaucucacaccugucuguaacuccaguuucagggaaucugauauuucugcuauucucuggcaugagacauauacucuuuuaaaaagcuaaauuuagauuuuuaaaaagugacaguaacucuugggauaacguuauaaucuuuguuugcuuuagcuacgcuucuaaggagccuguuguuucucgggaaagcucaaauaacucuugguuuuauuuuuguaggcucagaucaccaugaaaguaauccaaggccuauauaguggggucaccacaguggaacuggacacccuggcugcugagacagccgcgaccuugaccacgaagcacccugacuaugccauccuggcagcaaggauagccgucucuaacuugcacaaagaaacaaagaaaguguucagugguacgucugguauaaaaacaugagaaagcguuuaauagugucauaaaauuauaggaauaacaagugaauuuuaaagauuaugucuuauuuuuaaaagcaauauacaauuuaguggcagcaugggaacuagaacuugcuguuucuccauguagcugagcuacugagugaaagagcauaugcguguaugugaguguguguuguguugaggcagggucuuauguaaccugggcuggcugcagacucaguuuguauccaaagcuggccuugaacccuuuuuuuuuuuaaagauuuauuuauuuaucguauauaacuacacuguagcugucuucagacaccccagaagaaggcaucagaucucauuaggggugguuguaagccaccaugugguugcuggaauuugaacucaggaccuuuggaagaacagucagugcucuuaacugcugagccucuccagcccuggccuugaacucuuaauucucuugacucuauccaaguucuuagauugcuggcagaugucaucguauugucuuuugaguuucuguucuuuuuaaacuuuuuuauuaauuuuaaguuauguguguuuguuuuguguguuuguauguguauggacaaauguguaccacagcaugugugugaaggucaaaggacaacuugugggaggcggucccugggauugaacucaggucaucggguuuggcggcaaauacuuuuucuguuaagccauguugcugaucuaaggucuauuuuuguuuuuuguuuuguuuguuuguuuuuguuuguuuaaagaacuaaaaaggaaaaaaaagaaagacaaaaaaaacuaaguggugagaagucacuaauagucacuugggaauugcugauaagcuauaagaccuaacauucauuuucuuugaaagaauauuuccuuuauauauaauguauuuuucuauuguuaaucaacagagguauguuuguugaguauuugcucugcuaggugcugaaguggguugguacuaagcaaggauugagagcccauuguuuuaaaacagccguuccgugguuuugacuuuauuacucuucucuucccucagaugugauggaggaucucuacaacuacauaaauccgcacaacggcagacacucucccaugguggccagcucaacacucgacauuguuauggccaauaaggauguauguacagcauuucuuugcugguggaaaauuuucaauuuuaaaauuuuuuaaaaauaauacauuuaaggcugggcaaugguggcgaaugccuuuaauuccagcacucaggaggcagaggcagguggguggugcccacagaggccagaagacaguauuggguucagauuucccgggacuauuaaaguugugugugguucugagcuaccauguggguacagggaauugaacccugguccucugaaagagcagccaugcucuucccacccaccccccccaccccccaaaacaggguuucucuguauagcccuggcuguccuggaauucacuuuguagaccaggcuggccucgaacucagaaauccgccugccucugccucccaagugcugggauuaaaggcgugcgccaccuccguccggcugagcaggcgugcucuuaaccacugaaccaucccaccaguccucuuuacaagaccuaaauuuuuaguccuuguggaccugggaccucuggcaguccucugugcuucugccuugugagugcugggauugcaggugugggcaccacaccucacccuggucauaaucuugaagacauguuaaaaacagguaacaguugcaaaaccugagccuaaaaaguaaacacuggaaaaugagcaaauacucauagucuaguacuucaguuuuuugcucauccuuagccuguaccuggacuugacugcauaaaugcccuucaaaguuugacagacagaagcuuuuagauaauauuacggcugauacgaucucaacuaauuauuuuuguuuucuucuaaauggcuuuauaacuuaccaaggcucuuuaauaaugaccaauucuauaguauuuucugccacaauaguaauucauguuagcuaaggaccaugaauuuccaaagccuauaagcuacuuucucuuuguuuauaauacauaugauuuuguucuguuuaaaguaggcuuauugucagaaauuugcaguugaaaauguugauacaugcuuaugauccuagcagucaggacugucugugcaaguucaagaccagccuacuggucuccuuaguccaggcuagucagggauacauagcaaauuucugucucaaaaauaaauaacuguacauauguaccauaaauuagugugugguaccaauauuuuaauauuaacuaguaugaaagcauguuggguauccuauauuaguuuuaguucuggacggagucagcugaaaacauuagaaguugagaaaguaaguuuuauuauuuuaauuaugaauucuuuuucuucagcgccugaauucugccauuaucuaugaccgagauuucucuuauaacuacuuuggcuuuaagguaaauaaauaaagaauggguuucaaauauaugggcauuucuuuuuaaaucaggaaguacagugguuuguuuaugcugaugauuuaguuugaaugcaccuggcuaugguaggguuaugguaguggugauacuuuaagcaaaauuaacguauucauuaaucgcuuuugaacuuuucaaauauuacuuguggauuauuauuaaaauuacauggguaaugugucacugucacuccgaauucuacuguuuucucaauaaccguugauucccuacucugcuaaguguuuaucuaaauauaguguguugcuuacauaaugcagugacuaaggacagggauguuuauaggagacugacuauguccgcucucccauuucuuauucauaagcuauguaauauuaaaguuuuagucuuaggaugggaauaacguucaacauacucuucuggaaauuaauuaugucucaguuagugucuagucucuuacaagcacucagagauguggggacaucuugcugcugcugcugcugcugcugccgcugcugccgcauaccacagcccauaguguuguacauuguugcaugcaagcagggcaggccuuuuccagaaauuggcauguaaucuuugcugaaguagaacagccacaugauaauguucuagacugaagauagaaacaguaaauguuauucuuuucauuuaaaaugauaacauugagagauuucaacuauaaauuacauauccacuguguauuuaaaaacuugagaauucauuggcugcuuugcuccucuagacacuggaacggucauauuuguugaagaucaaugguaaagguaagaaaugaaaauguuuuuauucauuauauuaaauguagagcuuggcacuauuagccuuaacauuccuauuuagacucugaauaacauuuuaaaacauuuauugcacuuguggcuggagagauggcccagguggcucuugcagaggacccagguucaauucucagcauccauguggcacccugugacugucuuuaacagcaguucuaggggauccaaugcccucuuuuuguuguugguuuuuuguuuguuuuuuugagaggguuuuucuguguagcucuggcuguccuggaacucacucuguagaccaggcuggccucaaacucggaaauucaccugccucugccucccaagugcugggauuaaaggcgugcaccaccacaccuggcccaaugcccucuucuugugucugugggcaucagacaugcauaucuaagcaaaacaccauacacauuauagaacguuauuacauuuauuuauuugugugcauggguaugaggagggagggagggagggagggagugugccauaauguacauguggaaguuggaaaccagggauugagcucagguugcuagccuuagcaacaagugcuugugcccacugagccauuuugcaaucauccaaauaaccuuuuguuauuugguuauaaacaaacaugguaagaagagugcaaauaucucuaaauuacaauugaaauaacuguuaugcuuguuuguaaaguuuuuacaaguuucucuugcuguuaauucuuugguucagauguguuucagacuaauuauucugauguguccuauuaucuggaaauuccuucuuuguuuucaguggcugaaagaccacagcauauguugaugaggguuucuguggggauucacaaagaagauauugaugcugcaauugaaaccuacaaccuacuuucugagaagugguucacucaugccucuccuacucucuucaaugcugggaccaaccgcccacagcugucuaggcacguaucaguuauagcugcuuuuuguugcuguugcuuucuuuuuuauuauuuauuuguuuguuuguuuguuuauuuauuuauuuuugguuuuucaagacaggguuucucuguguagcccuggcuguccuggaacucacuuuguagaccaggcuggccuugaacucagaaauccgccugccucugccugccuccugagugcugggaucaaaggcgugcgucaccaugcccggcugcuuucuuuuuuaaaaaauuauuuauguauauuaguguuuugucugcauguauauaugugcaugccuauugcccauggucagaaaagggcauuggaucccuggaacuggaguuagauaguucugaccuaacuaugugggugcuaggaauugaacccaugucuucugaaagacuagcuagugcuuuuaaccaccgagucaacucuacagccccuaaagcugcuuuuauaaaagguuugacuagggaaauaagaaaaagccaggugguucaucacauuaaaaacaaacaaaaacuucaauuauugccugcucugauuaaauaauuuguauuuugggacaaucucugacuuaugggaaauaaguuggaaguaaaugcaguuaaaugagaacguuauacaguuggucgugguauuuguacagcugacugcuuuagaugcugcugaacagaauguuuuugauagggaauugcauauugguuauauuccaagaagauuguuuaaaaaaaaaaagaaggcuauagcucagagguagauuaugugcuuagcaugcacaaggccuuugggucaagacuuuucagcacugugaaagugauuaguacuuggagcuaguuacaaaaugccugcaguaauuuauuaauuuauuuuaaaaaucauaaaaggauuaaggugaaaguagagaggcagauuccuaagacacaugggaaucaaacugauagaguuugugauguucuaaaucugcauuaaguuugguuccugagauuaugggcagaguaacaggacggcuuagcugugcuuagcugagaaagggauccccguuuuacaucuggaguaagggaaaagaacgcccuuagcaagucuguguguuccaggaagucagggauaugccagugucuguauacauaucucauuguacuaacacuuauauaacucauugcuguuuuauaauaaaauucacuagcaaaacugguauaugaaauaaccuccuuaauuugguaaaagauaaccacuaaaaacuuagucugggcuuaaagagaugacucagguuaagagugcucguggcuuuuguagagcaccuacuuuuggucuccagcaccaauaugguggcucacaaccauccauaacucaguuccaagggaucugacgccucugaccaggcaugcaugugguacacauagauacauacaagcaaaacacucauaaaauaaaauaaaacuaaaaaaccaaaaaaaucaaaaaaaaaaacccucaaucauuagaucuguuacugcuuuuaguguggcaguggaggucugagcggguguuguaagauaagauguugaaaugauugaaguguuugaaaaauggaagaauaaagaucacagauaauauuuuuacauaaagaauucagaauuaucuauggacaaauuagaauuaaggagauuuuagcuaaguacuuggauauaaguucaauagaaauaaauuuauguguuccuguauuguagcauuuagaaaauuuaauuuucugcuguucagagccagccaugaugguuaugcuugugaucucucaggggguaaggacagaagaauuaccauuuugggaccagucugcucucuguagcauauugacagccagccugagcuguauaggaagacccugauucuaaacagcaagauuugggccucuagcuuugugguagacucaaggggccuugaguuugauuccuagcacccaacuacucaagaaucuugcgaacauuggaaaugguagugcugagguagaaggauggagaauucaaugccggcuugggcuaauaugcccucauaaacaaauaaauagaggggaggaagaauuuuagcaguuuuuaaaaaagcaaguaaguugaaaauaauuuaaugaccaugaacaagcgcacggacauaugggauaauuaugcaauggaaugcuuuacaaccaugaaaauaaguuaagacuacauauuauuagguauggauugcuauaauauuuuugaauuaaagacaggcuucagaaggguaacuaauuaagaaauuacaauuagggucuuuguggcaucuuauuucuugagauugguguuauauagacauguguauauaaucuuaaugccugaguauuuuauagaaagucagugaauagaaucuauuugaguccuuuaacauucaagaugacaaagagacccugguagacuaaugcuagggaaugugagugugaagagauagauccaaaguuuaaguaggugggacauccuuuuuaaaaagacugcagguuggacugugguggcacgggccuuuaaucccaguacuggaaggcagggagaucucuguguucaaggcuagccuagucuacagauugaguuccaagacagccagggcuacacagagaaacccugucucaagccccaguacccucgaaacccaaacaaauaaacaauaauaacaacaaaaaagaccaagggaaugguauuuuuaauguacaugucaaagaauuugcugacuauaugguauuuguuuucaaaaaaacuucauuuuuuuaaggcugggccugguucuggagauaggugugaucucugaguuugagaccacccugguacguagugaguuucaggauggugcuauguucaggaccuugucucaaaaacaaaaacaaaaaaccaaggaacuucauuuuucuaaaugaauccuggcacauaaguggucugguaaaaaccaggcuugauaguuuaggcuuaccuaucagacuuccuucuggguuuaaugucuaagguaguuaacaguuaauuuaauuuaaaauaauauauugauguuuuauauucaguaaaagguguuucuccucauauauauaaaauaaauaaaucuuuaaaaggggggggaggggcuagagagauggcucagagguugagagcauugacugcucuuccagagguccugaguucaguucccagcaaccacaugguggcuuacaaccaucuguaauggaucugaugcccucuucuggugugucugaagauagcuacauugugcucauauauauauaauaaauaaaucuguuuuaaaaaaaaagguguuuucccaucuucugcaaacacuuaggagcuuuguagacuuuaaaucucuuguugccugauguagacgucuagauaaucuaaucacucuaugucacucacugacuuccuugcuuugguugucuuuuuuuuuucucacuguagcuguuuccucuugaguaugaaagaugacagcauugaaggaauuuaugauacucugaagcagugugccuugauuucuaaguccgcugggggaauugguguugcugugaguuguauucgggccacugguagcuacaucgcugggguaaguguuaaguuguaagacuuuugauaucacuccuaugugugcuccagaggccauacugucguaaugcuggugcuugggaggcuugggcuucugcuaauuaacaccuguuggugugaguaggagggagguauuuugcuucuugcuuccuguguuguauuggagggugaggcugugugagaugaucuauguaguauuuuuuugcucagauuuuaaaauuaugauuuuauuuuuuuugguuuuucaagacaggguuucucuguguagcccuggcuguccuagaacucaaucuguagaccaggcuggccuugaacucagaaaucugcuugccucuuccucccaagugcuaggauuaaaggcgugaaccaccacugcccagcagaauuaugauuuuuuaaaaagcaauaauaauagcuaucuuuuuguuguuguguugaggcagggcuucauuuuguagacugggcuggccuggaacucagggggaucugagccugugucucucaugugcugggauuaaagacauguuaccacugugcccagccagcuaucacuuauugauugcucacuaugugccaagucuguuccauauuuuauaggaauuacucauuuuacuuacuguagccuaggauacagccaucaauccagucgcuugcuagcaacuuuguuccuuacaauaauccaggcaccaguguuuucauuuuucacaugaagaaagugaggcuucagaguuaguuuuuuucugugucugucacuugcuguaugguagagcugggauuccagcucuagacacuggaaagcaaggugaugaaaagugcagggcuuggauuuccauacuguauuuuucccuacuggcaguguggccuggagggaguuacgucagcauuuuuguguguaaugugaaaaaacauaaacccuaauagaaucagguucucaaggaaauuguccuaugauauauuggggcguguaggugugcaaugugucuuuuuuguuuguaauaucuguaauauuuuguguauuuauaucuaucuguccauuuuguuuguuuuucaagacaguauuucuguuuacuaucugucugucugucugucugucuaucaaucaucugaauuuguagagugagccacagcccacuuaucuuuucaaacucuuucaaagauuuaccuugggguuuagaaaauucuuuaaagaauugaaagguauuuuuuagucauaacacuauuugcuuagccuuauucuauaauccauucauugcugagucuccauuuuguuaucuugguauguugacagcauagcauaucauuuucauuauguugccuugaauucuuuggggggaggugcuaucauaguauguuuuguuuucuuuuaugguacccaaaguauaucuugguuuguuugauuuuuuuuuuuuugagacauuuuucuguguagcccuggcuguucuggaacucacucuguaggccaggcuggccuggaacucagaaaucugccugccucugccuccugagugcugcgauuaaaggugugcaccaccacgccuggccggauuuuuuuuuggauguauuauaucucauaaaguagauaaaguaggguuguugagguagcucaacauauaacuuacauaacaauauuuuguuguuucuuauguuggguauuauauuuucauugcugagguggggaguagcucaaacuucauagauggguuccuaggaaauuagucaguguuuugaacagaagauuggaaacaguuuuuauuuuuaugcuauuccuggcuuuuuuuuauuacuugagaccuauaucuuaaucaggugccuuuauuuuuguccuuucuuucagacuaauggcaauucuaauggccuugugccaaugcugagaguauauaacaacacagcucgcuauguggaucaagguggaaacaagguauacuuuguuauggacaagggcuggaaaucagaauuaagucuuuagcuauacuacuugguucaguuauauauuguuuuacuuuguuuuuaaagauuaauuaauuaauuuauuaauaugauuaguauguguauaucuaugugugagcaugugcauguggguguucauggaggccagaagaaggccucuggagcuggaguuauaagugauugugagacacccaccguugguacuagaaacguagcuaggaacuaaguucuagaguucuggaggccagaagaggaugccagaucuggaaguggaguuaugggcuguguugugagugugaauguggugcugggagcagaacugugauccuuucuuuguuaaagcagcaaguggucuuaacugcugagccaucccuccagccccaaauuuucucugucauuuaugaaaaauauuaguaguuuacuuuuuugauacuguuacuuauuucacuuaauuuacucacugaucauaguaaagaugaaaggagacauuaugcaaguguuuugcaaacuaugaagcuucuuuguuuuguuuugacuuggaugagaaugcugacuuauuuaccuuuagcgcccaggcgcguuugcuauuuaccuggagccuuggcacuuagacaucuuugaguuccuugacuugaagaagaacacaggcaaggaagaacagcgagcacgcgaucucuucuuugcacuuuggaucccagaucucuucaugaagcgaguggagacuaaccaggugagagggcuccucucagcuugguucuuacaagcuuuguucuucaguccuucaccucugugaugccacagacggcaaguucucgagagucgaugacacuugaccugugcaagcaggcagaacuacaguuuuagacccccacucugacuuggacagcagauuuccauggcagucccuuguugcagugugugggaagggcuguggcugcuacgugacaucucucaugcuggcacuccuucuuggcaggacuggucauugaugugucccaaugaguguccuggucuggacgaggucuggggagaggaguuugagaaguuauaugaaagguaugagguaacugcuaauguugcaagcaucaucagaccuaacacuucucucgcugggcauccaaauaccagaaguguguacgcuaagggcgaggcgcuugagaacgcugcucgcuuuucauguugcuaggcaccagugaguuugaucccuaccaguggaaaaacagaaaaauauuuaaucacuagcucauuucuagaaaucuuugaaaguaucuagaagaagaguguaauuuuuuuuaaagauuuauuuauuuuauguauaugagcacacuagcuguacagauggcugugagccaucaugugguuggugguugcugggaauugaaucccagcucucucuccggcugguccuacucacuccagucaaccccgcucucucuggcccaaguguguguaaauagacuguagcugucuucagacacaucaggagaaggcaucagaucucauuauggaugguugugagccaccaugugguugcugggauuugaacucaggaccuucgggagagcaaucagugcucuuaaccguugagccaucucuccagcccgaguguaauuguuaguuugauuuuuguuagauguuucuugauuuuuuuuuuuuuuuugguaccaaaauuaguauuuaucuucuuaaaauuuauguacuuugcauuuuuaauugauccuuauuaaaacugugauuaaagaguagcuaaguuauuuuauaauauaguacuuuuuauuauuauuuuuuaaauuacauuuaauuauuuugggcuuggggacaugagugccacagugcauauauggaggucaggggacaacuugcaggaguugguucuuuccuuccaccguaugggucccagagaucaaacucagguuaucagguguggcagcugucccccuggcucccgaguaggacuuuggugauaggaaucacaguaacuaggacacacaaguuaaaauuagcacagcacugaauuauguuuuguuuuguuuuuauuuuuuugaagguuaaugauaguuucauuagcguuugagaaaaacaagagggcaggcaagcuauaaauauuaucaacugcaaggagggaucuaaaagaggaagagagaaagccaugccccuuuagguuagggucugagaaaguaggcagcuuuagcagugguguucagugugcagcugcauguaggaggagaagcgacuucagagaaagaaagccagagcaacagggaaagcaaaacagaacaaaaagcaaaaguagaugcaggcugcguggcagaggcucuguaagcagcugccagucuugauggugguuuuuguuccuuuugguugugaaaaguaguauugacugggugggguuaagggucaucugaaggacucuaaagcugccugguuuucuguggucuuagcggauagaaaauagauuucaggguuggagaaaugguucaguaguuaagaguuuuugcacagucuugaggcccugauuuagaugucagauaacuagaugacaagccagguguccuggaaauaccaguaacucagcucuggcuuccgugugcccaggcaugugcccaggcaugugcccucacaacacucaugcacauauacuuaaacagacacacaaauaaauagaaccaaccuuuuuuuaaaaaaaaaaaaagucauucauuuuuuucccucauuagcaaagcuuugagaauuugccuaauuuuauauuuuucuguauucuuccuagggugugaauguugagauaauacuagcuuugucuuucaguuacgagaagcagggucguguccgaaaaguuguaaaagcucagcagcuuugguaugccaucauugagucccagacggagaccgguaccccauacaugcucuacaaagauuccuguaaccggaagagcaaccagcagaaccugggaaccaucaaaugcagcaaccuguguacagaaauaguagaguacaccaguaaagaugagguaggcggagagacugacugccuagcacaccgagggacuggagaggugguugcugcuugucgcucccucacugaacccagugguuauuugaagugguugaaggagauuuuguuccccaggacugaaaagaaauuuugugguggaguuauguuaacuaagcugcauuuuaaaaacaauaauuuaaguacccgggagcaaggagaacggaaugcaccagggaguacaguuaagagcugggcagugguggcacacaccucuaaucccagaacagaguuaggcagauagaucucugaguuugaggccagccuggucuauaaagugaguuccaggacagccagggcugcacugagaaacccugucucgaaaaaccaaaagaccaaaaccaaaaccaaaaaccuauuucaguauucugaauagugcaacucaugugacugauagcaagaggaguagaauccaugggguauagaaauuugcugauaaaugaugggaaaccaugauuuuaggggguggggauuuugcugaguuauaaagagguucccaguaaagacuaauacauuccuugaguuugguccucugcaccaguguuggggugauuguaaguuuucacaucugauuguuccaaaggcucuagugaucucacugauacaggaagaagaagucaggagugugugugauucugacaccuuucucuggauugcagguugcaguuuguaacuuggcuucucuggcucugaauauguaugucacaccggaacauacguaugacuuugagaaacuggcagaagucacuaaagucauuguccgaaaucugaauaaaauaauugauauaaacuacuacccuauuccagagguauggauagauuucucugcuuuauugaucauuauugaauccagauggaggacauuugucuuagucuggcuguccccagaguuggugugagagaaggaaaaugaaaagguuguguguaaguguagaauguggccuucugaguucagugauguuuucuuuucuuuuuuuccuaaaccuuuuggcacaaaggcacacuuaucaaauaaacgccaucggcccauuggaauugggguacaagguuuagcagaugcuuucauccugaugagauaccccuuugagagcccagaagcccaguuauuaaauaagcagaucuuugaaaccauuuacuauggagcccuggaagccagcugugaacuagccaaggaguauggccccuaugaaacguaugagggaucuccagucagcaaggguguaaguagauggcugauuuucuguugccugugaguauggggaaugagcugaauggccccuccuccaugggaccugggagggugugcuggguugugagagggucuguacagauuuaguuaaggaccuugagauggcauuguuuuggauuauuaaggccuagauuuauucaagugcgcccuaaauccagcaaucccuguucugcaagagaccgggaguuaugauauucccaaaaccuguucguucacacuaguagacuaggagauagauuaauuauccauggucugggacaccagggacuggaaucuggggaggccucuuagaguugauuuccuugcugccuuugucucuucuuuauaaagauuuaguuuugaaguuuguucugauacuuaggaauucuaauaugugauuauuugaaauuugguauucuaggccaaauaaacagaugaaggaagcaaagagcagagugugcuuuauuauaaaaggaauguaucucuuaaaauguuuaaugacuguuaagauuuccuaguuugucgauccucaggaguguggugaggucccaggcugcuucugagcaauaugcuuaauggagccaugucuaagacucagugcagcuaacgucccuuaauguguugacuacaagaugcaguggcuggaauguggggauauggcaguuaguuauuuuaaaaaaauuuuuuuggucauuguuuuaaauugccccaaaguaacaucauaacugugggguauuuaucucuuagauucuucaguaugacauguggaauguugcuccuacagaccugugggacuggaagccucucaaggagaagauugcaaaguaaggagugagguguaaaggacccuggaggccggaggccgggcucuucuggcucuucaggaguuggauaugcuagugugaccucugaaacuuauaaauuaucuucugaaauggggcuaaagugaccuaccacagaaauggcuuuggaaaguauaagaaaauaguuacaugaaaguuguuuggcauagugaaagccuuucaacacacaguaggcauuucagugggaguugauguuauuugaggagcugaacaaccaugcuagucaauuuuuuguuuuauuuugguuuuggguuuuuuuuuagauaagugucuuacuauguagcuccgaaugcccuggaacucauguagaucaggcuggccucaaacuuggagauccuccugcuucagcuucuugagcacugggacuaaaggcaugugccaucacuaccugacccaaauaggucuucguuuuaaaaauguuuuuauucuuuaauuaauugauuuaauuuuauuuuguguguguguauguauguauguauguauauauacacacacauacauacacgcacacauguaguuuuucauguaaaugugauugaauaugacauauucugagacuuuuugguguuugguuuagagaucuuucaguguaguguaauuacaauuacugaugauuccguaauugggauugagcaaguaugacaugaaaguguuuuccuaucuauaaccaugauugagauuuacaguugaggaaguagagacgugagauaacugauaucuuacaucuagagagugacugagcuuugaaccuaguuguacaaacccgcucaggacccgaggcucaacuuaugguccguaagcgugggauguuggaaagauaugcugucuguuagaggaacuuaacuaauacaagcagggcagucugugguagucacuggagaggcuugaugaacaguguuuguuuucacauuuguguucauucccaccugcucaggaaagugcuauaguguuggucucuacacacauuucuacuauuuauauauuguauguaugugugcguauauacuggugcacauguggaggucagagaacagcuugaaggaguugguugucuccuaccaugcugaacaauauauaccuuauauauugaccccagguuaucaggcuuggugacagauaccuuuacccacugagccaucuuguagaccguggaguugguagcucuuagacuaagcuguggagaguucuaagaguguucaauauucuuguuuaaacacucuuggcacuuaaaagugaaaaaaauuaauuuuuuuuuuuuuuuuuugguuuuucgagacaggguuucucugugaaguccuggcuguccuggaacucacuuuguagaccaggcuggccuugaacucagaaauccgccugccucuuccuccugagugcugggauuaaaggugugcgcuaccacgcccggcuaaaaauuaacuuuuuaaaaacuaguaagucuggauuuucucugaguguaaugugcccuuuacacaggauaaugaggauuguagucauacaugacuaauccugaccauuuucacagcauuguuuuacgaaggggcuggcagucauagaggcacacagagaagaugagugggguugaauggaugugccuugauucagaugagcugcugaggacugaguucaguuuuuccugggcaaaacagugcauugaguguucuaugugacuccuaagugccacagagcaaguggcaacaguggggacuuuaagacuugcucacaguuacaguugugcugguucuguuggugcuguggcauccgugccguggacuguauccugcuggaguuuaacgaagucaguaugugaguuaaaugccucugggauguucuccuagcaucugucuacacuaagugaugcagaguaguugcccucuggguagaguagcacgaaucucuaaucucucucucucucuuuuuuuaaagguaugguauaaggaacaguuuacuuauugccccaaugccuacugcuucaacugcccagauucuggggaauaaugaguccauugagccuuauaccaguaacaucuacacucgaagagucuugucaggggaauuucaggugagaauuuuacagauuuauagaagcucuucugaaaacuaauaguaaaaacuuacucauacuuugcuuaaacaacuaacauuaggaaagucacccuuuuguuuguuuaaaacagucucagguagaccugucugaccuucagcuuacccuguagcugaggauagccuugcacagaucauucuuucuccagugcucaggugcugggauuacaggugugcaccaccaugccuggccuagucagagucaacauguggcuaaaauuggggcagggugguuaagauagggcuucuuuguguagcagcccuggcuguccuggaacucacuuuguagaccaggcuggccuugcacucacagaaauccaccugcuuuugccuccugaaugcugagacugaugguaugugcugcuaaccacccagcuuuuuggcuuuuuuagaaaagccucacuaugaagaucaggcuggccuccaauuugccuacuaagugauccuccugccucugccuucucuguacuugguauguuucaccacuggcugcaugacguuuuguauuugcuaccucacaugcuucaguugggauuguaaagguguccauagaagugucacacaggcaugguggucuguauuuauaguuccagcacuuggaaaacugaagcaggaggcguucuaguuuuaggcuagccuaggcuacauagcaucccuucucccccuauuucuuuuuuuuuuuuuuuuuuuaaagauuuauuuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcccccccuauuucuuuuuaaaaaaacaaaacaaaacacaacauuaaggaguaguucucaggugaagagugguggcuaugcccauaauucuugaacuugggaaguggaggcgagaggaucagaagguggagcucagccuuggcucugggcaguuuacaguagcuugagcuauaaaaugguuaccaaugagaauuuaugugcugcaagucagaaauuacuaauuaaaacaaacaaacaaacaaacaaacauguggauuuccagguguccugaaauaaguuuugugagguauagggaaguugcauuucuagugauuuuacucaaguacuauuguucagucacuuuagaaaaccaaagaagaaucagucucuauaaacuuacucagcuuagacacugccguuucuuuucuuugcaaaugucauauucuuucuuuagcuuuuuaaaacuuuuuuuggguguggggugaggacagcauguucaugccauggacagaggacaacuccugggaguucuguccuucuaccaugugaguuccagggaggaaacacauaaccuugaauggcugaacuaaagguuuauuuuauugugugugucagcgggagugugcaugugugugugcaggugccuugcaguaagaacaggugcuauuccugcagaagacccaaguuugguucucaucucccacacugaaggcucaggggaguugauuugucuggauaugcacauacauacagucaaaaccuuaaaagauagauaaucugauggauauguaugugaugcauagauauguacauuguagagugauuaucacuauacacuguuucuuucauaauagaugucaagaccuuaagggucuuguagcuuuguguggugaaauguccuccucaguuguguaaaaauagugggguuuauuaggggaucuaauaaguuauucaucugucuuacuuauuuuaggcuucaggccugggacccuuuuguagguuguacugauguuauuuuauuucuugacauguuuucugcuuuuuucaucagauugugaauccucacuuacugaaagaucuuacugagcggggcuuguggaaugaagagaugaaaaaucagauuauugcaugcaauggcuccauucagguacagacuggaaauaacaugugcuucuaggagcugagcugagcauuguggugccaugucccuucucccagccaggcagugcguaggaaaauggccuuucacuguggccgugcagguucuauuaaugucucucugcauuguugugcuagaauugcacacaucuuuauauggucuguauuguuucuccgauagagcacaguucccaguuuuucuguacaaccugggaacuuuuaaaaccuugaagcuuggguugaauuuauugcuaaguaagucaggaauucuuaaagcuugaaauuggaguucaacuaaaaaaguguggggacugagacccacaguguagaagguaguuagguagcacuuaacaauaaagugacugcauuugacccacaggcauuugggucucaagauagacaccuuagccgggcagugguggugcacaccuuuaaucccagcacuugggaggcagaggcaggcggauuucugaguucuggucuacaaagugaguuccaggacagccagggcuacacagagaaacccugucuuggaaaaagaaaaaaaaaagaugcuuuggccagcuuggcaacuuagccucuuucagauucucauggcagaaaguguagcaucagucagguuguguguuucaauacaguuggccauagaacaauuuaaaggaguuuaucucaguacuucguuugaucaggucccuguaaaguccugauuauuuguuuuucuuucauuuagcuucgcucuuauuuuccuuuccuuuccuaacuaccucuagaacaguaacuguuuuguccauaagccaguucaagauggaugucuaagucacugcaucacauuuauauuugguugguaaaaugagauuuuauugauguucuaagcaagagauaaguaguuugggcuaacuugcuauaagcauucagauacuaacucauagcgguaucaggucugcaggaagauccaacccagcauccuugcaaggauaauuagucugcuaguuauauugcuuucuuuaacuggaauuaaagcaacaacaacagcacauaguuuuccuuuuucagagcauaccagaaauuccugaugaccugaagcaacucuauaagaccgugugggaaaucucucagaagacuguucucaagauggcagccgagagaggugcuuucaucgaucagagccagucuuuaaacauccauauugcugagcccaacuacggcaaacucacuaguaugcacuucuacgguuggaagcagguugguugagcacucugaggaggacuuaauugccagcucgaaauauuucagaguggaauaguugcugcuagcugccugcuauaaaguuuuuucacuucaaguguuaaaacucaugagugguuuuuaugccagcucagacuuugucuggguuuucuuguuucaguucagcaguuguacacugccuggugugggugcuggggauugagcacucagguccucuagaaggcuaggacgguucuuaauuacugagccaucauccagucuugguuuagaauuuuuacucucucagauuucauacaguguguuuugaucacaaucacccuuaaugacucccagaccccuuaccucucaacuccuacaucugucugucugucugucaguuuuuacuguccauauacuucugguuaugggaccauccccuggaaggaacuuucucuuccuaagaaacccuucuuacccccucaggguguggcucaugaacuccaugcuagaacagugacucgcuugcagccagagacaccuucacucuaaaugucagggucucuggcucucacagucuuccugccccuauguacuguuucauaagucuuucuuccucuucaacugaccucucggguccaaaccccuuugccauuuccaaaguagcuucacacugucaguccacuauucaaaacguccauuguucccaacuuuaucccaguguaugagccacguuacacuguugccaacugcaaagugcugugauucuguuuucccuuacauucuuauguccugacgagugugaggccuucuguggaauuacagagugacuuucuuacuugcaugcuuuugucugucuguccugggaaucguggccaagaagauuacccucgugaaggauuuagugcgcugcagaagcagccucauccccuaaaugguuacaggcuaaggcaggcgugugcucuguacagaccugcaagcaguacacguaaaaguaaauacaaagaaacaaaaagauuugcuauuccaaagaggcaacauuccuauuucagggaugaaaaacucaagcauuuuucagggugcuuuguagaggagauaaaauuacaaguuuuuuuaaaaagauugguucauaggaauacauuuaaagauuuuaauaacuaguuuuguaacugaucacuugggaauuuuaaacaaagacugucuaguguucuggaguucuuccuaauagcuacguuuucuucccuugcaggguuuaaagacuggaauguauuacuuaaggacgaggccugccgcuaauccaauccaguucacucugaacaaggaaaaacugaaagauaaggaaaaggcacugaaggaggaggaggagaaggagaggaacacagcagccauggugugcucuuuggagaacagagaggagugccugauguguggauccugagaaaaucagggccugggagacgcagcgggcucuccugcccgccgaggcagacgauuugagcauagauaggauaguggguuugcuugguuaucagcagcucugcuuggacgugccugccaggacagggagccacgacuuacaguacuguuucuacacaguguaaauaucauuuuuaacaaacagaaaaccaaagccagcuuugauauuaggaaucaaaguagaggcuuugggaauacuaaagagccuuccugcaaauuagugaggagacuuaggaagucucgucucuccagcuuucccugccuggccauucucaguuugggcaaagagauuuaguuugauuugacugauugccuagaaguaaaaucaagcaauuacucaucagcuaaagaccuuugucuagacaaacuucuauaggucauuuugaaauaaacauuucuaagugauugugugguacuaaacuugucaucuauuaucauacaagacaguuuaggggaaaaaacccaaaaacccaacauuuucuguugaguucagagagacaaacuuuaaagacauuuagauuguauagauaucuaguguuaacauaugcccuuuccugccccaggaugaaaucuuguuaacauaaaauugacaguuucuuucauuuauaauuugauucuguggcauuuaguucauucacacuguuguauaaacugucauccacaccauuuccaaaacauuccaucauuccaaauagagacucuacucauaaccacacuucuuacaccuuuuugaauauguauuccucauacacauaaugcaguauuugcacuuguauggcuugcaugauaucuagauacaucacagugugauacgcugucccuccauaugugcacaccaucuuguauccauccugucaucuguucaugaaacuugguuguuuccucccuuuagauagggagaauaauggcugccaugaacauuggucuacaaauaucuauuggauuccugcuuuuagguuuggugguucuauacagcaaagaauugcuggacuauauaauucuguuugacuuugaggagcuauauuugcagcaccauuauauuucuauaaaaguacuaaaaggccuuauucugucuucauaccuuauaacacucgauuuucauauuuuugauaaagcccuucuaugaguggggaauuuccuggucuuguagauugacuuguuucguuaaacccgaguuuuggggcauuuucucccuuuagucaucacauccuuuuuuucccuuaugaaacucauaauaaaucugcuuuacguaaugguggcuaugaacggccuuuuggcuuguccccuuccaucuucugcucccuagacucgguaauugauuuuucaacccuugaguuuguugauucuugcacaggccugcuguuuaguaccucuagugaauauuucaguucaguuuuuagcuccuaaauuugauguuuuaaaaaaucauuuuuauc

SEQ ID NO: 3973 - RNA, 1009 nt, Mus musculus
aaugggugaggauggaaauaccaguaucuucaaccuuuccuacagcagcuuccucuuggugggcuucccuggauugcaggaagggcgaccccuucugguccugccucuuaccuuucucuauguguccaucguuucugccaaugccuuagucauucauacagugguggcccagaggagucugcaccagcccauguacgugcucauugcucugcucuuggcugucaacaucugugccuccacagccgugaggccuaaaaugcuugaaggcuuugugcauuaugcaaaucccaucucacuccgcggcugccucacacaaauguucuuuaucuacuuuacgcuccuucuggacuacaaucuccugcuggccauggcucuagaucgcuauguggccauuugccacccacuccgcuauacugaccugaugaccucacacuuacugggccugauggccacuuuugcgauaacgcggagccuaggaguggcagugccccuagugguacuaacugcaaaagcucaauucugcaagacauccgucauaagacacuucaccugcgaguacaucgcacuguugagcaucgcuuguggagaccugaccuucaacaaccgcuugggauuggcuaugcguuuggucacugugacuuuugaucuggccuuauugggaaccuccuauacccguaucaucuaugcagccuuccggaucucuucuggaggagcccgagccaaggccuugcacacuuguggcucccacuuacuggucauccucaccaucuaccuuucuggucuuuccacuuccauugucuuucgaguggccaagacugugucucaagauguccagaaccuacucagugccauauaccugcugcucccaggagccuugaauccucucauuuauggggugagaacuaaggagauccggcaacacauagagaaaaugcucuguggaaugcagucaccccaagacagcagagagaagucacagaaugugagaggggagagggacuugccaggg

SEQ ID NO: 3974 - RNA, 4202 nt, Mus musculus
ggggacugacuugaccagucuuuacuuccccugccugugugaguccugguaaguaggagccuaugugcuuagccaagcaggggugugggggaggcugucagagaggagaggaacgagggcagcagccaacuccuucuggcccaguucaucuggcccagugcuucaccacuuccaacccagggggauucacugcauucacauucgcagucucuaacacugguuuucagagccuuugagguuggcuacgucuucuaagucaucuucugagaggaacccaaagccauauuguagcaggcugaaucugacuuauuccucucuucuugcacagagguagacaaauucuaggccuuucuagcaggugugccucucagaugucucacucaucaaacccccucucuaucacaaccacccucccuuccacauguagacacaacuacauucacccugcaguucagucagugugccugaagacagcagggcaggguuucuguccucacagacaacauagccagugccaggaagaaccccauuuuguauaagaaagggaucuaagacuggacaucccuuuucuugacauauggggacugagacugcaugaucggucuacaacucuggaguagaguaugugucuaugcacaccaaccaaggcaguggcccuuccucuguccccaaacucucucuucguguccaggacuugcggguaggcuuugagcucacuucuuucacuuacuagaagggagcacggagaaagaagcaccaagccugguguggcgguucaugccuguguuaucacagcacuuggaagguagaagagggaggacggguucaaggucauccuccgcuacacugugaguuucaggccagccuggaagacaugagauccugucuuuaaaagagagagagaaacagggagagagaggaggaggaggaggaaaagaagggagaagaggaggagggagaagagaaagaggaaaaaaguugcucacaucagccucauauauuucaccauccuaaaaagccaacauuguaacuccccccucacagcuaggauugcugaaaucccuugaccaccagagucacacaagugggugacaggaccaagguuccccaugacauauccccaccgugcuguccccauaagcucagcacacuccagcuuugggucauccucuucccagccuggccuuccuccagucugaugcucuuucuucuuugcagugucagcuaugcuuuuugcugccuccugcgaggugagggaacccacacccaguacccuguccugucaggaccacauuuagaccaacacaaacuccuaucccuaaagccuccucuaaaagguugugccuggugugguggcauacaccuuuaaucacuuaggaggcagaggcagauguaucucugaguuugaggccagcauggucuacagagcaaguuccacgacagcccgggcuacauggagacacccugccucaaaacaaacaaacaaacaaacaaacaaacaaacaaaaacacuagguuuuauagauuaaaugggcucugugugguuccugggagcacacccaggaacaagggaggaauauucagagagaugaugguagcuccauagaaaguccuuccuaaggaugggcucugccccaaacuuggacagacuugugguaagacggguuguuuuacaagcagauagacaccccaaaauaaaaugggcuucaaaacaaaauaaagccuuaccuacauaagccauuguucuuuccaacaucagugagcugugcucugaccaaggcacccggcagagaaucacaucccugcuggagggccugacucuuccuccuaagugucugcccucugcugcugcccacagaucccugagcuccacaggucucugauaccaaaagguccugugauuccaggggagcccagagaaaaacaagaaugacugcacagcccccaccccugucccuuucucacuaccacuaaaugacuugaaauaugaaguguccugauaagcuguccuuaucacuccaugcacuuuucugagaaccuaagccccgagucauagccucagccugagccucaggcccaggguccccacuccacacccuccucugcucagacucuggggucaaccuaggauagaucugcaaccuaggaggucugcauuucuaaggagauggcuguacacucaggguugaagauaauggagcaccauaugaugguaggggugggaggaagaaagaggcaggggaaggaagaaccaagggaaaagaguugaauggcuccaucagauggggccaucaugaaagagagaaacugccucucaccccauuucuagacuuuuuuuuuuuuaauguaagaaguacccuguagcuuccugcugugguaaauuaucucccguugggaugugggagacaugucaacucuuaccaaaagcacucgcucucucucucucucccucucucucccucucucucccucccucucucucugauucccaaccuaaugccuuuccaugucuucagugggcacagcaccaggagccacacaaauguccagccaccuccucuauaacuccugcauagcaagacuacucaagcguggguucucccccaccuuggguuuugucacaucagcggaagucagaauggaaugggauucaugucagcacccauguguucauugcauucucucccuugccacuuugaucucauucaauacagucugaauuccuucaagacaagagauaauguauuacucaccagguguuccaaaucccugguauagaaacuagcacaaaguaggucuucaauaagaauucauuaaugaagccgaguggugguacacgccuuugaucccagcacucgggaggcagacacaggcagauuucugaguuugaggccagccaggucuacaaagugaguucgaggccagccagggcuacacagacaaacccugucucgaaaaaccaaaaaaaaaaaaaagaauucauuaaugaaaaagaagggggaaaauggagggccauggaaaguagcuacuucuaacauacaacucuucauuuccuccauagaaaugcuguaguuaaugucuacacccaguccagccuggugaggcuggggcagguccuagcagggccuuucagggacugaaccccggcauccugccccuccccucucccuggagccuccccaagcccucaggcgucaugucaggguggagcaauggcaccuacaaugaguccuacaccagcuuccuccucaugggcuucccagggaugcaggaagccagagcccuccuggugcugcccuuccucagccucuaccuggugauccucuucaccaaugcccuggucauccacacgguggcaucccagcgcagccugcaccagcccauguaccugcucauugcccugcuccuggcugucaauaucugcgcugccaccaccguggugccccccaugcucuucagcuucuccacacgcuucaaccgcaucucccucccucgaugcuugggacagauguucugcaucuacuuccuuauugucuuugacugcaacauccuccuggucauggcucuagaucgcuauguggcuaucugcuacccucuccgcuacccagaaauagugacaggacaguuacuggcuggucugguggugcuggcagucaccaggagcacaugcauuguugcuccagugguggugcuggccucgcggguucgcuucugucgcucagaugugauccgccacuuugccugugagcacauggcccugaugaagcuuuccuguggggacaucucgcugaauaagacggugggacucacuguucgcaucuucaaccgaguccuggauaugcuccuguuaggugccuccuacucccgcaucauccaugcugccuucaggaucucaucagguggagcacgguccaaagcccugaacaccuguggcucccaccugcuggucaucuucacugucuacuccuccaccauguccucauccauugucuaccguguggcgcgcacugccucccaagaugugcacaacuugcucagugcuuucuaucuguugcucccgugucuggucaaccccaucaucuacggggccagaaccaaggaaaucaggcagcaccugguagcucuguuccaaaggacucagcaacaggucuucacugagaagccccagucccugcccucgaauagagagcuuccuggaugau

SEQ ID NO: 3975 - RNA, 1452 nt, Mus musculus
auuuuaacauuuauuuuuauuuaugugcauauuuguuuauucaugugugugccauguacacaggugcccuagguggucagcuggaguuauggcagcugcgagagaguugacaugggugcugggaacagaaaacaagaccccuggaggaggggcaagugauccuaacugcugagcuauuucuccagccuccaguuaaaauucuuaauaauguaucuguauuauuuaauaagcuguguauuuuugagccauggcaccuucagagaccaugcaguagcaaguagaggccucuucuauccccuccaccuacuuacuagcaacaauauugaucuuuucagugcuaaggaucaaauccagggccccgagggguguucugccacuauagacccagacacuuuuaauaacaauaauuuauuauugcuugguuugauacagggccuuaauauguagauuuggcugaccuaggaccugccagacagaccaggcuggcacaaauucaugccuguccuccugucuuuaccucucaagugcugggaugauaguucugugucaccauuuccaaccucaauaauauuaauuuuucucaagaauaauuucacaacaaaauugcccuauggauuuucuaagucagggauuuucuauaugacacuaauugaaaucgacuggauaguuaaacaggcgguuuuagacuuaguccuauugagaaucagagugagccauggccugggacaacaguaaauuaccuuggaauagucugugaauagccugacauuugauucuuuuuugagcauggagaacacuuuuuguuaguuuacuuacucaguaauagacucuuuugaaaagcuggcacccagaugucaagaugcauucuuaauuuuuuuuuuaaagguucauuuuguuuuucuaagacuccacguuuaaaacaccaucuguaaaccugcauugcaugaaggucuuuuugggugagagcucucagaaggaauagacacggaugucuucacuacaucucaguagcuuuaccacgauuugcuguguaacuguggacacacugaugcucuuccugagcacagacgguauccgguauuccuaugauggggagaacagugcugaaggggcuguagguacacgcccccucucccucaccucugcuguagguacacgcccccucucccucaccucuauucuaggugacuggaaguuugugggaaggagcaacgagagggauaauggaaugccugugaucugaaggugggcgggccaaaugagaaaggaaagccgcaaugauggugggacauauggggcacaagguagacagugggugaaggggacaaauuagaacacgaugccauggacacaaguguaaugaaaaugccguggugaaaccuauuguuuuguaugcuaaauuaguuaaaaacaaaacaaaacaacaaaaaacaauaaaccuaguaagcauga

SEQ ID NO: 3976 - RNA, 1040 nt, Mus musculus
uuccccucccccagauucauagugguccacugaggucauauauuucuggauccuuccgucuuaggaaauaucaacccucuucugcuggaaacgccuuaagaagcccugacggaucugcuucgacuugauacaguagaccacaggguucaugaaggguggcaccaagaagugcagguuagccaugagcacggccagagcuggguagcuguguuucuccacucggugcagcacggacagccccaacuugggcaaauaaaagaugagaacgaugcagaggugugagacacacguauugagugccuuaagccuuuccccgggugaugcaaugcccagcacaguccguaggaucagagcauaggacagcaugaugagggaggagucuaggccuagugagaggaggauggaaaccaggccaaccaggcuguugaugcgggugucugagcaagccagucccacgaggucgcagugcagacaguagcagugggagaggguacugaucugaggaaagaucagacgccgcagaaggauggguccgggaagguugagcaggauggcccucaccagaacagcagccccaacuuuggccacugcugagugaggcaggaugguggcauaaugcagaggaucccggauggcaaugaagcgaucaaaggccauggccaauagcacaccagauuccacauaggugaaggcguggaugaaaaacaucugugcugcacagaaaucgaagggcagcucccgaguacccagccagaagagccgcaccaugguggggaagguggaggcacagaggcccagaucagaggcugcuagcauggacaggaagaugaacaugggcucauguaaggcuggauccguacggaucaggaaaaggauaacgcuguugcccaggauggaaaccacacagaugagguugaugggaauggaaacccagugaugggaggccuccaggccuggaaagccagugaggaggaagguggagugaccaggagugcugguauugcagaacauaaugacuccaggagaaaacuguccacccu

SEQ ID NO: 3977 - RNA, 1059 nt, Mus musculus
caugauguggucagauccuuauccugucauuugugguaugauugaggacacccaauuggguguccucaccugccaucuugugaaaacauacggauaacccuugaacggaucuccuuggucuuugcuccauacacaaugggauugacuacaggugguagcaggagauagauauuagccauaaccacauggaccaaagaugugggaccacccagccuauguaccacugauagcccaaugagggguacauagaagaccaggacagcacagaggugggagaugcagguguugaaagccuugagugcugccccucgaguugaaagcuccaacacagcccucaggaugaggauauaggaaaagccaaugaagagggaguccacacccaugacugauaggaugaugaagagcccauaaacgacauuaacuuugguaucaguacaggacagcuucauaaugucuugauggagacagaaggagugugugacaguauguguuuggcaauaugacagacgcuucaaaaggaaaggcaguggaaagaagaauacaaauccccuggcuagggaagcuaggccaaucuuggcgacaguagucccugugagcacagaagcauggcguaacggguagcagauggccacaaagcggucaaaagccauggccagcaggacagcagacuccauggcagauagggcaugaauaaggaacauuugggucaagcaaauguugaacucgaucuccugaaugccaguuaggaacaagcuggccauuuugggcaugguaacagaagagaggaccaagucaaugguagaaagcauggcgaggaagagguacaugggcucaugcaagcgccucuccacacgaaugaugaagaugauggccagguugcccaguguggccacugcauacauaaagcauaaggggaaagccagccaaaaguggauuuuagauccuaggccagggaugccuaccaguagaaaauaggcuggaugggccaaacuuccauuugggguggcgaugagagggaccaagggcuguggcaugccagauacagagacugggaaagaa

SEQ ID NO: 3978 - RNA, 1073 nt, Mus musculus
acagacucuuucaagcuucaguguuaaaucacacaagugaauaauaaaacagaaauuuaaggaagaaucucuuuuaaaaagaacuuuaaaacuucccuaagauggcuuaacaaaaaauacuuucagcauggccuugcgaauuuguuugguuuucacacuauagauuaugggauucauuaccggaggaaugagcagauaaacauuggcaauuagagugugcacaaagggaggggcauguuucccaaaucugugcaccaaugacaggcugaucauaggaauguagaagauggcaacagcacugaggugggagacacagguaccaaacgccuuuuuccgcuccuccuuggaugcaaugcaaaggacagaauggaugauuagaacauaggagagaaggaucaagacagaguccaagccugcaguagagaugacaauggccaagccaaaggcacuauugauccugguaucugaacaugaaagcuucaucacaucaggauggaagcaguaggaaugaugcagcacaugacuccggcaaaaagacagacgcuugaggagcaggaguaaaggaacaagagcggugguuccccuaauuaugauugcaaaacccacugcaaugauucgagaauugguuaagaucauagcauaccucaguggguuacagauggcaauaaaucgaucaaaggccaucaccaggaggacugaagauuccaugaauguaaagccauggauaaagaacauuuggccaaugcaugcaucgaagcuaauuucucgaacauuaaaccagaagaugcccaacacaguuaccaauguugaaaggcauagaccuaggucugugaaggacagcauggacaggaaauaguacauggguucauggaggcuugacucagugaugaugacaaagaggaucaugcuguucccagagauggcaauggcauacagacaacagaaagggauggagauccaggugugagaggucucaagaccaggaaugccagugaggaagaagacugguggguaggcagugcucucguugaaggauggcauggugacugaaggaagcagaugucucuggggaa

SEQ ID NO: 3979 - RNA, 959 nt, Mus musculus
aaugcuugugaagucuucuaucauguccguucucaauucuucagaaauugagaucaccaccuucuuccugauuggaaucccaggccuggaguaugcucaugcguggaucuccauucccaucugccucauguaccugguggccauccugggcaacugcaccauccuuuuugugaucaggacugaacccucacuccaugcucccauguacuauuuccuuuccauguuggccaucucugacuugggccugucccuuuccucccuccccaccaugcuccggaucuuuguguucaaugccacaggaaucuccccaaaugccugcuuugcucaagaauucuuuauccauggcuucacugacauggaguccucagugcuucugauuaugucuuuugaccgcuucuuggccauacgcaacccccucagauacagcucuauccucaccagugcaagagucgccaaaaugggacugguguuucucauuaaaagcaugcuccuagugcucccauuuccuuucacucugaaaagacuggcauauugucagaaaagccuccuuucucacuccuauugucuccaucaggaugucaugaagcuggccugcucugacaacacagucaacuuuuucuaugguuuuuuuguugcacucuguaugaugucagacaguauguucauugcugucucuuacauauucauccugaagaccgugaugggcauuggaucccauaaagagcgccucaaggcccucaauaccugugucucccacaucugugcugugcucaucuucuauguaccuaucauugcuuuagcauccaugcaccgcuuuggcaagcacaagucaccuauggccaugauccuuauugcugacaucuucuugcuagugccaccuuugaugaaucccauuguguacuguguaaagacacggcaaauucgugaaaagguucuaggaaaauuaggucuaaaauaaa

SEQ ID NO: 3980 - RNA, 941 nt, Mus musculus
cuuaucucacacauagguuaaccaacuuucccaagaccuucucccggauuugccgagucuuuauacaguacacaaugggguucaucagggguggcaccaacaagaacauaucugcaauaaggauuacaaguaggggacuuuuguguuuggcaaagcgauguauggcagccagggugaugaugggcacauagaagaugagcacagcacagaugugggagacacagguauuuagagccuuaagccuuucugcuagagaugcaauacugagaacugucuucaagaucagcacauaagacauaagaaucaaggcaaaguccagcaugguacagagagccacaaagaagccauagaugaaauugaucuuguuaucagagcaggccaguuucaugacaucuugaugaaggcaguaugagugagagaggagauucuugugacaguauuucaguuuccuuagugugaaagggaauggaagcaccaaaacugugcuccugaaggcuaaaauuagcccuauuuuagcaacucugcggccauugaggauagaacuguaucuuaaaggguugugaauggcaagaaagcgguccaaagacauaaucagaagcacagaggacuccaugacagugaagccauggauaaagaacucuugggcaaaacaggcauugggugagauugccauggcauugaaaaagaagauuuuaagcaugguaggaagagaagagaaggacaagcccauaucagagacagccaacaugguaaggaaauaguacaugggcucgugaagagaggguucugucuugaugacaaaaaugauaaugcaguuacccaugauggcaauaagguacaugaggaagauagggauggagauccacucgugggcauauuccaguccugguaucccaauuagaagaaaauacaugaccucggaguuguugaaaacagacaug

SEQ ID NO: 3981 - RNA, 962 nt, Mus musculus
uaugaugcauucucucauguuggcuucaaggaacaacucuucccauucuacauuuuucaucuugcuuggaaucccaggacuggagaauuaccaauucuggguugccuuuccauucugugucauguauauuguggcagugacuggaaacaucaccauccuucacauaauccgaauugaccacacccuacaugagcccauguaucucuuucuggccaugcuggcuaccacugaccuuguccuguccuccuccacacaacccaaaaugcuggccauacucugguuucaugaucauaagauugaauaucaugccugccucauccagguguucuucauacaugccuuuucuucuguggagucuggggugcucauggauauggccuuggaccgcuauguggcuaucugcuucccacucagacauuccagcauccugaccacaucuguagucaucaaacuagggguagcugugauggugagagggcugcugugggugagccccuucugcuucauggucuccaggaugcccuucugccccaacaaggucauuccccagucuuacugugagcacauggcugugcuuaaguugguaugugcugauaccagagucaaucguggauauggacucuuuguggcuuucucuguggcugucuuugacuuagcugucaucaguguaucuuaugcaaugauucugagagcugugcugagguugcccucaggugaagcucgccucaaggcuuuugguacaugugcuucucauauuggugucaucuuaaccuuauauaucccagcccuuuucaccuuccucacccaccgcuuuggucaccaugugccccgaauuguucacaucauguuugccaaugucuaucuucuaguuccucccaugcucaaucccaucauauauggaguuagaaccaagcagaucagagacagaguuacccaagcauuuuguggaaaaggcucaugaa

SEQ ID NO: 3982 - RNA, 962 nt, Mus musculus
uaugauguauucucucauguuggcuucaaggaacagcucuucccacucuacauuuuucaucuugcuuggaaucccaggacuggagaauuaccaauucuggguugccuuuccauucugugucauguauauuguggcagugacuggaaacaucaccauccuucacauaauccgaauugaccacacccuacaugagcccauguaucucuuucuggccaugcuggcuaccacugaccuuguccuguccuccuccacacaacccaaaaugcuggcuauacucugguuucaugaucauaagauugaauaucaugccugccucauccagguguucuucauacaugccuuuucuucuguggagucuggggugcucaugaccauggccuuggaccguuauguggcuaucugcuucccacuccgacauuccagcauccucaccacaucugcagucaucaaacuaggugcuguugugauggugagagggcugcugugggugagccccuucuguuucauggucuccaggaugcccuucugccccaacaagaucauuccccaguccuacugugagcacauggcugugcuuaaguugguaugugcugauaccagagucaaucguggauauggacucuuuguggcuuucucuguuguuggcuuugacauaauugucaucaguguaucuuaugugaugauucugagagcugugcugagguugcccucaggugaagcucgccucaaggcuuuugguacaugugcuucucauauuggugucauauuaaccuuauauaucccagcccuuuucaccuuccucacccaccgcuuuggucaccaugugccccgaguuguucacaucauguuugccaaugucuaucuucuaguuccuccuaugcucaaucccaucauauauggaguuagaaccaaacagaucagagacaggguuacccgaggguuuuguguaaaagguucaugau

SEQ ID NO: 3983 - RNA, 956 nt, Mus musculus
aucagcuuuguuucugacacaguuucucuagaaucacauuucuuaucuguuggcucuucacacaguauaugauaggauucauuacaggaggcacaagcaagaaaaugucagccaugagaaucuuagauaugggggaacuacgacucgcaaggcgauagaugacagcaagggagaugacagggacauagaaaaugagcacagcacagaugugagagacacaaguacugaggaccuugagucuuucccuuugggaugcaaugcccagcacugcucucaggaugagugcauaugacaugaaaaugaagguuaugucaaggaugccugugagagccacaaauaagccauagaugacauugaacuuguugucugagcaggccaguuucaugacauccuggugaaggcaauaggaaugugacaagagauucuucuugcaguaucuuagacgcacuagaguuacagggaaaggcaggaucaacagcacauucuugagagaaaaagcaagcccgauuugaaggacccuggcacugguaaggauggaaguguaucucagaggguuacagauggcaauauagcgaucaaaggacauaaugagaagcacagaugacuccauagcugagaauucaugaauaaaaaacuccugggcaaaacacucguuaggagaaaugucuggagaauugaacaggaaaaccuuaagcaugguaggaagagaggaaauggacagucccaggucagagagagccaacauggagaggaaauaguacauggguucaugcagagaaggcuccgauuuuaugaaaaagaggauagugcaguuucccaggauggcaacaguguacaggagacauauggggaugaagauccaaaugugggcagauuccaucccugggaacccaaccaaauggaacguagaaacuucaguaacugagagguugaaaauggacauaccaguaugcaug

SEQ ID NO: 3984 - RNA, 2481 nt, Mus musculus
uauuugaagaggucuuuggagacauggugguuucucuuuccuucccagaagguaagucucacuguaaggucuuuaugucuugugugucccccagcagccuugucaucuccggcugcccuagaccugcauaaggacagauugagugugcugggauagacuuuuguugacaaaggggcugcucugcccuucuaagagguugagucucaucauaaggccuuuugcagcuugcauguguagugccaggaaagaguagucaucccccaaaaccagacaggaacugacgagaugcaaucacuguguggacuuuuuaccagcuagcuagggcacuaccaugagccacugucuagcagggaggcuuuggggauggugugccccgaauaucucucaggguaagaguuuacaguaagcagcaagcagaggggugugggugagugugcaaguaucuaauuggcuaguuuuuguggccuguaacauauugguggguguugggagucauaagcuaaauguuugcuuuccucugcauugguggucauuagggagggggcagauuaugaaccuagguugcagaucuguuggaguaauaacaagacacuggucuuguuggggguauaaccuagagacucgauuuauguucauguuugguuugggauggguuuuaugugaguguuuucuuuuuuggggagggggucgguuaacuuggaaaguaaugcuagguacuguccuguucauuucccugaggugaaaguuaggucagguuuucuagaauggagucugaagguaaaagauuuggccacuggcaugcccuaaagucuuuuuguguucuuguccccuagcagauccagcccuaucaucuccuggugcccaacagcugcaucaggaugaagcucagguagugguggagcuaacugccaaugacaagcccagucugaguugggaauguccccaaggaccaggaugcgggcuucagaacacaggcaacagcugcuaccugaaugcagcccugcagugcuugacacacacaccaccucuagcugacuacaugcugucccaggaguacagucaaaccuguuguuccccagaaggcuguaagaugugugcuauggaagcccauguaacccagagucuccugcacucucacucgggggaugucaugaagcccucccagauuuugaccucugccuuccacaagcaccagcaggaagaugcccaugaguuucucauguucaccuuggaaacaaugcaugaauccugccuucaagugcacagacaaucagaacccaccucugaggacagcucacccauucaugacauauuuggaggcuuguggaggucucagaucaagugucuccauugccaggguaccucagauacauaugaucgcuuccuggaugucccccuggauaucagcucagcucagaguguaaaucaagccuugugggauacagagaagucagaagagcuacguggagagaaugccuacuacugugguagguguagacagaagaugccagcuuccaagacccugcauauucauagugccccaaagguacuccugcuaguguuaaagcgcuucucggccuucauggguaacaaguuggacagaaaaguaagcuacccagaguuccuugaccugaagccauaccugucccagccuacuggaggaccuuugccuuaugcccucuaugcuguccugguccaugaaggugcgacuugucacaguggacauuacuucucuuaugucaaagccagacauggggcaugguacaagauggaugauacuaaggucaccagcugcgaugugacuucuguccugaaugagaaugccuaugugcucuucuaugugcagcagacugaccucaaacaggucaguauugacaugccagagggcagaguacaugagguucucgacccugaauaccagcugaagaaaucccggagaaaaaagcauaagaagaaaagcccuugcacagaagaugcgggagagcccugcaaaaacagggagaagagagcaaccaaagaaaccuccuuaggggaggggaaagugcuucaggaaaagaaccacaagaaagcugggcagaaacaugagaauaccaaacuugugccucaggaacagaaccaccagaaacuugggcagaaacacaggaucaaugaaaucuugccucaggaacagaaccaccagaaagcugggcagagccucaggaacacggaaggugaacuugaucugccugcugaugcaauugugauucaccugcucagauccacagaaaacuggggcagggaugcuccagacaaggagaaucaacccuggcacaaugcugacaggcuccucaccucucaggacccugugaacacugggcagcucuguagacaggaaggaagacgaagaucaaagaaggggaagaacaagaacaagcaagggcagaggcuucugcuuguuugcuaguguucacucacccacucacacaggcuccuguggacacc

SEQ ID NO: 3985 - RNA, 941 nt, Mus musculus
uuuaauauuuucuuugaagaaagaguuguauuaaccccuggcgaaucugccuguucuuagcacuguagaugaugggauugagcaucggugguaccagaagauagauguuggccaggagaaggcgaacagcagguacagcaugcuucaugaaucgaugcaccagagccacgcugaucauaggcacauaguacacaagaacugcacacauaugugacacacagguauugagagcuuuccuccgccccuccccagagguaauguuuaguaccguguacaggaucaacacauaagagacaacaaugagcagagaguccagcccaaaaguggaaguuacgaugcagagccccagaaugcuguugggacgaguguccccacagggaaguuggauuagaucugagugcagacaguaggaaugggaaagcacauugugaccacagaaaggcagacgcuuuaggagaaaaggcaaggggaacaugagcaacagacucuucaauccaaguguaagacugguaccagcaaugcggggcagagucaggauggcgguguaucggaguggguuguagauggcgacaaagcgauccacagacauggcuagaagaacuccugacuccaugauggaaaaugaauguauggagaacaucugcaaaaggcaggcuucaaagcagauuuuauuggcaccgagcagaaagaugcugagcacagugggcagggucgaagcagagacaccaagcucggagaaggccagcauggccaggaacaagaacaucggcuggugcagagaacuguuuuuucugaucacagccagaaugaggguauugcccaugaugccuauaguauaugugaaacagaaugggaagaucagccaaggguaccaugcuuccagaccagggaaaccggucagcaggaaguauuuuggggugaauugacugcuguugaacauu

SEQ ID NO: 3986 - RNA, 969 nt, Mus musculus
cuucagugcaccuuucucugcaagaggaggcgaguaauuccuugacggaucugcuuugucuuuacacuguaaaugaugggguucaucacaggaggugcuagcagguagauauuggccaugagaacauggaccaguggagaggcaugcuuggcaaagcggugagucauagacacaccaaccauagggacauagagaaccagaacagccagcaugugggacagacaguuguugagagcccggagucguucaguccaaguggcuguguucaagacacucuucaggauaagugcauaggagaguacaaugagcagaggguccaauacaauaaugagcaggacaagagcaaauccguaccagcuguugacucugaugucagcgcagaccaggugaaucauauccugguggaggcaguaggagugagaaagaaggugggaauggcagaagggcaggcgcuugagcaggaaaagggagggaagaacagccaagacacagcggcaaaugauggccaacccuauucuagcaaugaccucacuggugaggauggaggcauaguggagugggcgacagauggccacauaacggucaaaggacauggccaauagaacagaugauuccaugaaagagaacccauggaggaagaagaacugggcaaaacaggccucaaagcugauuucucggauguugaaccaaaggagcugcaugacuguagggaguguggugagaguuagacccaggucagugagggccagcauggagaggaagagguacaugggcugguggagagauggcucugugcggauaacgguuaggauggugguguuucccaugauggagaugguguagaggcagaauaagggaauggagauccagagauggauauccucaaauccugggaugccggugaggaugaaguagaaaggaucaugagugguguuuguuacuucugacauacuugauggaugcaacaua

SEQ ID NO: 3987 - RNA, 968 nt, Mus musculus
uuuagugcaccuuucuuugcaacaggaggcgaguaauuccuugacggaucugcuuggucuuuacacuguaaaugaugggguucaucacaggaggugccagcagauagauauuggccaugagaacauggaccaguggagaagcaugcuucgcaaagcggugagucauagacacaccaaccauagggacauagagaaccagaacagcuagcaugugggacagacaguuguugagagcccggagucguucaguccaaguggcuguguucaggacacuuuucaggauaagugcauaggagaguacaaugagcagaggguccaauacaauaaugagcaggaccagagcaaauccguaccaucuguugacucugaugucagcgcagaccaggugaaucauauccugguggaggcaguaggagugagaaagaaggugggaauggcagaagggcaggcgcuugagcaggaaaagggagggaagaacagccaagacacagcggcaaaugauggccaacccuauucuagcaaugaccucacuggugaggauggaggcauaguggagugggcgacagauggccacauaacggucaaaggacauggccaauagaacagaugauuccaugaaugagaacccauggaggaagaauaccugugcaaagcaggccucaaagcugauuucccgaauguugaaccagaggaccugcaugacuguagggaguguggugagaguuagacccaggucagugagggccagcauagagaggaagagguacaugggcucguggagagauggcucugugcggaugacaguuaggauggugguguugcccaugauggauaugguguagaggcagaagaaggggauggagauccagagauggauauccucaaauccugggaugccggugaggaugaaguagaaagggccaugagugguguuaguuacuucugacauacuugauggacgcaacaua

SEQ ID NO: 3988 - RNA, 956 nt, Mus musculus
cucauaucugcuugguuuucaccccauacacuauuggguucauggugggcggcaugagcagauagagauuagccaugaugauauguauguggggagggaugguaugccgcccaaagcgguguguaaagaaggugaagaaggcugggacauaugugaugacgauggcacagauaugagcagugcaggugcugaaagccuucugucgagcaucugcagaugacagacucacaacugcccguaggaucaugguguaggagacugugauacacaggaugucaaagcccccaaucaggagggcaaccauuagaccauagauggcauugauuugaacauugccgcaggauauuuuagcaacagacauguggucacaguaagugugggggaugacauuacccuugcaguauggcaggcgcuugguaaggaauaugaaagggaugacaagaaucacuccccuaagaaaaguaagcaucccugccuuggcaaugaccacauuagugagaauaguggcauagcgcagaggauaacagauagccacauagcgguccaaggccaugagcaucagcacuccagacuccauuccugugaaagugugcacaaagaacaucugagccaggcaggccuuaaagucaaucuucuugacauugaaccacaauaugcagagaguguugggaagggugcuggugcacaugagcacaucugugaaggaaagaagggcuaggaagauguacauaggucuguguaagaccucuucagaauagauaagauauauaagcccaaauuuuccuguaagagcaaugcuguacaugguaaauagugggaaggagauccacaaaugaaccucuuccagaccagggaugccauugaggaugaaugaagcuggagucagacugcuggcauuuagaagugauauaaugaguguuggaaacucauggucgagcagcccagaauugucucug

SEQ ID NO: 3989 - RNA, 3998 nt, Mus musculus
aucucagcucugccugugccaugccugccuggauccugccaugcuccugccuugaugauaauggacugaaccucugaaccuguaagucagccccaauuaaauguuauuuuuuauaagacuugccuuggucauggugucuguucacagcaguaaaauccuaacuaagacaaugauacauaccuuuaaucccaggagagaaagccaaacaggucucugaguucaaggccagucugggacaaaucaggugcuagguaaaauaaauaaauaaauaaauaaauaaauaaauaaauaaauaaauaaaauucaaaaauucaaaaaaaaaaaccccaaaaaauaaaaaaacaaaacuuaacuccaggcacagugguaaacucauuuaaucccagcauuauaggagacagagccaugcagaucucugaguucaaagucaagcuacagagcaaguuccagaaacacgaagcuuaggcagagagggaguugcaaaacagaaagcugguaauagaaaaagaggggccaugugcuagcccagcaagcagcagaacaugacagcuuuggucauguggcucugacuuuagagugaaaaauagaagggauuacuggggcaauggaugcugguuaccuggagcuaagaaauuaguggugauuaaaaagagaccagcauaguugagguaucuucugggaagugguuuuugagcacaaaaaagugcuguuucagagauagccaagguuguaccuccugcugcagcuauacuugguaauguguaagagucacccagaugguacugguuugaaggcacugugagaagccauggaaggccauuguugaagguacagccucaguugcaguugauggcucaggauugaagggguccugcagaggaaucuuggcaccaugugugauggguggugaguuggggcagguggcaagcuagcucaaauagaauaaagacccugcugugaguuacaucagauuggcuccugucuguguuuucagagaucacaaacauuuuccuggcacaacaggggauuacaguuaagugguuggauguaucuuaaaagaaacuuugaacuuaggacuuuuaacauugucaagucuguuauagacuauggggaauuuugaaguaggauuaaaugcauuuugcauuaugcaauguuuugguauggucuccauggacucauauguuugaacaagccuaugggggucagggaguggaaugucaauuguuuguauaugcuuuaccuaugaaguagcacuauuagaagguguggcccuguuguaaauguggucuuguugaaguaggugugucacuguggauguaggcuuuaagauccuuauccuagcugccuagaagccaguauucugcuaggagccuucagaugaagauguagaacucucagcuccuccugaacuaugcuugccuggaugcugccauauuuccaccuuggagaguauugacugccccucugaaccucuaaggcagccccaguuaaauguuguccuuguaagaguugccuuggucaugguaucuguucacagcaguaaacccaaacuaggacuccaaaaaagccaggccuagguuuugagaccucacuucauaaauaucacugaucaucucaguauuuucuacuauguauacauucucgcuuugaucauuuuaaacacuaguauugauuuucaccauuuccagucuuuuucaaggcuucuaccuccuguguguccaguucaugacuguguuggauggcccaccuaggcucagauauuugaaugcucagucaucauugagaggcacuauuuaagcaugauuaggagaccaggucuuguuggaagaagagugucacugugggggagugugggggaggugugacaauagcccagaccaggcccagaguuguacuccuccuguugccugagcaucuggauguagaacucagauaguucuccaacaccaagucugccugccuauguuucaccaugcuccuagguaugaugguggacgaaaccucugaaaguguaagcaagguccaaugaaauauuuucucuuuauaugcuaugaaauugguaucucuucacagcaauugaacagcaauuaagacagugaccaaauacuuuucuagagcucacuuuccucuuauaccauauuuucauuuagaguguuugacagaauuaaucacuuuuaaaguaagaaauccccccacaugauucuguuugaagccccuaugucccaggguuaaauguccuggguggugauacggaaacagggucacaguggaagaggcagcaguggagcacacagccuuauucugcccuuaaauuggauuuaacugguuauuuccuuuucuuuugguucaggaaaucacaaccaauagguuggaggggaguugaagucaaacagaacaaaagaucaaggucaguauguacuacaagagaucaagucucaaaagcaaaggaaaaagcaagauuuauuuauauauuuauuuuaucuccuuagaguugaggcaggaggauugcuaaaagaaagcaaauuuugagcacucauguuuucuagguaucucuuccuucugaaaucaugauuuccaugaauuugugcagauucccguaugaaaacucacugcuugcuauaucaaaccuuuacccuuagaaaccaucaaacuauugaaaaagagacuaugucucccuuccuucccuucccucuaugucuauauccaggucauuuucccacucacccugccccucccuucuuuacuucccccucccucugccacucucauugccuuucaaauguugucccucuuccaguccuccccucugcaacccuccauccuguccccccuccacucuuuauaucaaaugugagcauguuuuauuugaaaaauacauaaauucaugaauauacauguauauguaaauaacaaaguguuaacaaccauuuggcuaagugguaaauaucuauaguguagaguguagagaugauaagauccuaugugauuaagcagagaggguuaaacaaguacauacuggauaaucuaaaaaaugcccuccugacaggaagguuguccaugggagcuuucuccaccacccugaaaucuaguucaaaaacaggguuuugucccagaguccuucaucagaagcccugccuaagacagaagugaaccucuagugugguaggucuacacauacuuucuuuauuugacaugcuuucauuuuucuguuacaaugaaaacccaagcuugagaugccuagggaaauggaucuccauacaguucaauggucuccacacagauccaauuuaagauucguuuugcauauaccacaucugcuuugucugaugcaacuagaugcuugcagggaauugguuguuauagcaccagauucauggguguggccacaguauaacuauaaaacuguaagcaucugggaaucagagagcuuuuuugaggguacaguuccuuuauuaaugugcuugauccaguugggcaaaugauaggucuucuuuuuuauuaguauaauauuauugaaacauacaaaauuuucuuuuuugagcacauuguagguucaaguucuuuuuugucuuaaaaauagguuuuuccuuuauacacuauauucugacaacaauuuccccucccuucacacuccuaucuacucucuccuccaaaucuacuuuuccucauaucccuucagaaaaggaaaagucacaauggaaaauacccgaacauugcaaaacaagagaagacaaggcaaaagcccucauuugaaagauggacaaggcaacccaauagauggaaaggaguccuaagaccaggcaaaagaaucagaaacauacccacucuccacuguuaggaguccacaaaaaaacccaagcuaacagcucuaauaccaaccaaucacugccagauagcggagcucaucuagucucugcaagaaccuguauugagucucauaacccacugaacaaccauggugcagacaaaccccugaggauauucuuuacuagguaauu

SEQ ID NO: 3990 - RNA, 1324 nt, Mus musculus
aggagucccgguacuggagggugcagcaagugcuuccuggaucccgcggaggucacgaguaaugugacagcaacuugacaggcggcuucagagaggcgacugaacugcgggaacaccggggcaggucuucccaggcuggagugcgcgugcgucugcagaggaguggagaucgauucugcgaggaaaagggguucaucauggcggaugaucuaaagcgauuccuguacaaaaaguugccaaguguugaagggcuccaugcaauuguugugucagauagagacggggugccgguuauuaaaguggcuaaugacagugccccagagcacgcccugagaccuggcuuccuauccacguuugcccucgcaacagaccaaggcagcaaacucggacuuucaaaaaacaaaagcaucaucugcuacuauaacaccuaccaggugguucaguucaaucguuugccucugguggugaguuucauagccagcagcagugccaacacaggacuaauugucagccuagaaaaggagcuagcuccauuauuugaagaacugauaaaaguuguggaagugucuuaauccagcagugguucugaugcacaccuuggucucacugcagcaacccuggaccaggccagcaaccuuccgaccacaauaguacuuguagcuauguauucagaaggccgcuuuuccacauuacacuaaagaagagccuaucgcuauaauuuauagacagaucaauuguuauauuuauguguauaaaaucuuuucuuacuuagugagaucugagaacaccacagaaauggucauucgauugcagcucccauggaguuagugcaggcaccugaaagugagugguaucuguccagagcagagggucagaccgggaccgugaagcccuugagccagcaggcacaccugcugaacucugcuccacuccauaagccgaagacccuuuaacugagaauaauaaugaggucauauuuuucuucagauuauauuuuauuucuuugcauugugaggaagaugaaauggcuuaguaaaaacaauuaaguacaaucacuaacgcacccucuguguucucggugaggaugaguuacuaauggauuugauucuucagggugcugcuguucacugagagcacaaucacugcuuaugaugucucuccgcguugcuguaaccgugcuuccaccauuguguucuuuguacaauugaaaugcauguuacugaguucuguuuccuuaucaggauguauauaaaaugacaggauggccauuuuuuauacauguguauaaauaaaauaguauuuuuaaagguaaaaaaaaaagcag

SEQ ID NO: 3991 - RNA, 950 nt, Mus musculus
uaugacagcacacaagaacgacaccaacccuacuggaguuucagacuuccuccuaaauuguuuugucaggucucccagcuggcagcucuggcucucccugccacucagccuucucuuccuccuagccaugggggcuaaugcuauucuucugaucaccauccggauggaggccucucugcaugaacccauguacuaccugcucagccuccucuccaugcuggacaucauacucugccucacugucauccccaagguacuagccaucuucugguuugaccucagagccauuggcuuuccugccuguuuccuccaaauguauaucaugaacagcuuucuugcuauggaaucuugcacauuuaugaucauggccuucgaucgcuauauagccaucugucacccacugagauauccauccaucaucacugaccaauuuguagucaaggcggccacauucauucuggucaggaauguccuuauuacuuugcccauccccauucuuucagcacgacuccauuacugugggagaaauguuauugagaacugcaucugugccaacauguccgucucuagacucucuuguaaugaugucaaugucaaccgucuuuaucaguuugcuauaggcuggacuuugcugggaucagaccuauuccucaucuuccucucuuauacccuuauacuaagagcugugcugagacucaaggcagagggugcuguagccaaagcucugagcacauguggcucucacuucauccuuauucuguuuuuuagcaccauccuuuugguuuuuauccucacacauguagcuaagaggaaggucucuucugaugugccaaucuugcucaauguccuccaccaugucaucccugcugcccuuaaucccauuguuuaugggguaagaacucaggagauuaagcaaggaaucaagaaauuguugaaaaaggggugguaaa

SEQ ID NO: 3992 - RNA, 950 nt, Mus musculus
uaugacagcacacaagaacgacaccaacccuacuggaguuucagacuuccuccuaaauuguuuugucaggucucccagcuggcagcucuggcucucccugccacucagccuucucuuccuccuagccaugggggcuaaugcuauucuucugaucaccauccggauggaggccucucugcaugaacccauguacuaccugcucagccuccucuccaugcuggacaucauacucugccucacugucauccccaagguacuagccaucuucugguuugaccucagagccauuggcuuuccugccuguuuccuccaaauguauaucaugaacagcuuucuugcuauggaaucuugcacauuuaugaucauggccuucgaucgcuauauagccaucugucacccacugagauauccauccaucaucacugaccaauuuguagucaaggcggccacauucauucuggucaggaauguccuuauuccuuugcccauccccauucuuucaggacgacuccauuacugugggagaaauguuauugagaacugcaucugugccaacauguccgucucuagacucucuugugaugaugucacugucaaccgucuuuaucaguuugcuggaggcuggacuuugcugggaucagaccuaguccucaucuuccucucuuauacccuuauccuaagagcugugcugagacucaaggcagagggugcuguagccaaagcucugagcacauguggcucucacuucauccuuauucuguuuuuuagcaccauucuuuugguuuuuauccucacacauguagcuaagaggaaggucucuucugaugugccaauuuugcucaauguccuccaccaugucauuccugccgcccuuaaucccauuguuuaugggguaagaacucaggagaucaagcaaggaaucaagaaauuguugaaaagggggugguaaa

SEQ ID NO: 3993 - RNA, 1007 nt, Mus musculus
augaguucuaaaggugccuggguaccucuuacaaccuccucaacaaguucuggauucccugcuugaucucccugguucuuaccccauaaacaaugggauucagagcuggggggaugaggugaugcaggauauugagcaggauggggauguccgggggaauccucucccuggccagguuagugaugacuagcaccagcaagacugugcugaagaagaggaugaggaugaagugggaaccacaugugcucagggcuuuggccacagcucccucugcuuugauccugagcacaacacggaagauaaaagaguaggagaguacaaugagaaugagaucagaacccagcaggguccaaccugcuacaaguugauauaguuuauugaggguaaugucaucacaggagagccuggacacugacagguuggugcaaaugcaguucuugaugauguucugagcacaguacuuuagucuggcagaaagaaugggaacugggagagaaauuagggcauuccggcuuauaaugaagauagcagcccuaaccacaaacugaucagugaugacggucggguacuguagaggcuuacagauggccacauagcggucauaagccaugaccaugaaggugcaggacuccaucgucaggaaacuguucaugacaaacaucuggaggaagcaggaagagaagccaauagauuuauugucaaaccagaagauggccaggaccuuagguaugacagugaggcagagcacaauguccagcagggacagaaggcugagcagguaguacaugggcucaugcagagaggccuccaaccugauggugaugagaaggguggcauuggcccccauggccaggaggaagaggaggcugaggggcagggacagccaaugcugccaggucugguaguuggggaagcagaugaggaggaauucagagaugggagcuucagaaucguuggauaaugccauggaagaaauuacaaucaagcugaaaauccaaaacucacau

SEQ ID NO: 3994 - RNA, 1020 nt, Mus musculus
ccccugagguccagcugacaaaaauaacagucaaguggguucaaucuucuuggaaccuauaauugugaacagacacucucugaucuguuuggucuuaaccccauauacaaugggguccaaagcagggggaaaaagcaaguagagauuggcaaggaugaccuuggcagcagaagcuguggauggcccaaagcgcugcaugaccacagaaagaaagccagguccauagaagaagaggaugacacagacaugggcugugcauguacuuccugcuuugccacgugccucuggagaaggaaaacgcaucacugucuucacaaucuguccauaagaguaggcaauaaaggccauaucccccacaccaagaaagauugccacagcaaaagcauagagacuguccacaguuauggccccacaagccagcuucaccacggacauguguucacaguaaguguaagcaauugugugugaaccacaauaagacagucgacaagccaggcuuggaaagaagauaguuaaacccacaccucgcagugccaccaggccuccaaucuuggcaacaacuucaggcguaaggaugguugcauaaugcaauggguuacagauagccacaaaucgguccaaggccauggccaccagcaccccugacuccauggcagagaaugcauggaugaggaacauuugggacagacaggcauaggagcugauggcuguggcaccaaaccagaaaauagccagcaucuugggcagaguggaaagggagaggaccagaucaacaaaagagagcauugcaagaaacaaaaacaugggcugguggagccuguguucuauccagaugagagaaagcaggacugcauucccaguuagugacaggacaaacaugaagcagaagggaagggauauccaaacaugggcagcagucaguccugggaugccagucaagaagaaaguauguggaaggagaugagaauuauuagaaaaaaucauaguugcucucccacacaaagagcaaagagccgcugu

SEQ ID NO: 3995 - RNA, 1020 nt, Mus musculus
acagcggcucuuugcucuuugugugggagagcaacuaugauuuuuucuaauaauucucaucuccuuccacauacuuucuucuugacuggcaucccaggacugacugcugcccauguuuggauaucccuucccuucugcuucauguuuguccugucacuaacugggaaugcaguccugcuuucucucaucuggauagaacacaggcuccaccagcccauguuuuuguuucuugcaaugcucucuuuuguugaucugguccucucccuuuccacucugcccaagaugcuggcuauuuucugguuuggugccacagccaucagcuccuaugccugucugucccaaauguuccucauccaugcauucucugccauggagucaggggugcugguggccauggccuuggaccgauuuguggcuaucuguaacccauugcauuaugcaaccauccuuacgccugaaguuguugccaagauuggaggccugguggcacugcgagguguggguuuaacuaucuucuuuccaagccuggcuugucgacugucuuauugugguucacacacaauugcuuacacuuacugugaacacauguccguggugaagcuggcuuguggggccauaacuguggacagucucuaugcuuuugcuguggcaaucuuucuuggugugggggauauggccuuuauugccuacucuuauggacagauugugaagacagugaugcguuuuccuucuccagaggcacguggcaaagcaggaaguacaugcacagcccaugucugugucauccucuucuucuauggaccuggcuuucuuucuguggucaugcagcgcuuugggccauccacagcuucugcugccaaggucauccuugccaaucucuacuugcuuuuucccccugcuuuggaccccauuguauaugggguuaagaccaaacagaucagagagugucuguucacaauuauagguuccaagaagauugaacccacuugacuguuauuuuugucagcuggaccucagggg

SEQ ID NO: 3996 - RNA, 3342 nt, Mus musculus
guuuggggcugcagcaguugauguuuauuggggaccaguaucccuaugccagaucuuaagggccuuggccccugcaucucuugccucagcuucauucgucgcugucgaacuccgaagacaaacccugaagcaggggcagggacauggagugccggucgggguccccggggcccccacccugggcuccugguggaggguugcgggggcugaagagccaguucucugcuaggguuggggauagucacagcuugacucaugcccuggucuuccucccuagucccucccucugauucuuugugcuacaacacccccaucccgccaccuuaccacaaccaugcuuccaccucacccuccccuuggcuccuucaugaagguccuguacaaacucugggcugcugagccuauuccuugguuaugugcccugugcccucucccuccaauggccuuuccccuuccucaucuucauuuccccuagcaguaccugaaagcauauaggggccccuccggaagggguuucgacccuuaugggagaaucuggugggucugccuucuggcccuucuuggggaggugguguagguggggcugggacagguggagguacaucagcaacuucauggguaucagcagauacugaugugggggccagaguugauaugaugcuaaggcuaggucuaacccaguuggcuccuuggggcaaugggucuuuggucagagacuucuguggucccagcacacccuugggcugcagugaaaacuugaggcaggagaaagcaauagguagugaccgcuguaaccggaucagcugggguucacgggcuguaggcaaaagcccuagcugcagccaggugcaggagaagaccugguagaugacguagaugcugugggugcuucggagccagggaagauucuguuguaggcucaccugcccuggugguagcagcaggaaagcaacuuucuugcgcagaccucccauauguaggcgaauccugcagggcugcccauccaucauucgcauuucuucauaggcugucucggcucggccauuuggugaguauucccgugugcagugggcaaagauacccucagacccugccuguucuagaagauuugguagcagcccuacugauuucagugcccuucugcccugccgaccuggcaaagccaggcgggugugggcuggacgggacuguuucacuagcacgcccaguagaucauaguaggcugcauccgacaggaaagguacugccacuacauuggacccaaaacgcuccucgaugaccugcagguggccaguuuauaagucaggggcugaguuaaggucagagguuaacuuguguugucuaaauugaccuacccacuauuguucacuguuuaaguacauugcuacaguauacuaacagaucuguuucuuauuucccaguucccuguagaagaaucuaaugucuuauuuugugccaaauuuugguaaauacuuggauacaugaaagaaugagacuuugucuuuauaccaauguagcuugggcuaauggacggaacaaaaaugugaauaguaguuaaguaaaauaauagcaggaugugucaaggacaaaugauuuaaaagucuuugucuuugauagaaagaugaucaaaggaauuuggucaguggcaguacuugagcuuuggaggaauuaacagguugggcaguagucauuccugacagaauggucagccagggaaaaucccugaaccuuugggaacauuuaggaacacauaauuucauauuacuugcauuuaaggaaggaaaaggaaaggcacacgggaaauaggauauggaaagucauauguauaugccuuucauaaacuacuguuucauucagaggucaaugggaugccaggaagccacuuauaggcccauggugggaggaugggaccaaggagaagagagcugauuuuuuaauaagcauaaagcaggaaagagaaguaacuuaagacuguugcaauaauugcaagcaaaacacaauuuuaguuccugaacuacauaaugggaaagaguugaagacauagaauugguagaauuuggucuuuucauggaugugaaaaaaaaaaaaaggaaucuucaaagaucaugccuaggugauggguuauauggguaauauuagggaaaaauggauacacagaugcaggcuuauaauguccauucuuuuuugcaggggcaguuaucucuuacguucuuucuacuguagcuacaagggauaauucuuucuaugugcgugugaugucucuuuuuuguauuguuccaauaucuguuuaggguuuccaguuccuuagguuugcccuuuacuuauuauuauuuuguuugccguauuugugcuuggugaccuguucaugagaguaccugggaaccugguaagauccuuuuuaguagucagugacuuagcuguuauaguuuugacccauuauagauuucauugguugagccuucuggcucucaguuaugcuagauugcaaagccauacagaaguuccaaguuaucuaccuuuuaucucccagauuccacauaucuguguucuuacacugaauuuacccaaugaccccugaagcugcucugcucuuauuuuguaaccuaaagcaguguugaagugccggccuguuguauugaaagaaagaaaucagggcacucagaggugcccuguucugcuugaaguuggcacauuuauccuguguaucuuugcccugaguuauucgcugagauaauauaaggagaguuuucuuuuuucuuuucuguagugaaauaccucauuuaugauaauguaauuauuagcaggucuagucuagguacagacuucacuguugaaaccaacuagucuuaaucuugggaggacccuuucuuuccuuuucugccucccuugccuuugugguuagcauauucacaagcaaugggaguuaaugccaucaauucugcuggaugcugcucuaagauggugguuuaauauggaaaauacacauuuuuuuucuccuuuuuccucucauggauuuugguuuucauuuaaauuugcugcuguucauucacccauuacucauucauuuggguguauuuugugacuuuuauaaguugauugcuacugcuacucuugucuuagauuuccuaccucuuccuacacagaaaccacccaagacccagccuggucauacuuugccacuuuucccuuagcccucucacuuuaccuaccuuauccuugaugagggcccaaguggcaucugcuucauccaguguuagcaggugggggcuacugaccaacaugguggggagugggagggguugggcaagguaguggcugcugcaggaacccccaagcugccca

SEQ ID NO: 3997 - RNA, 12882 nt, Mus musculus
gauggcgguggugauccgguuugagucccaggguccccgcuacagagcaggugccuuaguuugucuggagccgcaguuaccgaguucugccgcaguggccgcagugauaaccacaguaucagcuaccuuagcucuuucgugaaggcuagcuucugccuuuguacaucccaccuccuaucugaaaccccaaacccaggccuuuucuucaaagacucggaggguccuggagggccgcaguugcucacaauggagacuguacaaggaaaagggcuagaguggacuagggcacugggggcggcggggaauugaggugagaaaugcacuaaaugaacugaguugaggugugguaaggguucuaguucuggcccugacuagggugaaagauagggagcaggcagcuuggucaucuaccuagucucuaggcagcguccacccccaccugaaacgaugaugcuccauuugcccucagcacggauacagcaagggaguagggugcuggguucccaugagaggggaucagaaaaggacugggucacuggaguguggcgggggcgggguagggguuggacaaaacugaaggcgccaaugaaguggauuccgcuuccugaggcaggacuggccuccucuacuuuguggccuuguuucgaccagugucauccauuccaaagaaauucuagugugaugugaaauaucuuuugggaucccaaaguggcugucagagguugggggggggggguggagacagaggaagagagaauuagagugggggugggguagucuagauacauggggaauucggauucaguauccugacuguuuuggaaaggaccugaucagucagcauugaguucauaaggacugcagagcuggaggaggggcuaagccugggaugucaucacccccucccuccacugucaccucugcuugucugagagcccgggaucagaggaaccugguguuugcucagcuccagcacagguggcaucucugauaauccgaugagcuuuucccacauuggaugacgguagcacugagaaacacggggacaaagggaauguaggggggagagagagggacauggauguagcuuacacucacuuauccagaaaacuauguauccagguauuaauuaugggacuuuugugccacccuuucaugcaaugagucuguccaugaagaacucccacuuagaggggauuuuaccaaauaagccagaguuugcaauacacaguccuacaaaaaaucauuaggaugugcacauugaacaauuaggaaaucagggcuguauagaugcuucagcuacuaagaacucuugcuucuuuugcagaggaucuggacuugguucccuagcauugacaaagugauucucaacuccaguuugaacagauccauuucucucuucuggccucucuggguaccaggcacucauguggcacacaugcaucuguguagacaaaacacucauaacacauaaacacauaacauaaacauaaaaaggaaaccuaagaaucauccuaacucuucuaugcucuuccaccaccguaauagauguugugacacaaaccccagacuccuuaaaaaugaaggauuuauugccuagcagacggcucccaacuaucaguccuguucagcaguugcuagagcagaguaacaacuccuucagaaccaugaacucuucccaggguguuaugcauccaaugacugaucagcacagaggaaucagcccagaauaauccucaucccccccacccccccaaggacaaucuguucauagcacuccagcuccuccucugagguuggcugaggacucuguugggucugaguuacugcccagccucucgcuuuacccaguccuugcuuuacccgcucuugcacagguguugauuccagagaacuccuuaguaaacacccucccugcacagcauucucuguuuuaggaucugcuuccuggggaauuauagcuauaucgcucccacauucaagcaaucgcaacguccuguugauuuuagcuacucagugagugugcuuauauucaagugucuugugauucaaucccagcuccuaggauggcuaacacacuuugcugguuauauccaguccucuauggcagaguucuauguucagaauaccauuugaauuacaccaacccaccaaucuuugcucuuagcagagagggaaucuuucaguuggaucuaugaagcccucauagccuggcuucugcuaacuuuuuuuuuuuuuugguuuguuuguuuguuuguuuuuuuaaagauucuuuauuuauuauuauauguaaguacacuguggcugucuucagacacaccaguagugagugucagaucucauuaugggugguuguugggauuugaacucaguaccuucagaaaagcagucagugcucuuaaccacugagccaucucuccaguccggcucuguauuuuuuguuccucuugcuguacauacauuggucuucuuuaaguacccccuuuuucuuaugcauuuuccagucauguggauuuugcauaugcuuucuggaagguucucuucuccuucauugcccaucuauuuauuuucauguacaguagcauucugcagagauguuuuccugacugucuuggagguugaugucuaauuauggucauccuuguauaagcaucccuggaggguagcugaaccagugaguacagagaagaaucggcuacaugacugugcuauguggaaacagagauuuugcaaauggaauuaaugucacuaguuaguugcucuaaaaaauacagaaauuauacagauggcccuagucaaauccuauagauccuuuaacagcuaagaguuuucccaggcuggacagauagcagugggaaucagauauuugaagaagggaguguguguugaaguagggucucccagcccuggcuggacuggaacucaauauguagcugacaaccuugaacuccugaucuuucugccuucacuuuccugaugcuggaacuauaggucuguaccacuguccuauuuguuguuguuauguuguuguuuuaauuuugguuugucaacuuuacaacagguaagaguuuaucuuggaggauagagcccaaggagaaaaugccuccaucagauugccugucuguugaaaagucuguuugguauuuucuuacauaacaguuaauaagggagggcccagccugauguguuaccaucccugggagagugguccugggaugcauaagcaaguagguuaagcaacccccccacuccucuacccacccacucccccuuuuuggcccuggcguuccccuguacuggggcauauaaaguuugcguguccaaugggccucucuuugcagugauggccgacuaggccaucuuuugauacauaugcagcuagagacaagagcuccgggguacugcuuaguucauauuguuguuccaccuauaggguugcaguuccggggacuuuugguauagcauuggaaauguaaaugagcugaauaccuaauaaaaaaugaaaaaaaaaaaaaagcaaaccaugggagcaguaagcagaauucuuucacagguucugauucaguucugccucuaggauccugccuugaguuccugucucaacuuccuuugaugauggacuaagaugcggaaguguaagccuaauaaacccuuuccucuccaaguugcuuuuggcaguggugguuuuuuuuuuuguuguuguuguuuguuuuguuuugguuugguuugguuuuuguuuuuuaucacagcaauagaaaccucacuaagacagccaccacgcccagcucaguacacuaguuuuugaagacugauuuuaaaauuuuuacuuauguauaucauguguguguguguguguguguguguguguguguguguguguaugccacauguauguggacaccuguggaggacagaagaaaguguuggaucccugaucuggaguuauaggcaguugugaguguagcugaugagaacugaacucugguucucuagaagagcaauaaguacccuuagcugcugaauacccucaccucucuaacuccucaacauaaagacggggaacccugugaagaaaugagaacagcugguacaagccagagaaugaggagagcacagagcaaggaccuaaagugauuccuaucugagagcaguuacccuacagcaggcagcaaaauaccagggacuuuuaguccuuucugaaucucuggaagagaagucaguguaaaugacagcuugugacaccacauugggcagacuucuggccaacggcucuguaagcaauaaaugaauggcuuuaagcuacugcaaacauugugaucuguugcagcugcuauagaaaauuaacacaaaacaccuucuaguuaaguggguggagacccuuguaagcuacaccaggaagacaugaggcacuguaaagauuguagggaugacucaugucagaacaauuuaggaggugagacugggucagauggaacaugguagcaccuuaaagucauagaaagaauguagaagauggauguaaaaacuguccaggaaacagaacucggaguguuugcagauaaaggguggcagaggggaaugagagauaagucccugagauuuuuucaaaauaaauuacugaauaaaaccugcuaacagaaacuguucuaggcauguugcuuuuugaugaauucuuuuccucucacagagagcuauaaauuuaggcccaauauuauuuguaaauguauuauuauuuuguuuuaggaauuuuaaaugugcauacaugucauguuugaugcuggcauuuaaaaauuauuuuuuaauucuccuaccauccucuucgccuauaugcccugacccuuuccaacccuuuguagccuccuuucaugacauaaugccucauugccugcuuuccucagcuccuccucuucucuucucguggucuccugugcacacacauaaccauuauaugcuaggaucugcauaugagagaauauucuaauuuuucucuuucugaguuaccuagcuuaauguaguauuuucuaauaucagccacuuucaucuguguuuaccucuaucauuuuagcauucuagcauuggguaguggcacuacaauuuuguuacccauucguccguugauggacauguaggaaggauccguuuucuugcaauuaugacuaaugcagcaguaaacaugaaugugcaagaaucccuguggguaugugaccuggaguaguauagguggguuuucugacaguucuauuuuucuuuuuaaaaacuaucauuauguaugcacaugaguguauaauguguguguugggggggugucugcuugugguaugacacaaauguagagaucagagaacaauuuuauagauuaggcucucuccuuucccugcuauuugaguuucugggauaaaaugcuggaucaucaggcuuacuuguguucaaagguaugcauguguucaggcaugaacacauguguguaaguauguguagcuaaaauugauguugaaaaaaauccucuuuggcucuacacccuuguucuuuggggcauggucucucaaucaaagucagaacucacaagauaugucuaguuucauuagccagauuucugugcaacucccuuaucucugccuucauaggcuggaauuucagugugcugccguacucacccagcagucauguggcucuaggacagugguucccaauguuuggguugugaccccuuuggggguugaaggacccuuucauaggagucaccuaagaccaucauaaaacagagauacuuacauugugacucauaacaguagcaaaauuacaguuaugaaguggcaaugaaaauaauuuaugguuggggguuauccaucacaacaugaagaacuguguuaaagggucuuagcauuagcaauaaagaaccacugcucuagggaucugaacuuugcuugauaacaauggcuuuaacugggcgccaucuccccagccccagugauuucuaacuugggauguuucuguacagaucuccauaauggcugugcuagcuuacaucccuaccagcagugaauaagaacuguucuuuguagaaguuugguccaguucuucuucccagcuccuugcucucagaaauaagacucagacaaaaaauauauuuacaauuuuuuaaccuacagucugccaugugucugguuaccugugcucagauaccaugugucccucccucucaucacagugaaucuccugugccuggcucucccagaauucccaacggaugucccaccuccuauuuccugccuaaggcacaggccaucagauuuauuauugacaggugccaugaccaaacaaacauaagauaaucuuacuguucaucccacauccucaucacaggagaaggugcugaacuguucaaaugcuguuccuggguaaaaaacugaaugacugagaaauuguuuagaaguuagugaccuggagaaguuagugacuuuggaaagagccauuuuggucagugccuggaggaaguagagugagcgguuucagggagguguuuuagaaauaugaucauuauagaaggggaagaauuacagaagaauguggaaaugaauuucaacucucaaacuuuucuuuuuuuuaaagauggaauccuuccaauagagagaagacuuccgaugcagcgggaaggauggaggagguuaguuuaugaugcuagguuucugagaagacaaggaaagugggcucuagaaaagagggcccuaucuuuuuuucuuucuuuuuugauauauagaaguagagacuuaaucucaaugucaaguguaaaaggggaacaaaaguagaagguuguaaccaaguugucagcaaccagcuaacaacuauauaguuuuugguuuauuuaguuuuugcuuuguuuuuuuuuucuuuucuuuuucuuuccccugcggugaagugaggcuuuauggauaguggcuaugccaggaagagacaaagcacgggucuaaaugaaaguguugaaggagagagacaggcuccucuccccuugcaggcugacuguacuugugagggcaagccaccuuuggugaugcccggaggcaaugugggagaggugucagggugacagagagcaaaagcccguauguucuuuacucugaaaugauuuuuaccaucuccgguuauucugcagaaaaagcacuccacacucucaucccucucauuucuuucacuauugccauagcaacgcaaugggaaucuuaacuaauacaguagauuuguggguuugguaagcccaggagcuacagacuguuagguaagugugugugugugugugugugugugugugugugugugugugugcgugcacaugacacagcucuggugugggguucagaagacaauuccaggugucuggucuuguuuccuaccuguuggagacaaggccucuuucuuguucuccaguguguauaucaggccaacugucccccaaguuucugaggauucuucuugucuccaccucccaucuggaguagaaacacuggaguugaagauaugugcugcuguacucagcuuugugugggcuuuuaugauuggauucagggcuuugugcauacccagcaagcacuuuacccacugagccaucacccuacucaacauaguuaaagcaacaauauugaaaaccaaaucaagccaaaaccaaaugaaaccaaaccaaaaaccccaccucccauacccccccaaaacaaaaaacaaaccacaaaaccaacacuacuuaaauguaauaggggguaggaaguggagcacagagggaugaaguuaguggggcaguagggugagccccugaagaguagaguuuccauuuucuucagcagcuuagcugggaauauugauggcucggcucaucaaagguagggauuuaccaguuggguaggauagaacacagggacaagugugaagugaugggcuguggacucuaagcugggcacagggugggaacuacuagggguguggcaaagccuaacuugaguaacagaggggcucuggagaccucagcucuccucaaugguaagggaaaguggauagcacaaguaagucuggaacuuucuggugcaggacuacagagagagaagacacagcucugaugagugcagacuccaaccugugaagcaggaauuguaagaagugagaagcuucgaaggcaguuagagagaucagauauggucauaauggauucagagagcugaugccuucauaagagaaggggaccagauauccaccuaucucccucccuucucugucucucucuucauacacagugagaagguauggugagaaggcaaguguuugcaaacccaaaaaugaccauugcaaauagcugagucugcugcuacccagaccuaagacuuguagcuuaagaacugcaaaaaaaauuuaucccuucuccuuaagcuacccagguugugauauuuuauuauggcauguucauucucuaaugguuucucagaccuuuccccauacuucuuuuuaaaucucucucucucucucucucucucucucucucucucucucucucucucucucucucucccuuccucccuccccuccccucuguguguguguguggugugugugugugguguguguguguguguguaugagagagagagagguuuguguguacguguauguauaugcauuucuguggguucugucacagguccaccuuggcuuggguguggaggucagaggacaaccuuggguguugguccucaccuuugacuuuguuggagagaggguuucuucucaucacuguggagccagcaggcugacaaauuucuggagaucuucugcgucuacaucgaaucucacugugggcgugcugcuaccacauaugcauaugcuguucuguugagguguacacaguucugaggaucccaagacagccccagugcuugcccgauaaugacuuuacccgcugagccuucucaccagccccgcacaccccuuuuauuaccccccccccauauucuuuauuaucauacucagacauugccuccaaaugguuguacuugguuggcuucaggaaccucaaauugcugaaaguuucauuuuaucuuuauaauagagguuuacauuguuuucauuuuuauaucuugaucauauucuuucacucccugacuucuccuagaaccuacccaccaccccacuucccacucaacuucauguccuuuacccuccccgcccccccaaaaaaauccaaaucaaacuaaagaaaaaagugccaaaccaacaaacagggcacauaaaaaccacacaguucauuuugaccacuggcuguucuugagcugcucaagaggccugaagcucugaaggauguugauguaaccauuccauugggaaaaaaaccauccgauguucucugucccagcagguaucaauuauaagcaguuuguugguuagggaugggacgacacugugcccacuucucguacaagcugacacaguuucugugaguucaucuguacaucagcccuguugugucuaaagcuccuguuucuuuuugcucauccaccaccucugccccuuauaaucuucccacuuccucuucuuugauguuacaugucagccaucaucuuuugaccagaguaauuuccucugcaguaucuaacugcugauggguaaugggaguccagggccuggaaauacugugaauaugcuaauuuaaugaaagucauuuaguuaauuaauucagccauguugaagauuaaacguagggccuugcauauguggaugaacacuacuacugagcuacaugcucagccaaugaagauggcuuauaaaaaggaauguaaacuaacugcuaccuggagaagggggaguuuccauguaugagagaagaacuggacguaaauuuguuaagaggauaaauauucauaauuccaaaugaggaaauuccaucuagaccaaggaccuuccagaguuuggagagaagauuguacagggucagaaaacaggagagguuucuuugagaacaagaagagaacugcaaaaucagcaugaacauucauaggagaaagaccuggauccucauccuagaaccagucgcaaacguaugugccuaagaagcaagucgaaccacacgaugccaaguagggccagguucugugcugagagagaggcugcuguuggaacucgucuucaucugcuaagguuguguuuggcuuuaguuuagcuuugugccuuggggcuucuggaccacuaaccuugacuuguaugguuagaaccguuuacagggagguucugucacccuggcaaccucugacccagugacugaagcaugauccuucuuucaguacucaauaucacaagugaggugugugagagauacuuacugcuucaguaaagacucaggaaaagcagccaaagagaggagacuacagugacugaugcccagucagauagccuguguugcaauguauuguucauucuaaucagggacagcgccacaaaauacucaauacuaguuguuuauuugggaagcucaccauucacacaaugguguccugucagguuccuguaauaagcucuacccccagcaucccuuucucccucucccucucccucucccucucccucucccucucccucucccucucccucucccucucccucucccucucccucucccucucccgcucccgcucccgcucccucucccucucccucucccucucccucucccucucccucucccucucccucucccucucccucccucucucucucucucucucucucucucucucucucucucucucacacacacacacacacacacacacacacacacacacagagcuuccccccuuguuccacuuugucaguccuucucucugggucugacuucucccaaguccacaccuuucaaggcuuucuuugcauuucugugaugcguggauaugcuucugugucgagcuccugccuacgcaaucccugcccacacaggaggcucuucucuugccauaauuaaacaaagaggaaaauggcuaggaaggcagccaguuggagucagagcaggcauuaauggugcguaggggaaagaaaucaggggcaguauuggccuuccagguccccgagcuugugccuugggagagcagagccacacagccagaggcugucucuggcuggauaaucacacucgauggcugacugggccucaaaguuagucgauaaaaaccagagaucuaccaggucaagaccucacuugagggcuaauagagucaaagaaaagccacucagagagagcuucuaagaauguccccaaauuauuagcuucugcugcuccuguggguccugcuggggaugaagacugagagcaacaggcuaagauauugaaccugggaagguacuuguuaauauuguaaggaguuggguucagcucccaggaugcacaaagugacucacaaccaucuguaacuccaguuccuugggaucuguugucuucuucuuauggcugaagguaccaggcaugugcauacauaaauaaaauaaaucuaaaaauuaaaaaagucugaaaaagguguuuucacaagcaagucaagaucacagugcccuauucaauacucagcaugcgcgauuggcuccaccaucccuggcucagcagcagggcuuccaaccuggucugucgcagccgacaucaguucagcagauuccaaucccuaucuaugccccacugcaagggcagcaucaagcccagcugaguuugggggcugggccugcuguuucacaggcucaggaauuauucaguucuucaauucaaccauacagaucacagccagccuuuaugcaaagcagucuuucccagccuuccaguuguccucucugguacagcuauccacaacuucccagcuguccagcaccaggaacuugccaaggcacaaucaggucuugccuuucagcagacuucaaauacucagcccaucccuauucugugugaacaucagcuggggcaggcaucaggacuaggaaguucucagcuuauugauacacaucuucuucaggcaagagcaaaucuuacucaaaccucaaaucuuuacucuggacaaguacagaagccuggucagacaaauuuuuauaacacugcccaaucccccagugcucuccagcagguuacaguaccuuuaccagcaucccagcuuuccuugacgaauuuuggaucuacaggacaaccucugauugcuuugccucagacacuucagccccaguuacagcacacgaccccacaagcacaggcucagagcuugagccguccugcccaaguaagccagccuuuccgaggauuaaucccugcuggaacacagcauagcaugauggcgaccacaggaaaaaugucugaaauggaacuaaaagccuuugggaguggcauugauaucaaaccaggaacaccuccaauugguggucgaagcaccacgccaacgucuaguccauucagggcuacaucaacaaguccaaagagccagucuagcaaaaugagcagcguuguguaucagaaacaguuccagucagcccccgccacagugcgcaugacacagccguuuccugcacaguuugcaccccaggcaaagcagagagcagagguucuucaguccacgcagcgguucuucucugaacagcaacagaacaaacagauaggaggcaaagcccagagaguggacagugauacaaguaacccugaaacgcugagugacccuccuggcaccugccaggaaaaaguagaagaaaagccacccccugcacccaccauaaccaccaaaccuguuagaacuggaccaaucaaaccucaggcgaucaaaaccgaagaaacaaaauuguaaaggcugugggauggguggguagggaaagugaagucaaauaaugccagca

SEQ ID NO: 3998 - RNA, 2159 nt, Mus musculus
ggagguccuauuuuuuuuuuauuuuaugcauugacaugaagacacagucaguucgucacacucauugugagagaugcucgauucuaggaggccuggauucucucaaccuaucagauuacucauuugguuuugaaaacaaugagugcuuugugugcuuuguuuuguuuuguuggcagaaggaaaguagaccaagggcuguuuuuggauugcuuucuaaaugcaccccaacccaauggugugagcugucugugagugucagacaccagaaguaggaagagugcauuagcugacauuaacuagggcguuuucuucaaagaacugcauacugccccgccccaggccgggccccaaaguuguacuuauguguccccaagaggaauguauuuaagcaguaaguggccaauauuucuccgugccaauggaggacccaggauucggugaaaagugagaacguuugucauucagcccauuccuuccccaagccaugcgcauugucgcucgcccuuucucauugagucuggguuagagaaaauugcuuuuauugguggugaaccuaaauuaggcugaaagcuccucugucagaggacacaggguucagacuggaaagccaggaaggaagcuuuggagcugggcaguggaugcaggauucucuccuuauuuggauguaagugcugcacucuauaaguacuuauuuugggacaaggcuuaagcaccgaaugggacaggcagccccagggaucaggcugcgcucucuauuugaagcacggguuucucaggaucuuccuugguagguugaggagguucuggcuccagggcagucucgagcucggacuccauuucaggcugagcugcaggcuggccuucugaugggccuucagagcuccggacaggcccuacgcguggcggcuugacuggugugggcugugcugcuuuacgacuggaaagagcccuuuucaggcuuugaacuuucuguaaaccagugcggcgcagccgcugagcccuggacuccacuggcuccucuucagaacucucuccaacuucauccucuggcugaucugggcccagcaccaacugguccuccggacccaagagcucugggacuuucuggaaggcgcgggcuggaauuucagucuccuccuaaaugugaugacacagcuuuugauucucugauuugacccuggcacuuagccaggaccagccugaaacucucuugcccgcccgccaagggaagcuacuccacccuuugcaucugcacuaggaauuggggccaaaauagaggaaugggaagaugggggauggggaggauggaggagcagagagaugagcaaagagggggaaaguggaccuugcaaguuugcaaaguggaugaaaccguguagaguguaacagcuguauaggcgcuuggaggaggcagaguaacaccuaacaguuaguuccaugugggugcgacugaccaaauccgcagacuggccugaguuagggagggcguggguuggccaggcugggagugagaaagggauaaggucgcuguugugagaaagugggugcggcucugagagucuuccacaagugagggcagcacgcugggucaggaauguggagaugcggacggguggguggcaggaguccuucccucggugguaaccuagaggcgaggguugggggcgggagagggaugccugaggucacugaccuugaagagcaggacgugcagcuucccgcgcgccaccagcagcccgugguuggccuccaaccgcugcaccugagcagcgcgacgcacggcccgcuccugggcugcgucggcgugcgagcccacgcgcuccgccuuggccagcagcugcgucaguguguugcugguggugucguggcugcgacucagcgcacccaggccacucuguaugcgacgcacggagcccgccaggccgcccugccucucagccaggccgccuugccgcucccgcagagccuccagcaugguggccaauuucuccagcaaggucaccacggugacugcgugcaccggacccccugcgggcgucucaggcacagguccgggcuccagugcgcucucccccaugaucucugaccaccgggccugcucucccugagaccgauggcugcgaucugggcuggggcugccuuuccccgccuccuccccu

SEQ ID NO: 3999 - RNA, 1318 nt, Mus musculus
caguguguugcugguggugucguggcugcgacucagcgcacccaggccacucuguaugcgacgcacggagcccgccaggccgcccugccucucagccaggccgccuugccgcucccgcagagccuccagcaugguggccaauuucuccagcaaggucaccacggugacugcgugcaccggacccccugcgggcgucucaggcacagguccgggcuccagugcgcucucccccaugaucucugaccaccgggccugcucucccugagaccgauggcugcgaucugggcuggggcugccuuuccccgccuccuccccuaguucaggccgugacucagccgggcgggaguuggcaucuuccgcggugggaaaaggaggaggccgagcaagggggcggaauguccaaagggggcucuuucgaaggcuccgccccgggaucugcgaguaagacaguccugcccagaggcaccucuuuucugaguuugugcuccuuuucccccauuuuccuggugggcuucuuucaggccuguguucuucacagcaaaaggcaaaccacugaaaauuucauuuaucuaucuagugaucagagaaggggguggggguggaaggcagggguguuaaaggcauagccuaagccgucaaagcugcugagccccaacgcugggcggaggccuguaaaguuuggaauguucugccucagacccaagacugccuaggcccaaggcagggcuuugugucuaggcgggcugggcggggcauccucugauauuuuccagguuuagccucuggcuucguuuauugcuauuucuuccuacuggacugcguuguucuucuuuggauuccuggaggauagcucagccaugaguuagaauaaguacugguuuguccguuuuaauggagauuggcugugguuccugcguaaugccuucaaucccgucuccgaaauuggugagugugaggauuugaaaugcugcaguagcuagauauggugauacauauugagguaggaaaaucaccaauuggagaccaugaugaacuacauagugaguguuagaguggaaaaucacuacauaaagguugauuccugaguucugguugugaaaacuuuguuuuuauguuagaguuugauuugcucaucuuggacccgauauuagcagagccaucugagccugacaaaagaacacaaagaguuugagcgggguuucaugucauucagggaggcccugaacucacuguucagccaaggauggucuugaaugucuguucuugcuucugccacccaacggcugagauaacaguugugugccaccaaaccuacuuu

SEQ ID NO: 4000 - RNA, 1318 nt, Mus musculus
aaaguagguuugguggcacacaacuguuaucucagccguuggguggcagaagcaagaacagacauucaagaccauccuuggcugaacagugaguucagggccucccugaaugacaugaaaccccgcucaaacucuuuguguucuuuugucaggcucagauggcucugcuaauaucggguccaagaugagcaaaucaaacucuaacauaaaaacaaaguuuucacaaccagaacucaggaaucaaccuuuauguagugauuuuccacucuaacacucacuauguaguucaucauggucuccaauuggugauuuuccuaccucaauauguaucaccauaucuagcuacugcagcauuucaaauccucacacucaccaauuucggagacgggauugaaggcauuacgcaggaaccacagccaaucuccauuaaaacggacaaaccaguacuuauucuaacucauggcugagcuauccuccaggaauccaaagaagaacaacgcaguccaguaggaagaaauagcaauaaacgaagccagaggcuaaaccuggaaaauaucagaggaugccccgcccagcccgccuagacacaaagcccugccuugggccuaggcagucuugggucugaggcagaacauuccaaacuuuacaggccuccgcccagcguuggggcucagcagcuuugacggcuuaggcuaugccuuuaacaccccugccuuccacccccacccccuucucugaucacuagauagauaaaugaaauuuucagugguuugccuuuugcugugaagaacacaggccugaaagaagcccaccaggaaaaugggggaaaaggagcacaaacucagaaaagaggugccucugggcaggacugucuuacucgcagaucccggggcggagccuucgaaagagcccccuuuggacauuccgcccccuugcucggccuccuccuuuucccaccgcggaagaugccaacucccgcccggcugagucacggccugaacuaggggaggaggcggggaaaggcagccccagcccagaucgcagccaucggucucagggagagcaggcccgguggucagagaucaugggggagagcgcacuggagcccggaccugugccugagacgcccgcaggggguccggugcacgcagucaccguggugaccuugcuggagaaauuggccaccaugcuggaggcucugcgggagcggcaaggcggccuggcugagaggcagggcggccuggcgggcuccgugcgucgcauacagaguggccugggugcgcugagucgcagccacgacaccaccagcaacacacug

SEQ ID NO: 4001 - RNA, 4034 nt, Mus musculus
cauaagaggaacaggaaggggaggagcuguuuuguggcuggcugcugagcuaucagucaaccacaacgaaggguaaucaggugucuccagcguuacccgggccccgagggccagccagggcuucggccuguggggccuggaggggcaagccaguccugucuacgagccuggcaaugccccaccacagagcaucauccggccaggaccaccucagagccggcugggagcagagacuggagagguccuuaccggcacccagagugggacuccuuuggauggggcugggcuuggcgcugguucuggcucuguuugacuccacgguucuuuggguuccugccagagcuuauccucuuccuucugaaggccauucugucaaauucagugccauagcgccgccgcuccagagugccuuuggguggcagaaccucacuugccccgccugcaaagucuuauucacugcucucaaccaugggcugaaggugagugcgugaagggcuguuguggaaugcugggggcaggaugaagugcacugguaugcccgggggagggggcaauauauuucugguagagggugcuuccuaugcauccauguuaccacuaccccacugugaccuuuauaaaguuagggagaguaaagucagcuggcuaauugugggcuugaaaugguagcacacccugagcuagaguagguagcuagaggccuggugcugaacugcugggcagugugugggagauacugaugucucuuuaucauggugacagaguuauccuagcuccgauuuagacauggaagccuguggagugguggccaggguucacuuguucugucucugaccuaacuucauugguuccuuccaccacagaaggagcccaauguggcacggguaggcucuguggccaucaagauaugcaagaugcugaacauagcaccacuagaugugugccagucagccguccaucucuuugaggacgaugugguggagguguggacacguucaguucugagcccaucagaggcuuguggcuugcuucugggcuccucuuguggacacugggacaucuuuucgacuuggaacaucucuuugccaucagugccgaagccacccccaaagccaccgagcccaccagcccccggugccccugucagccguguccucuuccuuacugaucuacacugggaccaugaguaccuggagggcacagacccuuacugugcagauccacuuugcugccgccggggguccggauggccacccaacucccagaagggggcuggguucuggggcgaguacagcaagugugaccugcccuugcgaacgcuagaaagccuguugaaaggacugggcccugccggcccuuuugaaaugguguacuggacgggagauaucccugcccaugaugucuggcaacagucucgccaagaucagcugagggcccugaccaccaucacagaccucgugaggaaguucuugggcccagugccaguguacccugcugugggcaaccaugagagcacuccugucaauggcuucccuccucccuucauaaagggaaaccaaucuucacaauggcucuaugaagccauggccaaggcaugggaacccugguuaccagcugaugcccuucacacccuaagguacuuacugucgguggaaacccaggaaggaagaagaaagauggaugagggagaaaggaggagggaacuggguagacuacuccagcagguguccucagcacucucuacugcccucccuaaccugacccugccuucccuuuaauuaucuccagccacccucuuuucagagcuagcaguacauccccacucccuagcuugugucuuugccuacaguagcucucuuuguaaaaugaauucucccucccucuuuaauaucucccauuuuuuucucaacguggccaggccuauaacaucucccgacagaaaggccuuugcuuucugacucaccucacucuuuguccugaauucaugaagcucucaacccucugaggcuucuuuacugucagaggagcccuauaauuacugcuguuggucuucagcuagggugggagcuccugggggugggagaugacaucauguguaccucugccugaugugcaggacuauugacaucucgguuacuuuuguuucagaauugggggcuucuaugcccucaccccacgcccuggccuccgccucaucucucucaauaugaauuuuuguucccgugagaacuuuuggcucuugaucaacuccacagauccugcuggacaacuccaguggcugguggaggagcuucaggcugcugagaaucgaggagacaaaguaaggggaugcguuaugaaccggguggagaaggugcuguuggggcugaggagaagcaggcugcuguguguggggcugagaucugugaagaggggagugucgcuucacuuccuagaacuacugucuucccuggguccauguucaccuuccuguguccuucguauacucaaucuucugucacucuacccaaggcugccuggauuccucaaugcucugacugcccuuaauucucccuucaggugcauauaauuggccacaucccuccaggacauugucuuaagagcuggagcuggaauuauuacaaaaucauagccagguaaagggauagagggcuuggguguggagacugaaggguuaaaauacucucaacagucaggcagugguagcacaugccuuuaaucgaagcacucuugaguucaaggccagccuggucuacaaagugaguucuaggacagccagggcuguuaacacagagaaauccuuucucuggagaaaaaaaaaaagaaagggagggagggagggaggaaggagagagcaauucccucaagcacagagucucacaaucuggaggagcuacuuugcccauugcagaacgaccacccuaacuccucaggucuacccacccucauuuccacuuccuuacagccuucuaucacugugucucugggcagguaugaaaacacucuggccggucaguucuuuggccacacucacguggaugaguuugagaucuucuaugaugaggaaacucugagccgaccacuagcuguagccuuccuggcgcccagugcuacaaccuuuaucaaccuuaacccuggugaguaaggcagaagggagcauuccucauccugaggcuggugugacagaaagggauggaagccaaagcagguccucccuaaaguuccuuuguucccuuccuuaccacucaacccucccuucucgcaggcuaccgaguuuaccaaauagauggaaacuaccccggaagcucucaugugguccuggaccacgagaccuacaucuugaaucugacccaggccaacgcagcaggaggcacaccaagcuggaagcgccucuacagggcucgagaaaccuauggacuuccagaugcgaugccugccuccuggcacaaccuggucuaccgcaugagggaugaugagcaacucuuccagaccuucugguuucucuaccauaagggccacccaccuucagagcccugcggcacacccugccgccuggccacucugugugcccagcucucagcccgagcagacagcccugcuuugugucgccacuugaugcccaaugggagccucccagaugcuaauagguuguggucacgcccccuguugugcuaguauuccauguuccagacuggggaaaguucauguaucagaaaagggauacauucccgagugcugcuuaucuaccugaggcaaaagcuucgggggaaggagccagccaggccagggaaacaagccgccucaugagagcuuguuugguuacacuggaggagguuuuggcuguccuacuuaugcccaggaucuggauuaccccuggggcugaugucugaccugggcuuugucgagggcucagugcucuggauagucagacaggagcuauugcccgagccugggcuaauggaccucugaacccuguacuguuaccugauccugcaaggcuguuaaaauaaagagacacacuucagacuccaccg

SEQ ID NO: 4002 - RNA, 6217 nt, Mus musculus
uguacauuaacagggacugaguguuuauuacgugccagacagagcuaaucacuuuacauacauuaucucauuuaauacgcauaaccguaaucgguagcugcuuuuauuagcagcuuuacaacggaaggagcggagcgagcuuauguuccccaggcauuaauccuaaucagcuagaaaaugguggagccauguuugggcucugcuuucagguucugucuccaaccauuugaagauucaaugcccuuacaacaaaaauccucaguggcccauaaaguagggggcuaauaagagaaccagcaccucuaauaaucaaggcagacagcugacuacauaaaggcuaauuaaagccccagaagccuggcuggggauugcaguuaucacugacaaagagucaagucagaguggugugcacccugugcugugggaaccugcugacuggguugguccccuuucuccacccucuagaggggacagaaugcugaagaagucugcaguugucuuuggaccuguaguugaccgcacucaagcccugucuaaagugcugcugggaguuuucuugugauuucuuauacaauuaagguuugacuucaacaagagcagugcagguugcagcaggugcggugagaaugccuuuaucucugcgguagcuacucacuggaugugaaggagcucaggcaggguucaugcuuagagugacaagcaagggucacuaggcuacccaauaguccaggaaguauguucucuacacuucgcuucucccgugcugccagaccucuaagagguuucuuaguuccauuucuccaaagaucaagucugccucuugucucucacccacuuaauuuuucauucuggacugaauucuuauucagacuuuaugagcauuggccuuucuuccucagcuguucgcuacuuacuuuucagaucucagcuuuuaaacuggcaucgccaucccuaccucagucuaagcuagaugccccuuaucuggugcucccacugcaucuuguauccuagcauuucucauuguauuguaguugccugguuacuugucucuaucccccacuaggccuuaagcacugugagcagggacugcguuuuauucacugauguuuccccagggccuaacgcagugccuggcaaauaaaagcacucaguaaacaucggcuguaugauugaaugcaugaugguuagccggcccaacccccucuggacccuaugcucuucagacacauagauugccuuggugcuaacgggaagagaaaaauaaagcguuggcucugaaagugaggggcaucaggccuucggcagcuucucaaacuuagcugcagcucuucugaauucauaggaacugaaugcaagauuacugggcauuucuuaccaauccacccuccucuagucccccacaaauugaccucacugggccugcuuuuaugaaagguuuauuccuagugcuagaacccagucuucugggguucuaagcacaguucaacuggguggguggaugaggggagggcccauucagaugcagggccacaaaugcagcuccccauuauccccaccccuuuggucccaguccccuucucugcaauggacacacauugaggagggaacaaaggguacuggaggcaacacuauuggcccagaggagcccaagaagagcugccauuggcugacagaaccuuuugagguccugucuuuggucaggggcacaucccaagagcuggggauaggccugaggagugaugccauuggccagggaguguuuugucauagccuuuggcuguggagugaaaggaaaagaucugggaaugaagcccaguggccaggaagauaaagggcaggacagcagcuucugggccuacgggccuacgggccucuucagaccacagcagugggcaaaacuggugucagaccccagucagaaaaaacgagcccaagccagcaaguaaguggcaaaggacaucccauguccaaucuccuccacccuggggcugccccgcccaguguccuucuugauagccaaguugggcugggagcugcucacugcuccucuaaccaggaaggcuucucggcuccuggaggccgcagcuugauguugaacugcugaagagucugcuccagcuguuucugguucccagcgaaguaggcagacacggcauuguggaagagcagcagcugcuugugcaucaccuugaucugggggcccagcagggucagcuaaggcuagacucaggcacccucagggaggggcuacaagccuaagcccagacacaguccagagcaaauagacucugcugacaguguuuugggguagggaguuuucaagaagucaaaagagaaggggcaauaugaagaaagaaaccugacuuaaucugcuggguuuaggguucuggaaccccagccaaggggcaauguuuuuuucaguuaugcuacugggacuagaagccagugaugaggagggugaacugaaagugcucagguuucaaggggcuaggggaacaacccacucccuagccaggggcagcuccgcacccaacaaucagaagggucugaagggauagguacugugucuuaggacuuaggugacuuaggaccaagggaguagggcagcaccuuguuuucuuccaggaacuucagcuugauggccacaucuccccgcagcuucucauauuugucccgaugggucuggaaaguggccugggcacucucaagucgaccacgagucccugcaucccggggcccuaggcucagcucuucuaagucuguccgguaggcaucauauuccagccugggaagggggugauaaaggcuggucuccaccucuucauccacacucauauuuccuuuccuuucugaaucuguaugccccuaauguuugcauuuucacccaugccagccaacuucccaaaccgugggcccacaccuggcagccucauacuguuugacagucaugagugugucuuccauggucuuggugaccaguguguugaugcuagagacaaagaaguucacagccccuagcagcgucuccccauucuugcacagcagcuuuugugucucugcauuauagccaaauuccuccuaagggcagaagggaggcacaggcauugaguaacacuccuuaccugacugcagcuguagagcccuucauaucccuccaucccaaagaagaaacagccaucaaaacuacaacaaccagacugccucuagcaaggcucucuuagccacaaaguuaguagggucccuuggcgaugccugagguaagaguguggggaguacgaguucuuaggugaguuuacaagacagaacacggagagcuagugcagcaggcagggagggaaucugauuaggccaagcaccaaaggcauucuugaugauguggagacagguuacuuaugagguacuggugagcccucucccacaacccuuccaacuucugggccucuguacaaacccuuaggcugccuccauaggugagugaugcugggggcaggacugggcgcaccccagagggguucucccugggggcugcaggagggagggagggagggaggcugaggaaagccugccuggaaggaccagggcccaguacccccacccucuuuguuuuggcugaggcaccugaagcucuggggacuucuggcugaggucagcaaaggcaucaccuagugcaugcugggucugcaacaggcuguagaggugggcugucagugcccggcccagcugcaggacacuuucauacuugcgcuucgucucacgcagcaacucaaucugcagcucuagcuccagauccacaguccgggagccucggccaaaucucucugauaacagcugcuuugugcacugauuggaagggggggggggugaggucagaaaucuaaacuccaccccaacaaugaacuacuccagcacccccguucucuuagucauagcaaagacuacacaguaagaccuggggaaagggaaaagguccccacggagaauuucugaggagaagcacuugaaucuuaccuuauauguguugaugccccauuucuugacgaugucaaacuuuucuccagcgaugccccgggccaccucgucaccagggccagagggugacgugcugugagauggaugucggccagacccuaaaggaccaaguucucugacaccaguuucucuuagauaaaaccauacacuucuguggcucacuccucccccccacccccccaaacacacgaaaugaccucucugaagaaggacuaucuagacagacaacugcauucuucuggucacuagggggaacaaggacucauguccugacaaccaaaucaauucaauguauguaucuggcauucuuggaguaggguaggaguguuguugguguacgagauaagcgggaauagaagcaaacaugacaugugcgauuggcaggaucaaagauggugaacacagaaaaacagagaaguuggcuuauauuucuagguagaauucuagccaguaaaagagucuaaaaugaaacucugagaagccucacaaagcuccaaacuggccuuaagcuccugagugcucauaaccuuaaggucuuaacuuggcucagaugguggcggcaaggaggagaagacgagugagauuaucuucgagacugacuggccagugggaggcagaugggcaacucugggagcuggccugggacuggacugucuaugaacuucacaccagcaguucgcaagcucuccaguccaggagucaagcuuuccuguaugugucuaugugccugcaaacugucucaacaccccaccccucaagccuaucucuaucauucauaccuguggggaugaguccgucaccagagcccccauagccaccagacacaaugcuaguuucauugagguuggguccugacaccaucaccugcuggagguccuauaggucagagaagaggggggcaccucaggaacacagggauggaugaaacauuuuggggacggagacagugcauaguaaagucuguacagaaccauaaagaagauuugaaaaguaugaaggaguuuaguuaacugaaggcuaccgggacaggggaaauuaaagguuuauaagucaggaauguauaacaaaacaaugagaagaaucaaacagaagcaccugcuccagcccaucgucuucaggaagcugcccagcuucgccauuuccguggaugggaaucuccauuguggcugccuucccuagaaucccguccgucauggcuagggaagggacuggagucaaggucuccaccccagcacgcuguaaagcccaacacagacaauucuggaaacuggccagcacuccagaacaaggaggccuucccuguguucucagagguuucagggguugucuuugggcuuggguguccugggaucagccaccacggcuuuccuugaguuuguguguuucuucucuucugaggacauuaucucuacagaugcaugcauaccaaagccucgggugucuucucauaaccccccuaccucgccuucaguaaccauucaugcauucagucauucaacaacuaucuagugagugucuauuaugagugagauacugaggcaaugggauuauagcagugaggaccagaggggaggucuaugcucucugggaacuuaacccugcagaggcaauguuuaccagaacccuuuccuaggcucagacucucacuugccacucaggcaugcucuacaauccuggucuuucacauucuuugguguuccuuccccucuuccuucagccggucugggcucuuccuuucuccaucucaugcaccugacucccuuaggcccuccccagcaggccuugguugaagcaguuagugaauguuccuggugucaggugaaaggcucucuuucccaggacacgggcaaucccuuccaaagucagcugaagccucccagaugugaggggcuccccccacccccauacaccugggcaucagguguguccucauccuugccaagggcucagggcauuuugcccucaguacagguucgugcguucaacuucccuucguccaaguauguccuucucaccugggccgggccgcucuuccccucagggcgcgaggcccggaccgcgcggggaccucggguuccaguucucgucgcgauccuagcagcaggucagagauuuggcggaagugacaugcucucugggcagaagaagccggccacgucgcagagaaaaagggcggaagugacguuug

SEQ ID NO: 4003 - RNA, 6217 nt, Mus musculus
caaacgucacuuccgcccuuuuucucugcgacguggccggcuucuucugcccagagagcaugucacuuccgccaaaucucugaccugcugcuaggaucgcgacgagaacuggaacccgagguccccgcgcgguccgggccucgcgcccugaggggaagagcggcccggcccaggugagaaggacauacuuggacgaagggaaguugaacgcacgaaccuguacugagggcaaaaugcccugagcccuuggcaaggaugaggacacaccugaugcccagguguauggggguggggggagccccucacaucugggaggcuucagcugacuuuggaagggauugcccguguccugggaaagagagccuuucaccugacaccaggaacauucacuaacugcuucaaccaaggccugcuggggagggccuaagggagucaggugcaugagauggagaaaggaagagcccagaccggcugaaggaagaggggaaggaacaccaaagaaugugaaagaccaggauuguagagcaugccugaguggcaagugagagucugagccuaggaaaggguucugguaaacauugccucugcaggguuaaguucccagagagcauagaccuccccucugguccucacugcuauaaucccauugccucaguaucucacucauaauagacacucacuagauaguuguugaaugacugaaugcaugaaugguuacugaaggcgagguagggggguuaugagaagacacccgaggcuuugguaugcaugcaucuguagagauaauguccucagaagagaagaaacacacaaacucaaggaaagccgugguggcugaucccaggacacccaagcccaaagacaaccccugaaaccucugagaacacagggaaggccuccuuguucuggagugcuggccaguuuccagaauugucuguguugggcuuuacagcgugcugggguggagaccuugacuccagucccuucccuagccaugacggacgggauucuagggaaggcagccacaauggagauucccauccacggaaauggcgaagcugggcagcuuccugaagacgaugggcuggagcaggugcuucuguuugauucuucucauuguuuuguuauacauuccugacuuauaaaccuuuaauuuccccugucccgguagccuucaguuaacuaaacuccuucauacuuuucaaaucuucuuuaugguucuguacagacuuuacuaugcacugucuccguccccaaaauguuucauccaucccuguguuccugaggugccccccucuucucugaccuauaggaccuccagcaggugauggugucaggacccaaccucaaugaaacuagcauugugucugguggcuaugggggcucuggugacggacucauccccacagguaugaaugauagagauaggcuugaggggugggguguugagacaguuugcaggcacauagacacauacaggaaagcuugacuccuggacuggagagcuugcgaacugcuggugugaaguucauagacaguccagucccaggccagcucccagaguugcccaucugccucccacuggccagucagucucgaagauaaucucacucgucuucuccuccuugccgccaccaucugagccaaguuaagaccuuaagguuaugagcacucaggagcuuaaggccaguuuggagcuuugugaggcuucucagaguuucauuuuagacucuuuuacuggcuagaauucuaccuagaaauauaagccaacuucucuguuuuucuguguucaccaucuuugauccugccaaucgcacaugucauguuugcuucuauucccgcuuaucucguacaccaacaacacuccuacccuacuccaagaaugccagauacauacauugaauugauuugguugucaggacaugaguccuuguucccccuagugaccagaagaaugcaguugucugucuagauaguccuucuucagagaggucauuucguguguuugggggggugggggggaggagugagccacagaaguguaugguuuuaucuaagagaaacuggugucagagaacuugguccuuuagggucuggccgacauccaucucacagcacgucacccucuggcccuggugacgagguggcccggggcaucgcuggagaaaaguuugacaucgucaagaaauggggcaucaacacauauaagguaagauucaagugcuucuccucagaaauucuccguggggaccuuuucccuuuccccaggucuuacuguguagucuuugcuaugacuaagagaacgggggugcuggaguaguucauuguugggguggaguuuagauuucugaccucacccccccccccuuccaaucagugcacaaagcagcuguuaucagagagauuuggccgaggcucccggacuguggaucuggagcuagagcugcagauugaguugcugcgugagacgaagcgcaaguaugaaaguguccugcagcugggccgggcacugacagcccaccucuacagccuguugcagacccagcaugcacuaggugaugccuuugcugaccucagccagaaguccccagagcuucaggugccucagccaaaacaaagaggguggggguacugggcccugguccuuccaggcaggcuuuccucagccucccucccucccucccuccugcagcccccagggagaaccccucuggggugcgcccaguccugcccccagcaucacucaccuauggaggcagccuaaggguuuguacagaggcccagaaguuggaaggguugugggagagggcucaccaguaccucauaaguaaccugucuccacaucaucaagaaugccuuuggugcuuggccuaaucagauucccucccugccugcugcacuagcucuccguguucugucuuguaaacucaccuaagaacucguacuccccacacucuuaccucaggcaucgccaagggacccuacuaacuuuguggcuaagagagccuugcuagaggcagucugguuguuguaguuuugauggcuguuucuucuuugggauggagggauaugaagggcucuacagcugcagucagguaaggaguguuacucaaugccugugccucccuucugcccuuaggaggaauuuggcuauaaugcagagacacaaaagcugcugugcaagaauggggagacgcugcuaggggcugugaacuucuuugucucuagcaucaacacacuggucaccaagaccauggaagacacacucaugacugucaaacaguaugaggcugccaggugugggcccacgguuugggaaguuggcuggcaugggugaaaaugcaaacauuaggggcauacagauucagaaaggaaaggaaauaugaguguggaugaagagguggagaccagccuuuaucacccccuucccaggcuggaauaugaugccuaccggacagacuuagaagagcugagccuagggccccgggaugcagggacucguggucgacuugagagugcccaggccacuuuccagacccaucgggacaaauaugagaagcugcggggagauguggccaucaagcugaaguuccuggaagaaaacaaggugcugcccuacucccuugguccuaagucaccuaaguccuaagacacaguaccuaucccuucagacccuucugauuguugggugcggagcugccccuggcuagggaguggguuguuccccuagccccuugaaaccugagcacuuucaguucacccuccucaucacuggcuucuagucccaguagcauaacugaaaaaaacauugccccuuggcugggguuccagaacccuaaacccagcagauuaagucagguuucuuucuucauauugccccuucucuuuugacuucuugaaaacucccuaccccaaaacacugucagcagagucuauuugcucuggacugugucugggcuuaggcuuguagccccucccugagggugccugagucuagccuuagcugacccugcugggcccccagaucaaggugaugcacaagcagcugcugcucuuccacaaugccgugucugccuacuucgcugggaaccagaaacagcuggagcagacucuucagcaguucaacaucaagcugcggccuccaggagccgagaagccuuccugguuagaggagcagugagcagcucccagcccaacuuggcuaucaagaaggacacugggcggggcagccccaggguggaggagauuggacaugggauguccuuugccacuuacuugcuggcuugggcucguuuuuucugacuggggucugacaccaguuuugcccacugcuguggucugaagaggcccguaggcccguaggcccagaagcugcuguccugcccuuuaucuuccuggccacugggcuucauucccagaucuuuuccuuucacuccacagccaaaggcuaugacaaaacacucccuggccaauggcaucacuccucaggccuauccccagcucuugggaugugccccugaccaaagacaggaccucaaaagguucugucagccaauggcagcucuucuugggcuccucugggccaauaguguugccuccaguacccuuuguucccuccucaauguguguccauugcagagaaggggacugggaccaaagggguggggauaauggggagcugcauuuguggcccugcaucugaaugggcccuccccucauccacccacccaguugaacugugcuuagaaccccagaagacuggguucuagcacuaggaauaaaccuuucauaaaagcaggcccagugaggucaauuugugggggacuagaggaggguggauugguaagaaaugcccaguaaucuugcauucaguuccuaugaauucagaagagcugcagcuaaguuugagaagcugccgaaggccugaugccccucacuuucagagccaacgcuuuauuuuucucuucccguuagcaccaaggcaaucuaugugucugaagagcauaggguccagaggggguugggccggcuaaccaucaugcauucaaucauacagccgauguuuacugagugcuuuuauuugccaggcacugcguuaggcccuggggaaacaucagugaauaaaacgcagucccugcucacagugcuuaaggccuagugggggauagagacaaguaaccaggcaacuacaauacaaugagaaaugcuaggauacaagaugcagugggagcaccagauaaggggcaucuagcuuagacugagguagggauggcgaugccaguuuaaaagcugagaucugaaaaguaaguagcgaacagcugaggaagaaaggccaaugcucauaaagucugaauaagaauucaguccagaaugaaaaauuaagugggugagagacaagaggcagacuugaucuuuggagaaauggaacuaagaaaccucuuagaggucuggcagcacgggagaagcgaaguguagagaacauacuuccuggacuauuggguagccuagugacccuugcuugucacucuaagcaugaacccugccugagcuccuucacauccagugaguagcuaccgcagagauaaaggcauucucaccgcaccugcugcaaccugcacugcucuuguugaagucaaaccuuaauuguauaagaaaucacaagaaaacucccagcagcacuuuagacagggcuugagugcggucaacuacagguccaaagacaacugcagacuucuucagcauucuguccccucuagaggguggagaaaggggaccaacccagucagcagguucccacagcacagggugcacaccacucugacuugacucuuugucagugauaacugcaauccccagccaggcuucuggggcuuuaauuagccuuuauguagucagcugucugccuugauuauuagaggugcugguucucuuauuagcccccuacuuuaugggccacugaggauuuuuguuguaagggcauugaaucuucaaaugguuggagacagaaccugaaagcagagcccaaacauggcuccaccauuuucuagcugauuaggauuaaugccuggggaacauaagcucgcuccgcuccuuccguuguaaagcugcuaauaaaagcagcuaccgauuacgguuaugcguauuaaaugagauaauguauguaaagugauuagcucugucuggcacguaauaaacacucagucccuguuaauguaca

SEQ ID NO: 4004 - RNA, 571 nt, Mus musculus
gcuuuuuuuuuuuuuuuuuuuuuuaaauguugacuuuaauaaguguacagggcagcuuguggggcagcugaccgagauacacaguguaggagauacaagugaccaccuggaguuucuauacuucauucugcucacagaauauuuauuaagguuguuuaauauaugacuuuucauuugacauuguggaaguccuuuauuguaaagcuaacccuucugucuggugacaagcagcagccacgacggucacucuggacccccacacuggauaaauuccauuuccucuugagacauagguuuccuucuguauuucugagguaaugauuuuauaauuucugcagugucugguggccccuggugcaucaguaaaucgggggacguacuuccuuuagaaugcugugaaauugcagaggagugggaggggagcgcugcagaccccaaagcuucugaggcacugaguuuacguuugucucuucuguuagggaacuuuauuaauggagcauguggcuucacuaccugcacgacccugguggcggaagccaucuugcugcccaucgugaccccccuaagaaua

SEQ ID NO: 4005 - RNA, 571 nt, Mus musculus
uauucuuaggggggucacgaugggcagcaagauggcuuccgccaccagggucgugcagguagugaagccacaugcuccauuaauaaaguucccuaacagaagagacaaacguaaacucagugccucagaagcuuuggggucugcagcgcuccccucccacuccucugcaauuucacagcauucuaaaggaaguacgucccccgauuuacugaugcaccaggggccaccagacacugcagaaauuauaaaaucauuaccucagaaauacagaaggaaaccuaugucucaagaggaaauggaauuuauccaguguggggguccagagugaccgucguggcugcugcuugucaccagacagaaggguuagcuuuacaauaaaggacuuccacaaugucaaaugaaaagucauauauuaaacaaccuuaauaaauauucugugagcagaaugaaguauagaaacuccagguggucacuuguaucuccuacacuguguaucucggucagcugccccacaagcugcccuguacacuuauuaaagucaacauuuaaaaaaaaaaaaaaaaaaaaaagc

SEQ ID NO: 4006 - RNA, 5659 nt, Mus musculus
cuggccuuuuucaaaaucuuuauuccuuuaggccuggaggcaucuaacugguucaaaaucccgagaccuauuugcuccuagaggaaacuccuaggucuuauucuuaggaagucguaaacaagccuauaugccugguuucaaggcagacgccuccugaaugagcucagugugucaaccuagcucaccuucccucagcacuacgccaagaacuuguauauucaguaccuguaguuuuccuaggacacacagacugugccaauaagcagcccaaucaguuucugcuguugaacagauuccagcuucuguauuacccccuuccaaggaaagcuucaaacacguuaagucucuaaagagcaaauaagcccguuuacaugccuauaucaaacucccccagucuuucucggucacaucuacauuacuuauugcucaaccguuaaggcaguaggggugaucagacacagugagaucaacgacacacauagccauagcugguuuauucagcaccucuuacuagucccagcucuagcuguagcuuuccucagugaacccauuuaacauacuguaagacaagaagguuacauuuuucaaaugagaaauagaauauucagaaaguaaaugauuucuucagcuaaauaugguggcccaugccuguguucccaauaaucaggaggcugaggcaggaggauugccauuuguuuuguuugaggucagcuuggacuagugugagauacugucucaaaacaacaacaacaacaacaacaauagcaacacagaaaaaaauuagaugauucccagcuccaagaaacaaagaaauuaaauaacucccagccccaaguggcaaacuagcauugggaccugccauaaggcaaaaacugccugucuguagucuugaagcugaaggagcagaaacuauggaugagcagagguggacaauauuggucagaagacaacacagcggagagcccacgugccuucugagagaugaagagaaagcaaacccagagauccaucaguucucagccgacuaguuuccacaauacugaagugacccacaauuauuagacacauccaugcccucacaauaaacaccucauucuugagccugcccaaguaauuuuaugcuuucuguauccaagaaggcuccauuagaguagagcugagcuggaggcuuuaccacaguguucuugguacagaaggagggugguaccagauccuggcucauagccuggguagauacagucuucagaguucugagacuggagucugagcucuccccuuccaauggguguccaucggucaccugcgcuuguagagacagggcugaaguuuaaggccugagaguugggcuuuggguccuacucgaggagguccggucuuuucaaagucaaacaagaagaaguggcuguuggucagguccuagaagcagagaauaccaaugagcuacaaauuuucacuccaaccacacaucucaguguuuccccugcucagagagcaucucacagccccucccagagcuuugucuugaaagagcaaaauucccaucucuggguuuacagccucccuccugaacaccauuaucugaaagagguuaagaacugggcagacuucucggggacccccucaccuuguagauaaucuuaaagccgaguuuggucacagcccccaaaaagguccgaauauccucaaagcggcugcugacuucagcuacuuugagaagaccccugggaaaaggaggaagucaugugugaaggggugggcaccuguaugcacaucaaaaccaucuguguucuagggacucacucacccuguuuuuagcacucgauuugccuccucaaggaagucccugauguuaguucccaucagugaaaggcaaaacacagccacaucuacagauucauccuccagaggcaccugaugaggaagaauguucaagagagcacacagugucggaagaggaaauucagcaccaaaugcuugaacuggauaaucggauaggaagacuaggaagaaggguuaggccagacacacagaggggcuuaccugggccaugucacauacugugacccugggguccagagaagccaaaucaaaacagugcacaggguuccggacacuugaagcuaggcggcaaucuccacagccaaagucagcuaccacuaaggaugcaggccugggaguggaagggaggagagggccacuuacuggucuggucaaagucuugaucaccaacaccaccccucucauagugcauagcaccccucacccccauuacuucuggcggagaucuuuggcaauacgguccacugggugcaguggccacuucuuuacuugucucuggaagccacggugauaaaggagaaaagccucagggucuuccuggaauaggcgucgggcagcacugcugggcccugaguacaacuguucauuaagguagcgaaaucgggccccauccaggcguugugucaugcgugcucgcagggcuccagcucuagacucuugacuaucugacuuugggacaggaggcaccucagucuccucuauggaagccuugggaggagccugcucuggugucuggaguggccgaaauuuguucuugugucuccgcuuauuuuucugccgguuccgccacugcuugcggcucagggugugugaggaguuaggugacauagacucagggcuuggcuuggaugggucaauuguagcaguacucguccuggaauugugaacugcagagagggagaugagaaggcauuugagguuugguccccuaaauucagaggcauagcaagucauccuggcuacucccuuguccuuaagacagagucuguagccuggauaaaagugccucuuaccauccaacccgugugcgugcguguguguuuauguaagagaaagaaagaccuuuaucaucuaugcagucaguucacagccuccccacccccauauucacacauacugauaccuguuuggucaacacuguccaggggcuggguuagguguaaagaggaauauuccuggcauuuucucuuuccuuuuucuucuccagcagagaccccaccaagaggaggagcuugucuguggcauuuucuucuuauuucuuuccccucagagucacugauggauggcgccuguuucugacauuucccuuuucuuuucuucccuacuuccuuugagacgcuggcaagugagggccuuuggaggugucucuucuuccuuccuaccuccuccuccuccucagagucacugccagguaggcuggggguuuguugggagagagaugcugcuuccagagcccguaauguggccaagagauggcggcgcuugcgucccuggaggcaaacaagggaugagagugugugugagaauggacgaggccuggagacuaagaaaggagagaugggcuucagcuacuggucguucuucccauccaaaguuaacaaguuugcugugaagucagccaagcccagaacauucaggcugcaaucccacccucugggaaacuggagggcagaaaguguucccauccuacuuuucuaagcguguaaaggauugccuguugauuuccuuagaggaaugugauaagcacacaaacaacaggaccaaggcaagacagcagccaucuuugccucccacugacagcauucuaggagcagcagaggguuuuuuguuuguuuguuuuuuuuguuuugaaacaggaagggcagugucacacaugucuauuaaaaauguuccuaacuggccagcaguggugguacacaccuuuaaucccagcacuugggaggcagaggcaagcggauuucugaguucgaggccagacuggucuacagagugaguuccaggacagccagggcuacacagagaaacccugucucgaaaaaaaaaaaaaaaaaaaaaaaaguuccuaacugcaguagagagaagcugcacacagacaagcagaaauggacuacagaaaugagcagaacauccugggcuaacugaaggucaggaacaccccaaggggauacugaaacccucauaucugaugagguucaaaggaaaaggccugcuuuccgugaagcugauuugggguucaaguccugcugcuuguccucagcuagacccuuaccuugagccucuuuugaauaguaauucugauaaccucccagucacuugccuuuacucuaauauacuuucuacacugccacuaaaaauccucuaaaaauccuuucaagacuacggauucagcucaguaauaaaugcuuaucuaccacgcugaagcccuggaaucgauccucaguauauaaagugaugccaggugagagaaaacuuggagaagccacuccacugcuaaaacaacucuacugauuucuacccuuaguguacaaaaaacuuaaacuuuucaagcucugcgcuccacgcuccacgcuccgaaucccgcauuccuauuuggacuauccggaucuucagaucauaacuaacucccucaccaccccgauccacgauagcauucaggcucucccucuaaccaauacgacccccggaggguaggcuucaccuccuucaaacagcccagugcagggccgcucaccuugacuggcggggcagucgccggccuaaccugugcugucgcggccccuaggcccacgauggcuggggccgccuccacccauucgggcucuucgaacauaccacccguagcccgcagggccggaggagccuacgcucuggcccacgugcagcgcgcgucagggaauccuagggcuggagucggaccaaaccgggccggaagccaccgagugaaauucugugguagcuagagcggccuucgcggagcagagcaccauagagcguagccgcuggcgagcuagagaggcaguaggaggucggaagggagggaccgcggcccgcgcuggcccgagcuggccggggcgggccggggcggggccgggcggcgggcgcggccggacgggaguucccccggagaaggcgccugcggcccgagucccggugaguguggguagcuccgcgcccuaccccacgcugucuugcaaacccgucucugcgaucucugcagcaguucugagccggggccgccgggcaaggaccccuguccccucccccggguguuugcagcuugggucccuucccccacccccaagccuugcucgagggccggggcucagagccggcugacaccaacucgggaaacuagcaaagucuacccuacacccccagacccuccugcuccucgagccaaggggucguccgcugcccgaagcccuucauagacaaccacugucccucucgcgacgcuccccaucccagcacugacaccucuguccugagggaacucacacagagagucauucucuugucucuguucucccucagucccccgaggcuuccccagucccggggucucugugccgggacgcugcuauggacgacauuuucacucagugccgggagggcaacgcgguggcggugcgcuuguggcuggacaacacagagaacgaccucaaucaggggugagcugaagcguuggcgagugagacggcuacaaguccucucuccgcuacucggggugcucaugucuggcgggggcggcugacuuugcuauccaguguaaggaguaguaguaguaagcaaagccuguugauggaggaacgucuacaca

SEQ ID NO: 4007 - RNA, 5659 nt, Mus musculus
uguguagacguuccuccaucaacaggcuuugcuuacuacuacuacuccuuacacuggauagcaaagucagccgcccccgccagacaugagcaccccgaguagcggagagaggacuuguagccgucucacucgccaacgcuucagcucaccccugauugaggucguucucuguguuguccagccacaagcgcaccgccaccgcguugcccucccggcacugagugaaaaugucguccauagcagcgucccggcacagagaccccgggacuggggaagccucgggggacugagggagaacagagacaagagaaugacucucugugugaguucccucaggacagaggugucagugcugggauggggagcgucgcgagagggacagugguugucuaugaagggcuucgggcagcggacgaccccuuggcucgaggagcaggagggucuggggguguaggguagacuuugcuaguuucccgaguuggugucagccggcucugagccccggcccucgagcaaggcuugggggugggggaagggacccaagcugcaaacacccgggggaggggacagggguccuugcccggcggccccggcucagaacugcugcagagaucgcagagacggguuugcaagacagcgugggguagggcgcggagcuacccacacucaccgggacucgggccgcaggcgccuucuccgggggaacucccguccggccgcgcccgccgcccggccccgccccggcccgccccggccagcucgggccagcgcgggccgcggucccucccuuccgaccuccuacugccucucuagcucgccagcggcuacgcucuauggugcucugcuccgcgaaggccgcucuagcuaccacagaauuucacucgguggcuuccggcccgguuugguccgacuccagcccuaggauucccugacgcgcgcugcacgugggccagagcguaggcuccuccggcccugcgggcuacgggugguauguucgaagagcccgaauggguggaggcggccccagccaucgugggccuaggggccgcgacagcacagguuaggccggcgacugccccgccagucaaggugagcggcccugcacugggcuguuugaaggaggugaagccuacccuccgggggucguauugguuagagggagagccugaaugcuaucguggaucgggguggugagggaguuaguuaugaucugaagauccggauaguccaaauaggaaugcgggauucggagcguggagcguggagcgcagagcuugaaaaguuuaaguuuuuuguacacuaaggguagaaaucaguagaguuguuuuagcaguggaguggcuucuccaaguuuucucucaccuggcaucacuuuauauacugaggaucgauuccagggcuucagcgugguagauaagcauuuauuacugagcugaauccguagucuugaaaggauuuuuagaggauuuuuaguggcaguguagaaaguauauuagaguaaaggcaagugacugggagguuaucagaauuacuauucaaaagaggcucaagguaagggucuagcugaggacaagcagcaggacuugaaccccaaaucagcuucacggaaagcaggccuuuuccuuugaaccucaucagauaugaggguuucaguauccccuugggguguuccugaccuucaguuagcccaggauguucugcucauuucuguaguccauuucugcuugucugugugcagcuucucucuacugcaguuaggaacuuuuuuuuuuuuuuuuuuuuuuuucgagacaggguuucucuguguagcccuggcuguccuggaacucacucuguagaccagucuggccucgaacucagaaauccgcuugccucugccucccaagugcugggauuaaagguguguaccaccacugcuggccaguuaggaacauuuuuaauagacaugugugacacugcccuuccuguuucaaaacaaaaaaaacaaacaaacaaaaaacccucugcugcuccuagaaugcugucagugggaggcaaagauggcugcugucuugccuugguccuguuguuugugugcuuaucacauuccucuaaggaaaucaacaggcaauccuuuacacgcuuagaaaaguaggaugggaacacuuucugcccuccaguuucccagagggugggauugcagccugaauguucugggcuuggcugacuucacagcaaacuuguuaacuuuggaugggaagaacgaccaguagcugaagcccaucucuccuuucuuagucuccaggccucguccauucucacacacacucucaucccuuguuugccuccagggacgcaagcgccgccaucucuuggccacauuacgggcucuggaagcagcaucucucucccaacaaacccccagccuaccuggcagugacucugaggaggaggaggagguaggaaggaagaagagacaccuccaaaggcccucacuugccagcgucucaaaggaaguagggaagaaaagaaaagggaaaugucagaaacaggcgccauccaucagugacucugaggggaaagaaauaagaagaaaaugccacagacaagcuccuccucuugguggggucucugcuggagaagaaaaaggaaagagaaaaugccaggaauauuccucuuuacaccuaacccagccccuggacaguguugaccaaacagguaucaguaugugugaauauggggguggggaggcugugaacugacugcauagaugauaaaggucuuucuuucucuuacauaaacacacacgcacgcacacggguuggaugguaagaggcacuuuuauccaggcuacagacucugucuuaaggacaagggaguagccaggaugacuugcuaugccucugaauuuaggggaccaaaccucaaaugccuucucaucucccucucugcaguucacaauuccaggacgaguacugcuacaauugacccauccaagccaagcccugagucuaugucaccuaacuccucacacacccugagccgcaagcaguggcggaaccggcagaaaaauaagcggagacacaagaacaaauuucggccacuccagacaccagagcaggcuccucccaaggcuuccauagaggagacugaggugccuccugucccaaagucagauagucaagagucuagagcuggagcccugcgagcacgcaugacacaacgccuggauggggcccgauuucgcuaccuuaaugaacaguuguacucagggcccagcagugcugcccgacgccuauuccaggaagacccugaggcuuuucuccuuuaucaccguggcuuccagagacaaguaaagaaguggccacugcacccaguggaccguauugccaaagaucuccgccagaaguaaugggggugaggggugcuaugcacuaugagaggggugguguuggugaucaagacuuugaccagaccaguaaguggcccucuccucccuuccacucccaggccugcauccuuagugguagcugacuuuggcuguggagauugccgccuagcuucaaguguccggaacccugugcacuguuuugauuuggcuucucuggaccccagggucacaguaugugacauggcccagguaagccccucugugugucuggccuaacccuucuuccuagucuuccuauccgauuauccaguucaagcauuuggugcugaauuuccucuuccgacacugugugcucucuugaacauucuuccucaucaggugccucuggaggaugaaucuguagauguggcuguguuuugccuuucacugaugggaacuaacaucagggacuuccuugaggaggcaaaucgagugcuaaaaacagggugagugagucccuagaacacagaugguuuugaugugcauacaggugcccaccccuucacacaugacuuccuccuuuucccaggggucuucucaaaguagcugaagucagcagccgcuuugaggauauucggaccuuuuugggggcugugaccaaacucggcuuuaagauuaucuacaaggugaggggguccccgagaagucugcccaguucuuaaccucuuucagauaaugguguucaggagggaggcuguaaacccagagaugggaauuuugcucuuucaagacaaagcucugggaggggcugugagaugcucucugagcaggggaaacacugagaugugugguuggagugaaaauuuguagcucauugguauucucugcuucuaggaccugaccaacagccacuucuucuuguuugacuuugaaaagaccggaccuccucgaguaggacccaaagcccaacucucaggccuuaaacuucagcccugucucuacaagcgcaggugaccgauggacacccauuggaaggggagagcucagacuccagucucagaacucugaagacuguaucuacccaggcuaugagccaggaucugguaccacccuccuucuguaccaagaacacugugguaaagccuccagcucagcucuacucuaauggagccuucuuggauacagaaagcauaaaauuacuugggcaggcucaagaaugagguguuuauugugagggcauggaugugucuaauaauugugggucacuucaguauuguggaaacuagucggcugagaacugauggaucucuggguuugcuuucucuucaucucucagaaggcacgugggcucuccgcuguguugucuucugaccaauauuguccaccucugcucauccauaguuucugcuccuucagcuucaagacuacagacaggcaguuuuugccuuauggcaggucccaaugcuaguuugccacuuggggcugggaguuauuuaauuucuuuguuucuuggagcugggaaucaucuaauuuuuuucuguguugcuauuguuguuguuguuguuguuguuuugagacaguaucucacacuaguccaagcugaccucaaacaaaacaaauggcaauccuccugccucagccuccugauuauugggaacacaggcaugggccaccauauuuagcugaagaaaucauuuacuuucugaauauucuauuucucauuugaaaaauguaaccuucuugucuuacaguauguuaaauggguucacugaggaaagcuacagcuagagcugggacuaguaagaggugcugaauaaaccagcuauggcuaugugugucguugaucucacugugucugaucaccccuacugccuuaacgguugagcaauaaguaauguagaugugaccgagaaagacugggggaguuugauauaggcauguaaacgggcuuauuugcucuuuagagacuuaacguguuugaagcuuuccuuggaaggggguaauacagaagcuggaaucuguucaacagcagaaacugauugggcugcuuauuggcacagucuguguguccuaggaaaacuacagguacugaauauacaaguucuuggcguagugcugagggaaggugagcuagguugacacacugagcucauucaggaggcgucugccuugaaaccaggcauauaggcuuguuuacgacuuccuaagaauaagaccuaggaguuuccucuaggagcaaauaggucucgggauuuugaaccaguuagaugccuccaggccuaaaggaauaaagauuuugaaaaaggccag

SEQ ID NO: 4008 - RNA, 6948 nt, Mus musculus
gggaccgcggcccgcgcuggcccgagcuggccggggcgggccggggcggggccgggcggcgggcgcggccggacgggaguucccccggagaaggcgccugcggcccgagucccggugaguguggguagcuccgcgcccuaccccacgcugucuugcaaacccgucucugcgaucucugcagcaguucugagccggggccgccgggcaaggaccccuguccccucccccggguguuugcagcuugggucccuucccccacccccaagccuugcucgagggccggggcucagagccggcugacaccaacucgggaaacuagcaaagucuacccuacacccccagacccuccugcuccucgagccaaggggucguccgcugcccgaagcccuucauagacaaccacugucccucucgcgacgcuccccaucccagcacugacaccucuguccugagggaacucacacagagagucauucucuugucucuguucucccucagucccccgaggcuuccccagucccggggucucugugccgggacgcugcuauggacgacauuuucacucagugccgggagggcaacgcgguggcggugcgcuuguggcuggacaacacagagaacgaccucaaucaggggugagcugaagcguuggcgagugagacggcuacaaguccucucuccgcuacucggggugcucaugucuggcgggggcggcugacuuugcuauccaguguaaggaguaguaguaguaagcaaagccuguugauggaggaacgucuacacagaggaagcugucggaguuggguuuguuuuuuuuuuuuuuuuuuuuaaacuaaguuucacaauccgguucccgggaacuuugcagccucuaugaacucaugucagaggcagaccugagugccagaaaauugucuggaauuacauguagcuggaggaugaguuucugcgcccuagagcguuggguagaagugggaaaggauauuagaggucuaaaguucugaagcuuauguagugaugagaguacccauuugucaggcgucacccuggacgcaauugccuuaaagugauguuuuggauacaagaauugagacaggguuggggugagagcccuaaaaucauaaggaugaaguaauugaguugguaugggaugugaagggguugucaaagaugaccugggguuuaaaaggagguuuggguacuuggauacuuggcaguugcugagguuccauuauggacuggccacaguuuuggugacacuacagugacuuggaaacgcuuggcagguuguuagucaugcagauuuaaaguucaggaggucggauugggagaccaagaugccacaaauagcauuuaaaugguaucugaagacucuauaauguggaauguaguaccuuagaagaguagaaaauaaaggcagagguugagaagccuggcugacagggaacaaccaucagaauaagaaauaagaaauggauuaagauuagagaauggauguuuuaauaaaagaagagugguuaauuguaggcuacugagaaguuaaagagcauggaugagcauuuaaaaagucucauuucacuuacauuuaggaugaauuugaucuuuugaaugcuauugcagaacaguaacaggaaagugcauuacaguggguuccuucacauaaggaaccacuugugguugcugcuagagucuuugaaucagacauaaucuacacgcuagagauggcaggcuucucagggagaaaagugaaugggaggugaggaaacagauacuaugaacacuuucugaaauacuggcugauaacagaagcaacaagugcaguguugagaguuuaguucguaguuuuugguuugcuuuuggagacagggugucauguaauucagaauggccuccagcucuccauccuacugccucaaucuccugagugcugggauucccauuuguugccacuguaucugacuauaagaguguauuuuuuuuuuuuuuuuuuuuuuagguugggaaggaucaucuuugguccuaggcuagguuucacuagcuuucauuaggcuguauguuauuucucugcuagauucaagguuauuuguuucauuuuuucccacauaacuugugugcucugguaaaaacuaagcuguccuguuuuguugguaagaaaauagaaguuuaggcuguuguccaguaggaguggcaucuuggaagacuccuugcugucaaaaggugaaggauaucauuagggaaaccagaaagcuaugguggcuugaggggacagggcgugggugcuggaggugguuaacucccugaaagcuuucuugagauagagauccaggcccugaggugaccguccucaagcuugggcuugcuuggaggccacagacuucuggaaguuguucagucagaacaugugaaaucugggagacaagagugauagcaagggauagacuuauauccgggaaaagccuuugcugaguuuaacagaugagggcaaacuagaggaacaauuauuuaaagcuacauacuuccuucagcuguugggggauucuaguugaccaagccaggaucagcucaaggccccuccuccaguccccucacaggaagugaccacagcacuaaaguaucuggaggcugcaggccuagaccacagaccgcccccuguuccgccccucagaucugcaucccugggcuggagggaauuuccuuuuauggcuucaggcugucaguuugacccagcccauccaguuguuuuguuuguacacuucucuuuauaaaauauauguccuuaggggaugaaaauacaaaucagguaacgguuuuuauucaaaagcucccauuuacauuuuucucugaguuuuggauugguaaguaggaucauccugguuugugggauuauccgccccaucaguaaugaaaagcauguuugucauuguacccccaaacauuuucguuccauuccauuguuagauguucguuucaguaacagagccaaaaguaagcuuguuuccucuccuaaguuauagccugucuucuccaguaugccuucuccccuauuaaccuacauacaacaucagcuuucaccccauccucaagcauauaugauccaacagucaagauagcucacauuaacagauucuuacaauccagucaguugaacucuacaguaaggagaaaacaacgcaaacaaaggauuauagguguggcuaaagacguaugaacugaagauaaagcaugugucaaguauacaagguccuggguaugguuccuagcacugucaaacgggaagacaagagaguagggaagccagaggaccccaggaagaauacuaucaccuaguggacuagaacugcuagggaaggaguugugguuacagugauaaaccuuacaguuguuggggcaucuaggugcuugggugugaaccucaugggaagucugaacugaacuuuaggaauugccaacgugaguaggagcuaaguccuaaagaggcaagccuucucgcugacuauagaaucccuuuucccccaugaaucaaagcuuuuguccuucccaacuccagcuuacugucugugcccuuuucucaaagggaugaucauggcuucucccccuugcacugggccugccgagaaggccgcucugcggugguugaaaugcugaucaugcguggagcacggauuaaugugaugaaucguggggaugauaccccccugcaccuggcagcuagucauggacaccgugacauuguacagaagguacaugcaaacccuucaccacccacaucucucucacacacacuaugaagccaguaauaggcacugucaugugaagaaugugugcuagucuuucuuucuuuaugccuggacacaagucucucacagggacugacugacugccuuuuucuuuucuuggccauggggcgcagcuguugcaauacaaggcugacaucaaugcagugaaugagcacggcaaugugccacuucacuaugcauguuucuggggccaagaccagguggcagagguaaguacucagaccccaaguccuaugaugaaugggaagcaaaccgagcacggaaccaucaauccauucugucagcccuacuguuugacauuuacagaauuauguacugcaucuguguucaugcuuguuugugacuggcccccugaacaauuuucuuuucaggaccugguggcuaacggggcucuugugagcaucuguaacaaguauggagagaugccuguggacaaagccaaggcaccccuuagagagcuucuccgagguucauuaccuaccccuaguuugucucuugccccaccuugcaucuccucccuccacagcacaauuaaggcuaagaucauucuucuucucuagaacgggcagagaaaaugggccagaaucucaaccguauuccauacaaggacacauucuggaaggggaccacucgcacaaggccccgugagucacuacugugggcaggggaggggcugcagcacaagauucuugggcuacuggggucauguuaaggugaagcuggguacauuaccugcucauauuuucaggaaaugggacccugaacaaacacuccgguauugacuucaaacagcucaacuuucuggcaaagcucaaugagaaucauucuggagaggugauccccacccuuuuuguuucucccuucguaacacccacaaacugcccacucuguaucccuaauuaagguuuuucuucaaguuaguagaaaagaaacaguacagccugagauaaugcuuccuauccucuguccuucagcuuuggaaaggccgcuggcagggcaaugauauuguugugaaggugcugaagguucgagacuggaguacaaggaaaagcagggacuucaaugaggaauguccccggcucaggugggacacugaauuggaagcuguuguguccaaggcaccccaaguaguacugaaaagugagauucuguugggucucaccacucuuuuccuccccaggauuuucucacacccuaacgugcucccagugcuaggugcuugccaggcucccccagccccccacccaacccucaucacacacuggaugccauauggaucucucuacaauguucuacaugaaggcaccaguaaggauguuggucuuguuggggagggacuagaauaggggaaggagacccuaaaugaaugauucuugcuuccuguuagauuucguuguggaccagagccaagcuguaaaguuugcuuuggacauggcaagaggcauggcuuuucuucacacacuagagccucucauaccccggcaugcacucaauagccgcaguguaauggugagaccacaguucacuucugguccgaaaagcccuuugcuggccuagaauaggacccaccuuuuuuaacuuaacuucucuuccucagaucgaugaagauaugacugcccgaaucagcauggcugauguuaaguuuucuuuccagugcccugggcgcauguaugcgccugccuggguggccccugaagguagguaaaggcaucguaugggaaauugaaaagaaccagcugaauaacaauagaugagguacagacuagacagguuaggaagcuggaauaguaagccuuauuccuucuagcccugcagaagaagccugaagacacaaacagacgcucagcagacauguggaguuucgcggugcuucugugggaacuggugacacgagaggugcccuuugcugaccucucuaauauggagauugggaugaaggugagcacagaacuacagauacuuguuuagggguggugguacugacaagcacugugguaagcgcuuccagcaguuuauacagauaaauaguaaucuuaccauucaaggaucaaaggcuuuuacccauaugaugaacucaaauucugaagcucaccuuauuccuuguaauuugcagguggcacuggaaggccuucggccuaccaucccaccagguauuuccccccauguguguaagcucaugaagauuugcaugaaugaagacccugcaaagcgacccaaguuugacaugauugugccuaucuuggagaagaugcaggacaaguaggaccuucagguccuugcccaaacuccagaagugucaaaacauggcugggggaguacacuucuccaaaguuaaagaccucugguugccuccccugucucuaaucaugguacuaccccaguuaugggacuuguucccugcucccaucccuaccacuguagccccaaaaggggcugggcucagagcuuugucacuugccacaugaugucucccaacaugggagggaucagccccgccugucacaauaaaguuuauuaugaaaacaggcucguguggggacagagggaaagacaaauacaucuggguugcguggcucaggugaaguagugcggcuucuucacauugaugccauacucgcugagggcaggggucaaguccuccaugguuaggguguacuugcgauccugggggaaagagggaagaccaccagcugagcacaagugcagacuccaauccuuugugggugacccugagcaggcccaauaccuccccuaggauucugcuuccccaaaaggcuuucaggauaaguuaggccuguacugcaguggaaggugagccucucacaccuugcucuugcuccgggagcugccagaggcugugcccuucauuuugcagugcuguagggcaucauuggcaauaucugagaugaauuucugggcagcuagugagaugagccgaauucuagagaggaagagggugguaguaaugagaauauuuagcaaacuccaccuagcacucaacagucuaaccugcuccgaguuuacucacaugcgugggucugaagcuucaaagccagcgcgguucagguaguaaccagucacugcaucugggaucugaaaaaucaaauuaaacagccaucaguguuagaucugccuauugaugcgcuggcug

SEQ ID NO: 4009 - RNA, 7427 nt, Mus musculus
caugcucaugugacuuaucacaugacuacagaucagccugaaagccaaaaugggacuccaagcccggugagaaacugagguggggaggguagcuaagggggauuacauuagagggauuacauguuguagaaggaguacaaugaggguucggcuccugaugaaacccaccugcugucccugcagccuccuagggcuccuugcucucgucaucgccggcaaaugcacuuacaacccugagccggaccagcgguggaugugaguugauuuaguacuacaggugccugucucugcagacgcuugguccuagcuuuccucauccucaacugcuccuaguacccacucuguagccuuauucgacacccccucggcuuaaucucuggucauuuaucuccuaugauccuuaucugcaucuaggauucgacccaaagucucaguucuuaaucccaaacuuuccaugaucuggauuucucguuauggccuaaucaaaucaugucccugacccuguaggcugccuccaggcugggugucccugggccgcguggaucccgaggaagagcugagucucacuuuugcgcugaaacagcggaaccuggaaagacucucggagcuggugcaggcugugucggauccuagcucuccucaauauggugccuaucaguuggggcaggaagugggaggcaggaccaggcaggcacuggcuggugcagaucauguagggccauguuucugguaugacagacaaaugacaauaacugccauauucauacacacacacacacacacacacacacacacacacacacaccaaaauuuccaccugaguucuucagucuuaaaacuaagaacaaaucuaagccuaguagcaugagguaauaauccuagcuacuuggacuaaaacaggacgauuuugaauccaaggcaugccugggcaguguagcaauauugucaacauuaaaaccaauuuuuuuuagaggccuagcuagcucauugauagggugggugcuuacggagcauaugaaaaacccuagguucaagugccaggaagauggugggugugggguagcuagcuguguuuaagaacacaugauucauaaucagaucuagauugaaauguucacuuacccuaccagcucucaaauggaggacuagcacuuagugugugugcaugaucaagucauggaccuuaccccacucucauagccacugccacacccuccucuguugcuaguucaaguccuaaauugucuuuggauuaauccacucuggccauuccucuugcuaccaacucaguuguuuauucucuuucuggauuacugcccaguacccggacugguuugaagcuuccucuccuucaccccacuccccagaacagucccuucucuauucuagaguauucucuauggugcucaggcuggagugaauccuuccccugcuuaaaguccuguauggugaggcaaggguguguguguguguguguguguguagaauggaggcgagaggaggggggggcauccuuagagcacccaagaagcuccucauaugcaggaaagaaugacucaccguuauguuguuuaaaaucaacaaggaugaagagcugagcuaaauuagaagguucuguauaacuggcuccaaaaguuuggggaaaucuuuuugaagauaagcuuaaaaugggauauugaaaguuuacuaacguccuugaguuuuugugaccaugguaacacaugcugugcauuuuuccuggccaugacguuucaugucucucgagccuuuucuucccuuugacucucacuaugccuagcccuacacaguccuccucgggaaguuuugauguccucugauugagguccagacagacaacccaggaaagccucaaaugaggacgagagccucuucugaaucccugcaggaaaguaccuaacccuggaggauguagcugagcugguucaaccaucaccccugacccuccucacuguccaaaaguggcucucagcagcuggagcccggaacugcgauucagugaccacccaggacuuucugacuugcuggcugaguguccggugagaaguaaugauuuccccauagaauccauugucccuacaaggagacaaaauaccccaauugggggaguuuaaagcgugcugggagccuguggguauagguaaugcauacggaaaugauggcaggcugcuaaguggggcucaggccaacucuucuacuccuucccaugguuucuguuuucuuacuuccagacaggcugagcugcugcucccaggagcugaguuucaucgcuauguagggggaccuacaaagacccauguuauaagguccccacaucccuaccagcuuccccaggccuuggccccucauguggauuuugguaaacccaauggaguugguggaaguugugggagggaggucuacaggcugaagaauuuuagaugccaaaagaggcauagaaucuuuccaguagagaagugggugguagugucuguaagaccuccuuaagccugaccccuuuccacagugggggggcugcaccguuuccccccuucaucuccaagacaacguccagaaccacaacagguaggaacuguuagccugcacuugggagugacuccgucugugcuccgucagcgauacaaccugacagccaaagaugugggcucaggcaccaccaacaauagccaggccugugcccaggugagccauguaaagcccugcggucaucacaaccuccucaagauaucuuuagugccucacuacccugggccucacucucugauccacaauuccugauuuggauguuuccacaguuccuggaacaguacuuccauaacucggaucugacugaguucaugcgccuauucgguggcaguuuuacacaccaggccucaguagcaaaaguuguuggaaagcaagggcgaggccgagcugggaucgaggccagucuagauguggaauaccugaugagugcuggugccaauaucuccacuugggucuacaguagcccugguauugcuaagagaauuaguugggggaugggaaaauggguuggaguagacuuuuggucucugcuucauuucaucaaggggaugccaugggcugaagggagauucuagcaaccauccaauggccauucauaucccuucuuuuaaaacaauucaggccgccaugaggcacaggagcccuucuuacaauggcuccugcuucuuagcaaugagucaucuuugccacauguacauacugugaguuacggagacgaugaagacucccucagcagcaucuacauccagagagucaacacugaguucaugaaggcugcugcucggggucucacccuccuuuuugccucagguaaccuucuaccauaaauuuaagacuucccaccuacccaagcggcagacuuuaucccaaccgacccuucagccugguuucugacucauaauaggaacucagagccuuaacagggucugcugauuugaccugaguacucugagguggcauauacaguucuucucugguauauagaagccuacaccccaaguucuucacaacuaaucugaauacuuacuaugucuuucccaggugacacuggagcuggguguuggucugucuccggaagacacaaguuccgcccuagcuucccugcuuccagguaaguaccccacucuuucacuugugacagaggccaccaggagcugcuguggcucagccuucagcauuaccuguuguguuugcugugcucccuuuucuuccugcguaucccaggcugcgagagcagauuauggcguuucuuuuccuuaguugcuaggguuuguugcuuguuuuucauguagaaaaguauauacaauuaacuccagccaugucuugagagcucccaaucuaucaauaaacucuguauacaggcuucuauagucuuacucccuuuuccaguaagacccagaccauucccacccaccuccacacaucuuggaggucacccauugucuuagucgggguuuuuauuguauugcugcgaugaaacaccgugacaaaaaaacaaaacaaaacaaaacaaaacaaaaacaguugaggaggaaaggguuuauuuggcuuacacuuccagaucacauccgucacugaaggaaaucaggacagaaacucaagcagggcuggaaccuggaagcagaagcugaugaagaggccagggaauggugcugcuuacuggcuugcuucccauggcuuguucagccugccaucuuauagaacccacgaccaucagcccagggaugccacccuccacaaugggcugggcccucccucauugaucacuaauugagaaaauguccuacagcuggaucucauggaggcauuuccuuaacugagcuuccuuugucucugaugacucuuguaucaaguugacaacacaaaacuaaccagcaaguacauucacuaucugaauacugucuucuccucagccccuauguuacuacaguuggaggaaccuccuucaagaauccuuuccucaucacagaugaaguaguugacuauaucagugguggaggcuucagcaauguuuucccacggccucccuaccagguuuguggauauuccuguggauaucuggagguugaaggugauggguggggcucaguccugcagcuugcugagcaggcugcuggccaauacucauacucagaaauguccuucaggaggaagcaguggcccaguucuugaaauccagcucucaucuaccaccauccaguuacuucaaugcuaguggccgugccuacccagauguugccgcacuaucugauggcuacuggguggucagcaacaugguccccauuccauggguaucuggaaccucgguaagaaucagcucugcucuaaacgcucuacucaggaacuacccucgcuccuccaccuacacaaucuaaacgcucuacucaggaacuacccucgcuccuccaccuacacaaucuaaacgcucuacucaggaacuacccucgcuccuccaccuacacaaucuaaacgcucuacucaggaacuacccucgcuccuccaccuacacaaucuugaacccagaacccccgacuccuuggagacuccugaucuuugcaagcaucaucccuuagaaguccaaucccucuaaaacccuaaccuauucuugcaucuucaucuugcaggccucuacuccaguguuugggggaauuuuauccuugauaaaugagcacagaauccucaauggccgcccuccucuuggcuuucucaaccccaggcucuaucagcagcaugggacaggacucuuugaugugaguauuggaggaaagaguguggauguugucauaggauaugagaagggcucuggugaacuucggcauuuucacuaucuaugauugccucugugauaugacuauaaauaaggugcagucuaggagcugguaccagcaggcccagaccugaugccaucaucuccucccagguaacccacggcugccaugaguccugucugaaugaagaaguggagggucaggguuucugcucugguccuggcugggauccugugacagguuggggaacacccaacuucccagcccuacugaagacccugcucaacccuugacccuuucgugccaugacgagaaagcagaacuguucccuguacuaaaagggaaggcucaguuucuuguuauuccucgauagaagcccugcugaacuccuguugccugcugcagauagcuucucccuaacccucagaugcugugaacaggacucaacucucaauccuacugugugccaucaaacucaggucuccaaacuucuacuucaagauccucaacaagaugcuauaaccagcauauuuugucucaccccaaccccaucucuccuuccucuuuccagcuugagaugugaaagcagggcaagaagguucagucuuccauuacugacacuagcagguccacccaacgcuuaccaccucugcacugaccguacacucuauuucucuucggguuugcuuuuccguucacugaagugagaccuuugacuaaucguuuugucuuucuucucucggcacugaaguacaauggucuccccaauguuuuauccaguuauacccuuuucaguguuuguuuuauggguuuucuuauuuaagaacagguugucaaaaaaccauuaaaaaaaaaaaagaaaaagaacacauuggcugcaaucuauuuaacuauauaacuauucuaaggaaaguuaaaaauugaaaacuuaaaauguuugaaauguucucauuggcaaaauuccucaacaaaauaaauaggucauuacaaauuuugcuuuaaauuuuugcuugagugauuuuuuuuuuuguaaaguguuuuaaaauuuacauuuuauuuuccccuucucagcuacaccaaagcaacauucagguuuuaauuucaacugucagacauuacaaacaucuagcuucugugaaccuggguguuuguucuuuccaucaguuucccauuuauccuuuuuccucagugaccccccucugaccacacuaaucagcccccuuuucugcugacuccagggaugcuguguucauuguuccauucuuaguuucuugcucuuaucauuuuauuaucaucccuugacagaucacugacaucuauacccacagugagugauaccucaaaugugagauaccucguuacuucaucucccuccagcccagaccuaaacuauuucaucucuuaaucuaugauauaaugccucuuucaaacaagccagaaaccuauaacucuuaacucucaucuuuuucaccuccuuacuaacuucaaaaaguuuucuugacugccucucaaguauaucuuuaucggcuaguguggugaugcacaccuuuaaucccagcacucaggagacagaggccaggcaagucucugaguuugaggccauccuggucuauauaaagaguuccagacaagccaggccuacauagucagaccaugucucaaaaauacacauaugugcacacacacacaugcacaaaauacugcauuaucuuugagcccauguucuuuuuucuucuaaacugcaggaagcacuuggggagaggaaaggcuuccgaagccccucaucuuccaaaccaagcagucuauguauuugugcaaacccuucaaagauuacuggguaaaagucagagacauugaaacuugccuucaaaaucgggaaauaaacauugcuaaugucucacacuuggaauuaagcaaugaauguuaguuucccuuucuucuuugcacugcaccuacauguagcugggaaacaaucauacaguauugaaauugucaguuuguuugccuuccuuuuccagacagucggugcuagugaacuagaaucugauucuuaacuuuguauuccuaggucccagcccaaauagaaauuaaauaaaugacuguuuaaaaaaaaag

SEQ ID NO: 4010 - RNA, 7890 nt, Mus musculus
auuuucagauugaaacgaaacggguaaaauuccuuuaaugcuggguucucauacugggggaacaguggauuaccaagacauauguggagcuacggaauaaacagaacuuaucuucuuaaaacauuaguuuugauagaggauuuguguguguauaauauauaacauauaacuuauaagaacuaaaauacuauuuuuauauuaaacaggcacuuuguggagaagaaugcaaaaucuuggggaaguuuaaacuccuuuccuuaaaaauguaagcacacagaucacuuuuaagauuaaagcaucucagacuuaacuacuggguuuaugcugaaaagucagaggacaucugcaccaugcccaugcaucuaagagcauacagaaaggagccuucaggguacagacauuauccagggugaacaauggggagucagcuuugcaggaaguucuuuuuucagaugaaguaggaggaaacaggggaagggaggaguucauaggcaaaaaauuguuacauccaggcugaagaagucuguaaaacacauugauugauucaauagacaguugaugccaacuuugucucauguucuuuauuggguggugggagaaaugaauuagauguguuuucucgaggaacucacuauuuagugaaggguuuuaaaaguagaguuauucagucacuauaauaaaagauguacagugugaaacuggcccacugguaaagaaaguaaaggaaaugcuuccauuuguggaacuaucagggcuggagcugugguucaguucuagaguauuugccuaguaugugcuagagccugggcccaauccacagccuaaaagacauaggaauaaauauaacuaagaauguaaaagauuuguacccagcugggcaguggugggacacgcuuuuaauucuaguguguuggagcagaaacagguggaucucugugaguuugaggccagacugguuaacagagcaagcuucaggacaaggcauccaaggcuacagagaacucaaaaaacaacacaaaacaagacaaaaugccaaaaaaacccuugugcucaaaauuauuagcaccgauaaaagacauugaaaauaacacugauaaguggaacacugccuugcucucaagauuggaagaaugaaaauuauuaaaauguucacagaacucaaaguaaucuauagaguucaugcaaucccuauaaaaauaccaaugaccuuuaaaaaaaaacaaaaauuaaaaaaaaaaaaacaccaaagacaaaguuuguaaguacaaaaaauuccauauagccaaaauaaugucauaaagaaaaaggcaucaucuuccccaacugcaggcuguaucacaaaccuauaguaagcaaaugcggcugugcggcauaacagacacaggccauggcacaggauagagcccagaaauaaacacaagcacgcagagucaacugauuuuugccaaaugaguauacacuggaggaaaucacuccaaaaacuguuguugagaaaccauauauccucaagccaaggggggaaaaucagaacccuuguuuuauaccagacucaaaauuaacuugauuuucuccauuccccugccccguucugguucuaggaauugaaacugaggccucauacuuuucagucacaugcucuaucccuuagcuagauucggaacccuacauaauuagcacaaaauguauuaaagacaaauagaagucccagacggaugaggguccuaguucugggaagaccaguauaacagcuagaagagaacacagggagaagcgucuccacugacccuagugauacauucugcauagaacaguaaagaauagaaagucagucaaugggaugauauugaaccaagcggguuuuaaacaucaaacaagcaaucugaacgugaaaagguaaccugcaggagauagaauauuugccguccauguaucugauaaaagacugaaauuuaaaauauauaaggaccuuguaagacuuauagaaacaaagcuuggcugucagugucuaagggcuccaggaaaugggguggccuuggccuuaagggcuugaggaaguggcaacuuucuuucuagcugguuguguguugugcuggggacugaacucaggacuugaugaaugcuaagcacacguuaccacagagcuccaccccagcccuggggccaaacuuuuuugcuuuguaggaugaacaagucucagaucuaauauacaguauggguggucuucuaugugguuaaaagaucaaaugaagagucugggccacuguaauaacgcugagcuucacuugaggaauucagugacuuuuucauaaaagaugcaucauuucugguuuugccaguguagaaauauauagguauuuucugucuguggcauugguuagaaauauuccaggauguuggaauauguaaaaugugugggaaauuaauuagacauauguuuauacucuugacaaucacuaucagcauuuaaggcccgguagaggauuuuuuuuuuuuuuuuuuuuuggucuuggauacugaaaugccuuagcauuuccacacaaagcacaguuguuucauaaacuucggccaggguugaauauggcaggcuugagauguggcuggaccaggcugucaauguaaugucuggauuuuauccagcaaaggcaaugcuuaggcacugaaaggcugaguaaacccaguaaaagcagguuguaauucauuccuagguuguaaaaucaacuuaguggauggggaucagcauuguguguguguauguaugauuguauguucccgugggugagugcacaugcauguggaggcuagaggucagccuccucaggauuuuuugagauaggauuucuuccugagccuagaauuuaccaguuuggcuaaguuggcuggccagugagcuucuaagaucugcauaucucuacccugaaugcccagcacugggauaacaggauauaccaucacaccuggcuucuguuuuuguuuguuuaaauuucuaucaguagugugugccacagcauguguagucaguuguggggguuauuuuuuuucuacuauguggauucuaggagucaaguuaucaggcuuggcaccaucuuuacggaaugaaccaucuuccuggccccacaccuagcuuuuuguguggcuugggaugucacuucaggaccugaugcucaagaggugggcauuuuaucgagucauuccgccgguucuggaagcagcauuguuaaagguaaugcaaaugugaaggaaaaugucuugugaggauaugcaauuuauauacauauugaccgccacauguucugaugcaaaaugcuuuuuuaucuuuaucugaauccuaguuaaaaaaaaauuuuuuuugggggugggggaaggaacacuaauuuuaguaguacaaagcuugauguuuuagacugcuuuugguagcaauaagaagaaaugacagucucaaauggcaguaaucucucucaaacacacuucauuacaacuuggauugcaguuuggaagcacuuuaacuuguuaguuuuuaaucuauuuucauuguugucuucagucuaaugcccuauaccauagggaacuauaaagcaauguuguauuucaguguacuacauaaacacagcaggcauaucuugugugacaaaguuaugaguuuaggaauggggaugaucagaagagccacgugaaaguuuguguacaaguuauguaggucaaaguggagccucuggaugacagggacugugugaacaaaguguaaagggaccugugccagaaaaaccacccaaauaagguguguucuaugcuucuacagcaugagcuugagaggcaccacguaguggagcaucaagcagaugcuugauuaguaggcaguguaagaaaucuggacuuugucccauaaaaaacuggaaaucuaucaggcaauuaagaugaccacauuccuaucaugacaacuuugugccugggacaucccacuaggaacaauugcauauuugcuaauggagauaaagcaggacaugacuccacuuaagauacagggauacaguuacucgguuuaaaaaugauagguagguauuggguucauagugcuaaacuuuuaaguaaguguguuagguuuuuugggugggugagggacauuaguuugucaaccuuauuguaaagaauugaaacccucccccccaauccuuaccaugaguauggcaauauguaccuucaaucucagcacaagggaggcagaggcaggaagaucucuaaguucaaggccagccuagccuacagagugaguuccaggacagccaagacuacacagaggauccauguuuguguagaucaaaaucuggaacucgauguggagaaccacucuuucgaagcgaugagaagggcuuggcuugguauuuaggcaaugucuacucaaaggcaguuauuuacaaauacaggcagauuaacaaagccuucaguagaugucuuaggauuugucaacuuuggggggccagauuauuagauauguagugcccuguacaacugugagcuccuugacugcugaugcuucacuuuuagccagggucagauuuacugcaaauaugcuugaaguaugcaaucucuaguauguaaggugaugcuggagauucggaugcuucuaauagaagggguagagauacagcucagaaggcacuugcuacuaagucugaugaccugucuuccauaccuaggaaccacagguuggaagaacuugggaaagcuguccucuggccucuaucugcauucugagaugcauguacccucccuacucaauaaagaaguauaaaacauuuagggaaauauuaaagcuccaaaugguggguguucaaaaaaaaaucugagagcccuuucauauuuuaccuguugcaaagucuuccaagauuugguuuuaagggaagggcuuuuccuagaacaagucaugacucaggcaucuaacuuguaaaugcucaaaagauaggaaaagggauaaagauuuacaaaaaacaugucaaguucuaugcagaaggaagagugacagcucugccgggaccaggugauuuaguguaagcagcuguagggcaaagagucuuagaauagugucacugaagcuaaugucuuucugcuuccacagugaccuucuaccuucaggugcugcacuaauuguucaggagaacuucuuuccaugacucccuggucaagucucugaacauacagaacagcagccaggaugggucauaucccauauuuaguggauauaaauaagcuccaugcuucucacauacccuggccauucugaaacaggauuuccucuuucuggguucccacagagguccacuuuuggcaacaaaagcuuccaggaaauucccagcaggcuuaacuuucuaaugcaucacucucuaucaaccuuccucuucacacccucuaagaggaaggaacuuauccggaaggccaacauccuggcagaugccuacagcccuaucuaugaucaggguggugauacaucuauuugaguccacauucaaaacccauucagacauugagugaaacaaaugugaccuugccuagaaacaauucucaguuuuagggguaccauguuauuugaagauuccuguacagaggcucacacagcuaguuaucaggaagcaaucucuugggacugaaugcuugcucucauaguagccugucaaaauccuguuaagaaggggguuagaagcucaggcggcugcacccuccuuuguggauggacagacagugguacagccauugguaagacacacacaugcuccuguaagcaggacuaaugaaacucgccaggacauaaucacacacauaaaaagacaucaaguggaagggggacuaguugaaauaggcaggacaauagggugcaugcauguggugguaagcauggucaaaagacauugguagauauguaugaagaugccaaggugaaaccuagucucauaggauucauaaagauucucauguauaacuuauaaaagcaaaaaaggaauuccaacggugggucucuaugcuggacgucagccagucaccauaggaagaugguuuggaaucaagagguacagggcccaucuaaauuaguguugagauaagcaaacugagccaggagguagugccccauaccuuuaauccuaguacugaggaggcagaggcagguggaucgcuuaguucaaggccaaccuggucuacaaacagaguucuaagacagucaaagaaacugucucagaaaaaacaaaaccaaagcaaacuggcacugugugguggugaacacuugggaacacagggacaggaggacugcugcaugguggauauagucuggauuacacagcaagauccccuccccuccaacaaacaagcaaaacuagaccuagaauuuagaaccuaaguugugaauuuacugucuuaggaggcugagcaucuggaugccucuuacuuuccauaaauccuagggaaggacaagaaagucaauaucuuauauucauauuaagacuuuuaucuucugugcaaagaggaucgugugagucagcagggaggucugggucucauuaugagggggcuuuacaaugcuacuuccaggccucacacacuacacgagcuccaagacccacgaacacgggcaccacaccuaugcaccacucuccagcuccaguuaagucuuugguguuugaacuguacaggagcuguggaggcuugcguccugguuauggugcagguccugcugcagucccaggagcagcugguuuaggagaguaagguugcugucucugugaggcagaggcaggggagggagguaguucccuuuauauucuaucaccgccaucuuggcccgaucuugcuccuuccgauucgggaucuguagcauucuuguguaguucccauucugaccuuggaaccgaggcgcuagcacuuuaaacagcuuugggaucaaguccuucuccuagauggggagaguuaaucagaaaaaauagucacaacuguagaggcauuuaacuauagauuauucccagagguaggguucaaaaccaucuucacaggcuuucccaccacccauucagguaccaaguuacacagaaacacuuacaggaaguuaugcggaugcucauuuuacccaagucaaauaagagaaauacgugucuaagguaguucgcaagucugguacauaaaagaaugcccugccuucaaucugccagguacccgguucucuaaggauuccuuccucacuagcagguagggagcacucacugugagccagaagucagccauacgcauggcucguucguuggugucgcccagcuuuccauaaucgaugagcugugaggacaaaacacauggaugcaagacgagucaagaaccgaggcgcccaccuuacucuucugucuuaccuucauccaaccaucccaccagcuaagcuaauucugggcgcuccuuccuucggagccccaaccagccuuccauuugcugcgcaggagugacgcguucagcugagugccacacgggaauucgcuaccguggaaaguucucccagcguggcccuacuccccacacacggccagagcggcggucugaggcuggacccggcggugaauagcuuggcucucaccuucuccgcguagccccucaucucguccgcgcgugcccaugucgccucgaugcguucguggcgaacuaggcccgugagcaaguuccgcagcagauggaugcgggacuccggacccaggcccaggcggcgguagacgcggccgugggagauagcggcagccagcgacaaccucaugcucucaccucagccccuccucucgggggcccggaaagggaaacuccgagcugugugugcgcgcgcggggagagggggagcagaggggcggaggcacgucucagaggacgcaugcgcag

SEQ ID NO: 4011 - RNA, 7890 nt, Mus musculus
cugcgcaugcguccucugagacgugccuccgccccucugcucccccucuccccgcgcgcgcacacacagcucggaguuucccuuuccgggcccccgagaggaggggcugaggugagagcaugagguugucgcuggcugccgcuaucucccacggccgcgucuaccgccgccugggccuggguccggagucccgcauccaucugcugcggaacuugcucacgggccuaguucgccacgaacgcaucgaggcgacaugggcacgcgcggacgagaugaggggcuacgcggagaaggugagagccaagcuauucaccgccggguccagccucagaccgccgcucuggccguguguggggaguagggccacgcugggagaacuuuccacgguagcgaauucccguguggcacucagcugaacgcgucacuccugcgcagcaaauggaaggcugguuggggcuccgaaggaaggagcgcccagaauuagcuuagcuggugggaugguuggaugaagguaagacagaagaguaaggugggcgccucgguucuugacucgucuugcauccauguguuuuguccucacagcucaucgauuauggaaagcugggcgacaccaacgaacgagccaugcguauggcugacuucuggcucacagugagugcucccuaccugcuagugaggaaggaauccuuagagaaccggguaccuggcagauugaaggcagggcauucuuuuauguaccagacuugcgaacuaccuuagacacguauuucucuuauuugacuuggguaaaaugagcauccgcauaacuuccuguaaguguuucuguguaacuugguaccugaauggguggugggaaagccugugaagaugguuuugaacccuaccucugggaauaaucuauaguuaaaugccucuacaguugugacuauuuuuucugauuaacucuccccaucuaggagaaggacuugaucccaaagcuguuuaaagugcuagcgccucgguuccaaggucagaaugggaacuacacaagaaugcuacagaucccgaaucggaaggagcaagaucgggccaagauggcggugauagaauauaaagggaacuaccucccuccccugccucugccucacagagacagcaaccuuacucuccuaaaccagcugcuccugggacugcagcaggaccugcaccauaaccaggacgcaagccuccacagcuccuguacaguucaaacaccaaagacuuaacuggagcuggagaguggugcauagguguggugcccguguucgugggucuuggagcucguguagugugugaggccuggaaguagcauuguaaagcccccucauaaugagacccagaccucccugcugacucacacgauccucuuugcacagaagauaaaagucuuaauaugaauauaagauauugacuuucuuguccuucccuaggauuuauggaaaguaagaggcauccagaugcucagccuccuaagacaguaaauucacaacuuagguucuaaauucuaggucuaguuuugcuuguuuguuggaggggaggggaucuugcuguguaauccagacuauauccaccaugcagcaguccuccugucccuguguucccaaguguucaccaccacacagugccaguuugcuuugguuuuguuuuuucugagacaguuucuuugacugucuuagaacucuguuuguagaccagguuggccuugaacuaagcgauccaccugccucugccuccucaguacuaggauuaaagguauggggcacuaccuccuggcucaguuugcuuaucucaacacuaauuuagaugggcccuguaccucuugauuccaaaccaucuuccuauggugacuggcugacguccagcauagagacccaccguuggaauuccuuuuuugcuuuuauaaguuauacaugagaaucuuuaugaauccuaugagacuagguuucaccuuggcaucuucauacauaucuaccaaugucuuuugaccaugcuuaccaccacaugcaugcacccuauuguccugccuauuucaacuagucccccuuccacuugaugucuuuuuaugugugugauuauguccuggcgaguuucauuaguccugcuuacaggagcaugugugugucuuaccaauggcuguaccacugucuguccauccacaaaggagggugcagccgccugagcuucuaacccccuucuuaacaggauuuugacaggcuacuaugagagcaagcauucagucccaagagauugcuuccugauaacuagcugugugagccucuguacaggaaucuucaaauaacaugguaccccuaaaacugagaauuguuucuaggcaaggucacauuuguuucacucaaugucugaauggguuuugaauguggacucaaauagauguaucaccacccugaucauagauagggcuguaggcaucugccaggauguuggccuuccggauaaguuccuuccucuuagagggugugaagaggaagguugauagagagugaugcauuagaaaguuaagccugcugggaauuuccuggaagcuuuuguugccaaaaguggaccucugugggaacccagaaagaggaaauccuguuucagaauggccaggguaugugagaagcauggagcuuauuuauauccacuaaauaugggauaugacccauccuggcugcuguucuguauguucagagacuugaccagggagucauggaaagaaguucuccugaacaauuagugcagcaccugaagguagaaggucacuguggaagcagaaagacauuagcuucagugacacuauucuaagacucuuugcccuacagcugcuuacacuaaaucaccuggucccggcagagcugucacucuuccuucugcauagaacuugacauguuuuuuguaaaucuuuaucccuuuuccuaucuuuugagcauuuacaaguuagaugccugagucaugacuuguucuaggaaaagcccuucccuuaaaaccaaaucuuggaagacuuugcaacagguaaaauaugaaagggcucucagauuuuuuuuugaacacccaccauuuggagcuuuaauauuucccuaaauguuuuauacuucuuuauugaguagggaggguacaugcaucucagaaugcagauagaggccagaggacagcuuucccaaguucuuccaaccugugguuccuagguauggaagacaggucaucagacuuaguagcaagugccuucugagcuguaucucuaccccuucuauuagaagcauccgaaucuccagcaucaccuuacauacuagagauugcauacuucaagcauauuugcaguaaaucugacccuggcuaaaagugaagcaucagcagucaaggagcucacaguuguacagggcacuacauaucuaauaaucuggccccccaaaguugacaaauccuaagacaucuacugaaggcuuuguuaaucugccuguauuuguaaauaacugccuuugaguagacauugccuaaauaccaagccaagcccuucucaucgcuucgaaagagugguucuccacaucgaguuccagauuuugaucuacacaaacauggauccucuguguagucuuggcuguccuggaacucacucuguaggcuaggcuggccuugaacuuagagaucuuccugccucugccucccuugugcugagauugaagguacauauugccauacucaugguaaggauugggggggaggguuucaauucuuuacaauaagguugacaaacuaaugucccucacccacccaaaaaaccuaacacacuuacuuaaaaguuuagcacuaugaacccaauaccuaccuaucauuuuuaaaccgaguaacuguaucccuguaucuuaaguggagucauguccugcuuuaucuccauuagcaaauaugcaauuguuccuagugggaugucccaggcacaaaguugucaugauaggaauguggucaucuuaauugccugauagauuuccaguuuuuuaugggacaaaguccagauuucuuacacugccuacuaaucaagcaucugcuugaugcuccacuacguggugccucucaagcucaugcuguagaagcauagaacacaccuuauuugggugguuuuucuggcacaggucccuuuacacuuuguucacacagucccugucauccagaggcuccacuuugaccuacauaacuuguacacaaacuuucacguggcucuucugaucauccccauuccuaaacucauaacuuugucacacaagauaugccugcuguguuuauguaguacacugaaauacaacauugcuuuauaguucccuaugguauagggcauuagacugaagacaacaaugaaaauagauuaaaaacuaacaaguuaaagugcuuccaaacugcaauccaaguuguaaugaaguguguuugagagagauuacugccauuugagacugucauuucuucuuauugcuaccaaaagcagucuaaaacaucaagcuuuguacuacuaaaauuaguguuccuucccccacccccaaaaaaaauuuuuuuuuaacuaggauucagauaaagauaaaaaagcauuuugcaucagaacauguggcggucaauauguauauaaauugcauauccucacaagacauuuuccuucacauuugcauuaccuuuaacaaugcugcuuccagaaccggcggaaugacucgauaaaaugcccaccucuugagcaucagguccugaagugacaucccaagccacacaaaaagcuagguguggggccaggaagaugguucauuccguaaagauggugccaagccugauaacuugacuccuagaauccacauaguagaaaaaaaauaacccccacaacugacuacacaugcuguggcacacacuacugauagaaauuuaaacaaacaaaaacagaagccaggugugaugguauauccuguuaucccagugcugggcauucaggguagagauaugcagaucuuagaagcucacuggccagccaacuuagccaaacugguaaauucuaggcucaggaagaaauccuaucucaaaaaauccugaggaggcugaccucuagccuccacaugcaugugcacucacccacgggaacauacaaucauacauacacacacacaaugcugauccccauccacuaaguugauuuuacaaccuaggaaugaauuacaaccugcuuuuacuggguuuacucagccuuucagugccuaagcauugccuuugcuggauaaaauccagacauuacauugacagccugguccagccacaucucaagccugccauauucaacccuggccgaaguuuaugaaacaacugugcuuuguguggaaaugcuaaggcauuucaguauccaagaccaaaaaaaaaaaaaaaaaaaaauccucuaccgggccuuaaaugcugauagugauugucaagaguauaaacauaugucuaauuaauuucccacacauuuuacauauuccaacauccuggaauauuucuaaccaaugccacagacagaaaauaccuauauauuucuacacuggcaaaaccagaaaugaugcaucuuuuaugaaaaagucacugaauuccucaagugaagcucagcguuauuacaguggcccagacucuucauuugaucuuuuaaccacauagaagaccacccauacuguauauuagaucugagacuuguucauccuacaaagcaaaaaaguuuggccccagggcugggguggagcucugugguaacgugugcuuagcauucaucaaguccugaguucaguccccagcacaacacacaaccagcuagaaagaaaguugccacuuccucaagcccuuaaggccaaggccaccccauuuccuggagcccuuagacacugacagccaagcuuuguuucuauaagucuuacaagguccuuauauauuuuaaauuucagucuuuuaucagauacauggacggcaaauauucuaucuccugcagguuaccuuuucacguucagauugcuuguuugauguuuaaaacccgcuugguucaauaucaucccauugacugacuuucuauucuuuacuguucuaugcagaauguaucacuagggucaguggagacgcuucucccuguguucucuucuagcuguuauacuggucuucccagaacuaggacccucauccgucugggacuucuauuugucuuuaauacauuuugugcuaauuauguaggguuccgaaucuagcuaagggauagagcaugugacugaaaaguaugaggccucaguuucaauuccuagaaccagaacggggcaggggaauggagaaaaucaaguuaauuuugagucugguauaaaacaaggguucugauuuuccccccuuggcuugaggauauaugguuucucaacaacaguuuuuggagugauuuccuccaguguauacucauuuggcaaaaaucaguugacucugcgugcuuguguuuauuucugggcucuauccugugccauggccugugucuguuaugccgcacagccgcauuugcuuacuauagguuugugauacagccugcaguuggggaagaugaugccuuuuucuuuaugacauuauuuuggcuauauggaauuuuuuguacuuacaaacuuugucuuugguguuuuuuuuuuuuuaauuuuuguuuuuuuuuaaaggucauugguauuuuuauagggauugcaugaacucuauagauuacuuugaguucugugaacauuuuaauaauuuucauucuuccaaucuugagagcaaggcaguguuccacuuaucaguguuauuuucaaugucuuuuaucggugcuaauaauuuugagcacaaggguuuuuuuggcauuuugucuuguuuuguguuguuuuuugaguucucuguagccuuggaugccuuguccugaagcuugcucuguuaaccagucuggccucaaacucacagagauccaccuguuucugcuccaacacacuagaauuaaaagcgugucccaccacugcccagcuggguacaaaucuuuuacauucuuaguuauauuuauuccuaugucuuuuaggcuguggauugggcccaggcucuagcacauacuaggcaaauacucuagaacugaaccacagcuccagcccugauaguuccacaaauggaagcauuuccuuuacuuucuuuaccagugggccaguuucacacuguacaucuuuuauuauagugacugaauaacucuacuuuuaaaacccuucacuaaauagugaguuccucgagaaaacacaucuaauucauuucucccaccacccaauaaagaacaugagacaaaguuggcaucaacugucuauugaaucaaucaauguguuuuacagacuucuucagccuggauguaacaauuuuuugccuaugaacuccucccuuccccuguuuccuccuacuucaucugaaaaaagaacuuccugcaaagcugacuccccauuguucacccuggauaaugucuguacccugaaggcuccuuucuguaugcucuuagaugcaugggcauggugcagauguccucugacuuuucagcauaaacccaguaguuaagucugagaugcuuuaaucuuaaaagugaucugugugcuuacauuuuuaaggaaaggaguuuaaacuuccccaagauuuugcauucuucuccacaaagugccuguuuaauauaaaaauaguauuuuaguucuuauaaguuauauguuauauauuauacacacacaaauccucuaucaaaacuaauguuuuaagaagauaaguucuguuuauuccguagcuccacauaugucuugguaauccacuguucccccaguaugagaacccagcauuaaaggaauuuuacccguuucguuucaaucugaaaau

SEQ ID NO: 4012 - RNA, 938 nt, Mus musculus
gcuaugcugacaaucguuuucccaggacucucuucaaagcuccagugaccucuuuauuccucaggcuguagauaaggggauucagagccggagugacaaucguguagaaaacugagcugauauugucuuguuuggggcugugaaagggacuggguagaacauacaugaaggaagcacccccauaccacaucccaacuacagucagaugggaagagcaggugacaagggcuuucuuccugcccucauuugagggcauauugagcacagugaacagaauuagugaguaggaggccaggauggcaguaagaggaagaauuagcacaauaacccccaucaaauaaaccaugaguucauauguggaggugucugcacaggccagcuucagcaauggggggaucucacagaacagaugauugaucugacgauuuuugcagaaggaauacugcaugguguagaugcuauauccuagagcacugagggaugccaagauccaugagguggcuaucaugagccagcagacuuugugacucauuaagauuguguaguucagagguugacaaauggcuacauaccugucauaggccauaaaggccagaagaagguccucugcacuacccagugccagcucuagaaacaucugaagggcacaaccuccaaaggauaugguauugucuuugaggagaaaauccacaacagccuugggagugauaacugaugugaggaggagguccaugagagaaagcuguccaaguagaagauacaugggcacauggagccgggcauccauggugaugacuagaagcagcagcccauugcuggucagggcuaagaaguacagggcuguaauugcagcacagagcaguucaggagagccacugccauccagaauccccaccaagaugaaaccacuucccacagucgaguuccagagcuccauu

SEQ ID NO: 4013 - RNA, 953 nt, Mus musculus
aauggagccuuggaacucuaccuuaggaacugauuucaacuuaguggggauucuggaugacaguggcucuccugaacugcuuugugccacauucacagcucuguacauguuggcucugauaagcaauggacugcugauccuggucaucaccauggaugcccgucuucauguacccauguacuuccugcuugggcagcugucucucauggaucuccucuucacuucaguugucacucccaaggcugucauagacuuucugcucagagacaauaccaucucauuugagggcuguucccuccagauguuccuggcacugacacuggguggugcagaagaccuccuucuggccuucauggccuaugacagguauguggccauuugucacccgcugaacuacaugaucuucaugagaccaagcaucugcuggcuuaugguggccacaucauggguccuagcaucucugauggcccuaggauauaccaccuauaccaugcaguauuccuauugcaaaucccggaagaucagacacuugcuuugugagaucccuccauugcugaagcuggccugugcagacaccuccaaguaugaacucaugguuuaugugaugggugugacuuuccucauuccuccucuugcugccauccuggccuccuacucacuaauuuuguucacugugcuccauaugcccucaaaugagggcaggaagaaagcccuugucacauguucuucacaucugacuguaguuggaauguucuauggggcugccacauucauguauguauugcccaauuccuuucacagcccuagacaagacaauaucauuucuguguuuuacacaauaguuaccccagcccugaacccacucaucuacagccugaggaauaaagaggucacuggagcuuuaauaaggguucugggaagguauauugugccagcacacccuacucucuagg

SEQ ID NO: 4014 - RNA, 1320 nt, Mus musculus
aaauauuuaaagaguuuuauuccauauuguuugaguaauuagugagcaguggucaaauguauuaaaguaaaauggaguugccagaggcuggggguaccaggagucagaaguuguuugacagacuuucauuuugucagguaaaguucucaaaaguacacacaauguggguguacuuaacacaacuggacuuuauaccuaaaauggguaagaagguaaacuguguggugggcauugucuggcuuucagaguuaaauguuaagcauaggaagugcugcuuucuucaucgucagugaacuuggggcacagagagagccauaaugcucucaugucuagaagguuggaccagaacucagucccagaaggaaccggaagcagcaguucccaguccacaggaaagggguggaguuuuaacuguccuggggauuucaacccaaggagggccuguagguuauuccuuguauuccccaacuauuccugucaggauaccaccugcacauagaaacccccacuuuuuuucuaauuuuaagggaggacgaugacucguucuugaaaugucucuguucuuugauaaggaauacaucucuuuccucaucggagcuucugugcucucaaguuuccugagguuucaucuuaggaugcuagggucaguguggcuggucagauaaucuguagccauuccagucugccaguucacauuuggcccuguggguggucuccagaucacaugucuuccuuucugguuucaugucaucuuuugaugaaaucucuugcugcacaccucuuucaggguguuaggaugguacaggauuucuccacccuagauccuaacagggaauaauguuagcaucuagccucugcuuuacagcagcucuucccaucucacugaaggggccaggcaucccacugagacacugcagacaccaagugaguuaacaucuaaggguauugauguuaagguuaucaugccacacucauucugcauagaaaucauagaacuuggccaccagcuacuacuguaaaccucaccccaaccuuaagaaguauaaauaagaagaggcucccucuucugacauaggggccugauucucuucagagacucugccaugguguccaucucuggcacugggccugaaagagcaucucugugcauuauuguaacugugggauccaagcauguuccuuguuugaagaaaugcaaugugaaaguccucauugaugcaauguugucuauucuaguucuuuauuagcacucuuaucauuugcauccauauugggguaaggaaagcccuguucacucagugucucuuucugucaagacaa

SEQ ID NO: 4015 - RNA, 1196 nt, Mus musculus
uauugacaaugaguccauuuauuuucauccauaaauauauaaacauuucuccauagauuacagaguugauacuccagaguccagaaacaggccaggagggaagacgcugggcauacaacugcuaucauccuuuuccugcaggaugaaagauaucaggagaaauaaaucacauguaggugggcaggacagagcuuaguuuccugaaacuauuggcuugagaggaaggucagagcucagcaaggaaagcccuugucaugggcauaagagcaggaaagagagagaggggacagugagcugucaacuggucaggaccacaccagauuggguuaggacggugcaggaggcugugaaaagucaugauggaaguuaaccguccaaccuaguggguugauuccacaauauaaaacgccauggaucccaccuugugucugcugcugagcuccugggaaguucccagcagaguucagguccuuaucuaugcuauggaagcuggggcucagcucagugagcugcccagaagauccugauaaacaucaaaguuugaggacgcuaaaguggcugagucuucagugcagggggagugguaagggcagcuuuuguaauccucugggugagguaauggagagccagccaaggcugcagaagcagaugagcucaccacuggccagcccuggggagaagaugcugccuggcuucacauagcagcguaggcacaccugguuauucugcucagucuccucagaugccucaggaaacacccgcuucuccucaccucucaucuggaaucuuccuggcugcaucuucucucuguguugcaauguucuggggugucccaggugcuccucuauucuccucugugccaguucauaagccuuucguuugaccgcuuuaaauaccaucucucuguagaugacucucaaacugcugucaagacuucucugucaacccaagacucagagcuccagguggccccuuagcacaccuuccuaaaauccaggucccgauuggaugccacuuggcucuuccuguucucccggggacuucggguuugaaccucacugucagacucugcuucucucacgccugagugcagucugucaguaaauuucacaggcuucgcucuggacuucagucaggacauauggcaucuccuauaacugucccugcccguacuaccuucucuucuuguuuagcuu

SEQ ID NO: 4016 - RNA, 9580 nt, Mus musculus
ugcuucacuuccuuuauucuuucuuuugguuccaaauccacuuugcccuucagcauuguaugccucugagauguucacaguucacuuuaagguuauaugcacauguguacccgauacacaaaccagcugagcugcuguagucuguguggccuaagugaguuccaaguguacugcuuuuaaucaaguugccagucaccacuauccuuggucuuccgugcagaugucauuggcaccuccucuagcuaggaaagccaaaagcaucuccaggcuuuguccagugacgagugaaaucaccagaaggucuacggaaugaaagauccaaugauguggaaugaguccaguggugaaaggcuuugcagcugacccugguggcacaugcuuguaauccuaguuauuauuaguuggaaagcugagauagaaggguugugggguucacagaugacuugagcuacagagugaguucaaggcuaagcggggcaauguagcagagagugagccguugugucuuuccccgaggaggucauuaugaaagaauacacugaguacaauugggugaaugaacgugggagugucccucccuggccuguuugagacggaguuugguccccugugggugagauucaaggauauagcagagcuccagggaaccccauuccucucuuuuuuuuuuucuuguaccccccacccucccguaugcacacacacacacacacacacgcacauugaguagcaaauccugcagcaagugcuaacacugcagcuacuuugccaguucuuccgaaaggacauaaaauuaaacagauccagguuuaaagacaacucugccacccacugucugaauggcuggggaaaugcaugacuaacgcugucuguuuccuccugugugacuuagagaacaaaagcuccgcagaaccucuggcccauuaggaagauuauaaggaauggaguuggggugagcuuuaaccccugcaguagcagagcaccaguauguuauucuuacuuugaccugcagguggcaauaguggucccuguaucgucugguuugaaugaugggauuugaagcacagcuucugggaaaugggaaaugaagaaacuuaaccaugccaacuuugacacagugccaagguggaggauacuaaaauauaaauauccccaauguugccaucugcuguacaaaaugcagggagucagaaagggauuccuggagcccaccuacuguggauuuacugcccugacauacagcuuuuuaaaaaaagugucuuacaaggcaaggaagaccacacaaggccuuugcccucuugugaguuuguccuucaaagcagagaaauguaaagaagguucauaggugguuagguugauagagaccuguucggauccugcuggaaugcuauccguaaacauugcuauauugccgguucuggucacaccccuacucuuuuuucacccucaccucacaucagcaaguccuggacugcccaguguauuuucuacauauccacacauugugagcuaaaugcaaagcaguccaguuuauuccgcuaagccauggagaaagucauggagaaaguggcuuccuucccagccuccaaaccuggaagcucaaaaaucacuuuugucuucagccugugaagacuucuuaggcccacaaccaaaagaacaucaugcccaagggugcguggagagacaccuugcaaauaccugacuugaacagggugaagccaaacucacucuaaagcagagagagggacccgcuaaguagugugggagguguuaguagauaaaaaucauguccuugguauagcugagcugcuccaggcuggggugagcugccgccuggaucagagguggugggccacacaccaggaugagcguguccuccccaggaggagggaggugcuccuugaucaugucagcgcuaacaaagccugagcuguacuuccagucugaaaugaagcagaaaggggaagaagcaugguucugcauuugccccugaugcuggagaccaggcuacccuauaaacgcuuggaagucugcacugcugauugucauaguugacucaagaagcagacauguggcuucccugccguccauagcauuuuugccaaauucuaggcucucggagacucgggaugcugucucucugcucuaagcauugaguagaaaguggggcuguuagggggaggugaggaggucacacugguggacagcuuauagguauaggcaguauagaucagggaagcaggagauguguaaugcaugaugcaaggugcacggaaguuccugggaugcuaggugaggcugcaggagcugacugaagcucagcauuugaagucugcuguccagaagagguuggagguaagaaguagccaugagcagguacacgagguuaaggggccaggggucauauuaggugcaaugugcugacugcagaguacgugcucaauuagccugguggcucagagucuauacucagugcaguguguggcguguggaagagguauuuaacaccugcccuugacucccauuaaaaacugcugcucccaauauccucccacucagauucuuguacgcccuauauagaccaagagcccccaggcauaaucuccuauggaguaaaccuuaaagacaaaacagacaaaagcuagagacuagucuauagguguguccaaggguggagcuggcccagaauaaaggagaguaacaugggucauaccacugggaggccuguccaggguauaccacagguugaacuguuugugaugagucguggcgacuucuucuagcuccuuucucagcaagauauccucuucugucuagaaaagaaggaacauuauaaagggcccucuagaaacagccaauaugccucccuagauugaacccaugggucugcacauucauaacugaacugccguuguccaagaucaagaccuugccagacuccaggggcagacaagcuccugcuacucccugucugagugacuaaagagcuggaggggcugaggggugggguggggguaccaacagcaaggcugcccucuggcugaaggacuggcugcgcagaccaccgacugcaugcaaaaguccccacucaauucccugcaucuagggucaggccuagcaggccaaaggacacaagcuuagugcagguuggccuucucuugaggagccaggggaagguggucuacauuugcuucugggaaaaguggaccaaggcuccaagagagugcccaggcuugggucaucaaacccuccauggcucuuguccaguaauucuacuucuggcuuuguuucagaaaauaaaaguuaacaauuacucauaauuacuuguuguuuaugaccaaaaucuggagagaaccugaaugaauauuuaguaaaacauuacuuuggugugaauauuuaaacuuagcaagaggaaaaugccuguguugauacuacuaagugaaaaaaaacugugcguguaugaggauguaucauguauagauacauaguacauauagggaaaaagacaaaugaaagcauguauauucuucugaacuuagaauguccagcaggaacacccauuauuuaauacuuauuuauauuaaguaauacauauacauacauauuuaacacagacugggaauugaggagaaaguucaguguauggaguaggacuguagggaagaaaggaguuaagcagaaacaaacagguuaggccuggccuuagcgucuucagcugccagcagcaggcuugcugagcccacuaagccucccacagccgcaggcagccaagcagcaugcccucaggcaaugggggaggaaugaauucauacagaggccggacucggaacauuccaugcuacugcagcaaacucugcgcugacucugcagaacugaccugguuagcaaagaggagggacauccuggucucaucgcugguguccuuggugauguggcgaaucagcuguagcaugggcguaaugccugcaaaacagcgggcaggccaguuugcucccauuuccagugccccaguuucuggccuuuaguggauuaacauguucaccgguucucuuucuaccauuuccccuucugucccccaaacccaaaguggggaagaauacccuagauuuugguguuccuuucuaacgcaacagaaggucaaaggccccuuuuccuucuugagacaggguuucaaguaucccaggguggccuugacucauuauguagccaaggaaugcccuuuaacuuuugaucaugucaaguacuggaguuacaaugugucaccaugccugguuuuauaugauacuguggauugaacccagggccuccugugcuaggcaaacacucuaccaacugagccacaugcucagcccuccuuuuaaauguuccugugaccagaggaaaagaacauucugugagcuaguuuuuuaaaaaaagcaugauucugagccuggguguucagguagcacacacacacacacacacaccagagccagugaacauuaaaacugucugugaugguuccuaauccuguaugucuccuaagacuucauucucgaaggauuuggaaagucgagcuggaaccggaucuuccacuauuuuggaaccagugagcaaagccugccuggccuggccacacagcccugacuugagagggagcagaggaacggggucagauucaguaucugacuccacguucccacuaccacagcuggggaggaaucucauagggucaaagaacucccaaguuagaaaggucuucgagaaacccugaaaaucuuaccugugccuccagcaaucauccccagguggugaaccagcuuuuuuucaggcucacuuguuuuguuugcuuugauuaaaaggguuccuagaaauauaaagauguuuuugacuucugcagcccuugucuggcagccuacaagagaugucugagucuuaggaggcagguccagcuaagggagagguuguagcgucccaagccuucugacacaguagcuucauaggccaccucugguaugccaguguacagaguggaaaucaaggcugggcaucccagggacuagcugggccucuucuuaggcaagcugaaaugaccugggagccucuuagagccccuccauugcaaugguggaugagugaguaaauggagaaacugggugaaugauuaguguggauuccucccauuguacucaucagcagacaccuuccauauaucugugcagagacagugaugagcguaugcaugugugaaauaaguuugagcagugacagaagucacuauaagugcauuuguaugaaugaaagucugaagacuggaaguacaagcccgugugcccuagggccgaggaagaccacagaaugaccacaggaggaaucuccaagcugugagaccccacugagcagcaccugguaccuggcucauuguagaacaggcgcccuguuggcccccgaaaaaggaugguauccccaauuuucauguucuccaaguacugagucaucuuuccuccuucaggauacuuggggugcacauuuuugaaguagaucugaaaagcaguuauggguccuuuacacuucugugucuuuggcuauaguuacacacaagugguaagcgcacuuggaauuggacaucaugcaaguaaauacuuccacacucacugugaacaauuuaacaauuuauuucuguuuccacaauaaaauaucccguaaaaaacaguuuaagggagaaaggguuuauuuuagcuuauaauuccagguuaaagucuaucuuugcaggaaagucuaggcaggaacuugaagcagcuuaccacaucacauccaacagagagaaaugaaugcaugcaugccuggcagcgcacagcucauucucuguacuuuaacaguccaguguccucugccuaggggguggugcuacccacagugggcuggaucuuucuccaucaauuaauacaaucaagacaauccaccacacacauuuccucaaaccaaccuaguauauauauauauauauauauauacauauacacagucccucguugagacucuucucaggugauuucuagauaguguaaaguugacagacuaaccacagcaauccuuugagacacuacaggauaaaguguagcauagcugauaaaugagauuauugaaaagcacuguacaggccauaagucccccccacccccagagggggaaaaaaaacacugcucuccacucuacuacacuuagaauaccuggggguucuagacagcuggguaagaugggcauuauuuaccuuuauaauuaaguccacaaagccuugaucaucgucacuggagacagguguguaagcccugaucaccaauucauuguuaauuugugccaagagauggacauaguuaccuacaaaaauguaucaaauguuaaacccgaggaucauaaguagaacccaggaauccuccaaagauucccuuugauaacacuugcccagccaagaucacacuauaauuuuagaguaagacugaauuaaaggugggguuggacacuaaaaauaucagaaaggagccgggugugguggugcauaccuguaauccuagcacuuggaccuuagagacugacuugaguucaaagcuaaucugagguauaaauugcaguucugccuggucuaagagugggaucuggucucaaaaaaucagaauuuuuuuuuucuguuuaaagaaaacuauugucuucaugaagguuuuucuuccugaucuggagucugggagggagucaccaguaccccaucuguguuccaggauagaacagggcuuagccucaugaaugcugcagggucccaggaccuggauaguccuauuucaaauaaaguagcaaugugugcaaucuggccauuggcucuacugagaggcagcagggacauuuaugcuaugucuuugccuguccagaguagaauucuauagacuugguggggagggcaaagacauaugaguuuagacuauagccugauggcagauaaugggucagauugaaggacagacuucagggaccaaggcaauuaguauugaggggaggaacugcaucaaggaaugcuaaaagcuagaagcaaaagaagguuccaggacagguucagaugaaguagaaauuaagugugcuugagaaauuagaacuacagguagaaauagaaacacacacagagagacagagaugaagagggggcaaaaaggaagaaggggaguugggaugcuugagggcauaggggcuaguucauaauguuaagcaguguaaaucugggucuugguggagucccuuggggcuaaggggcaaacuuauagacauagccugauuggacaccagggucacuugagaacacaggcuugaagccgcagcuuccuucugagagcucaccugaaacuggggaccuagaaagucugucacugcagccccauacagaaugaaacuaugucccgggucccagggucccaccuccucccaucuuuguguuaguggagcugugaggcauccaguuuuccuaucaagacucuuagagggcacuacauugccuugucccucugaccacacagcuuccacuguggcugaagagaaagcaggucagagaaguuucuacaaauucuauuucucaaguggcuugugcuuucaugcugccucccaacagggugaugacagaggcuaagcagaggaauggaacgcccagugacaggagugagggacagcaagcaggcucgggagcccggcaggacuccucagacuauaaucucaucacuuggcagaguugaagucagagcuuucuuuaaaaguaggucauuaguaaggcuguccucuaggagacaaggggaagggcuucucagucccaccuuuguuccuuagguuuuucaucuuaugagcugucuagagauguuacugaugaaacuagaagcgggacaauucaagaggucagcugggauugguuuccacagugagucccuccucaagugggucucaggaccccucagauaauccauccaguuagggcauuugcacugcuagugauucccauguauauugggccuugacugcaagggaacaucuguucuugucaucccugaacaacacaaugaaguuucugaauuuucauauccaucauucauuuuacccucacuauaccugaaguaggcagaaaagccugggaaauacuauagauggaagaaggucagagauggugagggacuggccuuaaauugcauggacaggagccauuaaggagaucuuaaacuuccugacucuaagcuuacgucuuaucagugcuccucaagcuauuacuauugugacaguccaagugggacaauggggacacuguccucaaguccagcugccuauucccuccauucaugugguccaggguuauaucaguguacccuccauaucccacaagaaugggaauccauugcuaauaggagccaaguacucaaacacucagacuuggacaugucaccaagcacugcucaccgacaggaagccccaggacauggucuggugagggcagcccaaagcggaaccuucugguguugugacugauuugcugguuagaaaaagaagaagaagaaagagguaggcagguucuguugacucucuaggaguuuugcuuugugguccagaucuuuagaaaggugcuccauuugguccugaggugacugaucaccucauauccccagcuagcauucucccccacccccacccuccccuuucaccuaaccagagggagguuuaggugacccacuaccuccuucucaaucaagggcagcggguacuuggcuucaggguccuguaaggugauaagaucuuucuucuugacacucauuuucuucagggcuaugagaaucgcaguggccccggugacagguuugguccuggcagauacagugugaagacagaccucagauuucacccaugcugggcuaggcagcucuaagccuggcugaucuuaugucuuacaggacuagcagagagaaagguauuaauacagaaggcucucucugggaccagcgugcagagguuagcugcagguccaagaagaccccuggaccaggcuugacaccuaucccagagugcuagugucuccaggcccucauuggucaucugccuccauccuggggggaaugacugugggauccuuaccagcuaacagcaaggcuggggacagagcucaccucucuagagacuugccacacucacuucggauuccgcuggagcaguggagcagugaguggcuuggggacucacuagcaccuuccuaugaguaacugaggcaaacauauaccuguaagaggcguggccaaccucccuauaauagcccucaacuccacccagcuccucccucacuaggccaguuuguucucaucccaaccuguugcagaaaagucugcagcuuagcccugaggcccacugucccaaccagcugggaaaccgcccgugaauccugccucggccaccgccugcggcuguucgccuagccccggguuccuuccugccccgcgcuuucccggcagaacucaccuggagcgagaugccugacuuauccucgagaugaacagugccuuugaugguggggaugaugaaacauccggcagug

SEQ ID NO: 4017 - RNA, 9580 nt, Mus musculus
cacugccggauguuucaucauccccaccaucaaaggcacuguucaucucgaggauaagucaggcaucucgcuccaggugaguucugccgggaaagcgcggggcaggaaggaacccggggcuaggcgaacagccgcaggcgguggccgaggcaggauucacgggcgguuucccagcugguugggacagugggccucagggcuaagcugcagacuuuucugcaacagguugggaugagaacaaacuggccuagugagggaggagcuggguggaguugagggcuauuauagggagguuggccacgccucuuacagguauauguuugccucaguuacucauaggaaggugcuagugaguccccaagccacucacugcuccacugcuccagcggaauccgaagugaguguggcaagucucuagagaggugagcucuguccccagccuugcuguuagcugguaaggaucccacagucauuccccccaggauggaggcagaugaccaaugagggccuggagacacuagcacucugggauaggugucaagccugguccaggggucuucuuggaccugcagcuaaccucugcacgcuggucccagagagagccuucuguauuaauaccuuucucucugcuaguccuguaagacauaagaucagccaggcuuagagcugccuagcccagcaugggugaaaucugaggucugucuucacacuguaucugccaggaccaaaccugucaccggggccacugcgauucucauagcccugaagaaaaugagugucaagaagaaagaucuuaucaccuuacaggacccugaagccaaguacccgcugcccuugauugagaaggagguagugggucaccuaaaccucccucugguuaggugaaaggggagggugggggugggggagaaugcuagcuggggauaugaggugaucagucaccucaggaccaaauggagcaccuuucuaaagaucuggaccacaaagcaaaacuccuagagagucaacagaaccugccuaccucuuucuucuucuucuuuuucuaaccagcaaaucagucacaacaccagaagguuccgcuuugggcugcccucaccagaccauguccuggggcuuccugucggugagcagugcuuggugacauguccaagucugaguguuugaguacuuggcuccuauuagcaauggauucccauucuugugggauauggaggguacacugauauaacccuggaccacaugaauggagggaauaggcagcuggacuugaggacaguguccccauugucccacuuggacugucacaauaguaauagcuugaggagcacugauaagacguaagcuuagagucaggaaguuuaagaucuccuuaauggcuccuguccaugcaauuuaaggccagucccucaccaucucugaccuucuuccaucuauaguauuucccaggcuuuucugccuacuucagguauagugaggguaaaaugaaugauggauaugaaaauucagaaacuucauuguguuguucagggaugacaagaacagauguucccuugcagucaaggcccaauauacaugggaaucacuagcagugcaaaugcccuaacuggauggauuaucugagggguccugagacccacuugaggagggacucacuguggaaaccaaucccagcugaccucuugaauugucccgcuucuaguuucaucaguaacaucucuagacagcucauaagaugaaaaaccuaaggaacaaaggugggacugagaagcccuuccccuugucuccuagaggacagccuuacuaaugaccuacuuuuaaagaaagcucugacuucaacucugccaagugaugagauuauagucugaggaguccugccgggcucccgagccugcuugcugucccucacuccugucacugggcguuccauuccucugcuuagccucugucaucacccuguugggaggcagcaugaaagcacaagccacuugagaaauagaauuuguagaaacuucucugaccugcuuucucuucagccacaguggaagcuguguggucagagggacaaggcaauguagugcccucuaagagucuugauaggaaaacuggaugccucacagcuccacuaacacaaagaugggaggaggugggacccugggacccgggacauaguuucauucuguauggggcugcagugacagacuuucuagguccccaguuucaggugagcucucagaaggaagcugcggcuucaagccuguguucucaagugacccugguguccaaucaggcuaugucuauaaguuugccccuuagccccaagggacuccaccaagacccagauuuacacugcuuaacauuaugaacuagccccuaugcccucaagcaucccaacuccccuucuuccuuuuugcccccucuucaucucugucucucuguguguguuucuauuucuaccuguaguucuaauuucucaagcacacuuaauuucuacuucaucugaaccuguccuggaaccuucuuuugcuucuagcuuuuagcauuccuugaugcaguuccuccccucaauacuaauugccuuggucccugaagucuguccuucaaucugacccauuaucugccaucaggcuauagucuaaacucauaugucuuugcccuccccaccaagucuauagaauucuacucuggacaggcaaagacauagcauaaaugucccugcugccucucaguagagccaauggccagauugcacacauugcuacuuuauuugaaauaggacuauccagguccugggacccugcagcauucaugaggcuaagcccuguucuauccuggaacacagaugggguacuggugacucccucccagacuccagaucaggaagaaaaaccuucaugaagacaauaguuuucuuuaaacagaaaaaaaaaauucugauuuuuugagaccagaucccacucuuagaccaggcagaacugcaauuuauaccucagauuagcuuugaacucaagucagucucuaagguccaagugcuaggauuacagguaugcaccaccacacccggcuccuuucugauauuuuuaguguccaaccccaccuuuaauucagucuuacucuaaaauuauagugugaucuuggcugggcaaguguuaucaaagggaaucuuuggaggauuccuggguucuacuuaugauccucggguuuaacauuugauacauuuuuguagguaacuauguccaucucuuggcacaaauuaacaaugaauuggugaucagggcuuacacaccugucuccagugacgaugaucaaggcuuuguggacuuaauuauaaagguaaauaaugcccaucuuacccagcugucuagaacccccagguauucuaaguguaguagaguggagagcaguguuuuuuuucccccucugggggugggggggacuuauggccuguacagugcuuuucaauaaucucauuuaucagcuaugcuacacuuuauccuguagugucucaaaggauugcugugguuagucugucaacuuuacacuaucuagaaaucaccugagaagagucucaacgagggacuguguauauguauauauauauauauauauauauacuagguugguuugaggaaaugugugugguggauugucuugauuguauuaauugauggagaaagauccagcccacuguggguagcaccacccccuaggcagaggacacuggacuguuaaaguacagagaaugagcugugcgcugccaggcaugcaugcauucauuucucucuguuggaugugaugugguaagcugcuucaaguuccugccuagacuuuccugcaaagauagacuuuaaccuggaauuauaagcuaaaauaaacccuuucucccuuaaacuguuuuuuacgggauauuuuauuguggaaacagaaauaaauuguuaaauuguucacagugaguguggaaguauuuacuugcaugauguccaauuccaagugcgcuuaccacuuguguguaacuauagccaaagacacagaaguguaaaggacccauaacugcuuuucagaucuacuucaaaaaugugcaccccaaguauccugaaggaggaaagaugacucaguacuuggagaacaugaaaauuggggauaccauccuuuuucgggggccaacagggcgccuguucuacaaugagccagguaccaggugcugcucaguggggucucacagcuuggagauuccuccuguggucauucuguggucuuccucggcccuagggcacacgggcuuguacuuccagucuucagacuuucauucauacaaaugcacuuauagugacuucugucacugcucaaacuuauuucacacaugcauacgcucaucacugucucugcacagauauauggaaggugucugcugaugaguacaaugggaggaauccacacuaaucauucacccaguuucuccauuuacucacucauccaccauugcaauggaggggcucuaagaggcucccaggucauuucagcuugccuaagaagaggcccagcuagucccugggaugcccagccuugauuuccacucuguacacuggcauaccagagguggccuaugaagcuacugugucagaaggcuugggacgcuacaaccucucccuuagcuggaccugccuccuaagacucagacaucucuuguaggcugccagacaagggcugcagaagucaaaaacaucuuuauauuucuaggaacccuuuuaaucaaagcaaacaaaacaagugagccugaaaaaaagcugguucaccaccuggggaugauugcuggaggcacagguaagauuuucaggguuucucgaagaccuuucuaacuugggaguucuuugacccuaugagauuccuccccagcugugguagugggaacguggagucagauacugaaucugaccccguuccucugcucccucucaagucagggcuguguggccaggccaggcaggcuuugcucacugguuccaaaauaguggaagauccgguuccagcucgacuuuccaaauccuucgagaaugaagucuuaggagacauacaggauuaggaaccaucacagacaguuuuaauguucacuggcucuggugugugugugugugugugugcuaccugaacacccaggcucagaaucaugcuuuuuuuaaaaaacuagcucacagaauguucuuuuccucuggucacaggaacauuuaaaaggagggcugagcauguggcucaguugguagaguguuugccuagcacaggaggcccuggguucaauccacaguaucauauaaaaccaggcauggugacacauuguaacuccaguacuugacaugaucaaaaguuaaagggcauuccuuggcuacauaaugagucaaggccacccugggauacuugaaacccugucucaagaaggaaaaggggccuuugaccuucuguugcguuagaaaggaacaccaaaaucuaggguauucuuccccacuuuggguuugggggacagaaggggaaaugguagaaagagaaccggugaacauguuaauccacuaaaggccagaaacuggggcacuggaaaugggagcaaacuggccugcccgcuguuuugcaggcauuacgcccaugcuacagcugauucgccacaucaccaaggacaccagcgaugagaccaggaugucccuccucuuugcuaaccaggucaguucugcagagucagcgcagaguuugcugcaguagcauggaauguuccgaguccggccucuguaugaauucauuccucccccauugccugagggcaugcugcuuggcugccugcggcugugggaggcuuagugggcucagcaagccugcugcuggcagcugaagacgcuaaggccaggccuaaccuguuuguuucugcuuaacuccuuucuucccuacaguccuacuccauacacugaacuuucuccucaauucccagucuguguuaaauauguauguauauguauuacuuaauauaaauaaguauuaaauaauggguguuccugcuggacauucuaaguucagaagaauauacaugcuuucauuugucuuuuucccuauauguacuauguaucuauacaugauacauccucauacacgcacaguuuuuuuucacuuaguaguaucaacacaggcauuuuccucuugcuaaguuuaaauauucacaccaaaguaauguuuuacuaaauauucauucagguucucuccagauuuuggucauaaacaacaaguaauuaugaguaauuguuaacuuuuauuuucugaaacaaagccagaaguagaauuacuggacaagagccauggaggguuugaugacccaagccugggcacucucuuggagccuugguccacuuuucccagaagcaaauguagaccaccuuccccuggcuccucaagagaaggccaaccugcacuaagcuuguguccuuuggccugcuaggccugacccuagaugcagggaauugaguggggacuuuugcaugcagucgguggucugcgcagccaguccuucagccagagggcagccuugcuguugguacccccaccccaccccucagccccuccagcucuuuagucacucagacagggaguagcaggagcuugucugccccuggagucuggcaaggucuugaucuuggacaacggcaguucaguuaugaaugugcagacccauggguucaaucuagggaggcauauuggcuguuucuagagggcccuuuauaauguuccuucuuuucuagacagaagaggauaucuugcugagaaaggagcuagaagaagucgccacgacucaucacaaacaguucaaccugugguauacccuggacaggccucccagugguaugacccauguuacucuccuuuauucugggccagcuccacccuuggacacaccuauagacuagucucuagcuuuugucuguuuugucuuuaagguuuacuccauaggagauuaugccugggggcucuuggucuauauagggcguacaagaaucugagugggaggauauugggagcagcaguuuuuaaugggagucaagggcagguguuaaauaccucuuccacacgccacacacugcacugaguauagacucugagccaccaggcuaauugagcacguacucugcagucagcacauugcaccuaauaugaccccuggccccuuaaccucguguaccugcucauggcuacuucuuaccuccaaccucuucuggacagcagacuucaaaugcugagcuucagucagcuccugcagccucaccuagcaucccaggaacuuccgugcaccuugcaucaugcauuacacaucuccugcuucccugaucuauacugccuauaccuauaagcuguccaccagugugaccuccucaccucccccuaacagccccacuuucuacucaaugcuuagagcagagagacagcaucccgagucuccgagagccuagaauuuggcaaaaaugcuauggacggcagggaagccacaugucugcuucuugagucaacuaugacaaucagcagugcagacuuccaagcguuuauaggguagccuggucuccagcaucaggggcaaaugcagaaccaugcuucuuccccuuucugcuucauuucagacuggaaguacagcucaggcuuuguuagcgcugacaugaucaaggagcaccucccuccuccuggggaggacacgcucauccugguguguggcccaccaccucugauccaggcggcagcucaccccagccuggagcagcucagcuauaccaaggacaugauuuuuaucuacuaacaccucccacacuacuuagcgggucccucucucugcuuuagagugaguuuggcuucacccuguucaagucagguauuugcaaggugucucuccacgcacccuugggcaugauguucuuuugguugugggccuaagaagucuucacaggcugaagacaaaagugauuuuugagcuuccagguuuggaggcugggaaggaagccacuuucuccaugacuuucuccauggcuuagcggaauaaacuggacugcuuugcauuuagcucacaauguguggauauguagaaaauacacugggcaguccaggacuugcugaugugaggugagggugaaaaaagaguaggggugugaccagaaccggcaauauagcaauguuuacggauagcauuccagcaggauccgaacaggucucuaucaaccuaaccaccuaugaaccuucuuuacauuucucugcuuugaaggacaaacucacaagagggcaaaggccuuguguggucuuccuugccuuguaagacacuuuuuuuaaaaagcuguaugucagggcaguaaauccacaguaggugggcuccaggaaucccuuucugacucccugcauuuuguacagcagauggcaacauuggggauauuuauauuuuaguauccuccaccuuggcacugugucaaaguuggcaugguuaaguuucuucauuucccauuucccagaagcugugcuucaaaucccaucauucaaaccagacgauacagggaccacuauugccaccugcaggucaaaguaagaauaacauacuggugcucugcuacugcagggguuaaagcucaccccaacuccauuccuuauaaucuuccuaaugggccagagguucugcggagcuuuuguucucuaagucacacaggaggaaacagacagcguuagucaugcauuuccccagccauucagacaguggguggcagaguugucuuuaaaccuggaucuguuuaauuuuauguccuuucggaagaacuggcaaaguagcugcaguguuagcacuugcugcaggauuugcuacucaaugugcgugugugugugugugugugugcauacgggagggugggggguacaagaaaaaaaaaaagagaggaaugggguucccuggagcucugcuauauccuugaaucucacccacaggggaccaaacuccgucucaaacaggccagggagggacacucccacguucauucacccaauuguacucaguguauucuuucauaaugaccuccucggggaaagacacaacggcucacucucugcuacauugccccgcuuagccuugaacucacucuguagcucaagucaucugugaaccccacaacccuucuaucucagcuuuccaacuaauaauaacuaggauuacaagcaugugccaccagggucagcugcaaagccuuucaccacuggacucauuccacaucauuggaucuuucauuccguagaccuucuggugauuucacucgucacuggacaaagccuggagaugcuuuuggcuuuccuagcuagaggaggugccaaugacaucugcacggaagaccaaggauaguggugacuggcaacuugauuaaaagcaguacacuuggaacucacuuaggccacacagacuacagcagcucagcugguuuguguaucggguacacaugugcauauaaccuuaaagugaacugugaacaucucagaggcauacaaugcugaagggcaaaguggauuuggaaccaaaagaaagaauaaaggaagugaagca

SEQ ID NO: 4018 - RNA, 4755 nt, Mus musculus
cggcgguaggaggagggccgagcgcggcagucacgccgacgcgggaaggaagcagagcccgcggcugcaggguuuucauuucauaugggggaaugguaguaugcuggucagauuuuugucaacuggacacaagcuacaguuauuuggaaagaagaacucuaaauugagaaaaugccuccauaagauuugccuguaguuccuguuugcagguuccugccugagucccugacccgacucugugauggacuguaaucagaauguaaaauagcuucagagguuaaaugaagccaggcagaauacacccaugaggcaucgcagccccucccauguuugggcauaacugcuccagaaccaaauugacccauuuggauuaguuaacuuuugucaaaaugaagaaaaucagucugaagaccuucaggaaaucuuuuaaccugaguaaaagcaaagacgaaacugaguucauggugguucagccccagucccuugcuggugacuucgugaaagaugacucuuuauucgggagcuguuauggcaaagacauggccaguugugacauuggcagugaggaugagaaagggaagaacagauccaaaagcgagagccugaugggcacuuugaagaggcgguuguccgccaagcagaagaccaagggcaagggcggcacugcgucuacagaugaggacaccuucuccucagcuucagcuccuggugggcucaaggaugugcgugcuccgcggcccauccgcuccacaucacugagaagccaccauuauagccccacgcccuggccgcugcgucccaccagcucggaggagacgugcaucaagauggagaugcgagugaaagcacuggugcaugcugccagcccaggaccagucaacgaugugcgcaaggaucuacgggagcugcagcccagggaucugcgggagcugcagcccagggagcugcgagaccugcagccagagccgugcccugagucccgcugcagccccagcucacccggggaccugagccuccaccuggaggaacacgugccuguaguaaucggacucaugucucaggacuaccuucaguacaccgugccuuuagaugacgggaugugcccucuugaagggccgcgcagcugcugccuggauacgucuucucccauggaggugucagccauaccccugccggggcgaguggugccuucuccgaagacgacagucauguggaccaggaccugguuguaggcccagagauccuuguggauucaucagugaacaauuuguugauuggcaccacaggagucauguugcagagcccuagaggaggucaugaugacgccccuccccucucaccauugcuaccuccaaugcagaauaacccaauccaaaggaacuucagcggccucuucaggccucucaggaaaaucuggaugaaauggauaaaugucuggacagauaccaggcaccaaauuuaaaucagauucagaaaaauuaucuaaacagucccauaacaccuaaagaaauagaaggagucauuaaaagacucccaaacucuccuccuauugauggcugacuaggucauccucugcuagauaugcaauuagagacgcaacuccgggggguggguguacugguuaguucauauugucuaguauaggggaaugccagggccaagaagugggagugaguggguuggggagcagggcaggggaagguuuggagggcuuuggggauagcauuugaaauguaaaugaacaaaauaucuaauaaaaaaagaaagaaaauauaugccuaaaacaaaaagaaagaaagaaagaaagaaagaaagaaagaaagaaagaaagaaagaaagaaagaaagaaagaaagaaagaaagaaagaauccaaaccaaaaguagcccagggccaaaugguuauagugcagaauucucucagaccuucaaagaagaccucuucaaacuauuacacaaaagagaaacagaggcacacuauccaauucauucuaugaaggcacaauuaugcuaauaccaaaaccacacaaauacacagaaaagaaauagaacuucagaccaugguacugguacugcaacagucagcuagauaaauagaauaaaauugaagacccagaaaugaacccacacaccuauagucacuugaacuuugacaaaggagcuaaaaccauccaguggaaaaaaagacagcauuuucaacaaauggugcuggcucaacaagcgguuaucaugcagaagaauucgaauugauccauucuuaucuccuguacaaagcucaagucuaaguggaucaaggaacuccacauaaaacuagucacugaaacuuauagagaagaaacuggggggaaaaccacaaagaaauaggcacuggggaaaaauuccugaccagaagaucaauggcuugugcuauaagaucuagaauugacaaaugggacuucauaaaauuacaaagcuucuguaaggcaaaagacacugucaauaagacaaaaaggccaccaacagauuaggaaaggaucuuuaccaauccuaaaucugauaggggacuaauauucaauauauacaaagaacucaagaagauggacuccagaaaaucaaauaaccccauuaaaaauggaguacagagcuaaacaaugaauucucaacugaggaauacagaauggcugagacgcaccugaaaaaauauucaacauccuuaaucaucagggaaaugcuaaucaaaacaaccccgagauuccaccucacaucagucagaauggcuaagaucauaaacuugggugacagcagaugcuggagaggauguggugaaagaggaacacuccucuguuucuggugggauuucaaggugguacaaucacucuggaaaucagucuggcaguuccucagaaaauuggacauaguauuacuggaggauccagcaauaccucuccugggcauauacacagaagauguuacaacuuguaauaaggacauauauuccacuauguucauagcagccuuauuuauaauagccagaagcuggaaagaacccugaugucccucaacagaggaacgaauaaagaaaaugugguacauuuacacaauggaguacuacucagcuauuaaaaacaaugaacuuagaaauucacaggcaaauggauggaucuggaggauaucauccugaguaagguaauccaaucacaaaagaacucacaugauaugcacucacugaugaguagauauuagcccagaaacuuagaauacccaagauacaauuuucaaaacacaugaaacucaagaaagaagaccaaaguguugauacuuuguuccuucuuagaauggggaaaaaauaccuauggaagggguuacagagacaacauucagagcugagaugaaaggauggaccauccagagacugccccaccggggauccauccaauaaacaaccaccaaacccagacacuauuacauaugccagcaauauuuugcugacaggacccugauauagcuaucucuugugagucuaugccaguuccuggcaaauacagaaguggaugcucauagucaacuauuggauggaacacagggccuccaauggagaagcuagagaaaguacccaaggaacaaaagggcacaauaugagcuaaacaguaccccacccccuagagcuugugacucuaguugcauauguagcaaagaauggccuaguucaccaucaaugggaggagaugcccuuggucuugggaagauuauaugccccaguagaggggaacgccagguucaggaagcaggaguggguggguuggggagcagggugggggaaguguauaggagacuuucagggaggaaacuaggaaaggggauagcauuugaaauguaaaugaagaaaguaucuaauaaaaagugaaagaaugaaaacaauaaaaauugccaauuaccaaccaaaaauaaaauuaaaaacagaaagaaaaaaaaagaaguugaagccugaauacaaagugaacuauucaauacucucacuggccaaagauacacaugcaguagagauggugauggaugucuuugagcacaaagggagagaaaagaugcucucaacaaguauggcaaacacuuggggcuaucgcugucugucccuuugagacacaggccccuacauauuuuuauuuucuuuuuuuuuuaauagaaaugacuucuggaaccagguaacucauuaagacuuagcuuguccucccuagagagcauuuguacgcuuugauguacuuugaaauuauuuuucauuguuuuccaaaagccagugaaaugguuuuugguuucccagaagaauauaggacacccauaaaaaauaacuuauuuuauucguuaaugauagcuaguuugguugauguaagaggacuuuccaguuaaauuuuaaaucaaauuaaauauucauguucaaaaucaaagauaaaauaguaaauaaugaacauaauacauuuuucugaagaaacauuauuaugcuaauauuauguauauucgauugacccucuguuagguaucuugagcuuauaucuuccaaucccucaauacagcaaauaggaaggccuuaugaggcaccugagcacccacauuguuuugcaggcaaugcaacaugugcauuaaauacuugacucaauucacccaaauauucugccuuuuucucagugccuuacuguuuugauguagguauccaucauuuauacaugacugugaagaguucguagacuccagagcaucugaaagugauuuauuguggcauacauaac

SEQ ID NO: 4019 - RNA, 935 nt, Mus musculus
aauggagacucaaaaccacacaacugugacagaguucauucuucugggguuaacagagagcuccacacuacgugucauccuauuuaugguauuucuaggaauauauacuguuacuuuagugggaaauuucagcaucaucaguuuaauaagaaguugcccccaacuccacacucccauguaucuguuccuuagccaucuggcuuuuguagacauuggguuuuccacaucaaucacaccaacaauguuuaaaggauuucuuggaaauagacugguacucucuguagcugcuuguauagcccaauucugcaucacagugacauuugggacaguugagugcuuccuccuagcugucauggcuuacgaccgcuauguggccaucuguucaccccugcucuauucaacacauaugucucccaggaucuguuuccuuuuaguuggagcuucauauguagguggcugugugaauucaggggcauuuacuaguugucugucgauucuguccuucuguggaccaaaucagauagaucacuuuuucugugacuucccugcuguguugaaacuuucuugcucagaugucuccaucauuggaauuauuccuucaaucucugcuggauccaucauugugaucacaguguuugucauagcugucuccuacgccuacauucucaucaccauccugaagaugcgcuccacugagggccgacagaaggccuucuccaccugcaccucccaccucacugcagucacucucuacuauggaaccauuaccuucauuuaugugaugcccaaaucaaacuacucuacugcacaaaacaagauacugucuguauucuacacaguggugauccccaugcucaacccccucaucuacagucugagaaacagagauguaaaagaggcucucaggaaggccaucaucagaauauuuccauaga

SEQ ID NO: 4020 - RNA, 935 nt, Mus musculus
gauggaggcucaaaaccacaccacugugaaagaauucauccuuuugggguuaacagagaauuccacacuacgugucauccuauuuaugauauuucuaggaauauauacuguuacuuuagugggaaauuucagcaucaucaguuuaauaaggagcugcccccaacuccacacucccauguaucuguuccuuagccaucuagcucuuguagacauuggguuuuccacaucaaucacaccuauaaugcuuacaggauuccuuggacauacaguaacacucucuguggcugcuuguguagcccaauucugcauugcagugacauuugggacaguugagugcuuccuccuagcugucauggccuacgaccgcuauguggccaucugcucuccccugcucuauucaacacauaugucucccaggaucugcuuccuuuuaguuggagcuucauauguagguggcugugugaauucagggacauuuacuaguugucuguugauucuguccuucuguggaccaaaucagauagaccacuuuuucugugacuucccugcugugcugaaacuuucuugcucagaugucuccauuauuggaauuauuccuucuaucucugcuggauccaucauugugaucacaguguuugucauagcugucuccuacaccuacauucucaucaccauccugaauaugcgcuccaccgagggucgccacaaggccuucuccaccugcaccucccaccucacugcagucacucucuacuauggaaccauuaccuucauuuaugugaugcccaaaucaaacuacucuacugcacagaacaagauacugucuguauucuacacaguggugauccccaugcucaacccccucaucuacagucugagaaacagagauguaaaagaggcucucaggaaggccaucaucagaauauuuccauaga

SEQ ID NO: 4021 - RNA, 491 nt, Mus musculus
cauggucaaccccacuguguucuuagacaucauggcugaugauuagcccuugagccaugucuccuucgagcuguuugcagauaaaguuccaaagacagcagaaaacuuucauucucugagcacuggagagaaaggauuuggcuauaaggguuccuccuuucacagaauuauuccaggauucaugugacagggugaugacuucacacaccauaauggcacugguggaaaguccaccuacagagaaaaauuugaggaugagaacuucauccugaagcauauagguccuggcaucuuguucauggcaaaugcuggagcaaacacaaauggugcccaguuuccuaucugcccugcuaagacugaauggcuggaugacaagcauguggucuuugggaaggugaaagaaggcaugaacauuauggaagccauggaguguuuuggguccaggaauggcaagaccagcaagaagaucacugacuauggacaagucuaau

SEQ ID NO: 4022 - RNA, 941 nt, Mus musculus
uucaagggaaccaauguguucucgccauuaauuuuuucauugccuccuucaccuccuuguuccucaaacuauagaucagaggguucaacauggggaucaccacuguguagaccacagaggccacuuugacuuggucagcugaauagcuggacuugggcaucacauacacaaacagaacugucccguaaaacaaagugacugcaguaaggugggacgugcagguggaaaaagccuuguuccuucccucagcagagcgcauccuuaggauugagugcaggauguaaauguaagacacaaugaucguagagagcgugcucacaaggacggaggcagaagagauggauggagauauuucagcaauauaagcauggccacaagacaguuucacaagugggaagagaucacagaaaaaaugguugacuuuguuggggccacagaaguuuagguucacaaaacagccugugaaugaugaagcauucaugcauccacccaaauaggaugccccgagcaggaagcagcagauugcuggggacauuugaguggaguagagcaggggugagcagauggccacauagcggucauaagccaugguggccagcaggaagcacucgguaguuccaaaagcuacaucagagccaagcugggcugcacagccagcgagagggauaguaguuucuucucuuaagaaacugaugagcauuauaggugugacugauguggaguagccaauguccacaaaggcuagauggcugaggaacaaguacaugggggugugaagcugugggcugcuccgaauuaggaggauuauacugauauuucccacuacagucacuauauaaaccgguagaaagaacacaaauaagauagcacguaguguagcacuaucuguuagucccaaaauaaugaauucugucaccauggugucauuuucagucuccauu

SEQ ID NO: 4023 - RNA, 2766 nt, Mus musculus
uagaaugaauccuuauuccaaaagguaaguguauuacugacuucccuccacauugaagaauguuugguucuuugaaaaauguauacaguauauucauaagcuguaguugggaaaucagucagauauaaucaagaaaaaauuuaauuaaaucaaguauuugucauaguccuauugcugugaauaauuaacuuucaaaucuuuauuauuuacccaacacuaaaaagaugggaaacccauggacucuaacagcauguaagcucagugaucaaggaaaaaugcugauaaauucacuaguuuuaacauagguugguaauuguaugacaaaugucuccugaaaauaaagacuguuuucugucuacauagucuaguaucacacgcuccaggcaccauggaaaaacacaagaaaauagaacuagaauucucaagauaugagucaguuugcuuuuaacagagugaacacagguaaacauaguauugcagguugaauguuuauccuuuggucuauauaggcaaucacauuauuucaucccacuguauuucaguuagaaaaugucauauuaggaaagaauuuggcaauuguguaaauaagcacauacuaauauuauaggaaauaguauucacauauuugcaagugaucagaaugguaguacaaaggacuugauaaaggauggaccuaauuaguguuuaaaguauuuaauaaauuuaucauugcuccucccauauauaauuuaaguaugaauuauuuauuauuucuucccaguucuugcaagaaauauuauuuguuuucauaaaaacuggucuuauuuuaaucagguuacugguagucucgguaauaaaaagcugaacuguugccucucccaaauuaagauaugcucgucaagaguauacaugaguggguccauggcucccgcuacacauguaguagaggucugccuuaucuggcaucaaugggaggagagguguuugguccuauggagguuaguugccccaggaaagauggaugcuguaagggugagacccagaguggauggguggagggagagcauccucuuagaggcaaagaggagggguauggaguggugggcuuguggaggggagaccaggaaggagacaacauuugagauauaaauaaagaaaaugaguaacaaaaacacagacaugcucuuaacuuuuuggcacucuaaacuuauagaguaguacaugcucuuuuggcacucuaaacuuauaaaguaguaagagaaauuaaauucauucugccuuggguuuauacucuuauucuagugcuucuuauguaaaguuuaguuacuaagcauuuucaagucacacauuuuaugaacuauacaauucaaucaauaagaguccuaauauuauaauggaaaugguaauaagcaccauacaaucuauuaaauccaguauagguaaugaagaaauaauuguuaaaggucagaaauuacugaagguucauuauaaauuuuacauuuguaaaguuuaauuuuucuucuacauaugauaacuguuuuaugauuucauaagucucacacuaacauacuaguuuuaaaucuauagguauauaaaaauguauauuaaaaguaaauuauuuauaggaaauuucuaguauuucauuuugaaauuuuugauagauuccauacauaaaaauauacaaucacuaagcauccaaucuagcaccccaauuacauguuuuaaaugacauauuuauaauaacuuuaaucuauguuaaugaaaaugcagucacauauauauaaaucccuuccuguacugccuccaucacagccuugaucuagcaacagcuacacuaucccauggcuuuccuggagaaugggaaccacacugcagugucagaauucauuuuguuggguuugacagaugacccaguccuuagaauuguccuauucaccaucauccugugcaucuaccuggugacugugucugggaaccucagcaccauccuucucaucagaguuucuucccagcuccaucaccccauguacuuuuuccucagccacuuggcuucugcugacauaggacuuucaucgucuguuacucccaauaugcuugucaacuucuugguggagagaagcacaauuucauaccuuggauguggcauccagcucagcucagcugcucucuuuggugcaacugaaugcuuccuuuuggcugccauggcuuaugaucgcuucauggcaaucugcaacccauugcuuuauuccaccaaaauguccacaaaagucuguguccaguugauuguaggauccuacauugcuggguuucuuaaugcuuccuccuuuuuacuuuccuucuuuucucuucucuucuguggacaaaauauaaucaaugacuuuuucugugauuuugcuccuuuagcugagcucucguguucugaugucagugucuuuguaguuguuauuucauuuucugcuggcacaguuacuaugcuaacaguguuugucauagccauuuccuauuccuauauccucaucaccauccucaagaugcguuccacugaaggucgccagaaagccuucuccaccugcacuucccaucucacugcagucacuuuauuuuacggaacaguuacauucaucuaugugaugccuaaguccagcuauucaauggaccagaacaaaauaaucucuguguucuacaugguugugguucccauguugaacccacuuaucuacagccuuaggaauaaugagauuaagggugcccugaaaagacauuuugauaggaaaacauucucuuaga

SEQ ID NO: 4024 - RNA, 1077 nt, Mus musculus
auuucccaccaacacaaaacauauuuucaaaucuucugggcuuuuuuauuuaccauuuuggagaaaaaccugauuauguugccuauaucuuucuucaaggcagucuguaugccuuuguuccuuagacuauaaaugaugggguugagcagaggugucagaaugguguaugucacugccaacaguguggcaucucuaaaagaguagcuguucuugggucucagauagacaaaagaagcaaauccauaauguaugaacaccacugugaaaugggaggagcaaguugaaaaggucuuauaccuucccuuggcagagggcaucuuuauaacuacugucacaaugaagacauaagaaaccaugaugaaaauaaagcugccuaccaacacaaaggcagugagugcaaagagaaucacuuuaugauaaaagguuaaauuacaggccagggagaccacagggucaauaucacaaaaaaagugcugaaugauauuggaguugcaaaaagacaaguugaauauugugaugacaauacacagagagauugagaagccaagcacacccgaggccacgaugaggugaaggcagaucuuuugggucaucaggauuggauaaugcagaggguuguggauggcaguguaacggucauaggacauggcagacaagauaaagcaguuauugccucccaagccaaagaagaaaaacaucugaguggcacacucagggagagagauggccuuguucuuugauaucaaguccacuaacaggcggggcaggaucaccauaguggugcauguuucugaaaaggacagggcaaagaggaaaaaguacaugggggcgugaagguugugauugagcuugauggccaccaugaugaaugcauuugcuagaauaauagucacaugggagaggagaaccacaacaaagaguagauuguguagcucugggaagcuggaaaaaccccacagaagaaacauauucacuguggugugguuucccauccuccuaguggcagugauuuuugucccagagcaagauauauauuuuagguaaagauucagagaugacugugacgagcuugugcac

SEQ ID NO: 4025 - RNA, 947 nt, Mus musculus
gaugaggaggcaaaaucacaacucuacaguugaauucauccucuugggauuuucuaacuauccugaacuucaaggucagauguuuggggcuuuccuaguuauuuaucuggugacuguguugggaaaugccaucauuaucaccaucaucuuccuggaccagaguuugcacaucccuauguaccuguuucugcaaaauuuaucuuuaguggaccucuguuucaguacagucaucacaccugaaauacuggugguccugacuagugagaaagcgaccauuuccuuugguggcuguuuugugcagauguacuucauucuucucuuugguggaacugaguguuuucuccugggggcaauggcuuaugaucgauuugcugcaaucugccauccucuaucuuaccccgugauuaugaacaaaagugucuuugugaaauuaguuauguucucaugggucucagguaccaugaugacuacucugcagaccacauggguguuuagcuuccccuacugugaccacaaggaaauuaaccaucucuucugugagacuccuccugugcuggagcuugccugugcagacaccuuccuguuugaagucuaugccuucacaggcaccauuuugauugucaugguccccuuccuguugauacucuugucuuauacucgaauucucuucuccauccugaggaugccauccacuacagggaggcagaaggccuuuuccacgugugccucucaucucaccucugucacccucuucuauggcacagccaguauaacuuaucuacagcccaaauccagguacucaccagacaccaagaaacugaugucacuggcauacacacuucucaccccucugcugaauccacuuaucuacagccugagaaacaaggagaugaaaagggcugugguaaaauuauggcaaagaaaagugacuuuacacacagguugau

SEQ ID NO: 4026 - RNA, 947 nt, Mus musculus
gaugaggaggcaaaaucacagcucuacaguugaauucauccucuugggauuuucuaacuauccugaacuucaaggucagauguuuggggcuuuccuaguuauuuaucuggugacuguguugggaaaugccaucauuaucaccaucaucuuccuggaccagaguuugcacauccccauguauuuguuucugcagaauuuaucuuuaguggacuucuguuucagcacagucaucacaccugaaauacuggugauccugacuagugagaaagcgaccauuuccuuugguggcuguuuugugcagauguacuucauucuucucuuuggugcgacugaguguuuucuccugggggcaauggcuuaugaucgauuugcugcaaucugccacccucugaccuacccagugauuaugagcaaaaggaccuuugugaaauuggugauguguccaugggucuugaguaucaugacagcuguuuugucagucacauggguggcuagcuuucccuacugugaccacaaggagauuaaccaucucuucugugagauuccuccugugcuggagcuugccugugcagacaccuuccuguuugaagucuaugccuucacaagcaccauuuugaucgucaugguccccuucuuguugauacuuuugucuuauacucgaauucucuucuccauccugaagaugccauccacuacagggaggcagaaggccuuuucuacgugugccucucaucucaccucugucauccucuucuauggcacagccaguauaacuuaucuacagcccaaauccggguacucaccagacaccaagaaacugaugucacuggcauacacacuucucaccccucugcugaauccacuuaucuacagccugagaaacaaggagaugaaaagggcugugguaaaauuauggcaaagaaaagugacuuuacacacagguugau

SEQ ID NO: 4027 - RNA, 8539 nt, Mus musculus
uguuuuggaaggcauuuauauuuuuccauauuaacaguuagaaacagccugcccauaucaaaguaucuuugcauuugacuaguauugugacuaauacauaauuuacuuuaagaaacguuucacucuuaucugggaauaugcucuuuaggaauugcugccgguguuucucauuagcauucuacuugcaguuggguuuuugaauaggaccugaugcugcucaggcaagugucucgcuuauacacagaugaggauuagcuucaauucccgauucucuggcucccuucuucccuguugggauuacaggugugcuaucacacccuauuuucuggggugcuggggacugagcuccauaugcccuaggcauucuacaguuacaaucccagacuucucagcauuuuaguguucuuccaucguaucaacuagucaacauacaaaaacaaaacgccucuuuucuacauuauuuucaaugcauuuuucucucauuuaaaaaugucuaucaaguuuggaaucaaucuaggugauaaugaaaaauacuauacuaauaccaucaauucauacuugucucuagacccauuaaccugccgcccaccuccgcacuaguccagucacucaccugcauuguuucuacuugcuggccucccugugccucuaaggcgaccagccacuaacugugauuucaguguuuaaguuuaccauccuuuggcguuuugguuuguguaggcacaugcauaucuuacacgugucuguacuacaauagcuuuccagacugaacagucuggugaagcagcuauuccucaccaugaagguuuucugcuccuguggauccaugggucccaggacugaggugugugcccauccucuauccuguugcagcucacuagcacaucucuagguccuuccacacugcacaaggcaaaucucuugacugccauuccagguaagauguuauggaagaaaaagggagaaaaagaaagaaaaaaccaaaccaaaccaaaaacugaaacaaucuuggagauuccauuugcuauuauccuaaguuagaagaagaaaaaaguaucacuguaaaccacugugccaagaaaaagcugcuugguguggggcugggugacacuaccgcagccuaggcugugggagcagccacugugggugagucaugccaacauaaccagcuucuccccacagugcccacucccuggcuuccgugcgaguucaggaacaugcuucuuucuccuggccgacaauaaacucgcaucagauaaaguucauuuacaaaagguaagcuauguuuauuuggagucacaagcagcugacugagucaccgugacucaagaccacaaagaaacccuuugccuccacuucggucucagcccuguggugaaaaccucgaccagcacaagugccucuuggggcucauucacagguuuacaaguuucucguugagggcaaucugugacugggugagauuggccagguaggucaccaucagcagguccuggaagucaaaggauaagcagugagaggcugagugcaacagugacagaaaggcuggcuagccagcuccaccauggacauuggcugcgaagaguccuggauaaaugcuggugaggcagacugaacaaggguuggagguagaagccaggaagggaaugugcaugacugcuauccucucugauucucauagaugggggacugcaguauagcccugugcaguauaggguaugugcccuggggaacacagauggggaaaaguaggaacugacuuuguuaaacugauuuuaucaagucuucuaacugagucuaguuaacaagucauggcaauaccaguaguacuucagucaagccauuaggaaguggagucgcccugaacauacuauacugccuccaacuuggacgacauagcagaagucccuccacccagcucucagggugcagccacggaacucacauugauguugcuguugagcauggucucaaagucaucaggaacuaucuuggguacuugguugacaaggcucaucaagaagcggcccaccguguugucagcagacacuuucccagacugagcacagaacaaagacucaaugaggcacuguccugucagguacugucaugucaccagcagacggagcagggaugcccacccucccuugcuuuucccuccccaauucucaccagcacauccucagcauacuguaauacagugcuuagagcauccuggaugcgagcugaggccccucccacuuguuguaagucacuugagaguccaaucacccgguuggggcuaaaacacgucuucaugaugaggucaacugugggagugugggacaggcaguaagagacaacacagaaagcuuagucaugacaagaggaaagaggucucuagccaccuacuaacucccuccaugccuucuggaagcagucaguuccccaaaaucccugcucucccugacugacuaccugcuugcuaacuauugguucuggccucauauggaugacuauauggcccgggacacugacaauuccccacccugaacaaaccuucaacuuucagucagcaugaaccuugaguguguucuuuaagcuacccagggcuuccaucuuugucagaaacagcuccucucuugaauaauccuagggucuccaaguguguacagcagggaaggaaacucaccuccaaugcguucagugucauaauacgcguacuucacugugagaggugugaacaucacucccaugguccucccagggacacccauuaaagugcuggggaagaaggagaaaauuaaucgaccaucgccccugggagcaguuuccuuguguagacuaggcugggaaagcagucaaaguuagugucuuccucuugagaaggccgggacugucccagaguuaucuugugagcaaacuuuccuuuuccucuuuggcuuggaaagguacaggaugacuucacacaccauaaugccagugaggaugacaggacucuggaugcuccuggcuggccagacacucccauuuccagggaaaccagacacaccagaacauucuuuucugggccugugcuuuugcuuuucuuucuuuuuuuuugucuuuuucgagacaggguuucucuguguagccuugguuguccuggaacucacgcuguagaccaggguggccucgaacucagaaauccaccugccucugccucccaagugcugggaucaaaggugugcgccaccacacgggccugcgcuuuucauuaccaugaaaacgccaaacuaauucaugucccaaaccacuagauugggcgcuagaaguaacucaauaaaauugugcuuauuucaacccugcauuuucaucuggauuuugaagaaaaugaauuuguagagacuagcaaggacaugaagguaagggcccagugcacaguaauaggcucaaguuauaguaauaagcucuucuuuccucagaugcuaaagccuuccccagcaagcccugacaaauggugguguagcuggcagcaaguuuuauguaucaacacugcuauguuacuguucaaaaguauacuuauuucuagcuuaaaagauguguucccaacaaugcuagcaucuucuagucuauaaauacugugcuuaguccuaggaauaaugaaugcacuaacuaggguuuguaguagcuugacauaagcuaggcgauuccucuguuggauuggccuacaggcaagucugugaggcauuuucuugaccgauguggguguaccaccccuggguaggugguccuaaguggaauuagaaagcagucugagcaagccaggggagcacagagguacgugcagcaucaccaugguucugcuccaggcucccgcccugacuucccccaauguagacugggaucuguaggcugacauaagccuucuccuucccaaguugguguuggucuguguuuuaucacaguaauagagagcaaaccaagcugugcagugguggugcaugcuuuuaaucccagcacuugggaggcggagccugguccgaggccagccuggucuacugagugaguuccaggucagucugggcuauacagagaaacccugucuccaaaaacaaaacaaaacaaaacaaaacaaaacagaacgcaaaccaagacaaugaaaaacuaaugauaauucagaaaagcaacaaauacaggcucagaagaaccugauaaacacaucauguguggguuaacuguuccagaagaugaugcuaaaggcacuuccauuuggaaugguuccaaacaacaaauacuccaguguaagcaggaccagugagugagugugaguuaugggguccgacuucacuuuagaaacuucucuaaugacagcuguuaaaagaggaauaaaguuccugaagagaaacuaagcggcaggauuagaccugagcgugcccagggcucaccugacauaggccuugaugcucaugcgcccaugcuggagaccuguguccaccgugaggugaaugggguucggggccucccugcuguaguacucauggaucagcacugaguguucugugaugucauggccuguggcauaccugcaacagcaaucauagacgcagggcagcugacaccaauaccaaaugcaacagcgcagcggguguugccgggguucucacacccauuuuagcaguaauuaacaauaugaaaaacugcauaacaaaguuguaauugaaaauaaauauucuugacuuucuaggaucaaguuaucaucaaaaucucauaggcucucgaggucacaugcuuuauauguucuaugucugaaaggggagacgagaucuagucugaugacaaugagacccucuauccacucccacccgcgccaucuuaccagccuaggaugagcucauuuggggagacuuuuuuauguaauucauacauauucuuagcaaauuccaugucaacagccaccuaagggggaaggcaggagaggagguuaagaagcuacaaguauaugcugaauaggaaaaauuaccaacccccaccaccugaggaggcccaauguggacagggaaagcagagcuucagcugcagcucuggcuacagacacagcacaguggggccuucggggaaguuagggguugaauggcugugaacuauacaggggcugcuuaaauccucucaacucacuucaucuucugacucauuguguggcaccgaaaagcaguuggugacuucuaccgagugcuugucaacaguuccugguaaagagagaagagccaggcguuacauaauccugagaacucaaagcccauggccccugacuacccaaucccccagggucagggcccuuucuaacuaaagaggaacaagaacuccugagccuccugucuccaacagccccaugcuaggaucacagguacgcaucaccacaccuggcuccuguggugcuggagagugaauucagggcuuuaugcacgauaggcaaguggucuauaacuaagcuguuucuccagguccugcuuuuggagauggccucaaagucagcaaacacgaagccaacacauuagccccaaguccagcaucaacagaacuaguauuuuccagaacucaaacucagagacccccccccccuuuccaucaccagacacgauuaagccuuccuuugcaaggucuccuuugccugcuauuucccccuaccagcccuuccccacaauacucuguacuuucuagaguaguaguuuuuaaucuuuuaaugcugugaccaucauguugugguaacccuuaaccauaaaauuauuuucauugauaauucauaacuacaauuuugcuacuguuauaaauguaauugaaauacuuguguuuucugaugaucuucugugaaagggucauuccacccccagagguuuucuuaccagacuuccucucacaccccuaacucucacauuaguuacuggaucucacugagccauaggucccaacuauucucacuugauguccugguaccuuccuuuaaguuccucacccccuaccccuuguaacaugucucugcuaguguugucuuuuguuggcuagcguuaugguuucauuuucugaacuauguggugguuugaauaugcuuggcccagagaguggugcuaacaggagguauggccuuguuggacuaggugugccacugugggagugggcuuugagacccuccuucuagccgggugggacgaagcccagucuucuucuggguucccuugaauaagacauggaacucucagcuccuucuccagugccaugcccgccuggaugcugccaugcuucccaccuugaugauaauggacugaaccucagaaccaguaagcagccacagugaaaugcugccuuggucauggugucuguucacagcaauggaacccuaagacaagguucuuaacccacagguauaccuucugucaucugaacacucaccaacuuugaccacugugacugcuucccccauuucagagccuuuucuccuagggccuccaagauaccagucucuucuagcuuuuccccuucucuuccuaaucuguuagcuccucugacaccucaggguuucagcauuguuaguguucccaguuuuuguucuaugcuucuuuucuaggucaaguacuggcccagaaacacuucaguucauguuuaugugcccaaucucuuuugcauuauuuauggcucuuuuccugcuacaagggcagaguugaguagcugugacagacugcacacaaagcugaaaauauucccugacuuuuuuuaaaaacacagcuaccaaucccugugguaggugaguacaucuaccucuuuauuucaguuacuuaucuucugggggcuagggcauacuugcccacaccucuuuacauuugcaucuucacacguacuguuaaaauuugccuuucuuuuauacugauuaauuauggaugugcaacugcuugcccauggaagucagaggaccgucugcagguuuucuccuuccaucaugugggcucugggaagugaagcacgggcaggcagugaagcgcccuggcagcccugcuuacucaauuuucuacuugaccaacccacugguacacucaggggcaccucacaaggaauaccaagcccaagccacacucuguccuuucuucuuguaugcacaacggcagcucuagaacucacccaaaccccucucaugcugcaguucugucacgccuugaccugcgagcucuauuuccuugcguccacucucugccucucucugccuccccuuugcaggugcucugcuucagcccucaaucugcuguccaggcccaacucaggucuacuacuuuccacaaagcaggcauguucucuaguuuccccugccucggcucuggaaugagugcuggucaugggccucugcagagaccagccuggaggagucuucucagcucccugugaguccugccccacaggcaggugaccaaaccacugagggcuucacuuccugccacccucccguaagccugggaugccaaccucuucagauaguuggcuucucuucaucuugaagguuagcgacggacacauaauacaacaacagucuguguccaaaugaaaaaucagaggagugagguggggguuggggguggggguagaacuuggagcugagcauaucuaggguuuaugaaccaguauguaggaaaaccuugggacacgugccugucugaaaaguuuaggaaagcuagauauuauauauccagaauauguuacaaauauaccugguuuauuugaguuggaggaagcuucugacacauccucuucccuaacauggguggugggcacuuucuguuugugcugggguggugguaggucacugcauaagagagggcauguggguacucuguuuaacgggucaagggcuuugaacuugcugucauuugagcuuucauuuuuggcagcaugcccucucaguaccacguuguugggaguauaaaauaacauguagaucaaguaucacaaacuacgcaauagcuuauaccuacuccuugcacauuucuguggcuuaacggcaauucggcugaauucagaucacucgggaaggcaagccacaguaggaaggugcaaaaagagaaacaggcuaagaguucaggggcgauggaacgagaggaauaguaagaugcacaggaagaaaacauuaauuuccccagaacucacccaacaggguuccaauaacucgggcagcucccucguugcggcguucguagcuguccacgaucgaggccaaaaugacgggguguagccugaccacgcggccgcccgggaaaggccccgggagggcgggcccgggcugcgaaggcgccggcgucugcgcuggggcuggcgcggaggcuggggucuggcccggggcugcaggcgcagcuacagcaggaucagacgagacgggcgccggggacgcagcgggagucgcagccggugucggagcuggcguggauggggucggggcugaagccggggcugcggugacgaccggcgccggggcugcggcugcaguggcaggagggacauuagccgguacggccggagaagccaucuugccgagaaagagaga

SEQ ID NO: 4028 - RNA, 493 nt, Mus musculus
agugauccuaaaacugacuguccuaaggaggaagugcgcauauguacaaccacaguguuuguggaccccuaugaggaggccgaugcccagauugcccaggagcagaagaagacacagcaucagguggauccagaguccaaggucaagaugaaucagccccagccuggaaaccagggaccccagacauaccgccagggggugggcaaguacauccacccugcagccacggagacauaucgccagggggugggcaaguacauccacccugcggccacggaccgaucagcagaggaagaaccaucgaccagcauggccacccccacggccaagaaaaggcccagucggggcuuuggggacuucagccaccgguagcagcaggcuggccucagggauccugguaggaaugcagggcugugggcuucuggggcugucccugagcuuucugcccuugccaucaguuugggcuaugagccaauaaaccuguugccuaagg

SEQ ID NO: 4029 - RNA, 3235 nt, Mus musculus
auuuaaagauguagacaaucaggaucuugggcuuuauuuauuuacuccaagguacucuuuacauaaaauuucaucuuucuaguaguucaaaggucacagcucugguucuacaguauucccaaccagugauguccuguugcagguaggcaugcucccuuggaacaacaccuagaugccaccaacaaagcgaagcuggauggaaccuacuaccuccuccuccccuuaaguuuuccaugcuaaucuguccaguauuaagugaccagucguccugagcuaccuguccaucacaguaagcuuacaaagcuaggcaguugcuagcaaucuggauggcaagguuuuucaagaacuuuagauuuucaggaaaacccaucucauuucugguccucgggauuuuuugagaccagguuucuucacuuuggacugaaaguaauggcauucaucaauucuuugaauaucaagaccaauacacacggggauguaggaauuuacaacugugcauaguugggcuacacuuauucccacagacugacucucaagggcccacaccucaccucuuccuagaauguuaggcagauuuccaacaugcagacaaggaaggaugcaaagaccacauggaaaauguuagcauuuaauuaaccuccgguguggcuuuuaagccaccagaacacaggcaccuccaacacccuuaaucuucuccucagcucuucugcugaagaauuuggccuucacgaugacagguugcuuagggagcuuucccuugcccagaacuuuguaguagcccuauaauagaaagauucacaacauacaucagacacauaacaccccaagauucagguaggacuugacuuauucccccuuuucagguauguaaagccuggccucuaacucaaauguagaucaauaugggaucauagagauucaccaacuacaccuccauaguugagaguauagcauaugccagcccagauaggccauguuucugaucugggcacuagaagggacacugaaggccccuaccaaugaaucaagaccagcgauucucuccgagaacuguagcacaccaggacaagcaccaugucaggaugugacucuagccucggccaaacacccccccccacuccugaccaguuacacccuacuaaauauaguagguuaggaaugaugggcccaugaaagccucccugugguuugggucucugcacuuaggcuggugugguuuuuuuuuugggggggggggggauggggguacuuuuaacaauauagggccuuaaauaaugaacacuuuaaccugcaaaaaaaaaaaaaaaagccaggaugugccuuaagaccauucuggaccaacuauauaccucaaaaagcaaaccuguuagaaauggaaacaagugggaaccaagcagaggaagaguuauuagcaugugaccaauucaaucaccugcaacaauucuacuaaaauuuucuaauagguaauggccaaauguauauauagguuuggcuuucaaauaagaccguguauuaaaggucccauuaagagugacaaggcaggcugcuggagagauggcucagcucuaaguacugacuggacuuccagagagccuguguucaauucccagcaaccacaugguagcucacaaccauccauacauaaugggauccgaugcccuuuucuguuguuuuucucugaagaguguucucauauacauaaaaucuuuuaaaacgaauggcaagucaguucacucacugaucgaacaacaucaaugaugggagcaacuccagucuuguuuuuugccgcauugacccgugucugcucgcugaccaauguccacaguuuauccagguugacuguugggcagaagcucugguuccucuucaagugguaaugccgcauaccaacuuucccaaaguaaccugggugacuggggagggaaggcaaccaucuucagagccucacugagaaaacuuaucuuuguaguugucuccuagugaguguaaguguucacuacuguaaacauugacacagcaggcaccagauacaauuuuugaacuaaaagucaggucacucaguagcacccccacuccuuaaaggauucccuaaauagggugcaacguaacuuugaauggguuaacuugacauaugucacuaaccuggugacugacugugccagaaaguccacacagccagugaauaaggucagcaguuauucuucgaggacuuaagcacacuaaggcaacaagcaauaccugagcgugacucuagccucggacagguccccucaguucaagugcagcguuuacuugcuaaagcuagccauaccaaaugguaagaagcccguuuccagggagacaccguccuaacucaccccuucagcccccacuuccaaaacacucacuauuugucaaaguugauccugugguggugcaugccuccagcauucccgcggccgccugggugcuugcggugcuuaccugucggcacacaaagcaacuugugugacuuauagcugcucacaugcccuuauuccugcucucaguuuaccauccguuucuaagcccgauuuaucaagacucggggauagaaggaacauuuacggcauuucacaucccagcggcauguguuuaacucucaccccgcuaccaacauaaaguaggggaacugcaaguguuuccuuccacccacggaugucuacuuuccaacaaaacuccaaaggccaaacgccgaggaggcgcacacuuaccgaugcggccguggccguggcucacguggccccggaguuuccgggucuuccucagucuggauggcugcgugggaaaaacagcaaagugguuaggccugcuuagaggauggggagaccggggagagggcagcaaugccugccugcccggaucaggccugcacacgaggacuugccuucuggagcaccggcuaagccgaggccgggacucagagcgugcucagccgcccgggcccgcacguccacgcgaucccagcucuggucggaacacgcggccccacguuccucgccccacacccgagugggucaucccgccccgcaggcuacgcccagccauggagacccacuaggaccauagcaagcagcugaaaggcugggaagcagagccccgacccuccgcgauggagcggaggccaagagaagaccuaccauggcgguggcagaaagggaaaagggaggagcucacgaagucucgcgagguagcaggcgcgggggcgggaccaaug

SEQ ID NO: 4030 - RNA, 4086 nt, Mus musculus
ggcccagccuuaaucagcuucagacgcgaagcgggcgcuuguugucguucgaggacuuucuugccgcgacaggucaguguggaucccgugacucguugcgcuaaaaacauuugugagaguaggugcaugcggaccguauucaggggucucgccacuccagaaccacuuuugugugaggaggugaugaggcuagcggaccaacgcgacugaggagguagugcuggggaaagggcauucugucagaagaacucucaaggcuggggauggaggccagacggaggucuuggaacugugggugaggggacugguaagacuccaggggauggcagguauuucuuggcagguugguagaggauguaguggaguggugaguggggaaucccgucauucccuuccugcagcuuccucauuccucccuuggaagaacagauucacacaauuuuguuggagguuuauuuguuuguuuguuuuugacagucucacugugcaaacccucacuauguagaccaggcuggcuuucagucucuuugguccugggaucuggaccuaccauucaagcaucaaucguaucacuuuuuaaaguaagaaauggaucagauaccuuucagaacaccauggggcuauggugaaagcccugggucucagcgggagugacacccccuggugagcagcagggcgugaauggggagaaaguuccacuuuaaggaacauugcucagugcggggugggucccucacaggacacaaaggaauucucaguccuuaaguagugugaauagagaaacauuugcccacaaaccuagcuaccugagauuccuugaaauccaugccagaagccaggaucuguagugugcaucugucagcccuacccugcaacagugacauaagaggugaggacaggaaauuggcuagaacuccuggacuagacaccuugaauuauauagucuagcaguagcaacaagcaagacccugccuuacacauggcagaaggugagaacggacucccaaaaguuguccucagaccuccauacacuuucuuuggcacacauguacuacauucacacacauaaaaaaugaguaaaaaguagucuaguucuuauugaugaaugauucucacuucaacuucaggaucuagguagccucuauucugauugacauccccauaaauuugccuuuuucuggcgauucauacaaauaaaaucauaugguauguggcccuuuggaccggucucuuucauuuagauuacuuugaggcuugucugaguuauaguauauaguacauugucaucccuuuuuauggauaaauaauauuccauuauaugaauauacuguauuuuguuuauucaucacuuggaacuauuuccauccuggaggccuauucugauaaugcauucuaagacuaaauauuuucauuucucuugagcagaaacuuugaaguaaaaauuuugagaguauuauaaauuuauauuuacaugauaugaaacugccaggcuguuauucaaaguugcugcacaguuuuauauucccacaacuggccgcuuuuccguguccacucuagcguuuguugccuuuuuguguugcaguccuucuccugcuggugugaguaugaagugacagucucuggggcuucaguuaggauuuccauagugaccgguacugcuguagaccguuucuuguuauuucuagcuguuccuaugugcccuuugcugaaauaccuggucaaauccuuugucuguuuuuuaauaugguuugucugugguuuuuaaaaauuauuauugggcaauaagaguucaaauucugaauauaggcccccuuuauuagauauacgguuuguaauaauuauauauuauacaaauaauaugauauauuaauauauaauaauauauaaauguauacaauguacuuaauaauauauaauauaccaucacaguauauucuguuuuucauuuucuuuuucaguuuuucguuguuggggauuaaaaugcucagggcccuuugcauacuagucaaguagcuuuacuacugagcuauaucccuagcccuucauuuucuauguggugggugggguugggaguguuguaacgugugguccuuugagcaaaacagccaccaucuucauuagcucuugcuugcaaaugugcgugcgcggugucuguggacuguugacauucccucauagaaggaagagguaggagggaucauugugccuuucuuuacaugagucuccaagcaguuuguaugcaguuauacccuaguugcucagaggccuaggucucagagagaggcuagaguguauaagcugggaaagacaaagggaagggccaacauccaggccuuccugugugauagcuugugggucaggaagcuacuuauaacucccccauuccccccauaagccucacaaacucuuaauuucccagagugaacuucaacagaaucauauuuugguucguuguugggacuuaaugaagaggucuuucccauuaucacaacagucucucucucugugugucuguguguguaugguuugauacuagauguccucaauugaguuccaucuuaaguuuugaaacagcaucucuuaaugagccuggaacucaccaauuuggcuagaauagcuggcuugcaagcuccagaaauccuuuugucucugauuccccugcaccaguuaaugaauagcacacugccauguuuagcuuuuauguggguguggugcaucugggguggucccaacucaggucccuauguuugcauggcaagcauuuuaccuauuaagcuucuccucaucucccuuuaauuuguuuucuuuuuaaaaaagauuuauuuuauauguaucugaguguuuaccuacauggaugcaugugcacaaugugugugcuggugaccacagagacuagaaaaggacauaauaucaccuggaacuggagguauagugguugugagccaccauguggaugaugggaacuaaaccccaguccucaacaagaacagcaagugcuuuuaacugcugacucucuccagcugcacuuucauuuuauuuaaaauauauuucuucuuuccagauuuauuuuauguguaugggucuuuugccugcuuguaugcauaugcaucaaaagccugcagugcccauggaggccaguagaagacauggauguuucuucugcuuguauguuuguacaccaugugcuuguagugcccauggaagccagaagggggcaucagauuccuugggacuggaguuacugacaguugugagccuccauguggguccugggaauagaaucuggguccucuggaagggcaggaaguacucuuaacuacucaaccaucucuccacauccucuccuuucauuuuauuaaugaugucuuuugaagcaccaagucuuaaauuauggugaggccaguuuuacuauuuucuucuauggguugugcuuuuguuaucauauguaauuuuugccuaauuaagcauuuuuucuucuucuaaaguuuuaauauuugaguuuaauuuguauauaugcuaaaugagguauaaacucauuucuuuagauaccguuugucaaaaagacuauucuuuuuuuauuggguggcauuuguacuuuugucaaaagucaguugacuauaaguauacaggaguuaauuucuggucuguuccauugaucauauguauguaagccauucucucuugauugucguagguuuaugguaagucuagaaauugagauaucaaguauagaacauaguauacaaacuguguucuguacuuuucaaaguuguuuugauuuucuaggucauuuauauuuuaaaagauauguuaaguuccacauaaagauguugugugguagcuuuugcuaccucgccuaagcucuaggaauggaccaccccaccugccugacccagagaaaauuggaucugcaauuguaaaacacacuguuguucaauuucagcuugucuuauuagcucaguuucugggcauuauuaaucuucccaggcuggcgugcccucccgaauacucuuagcucagcauucuaaaucuguccucaacuuuagucacucaguuaccuuuagucucagcucagcaucccguccu

SEQ ID NO: 4031 - RNA, 24605 nt, Mus musculus
uccggagcucucccaacuucagagcacagagguacaacucugagaagccgagcauggcucagcugucagucaucccgggaucggccgcggcguggacaggugagcugagagcccgaaggagccgacuaggguggaaggggcuaggcugccggagcacagggccccacagcccauucuaugcaaugcgugcagggcagggcaacccacgcgggagaggggacaguugggcgaagcgguuccgcuagacccucagcgccccggggucagucugucggccguaggcugcuccgagcuagcuuuuuccucaggaugggugauggaguaaaggugggugguugacgcugauagaccccacccucguuccugaaccugcgccagaggggcgggacgcuuugcuggccacgccuucucccgcgcgcacuggcugcuccccaugacgucacgcucggauauaaaaggcgcgggagccggcucccgcggcgcuguccaggagcucgagguugaaggugcuuggcaggggacacccggccgcccggccgcgggcguuucagcgauguuuuacucaggacuccucaccgagggcggccgcaaggagacagacaugcgggaagcggcgucccugcggcagcagcgccggaugaagcaggcggugcaguucauccacaaggacucagccgaccugcugccccuggacggccucaaaaagcugggcucguccaaggacacggugagcuccccacaucggccacacccgucacgggccucugggccaccacugccgcccaggcccuuacugucacuuucacugagucaccgaccaggcuugucgcuauccacucccuggcgggugcuccggcaaaaccccucccuaucuaucuaucaaggugcuuuucuugccuguucuccuuuggcgcagucuccucucucccgacucuccccuucauguguaaggaagaaagagacccuaccuuauugcccucaaaucuccucuccacuggcuuaucuagaaucuaaaauuuggcuccuggagcuggagcuucaucacaaguccugccucccacugccuccucacaggcugcgugcguggccaguugugucccagacuaaggugauugagaaacagugaaaagcgagguuucuucacaguugcugaauauauauauaugcuuugguuaauucuauugugacccccuccccgccgccccaaauguacuuaguuuagucuuaaucuaccuuugauuuucuacccuggaugggggaguggggugagagaggggaauaggggucaagcgcaaaucuuuccagaaccuaaacaucucuucacacucucagcucucccucuucccucuaaagacugggaagauggaggaagcccugacugcuucaucucacagaccagauaaugcauguagauaguuggagcuggggcuguugcagucuuuuuauuucuggcaguauuauucuugguauuaaguagaaguucaggaugugggccagaauccaaaaccauauuguccuccauccauugaauaagggugaauggcugagggaugugaccuauauuuaauucucuuccccugcucacaaauuuauauguaacuuuguagcuucauuuggaguuguuguuauuuggaaaaagauuuuuuuuaaugagacaucagaaucuugaucuguauaaucuaggcuggcuugaaucucaucacauagcccauauuggcuucuaauuuuuaauucuccugucucagccucaugauugcugagauuauaagguguauaucaucacuccuagcuuuguggguuuuuuuuauuuauaguuuccuuauuaucuguggaaaauuuugugaaacaucaauuaaaugucuuuugcaauagaaauaaaugcucuggauaaucuuccuaguauuuuuauauuuugagcuucugaaaugcuuaauugugguuguuggccuagguucacugaaauugcuauuucuggccccaguauggcaacagaggcaagagcuccuucccccaucaauaguucuaacaauucaucaauaccaaagauuuucccugccugccauuagauacacuuaugaagggaaaauuacuccaguuaucuuacucuguuuuuaaaagcuguuuuucuguugugccuggguauaggugaucuagucauguuaacugagagugaucucauuaaaguuuauuccuaccaaagagauagcucuuucuuccuucuuucacuuuaaagcauucaugauucauuuagcaaauucaguccgaaucuucucaccuucagaacaaacuaauccuauucaauaaaguggaggguauuauuagaagaaucaaaaugcggacuuuuagaauguuggaucgaaggcacuaauguuugguuugaguggcugagauguucccuaauaagaauuaccacaacuuccuucuuccuaagauuccauauccugcuuugaacuauguaaggauaauucucuucugacuccuugucaugguugagcuacugggagcugacagcauagaacauagcugaaggcuauaaggaggaugcuuucagaguacagccauggguaugacacacagcaguucacugugaaacccugagccagaguucacacuuuccauaccccauuuucauagaguuaauuucccucucucacaguucucacaccuuuaacgugcaagcuauugcagggagaaucagaacacaucccagacaccaaggcugacugagggaggguggggagcgcugcaagggugggugaaacagcaugcuugaagcucucuuggaacugagguugcagccucaguacaaucucagaaggauuuuagaaacauaucuuaucaacucauuuuacaggcaagaccgaucaugccgacuccauuuucuuccacgauguaaaauuuggaggcuauuaaaacuaacaguaguuuuuacuugaaguaguuuaucaaaaaacccaauagaaagggaacauaaaaaggaaguaggaaaagaggaugcaguuucaacucuuauugaugcugggguuugagcaauguuaagaguguggauuauuuucaucauguaaguaucccacguuuuaauuaugccgcuggcuuuucugaaucaucuaucuuguaccaugcuaucucuaaaauguuuaugguucgauagcaaacacuguugguuuagcagauggcaccuguaaggccaucaaagauggcccuauucucguggucccaggguaaugccuuugcccaguuccuuuguguguggaguuggcugccacaaaaucugcuguggaaaugaauuguauagcuuaugucuggcucccuuauuuuaucauuccauuguauugugggucuuguauuaaauuaagaacuaaaaucaaauuuaugaaccauauuauauuugacuuuaaaaaauaauagagcuagacaaaagcaucuuuauucuuagaauuuugccuauuguaauuuucuuguuuugguuaauaaaaguucuuguuguacuaaagacuuuacucuuugaaagcaguauuccaugugaugauaugcuguguuucuugcaugauguuauuaccagccugucuggcucuaucccuccuugccuuguagcagagagaaauuuucuuuccuucuucuguuugaaucugcagauaaccaaaaagcucuagccaaacuaaguagaauucaggccaggggaagauggaacacagugaugggaacugacuaucaaauaucugaugaaaagcucaggcuggugcccuaaagauuaccuaccuauaaugcuguagaccuaucacuagagaacuuuguagccuuagaaggagcuuuaaaagaccaauauaauuauagccucuagaaggguaccuaugaugggaugcagagaguaggaauggaaguugggggaggauauggucaagaugcauuguauacuuguauacaguugucaauaaauaaaauaccgucuaaaaagauuaccuuuauggaaauauugaaggaaaugagggaguaaaauaugucagggaagaauggauguuugggcaaagauacagcaaauaugccaggacuuuaaucccagcacuccagaggcagagguugaggccauccuguucgacacaguaaguucuaggacagccagggauacagagaggaaaccugucucaaaaaaacaaaaaacaaaaaacaaaaaacaaacaaacaaaaaaaccaaaccaaaccaaaagacacagcagauauaauguucuggccaucaggaugcuucauagaauuagagaauugagagaggaccaguguagcuagcguggaaugagcaaggaguguggugacaggagauagauaguaacacaaugauggacauggaaccagcaaggaguguggugacaggagauaguaacacaaugauggacauggaaccagagcuuuguguguucuagguaagucucuaccaauaaacuacauucccagccucugacauucauuuaaaaacaaacaaacaaacaaacaaacaaacaaacaaacgccaaacuuaacuguggucacuaugccgagaaugaacugaagcauaaaaaucaggagauaaaugaggaaacuguugcacuacagauagaaaaugaugguagcuugguuagauugaaggauguaaauacgagggaaaggauauugacuguagauguuguugagaggaggggacaacugcacuugggaggggaggauaggaaaaggaucaagaauguguaugaugccagagagauggcuuggugccaaagagcauucacagcugacugggguucaauucccagcgcucucaugguggcucauaaccuucuguaacuacaguuccaggggaucuaccuccuccucucuuuugucauuucugggguacacagacauccauguaggcacaacacccauacacauaaaauaaaauuacaagaaaaagaauguguaugaguugggacacugucuauaguugcaagcugcuuaaggcuagccuggacaacauagugaaacccauuucaaaacuuuuuuaaaaaaaauauuuauuuauuuauauuauuuauauguaugaguacaucauagcugucuucagacacaccagaagagggcaucaaauuccauuacagaugguugugagccaccauguggcugcugggaauugaacucaggaccuuuggaagagcagucagugcucuuaaucgcugagccauuucuccagcccccaucucaaaacuuaaucaaaccaaaccaaguaaaugacagagucauuugcuaaggauggcaggaagaaguuccugaccaaacauggagcucaaacauccuuuauuacuguuaaaaaaaaaaaaaagcaaggcuuagugagauuagugauuugcucaagguaauauacgacaagugguaauuugcuaaaaguagaaagccuucacgcugcaauaauuaaauagaugagguugggaaggaggauaagugguaguuaguagaucuugaaugcuaaauugagagaauuuuuguuuguuccaucuggcaagagaaauuguaaggggaagagaccaugaagguaauguuuuaggauuacagaugcucagauguagcaguagcagcagaaauauagaauaauauaugagaagaauuucauucaccaaaauagaggauagugaagaaaaacaaccuuuauggggaauauggguaggacaaguugagucugaagugccuguggaguguccagguagaagaggguaguuagguuuaugggccugaaacucaaagugagcuguccuugagcuagaauccuuuuaaagguaguauuucauuaugcaaugaaaacagauaaagucacccauggcaaauauguaaagugagaaaaaggccaaauauagagcaugaagaauguugacauuuuaaaagggggcagagguagacaagacaaacagcaagauggcuuuagaggcuaguuggaagagaugcuuaagaaaauacaauguuaguuuuuugcaacauuucugaugacaaacaugugguaauuaguaauuaauaaguuaaauugauauauauuuguacaauaaucucaaguaucuauagaugauagcaccaaguaugggcuggggagauggcucaggguuuuuuuaaaaauauuuuuuauuacauauuuuccucaauuacauuuccaaugcuaucccaaaagucccccauacccucccccccacuucccuacccacccauucccauuuuuuuggcccuggcguuccccuguacuggagcauauacaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccagcauagucucacaagagacagcuacaucuggguccuuucgauaaaaucuuacuaguguaugcaauggugucagcguuuggaagcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauucuucuugaguuucaugugucuagcaaauuguaucuuauaucuuggguauccuagguuuugggcuaauauccacuuaucagugaguacggcucaggguuuuuaaacauacacugcccucccaguggaccugagguuacuggugguuaccucuaccuggugguuguaaccaucuguaacuugagauccacaggauccggugcucccucuguucucugagggcauuuacacucuuguauauauacuucccaccccaaaacauaauggcaaauaguccaauaaaauacauuuaaugcacugaguaggccagcugugaggaaagaguguuaagcagcuguacuggguauuuuucuuguuacugucacaaaauugcugacaaaaggaacuuuaggaaacaaugauuuauuuggacccauggaauaaaggugcagcccaucauggugauaaggcauaguaauaagaacuagaggugcuuggcccauuguguugcagacaagaagcacacacacacacacacacacacacacacacacacacacacacacacacaaaugcaugcaugcacauauaacuacauguacuuaaaaauuaaguaaucagugcucgcuucggcagcacauauacuaaaauuggaacgauacagagaagauuagcauggccccugcgcaaggaugacacgcaaauucgugaagcguuccauauuuuuuuuuuaccaugacauauagucagggccgacucuagggaugccagauucugcugccaugcuggaaaggugucuguuggaaaaguggcaguuguucacugucagggaagacuauauugcaggcccuugcuaggggacagugacacaacagaaucaggaaaaaaugggauuuccuccuagcuaucaagcaaucagagcuuuaggcugguugagaugccaggucaucucagauaugcagauuccugugucuacauaacuaaugagcaaagaaaaaaauuaaucaauuacaguguauguguguguuguauauuaauacaaacauauacuuuaguuuuugcauguucuuguagaugcuuuaguucuuuaauugguccacuuucaguccuuuucuauuugacuguguauagaaauucaauaagcuaaauuauuuuccaaggucuauugaaaugaggauuggccguugaauuucaccaguaagauauaggggaaaaacugcuaauggaacuguuagaaaaacauuagcuuuucugacaaagggauagauggcauuaggaugguucccuuccucuucccucuucuuuugaauauggauggauguaaugccuggauauaagucaccuugcuuaugaccguggggagauguguaagagaagugaaauuguuaaucugcugaguuaauguaggcaguauccaccuucaaauuucuuauuucuuuagaacugcauuuacaccucuguaagcuggccuuucuuguggcugcucucuuuccuaugauacaggaucaccauguuucucaauaaauggugauauaccaauguccuuuuucuucagacaaugccucacuauauugucuaggcuuaacuugaacuugugauccucuggcccaggcuucugauuagcuggcaugcacugccaugcccauuucugacuuauugauuuuuacuagcauguauuuuuuuuuuuuguauuggucgucuuaaaauggauucagauggaacagaaggaugguuucguagguaaaagcacuugcaccugggucugaugaccugagcucuguccuugguauucacauaguggaaagagacaaugcacuccugaaauuugucuuuugguccccauauauauggugcaguacaugggaacacacaugcauuaaacuuuaaaaguuuuugaauagguaaaaaauuccauucucauaccuucugucuuacuuaggguugcuauaaggagaaacuacaacuccacaccuacuccaacaaggccacacguccuaacagugucacucccuauggggcaagcauucaaauacaugagucuggggagccagaccaccacaccucauaauauccucucuccuguuauacuaguuauguugaauuauuauuuuguuuugaaucagcauuuacuguuauaguaugaccauauuuguauugcuuacagcugagacaaauguacugugauauuuuucuguuagguauuuuuccaaaauuaauuccuugaaguuuuuccuuuacuuaauuuucaaugaaaaauugcuuuaaaacuauaaaugauuacaaguucauuuuuaaaaaauuuaaacuaaagcauaauuguaucauuucucccuucccuuucuuccucuuauauuauuuuugaaacgggguuucucuguguauagccuuucguguuuuggaacuugcucuguagaccaggcuggcuucgaacucacagugaucugccugcuucugccucuggaauucugggauuacaggcaugcaccgccauugcuuggcccuuuucuuucuuuaccucccuuucaaucucauguuuucuuuucuuuuuuuuuuuuuaaauaaauauguaaguacaacccuaucagucuguauguuacucauauauauaugacuuggggguuuauuacuugguauuagaugacuaauuaguggggagggaaggggcucuucccagggaagaccaucucucuuaugcacagcuuuccuaaguugccuauaguucucugucaaagguuagggccccaugagcucucucccuuccauguuaacaugucuauugguggugaugguguucaggucuuguuuaggcagucauguggagauuucaugguuguagcuucucugagacuuguagaagaugcaaucucacagcagauuuccuguuccucugguucuuagauucuuuccacuuccucuucuuugguguuccuugagcuucaggggcaggagcuguguuguagauguaucaguuguugcugagcaccauaugaucauuuggucuuuauaucuucauggguuguguuuuucuauaauacucucugucuauugcaaagagaagguucuuugacaagaugugagauaucuggcuagacucuggcacaggauguaugacuccuuuguuuugagacagucucaugcaucaugcagcccaggaucaucugguacucacuguguagcuaaggcuggcuuugaacacuugaucuuccugccuccaccucucaaguguugguugggauuagagcacccccacaaauuagucacccaauaccgaguaguaaaccccaaaaccauauauauaugaguaacauuauacagacuaagaagaauaucaggcuugguccauuuuuuuuuuuuccucuucaagacauucuuccuggaauccguuuucucaugucauuuugaucugacugcuauugaucuuaauaggcaaauuuuuaauacugcauucagaauucccuuuccuguccuucucuacugaauccuuuuuaaaauuuaaaaauguuuguuuacauguuaugaguguuuucccuacacauaugucuguguaccauaugcaugccuggugccagauaaggccagaagcuagcauuagauucucugaaucuugaguuacaaaagguugugggccaucauguggguauuuaggaaucaaacccaggucuucuggaagagcagccaaugcucuuaaccacuaagccaucucuccggcaccacuagaguuuuggagguauuauuccauugguguuguuuacuguugagaaaucaucaugauucugguuccuaauccuuuguauuuguguuauaguuuucucuuuggaagcuuuugggauuggugucacaauaguucacagugaugugauaucguuuugucuguucccccucacacaaggauaugauaucuugaaguagacuuucuugcauuuuuuuuaagauuuauuuauuauauguaaguacacuguagcugucuucagacauuccagaagagggagucagaucucauuacagaugguugugagccaccaugugguugcugggauuugaacucuggaccuucggaagagcagucgggugcucuuacccacugagccaucucaccagccccgaaguagacuuucuuuuucuuucacuguacuaggcuuugccauuucaaucuuuaaauccacauccuucaguucuuccuuaguguggaacccaacacuccaauagcuguuauacacaucugaaaggccaauuagucuuuuaaauuacagaguaaaguuuuagcauucuucccaauuguuugggucaagugagagucauaugcaggcuuuaaacuuuucaguuuccauuccuacucacagcccugaugguagauguuccaguaccucuaucugcucagcuuugccaguguauuggaaugauugagaaaacugcuuuugauauagauacugcuauacaugugauagcucaaacauaauucucuuaaguuaucaguacaaaugguuucugauguuuguguguucuguacccacagauccacccaacuauaagaugaaaaauuaaaaaaaaaaaaaaccuguuuauaggaacugaagaaauagcacagcaguuacgaacauuugcucuuccacagggcucaagugagguucccagaaccuaccuuggucagcucacacauuuccucauuuccuucauucgagcuucucccucuucuuccccaaggauacugauuuauaaccugcuuugccaagaaucaguguguuuugggaaucuguuucuucucaguggaguuauggugagucacagcucugacucccuucuuccuuugcaaucgguaagguagcuuauaauaaagacuuuuccucugcuagccccuuccccaaggaacuucuaggcucuggacuucuaagaauaagaucuuacccuuuaaaucagaggaagaaugugguugguugaaucuugggacuaauugcuauccuuugagaauuuugaaauguuauuguaaagugggcauaagauauauguguauagaaaauuucucagaucaaaugacuuagccuaaaaaaaagaaaggaagaaagaaagaaagaaugaacgaacgaacgaaagaaagaaagaaagaaagaaagaaagaaagaaagaaagaaagagauguucuaaauggucuagaggccacuuugaguaagaacagaggaauaugaauauauaugauacagaaacucuacuaaguucuacugaaacucaaacuugaauguacaucggucauucuguuuccugacauuaucuuucugucauguauauaaggucuguuacguuucuucuuggucaguguccguuuuagguccucacuuucuuguucauuaaaaagugagacaaucuggggauauagcuuagugguagaguguucggcugugugaaaguacuagcauacccuagcuuaaauccucaaugcuguaggaggauguugaggaauggaagagaauaaagaggagaaagaggauacagagggagaagaggaaaguagacaacuguaagucaguaccuuauagacagggcagcucauugucaugggcacucagaagcucugcuuauugcuauauuaaaugucauuccuuauauucuuauagucuuacuuuucacaccuacuuugcaggugccuuauaggccuggaucuucugacaguggaguuaccaacagggaugauagaauagaaagacagucauggcugaguagaccucauaacggacauauuuuggagccaggcaagucccacaggaaucauccucacugauagccucuagacuucaaaacauuuguaucccuugguuuaucuuguugucuaggaaaacacagagaucgcuuauucuagaauaaagcuucuuucuccugaggaaggcagaaguccccaucaccaggguccuuugguucuccuaagccacaguugguccuauaucuaugcauuaguuacuucucuauuacugugauaaaacaccaugaccaaggcaauuuauugaaggaagguuuauuugggcuuaggauuccagagggauaagaguucaccacaacugugauggggaaugguaacagacaggcauggugauuggagcugcaaguggagggcucuuaucuugaacuacaaacuuguagcugagagggcacaguggggauaucacaaggcuuugaaaaccucaaagucugccccaguaacauauuuccuccugcaagaccauuuccccgucuuagucacuguucuauugcugugaagagacaucacaaccaaaacaacucuuauaaaugaaaacauguaacugggagcuugcucaaacguuucagaacuuuaguacaguaucaucaugguggggaacaugccaacacucauggugcugaagugguagugagaguuacauccugaucugcaagggguuguggugauagagggagugggguauggggggguaugggcuuucuuaaacuucaaagccuacccccagugacacacuuccuccaaggagaccacaucuaauccuuuuaaucuuaucaaagaguuccacuccuuggugacuaaccauucaaauauaagucaaugggggccauuuuuacucacaccuccuaagccucacaaaaugguacuagcaaguauucaaagauuuauuuauuuuauguauaugaguacauuguagcuagcugucuucagacacaccagaagagggcaucagaucccauuacaaaugguugugagccaccauguaguugcugggaauugaacucaggaccuuuagaagagcagucagugcucuuaacugcugagccaucucucuagccugugggaccaaguauucaaaugcccaagaauauggggacaccucauucaaaccacuacauucuauuuccugccucccauaucauuaugcaaaaugcauguaguccaauuucaaaaguguccauacucuuucuuuuacagauccaacacuguuuuaaaguacaaagucucuuuugagacucaagccagucucuuaacuauaaaccccuguaaaaucaaaaggcagauuacaugcuucuauccaucagggcaaacucuaaauccuguaauuccaugccuguugucaaggacuuagaugguuuuaccccuccagcuuugcugucugcaagcuacgccuuucucucaggcggguuccacucccuguuugcaggucuuguuggcagacauuucucacuucuagcaucaccaacaucuuagagucucaaacacaauccaggcuucauuucacucgaaggucucucgggccuuccaagcagggacuccccugacacaugccuggccuuagagacuuucugacaccacagaggacgauuccaugacuccuuuacuuaugugucuuaccugguucuaaagcuggcaaccauguggauaacacuguugaguucugcugccagguugggaugcagucugccccuugaauagcauuugcagaagcuuuugauguuuauuucuuucuagaagcagaaaauucuuuaggcuuuuuccuuucacacguuggaagcuuaguuggguguggccugcacccuccccuuucccagugcagaucuaggcuuuccuucauuccuucaucuccuuaucucuuucaacacaagcccugacucaacuuaaguuucuuggugcucuuuuauaugcgugacugcacauuuuauauuuuucugccucacuuggucuucauuggagaucuacauaagaaugacuacuaauaacaauuugauagaaucaauauuaggcugucuuggaauuuccucugccaaagaaauuuguccauaacuuuguaauuuagucuuggaaaaaugcuuaggacaagggcagaaaacagccacauucuuugccaaaguacaaaacagaaaaaacagcaucaagcccaacugcuaauaauguuccccucugaaaccucuuauacugggcaucuacagucuauguugcucugacaugucuaucuuccaagcuauucuaguauggccucuuaaaacccaccagagucuccuuauucuuucauagucacacuucuuaguccaaaguuccaaagucuuccacauuccuccagaaaauagcauggucagaccuguugcagcaguagcccauucuuugguaccaaacugcugucuucauuagguuucuauugcuauaauaaagcaucuugggccaaaaaaccuugaauuucuuuuagcuuacagaucucaguccaaucaucacugaagaaaguuagagcaggaaucuagaggcaggaacugaagcacaggacuuggugagcucuguuuaauggcuuacuccucaugacuugcucagccugcuuucuuauacaacccaggaucaccuucccagggacaacacuaccugaaaugggaugggcccuuccauaucaauucucaaucaagaaaacgugccagaggcuugccaaccugauggggacauuuucucaacuagggccuauuuucuuagaugaccugagcuugugucaagcugacaaagaugaagcagcauacaccagaguuggccgugacaugcugguuuauauaguaccugcccugacaauaccaacgcuuuccucaccugagggaagacugagaagccaagucggagcugcucugugaaguccuuuguuauuucuguggagucggggguggggcugggagagcagggagagcccuggcaguaagaagccucugcuuucuaucccucaagcaaccccauaacauucugcagaggcgccucauggaaaccaaccugucuaagcuccggagcacucgugucccuugggccucuaagaccaacaaauucaaucaggcuaagucugaagggcugaagaagugugaagaugaagacaugauuuuagugucuugccagguaagagaacauuuuuuuuucuagaguuuucuuaaaaguagguuuugagggcccuuuaugaucccaauaguaggcccucuccucaaaccuuuauagauagugguuguuaacauggaauuaauaaguggguuuuaaaguucuuuauacuagaagugaauauaauauuuuauguaugcacauuugaaugggaagaaauaacaaagcuuuuaucauauuuacaaaggaugugugauuuuuuuuaauuuuugaaaaauauuuauuuuauauauaugaguacacuguagcuguacagaugguugugagccaucauaugguugcugggaauugaauuuagggccuaugcuuguuucagccccauucacuccagcccaaagauuuauuauuauauggaaguacacuguagcuguccucagacacaccaguagagggcgucagaucucauuauggaugguugugagccaccaugugguugcugggauuugaacucaggaccuucggaagagcagucagugcucuuaaccgcugagccaucucuccagcccaugugugaucuuuuuaaagagcuggcguguaguucagagguaaaacaaaaugaaacaaaacaagccucaucuagcucaucuagcucaaagcccugaauuugccuccaggaugaucuuuuuuaaagauuauguacauaauauuuagcauagagugaaacccauaaaggauuuuauggguauucuaucagccuuagauuuaguuagcaggaaaaagagccagucaaagacagauuuagccgugggggaagugggacagcaccaacgaccgguuggaaggcugcucucaacccaugucuuucauuugacaucugcugcuugcucuuugucucauuccucuuuugcuucucuagauccuauuaaagagucuauuuccuucccacagugugcugggaaggacgugaaagcuuugguugacacuggcugucaauauaaucucaucuccucagccuguguggacagauugggguaaguagccauuuguccuggguagaagucagaugcauuuauucuucuuccuugcaucugguuuaagguuauaaugcuuggauguauccacagaagcaagaaaaacaugcgaagcuuuuccucuccuccagaaccaguuuccuuaacagagaggagugcugcaauuugucagacagugggagaaaugcaggagaccuugggccuucuguuaauuuccacuuucuaaauucugagcagguuucuagaguauggagugagaaaguauaagacucucgcucaguacauacccugccuugauucucuagacagcaaguuguccuguuguuacuccagaaguguagaagcaaggauggcuuucucuaccuuacugcuauuucacucaaccuuuccuguuacuucuuccuucuucuuacucuuucuuccaaaguaccagauguucucugagguaucuugcuuagaaucaaccuaauauuauuuccccuaguuuucuguagacccagugauucucaacuuuccuaaugugugauccuuuaauacacauguuguggugauccucagccauaaaauuauuuucguugcuacuucauaguuguaguuuuguugcuguuaugaauuguaauguaaauaucugcaauguaaacuccaguggucuuaggcagucccugugaaagggucauucacccccaccccaaaggggucaggagccacagguugagaaccaaccgcugcuguagacagaaaacuguuccucaggccaaaucucuguaauuaaugagacagaccaaguggccuguuuagagcuucauccaaaacaugcauauucucaacugggcuuacccagggcuucacugcaguucuuaaugacugcauuauaucaucuguuucuccuauaucugccuacuucucacuuccuacccacuguugggacucucggaaguuuguucugugaauuauuuuauacauuacuaucuaggauuggggaaaaguagaucccaggacucaagugggaagaaucuuaaguuuuuugucuuugguuuuuuuuuuuuaauguagugaagagaugagguauguacaauaugaugguuccagaaagacuaaugauguccuggugcauaauuaggcagcagacugccaugguuccggaggaauuaauaaccaucuguaaaacugcaauuaguuuucuuuuggaugggcuguaauaccaaaagagaggaaauggaggaaaacagaaguauuggcacagaaaaucccuaauuaaguauuuauccaccagcccauaauagcucgggugcuagcuauuccaaucagcuuauguaauugugugaaaccuuggugcuguuccuuuccuuccaucccagcaaaggcaagucaaauuagggaggacuuuccccauaauaugcuuugcugcuaaccaguaucaauagucuuaccaaacaagugccugucuccauuagccuuauagacuaagacaauuuuaugacaagaaauugaaauaggaaggagaaaaauggaccuugaacgaagccuuuucuaaguuaggauuaauuugcccucugauaucuguuauccgcagauggauaaagacacauuaauagggauauuaggaugcagaauagaauucccuaaacaugucaacuccucucugcacaaaugcagguaguaauuuaaguuucugaaagacaggaaacaaguccccuguuuucucuuguauuccccuggcaugguuagaaagaaaggguugaagcaaguauagccugccuagcucaggaagucccucgagaacccaauucugagacagaaaacuuugacaaagggauuauaauagcuuucucucuguuucagacuaaaggaccaugucaaaucucacaagcaugaaggggaaaagcuuucucuaccacggcaucucaaaguaguuggccagauugagcaccuaaugaucacaguggguucucuccgucuggauugccaagcagcugugguuggugaguuaaauugggggacagaugggucuaacauaaacucucaugccuauaauacugacuucuucaaaauccaagauuuccauuuccguauacucuacaccuuugucauaauuuuacccuuccaagcgcugggauuaaagguucaugccaccauacugugcacauuuguuguuauuguucugagacagggucucucuauauaguucuguauguccuggaucucacuauacacacuaggcuguccuuguacucacagagauucuccugucccccccccccccagugcugaaaucaaaggcguguaccaccauggacagcucagcacaucagguuuuuuuuuuuaauuaauuaguuaauuuaccaggggcuagauggcauagugguuuagaguauuuccugcccuuucaaaagacucagauuagguucccagcaucuauauaggauggcucacaaccaccugugacuccagugccaagggaucugacaccuucuucuggcauccucaggcuuuuguacacaugugauguacauacauacuuaggcacacacagaaacauuaaaucuuuaaaaauagaacggagccaguggaauugcucaguggauuaagaugguuggaaucaaacugacagccuguguuugaucucacauuuccacauguguuccacggcacagguaugcccccauaaauaaacacauguaauuaaaauuuuaauaaucuugaugacauaaggcuguuuucauacaggcauguaaaugcacuuccucacucuucacugcucagucagcucccacuguugccccaacagcuucacuaccugaugucaucuguuucucugacugucugugcccuucugaaagaagacacacaaaagagagaaaacaucaauucuuugucuuucugaaacugguuuaauuuacucacuaugaugucuccaguugcauccauuuuccugcaaauggcauagcuucauucuuuauggauaaaaggaauuccauuaugcauauaagccacaggaaacagacuuuuccuacauuuacuaauguauguguuuggggagggugugcucuugugacaugccauuuuuauggaggucagagguuaggucuuucccuccacuguggauuccaaggagugaacucaggucaucagauaugacagcaaucacuuugcccacugagccaucuuaucuaccuaaaaacagauuuuuuuuuuuaaugugugagcuaaaaugucccaaaaggcacuuuucaugagcucguaacuggugaagacaagguccuuguacuccugccauaaaugccugauugccuacucuccuucugugcuucucauauguucuguuagacuacacuaaguacuugccucuguuuuacugaaggccuuuguccucuagagcaaaaaagacuuugguuugaauuuuggcuuuuaccuucuuuuagcuauaaugaucggagaaaguacagguucaacggcuguuuauuggguaguuagcuggcugguuugcuggauggguggauggauagaugauacaaaugcauugaaugguguuuacgcugacauccaagccagcauggaaaugucugacucuuacuguuuuguuuuuuauuagaugauaaugaaaaaagcuuaucacuuggucuccagacucuuagaucccugaagguaggacugauauuucgucucagaggcagggaacugagaguagcaucacugagugaccagugauccugcuuuguuuuagugcaucauaaacuuggacaagcaccggcugauuguggggaagacagacaaagaagaaaucccuuuuguggagacaguuucugugaaugacgacaaguaaguacaugagucagggcauucucagacaguauauaggcuuauagcccaccucuagcuuucagucauagcagaggucagcccuuccccagacuagaguuuacugucccgcagaacucuguagccuacauguuauaauaaacaaggauagcacauagaauaguggaaaaaacagucuuuuaaggggauguguguguguguguguguguguguguguguguaacaagguuucagugugcagcccaggcauggaauggggugaguugggaauaaggcauugagauaagguuuuagcauguagcccaggcuggcuuuaaauucaugagcuuccugccucagcucccuaagugcuaggauuauagauguauacaugagacauuuuaaaacccaaguuaauuugccuucagauuaacuccuuugaauuugcuaucaauuauuuguuucuuucucauuucagcacuucagaagcauaauugcagccugaagcgugugcgcaugugcacacacacaccagguugacagacugagaaaacuggguuugaacuaaauacaauagcaacuugcuauggaccaaguccuucccuccaguacauccugcaggggcuucuucccgcucagaccuuuuuagacuauagucugugcuuagagaucuugucugguuaauggcuuaaugguuaaacagacauuguuuuuuacuucuuugaauauuuaauuuauagaccuuuuuugacacugccaggucuuauuuguggccuauuucucugcuucuuccaagaauuugcuuuuuauuaaucaauccaguguaggggcugccagguucuacuucuccauagauaacacuugcuuuuugaaaauauuaaaauauacaguaaauaggaacuuucuuucagcuguuucaaagagguauagaaacaugucuugacuuuagaaucucuucugaaguaauugauuuuuccagugugaacuuaucugaaagauguuucagggggaucaucugguccagacauuuaauuuaaacacacagacagguaaauuaucuaaauucacauauuaagucauggcagaagacaagcagaauccagaccugauauccaaaccaaggcucuuaugcugcuuucuuuguuuuccagccuuaagaagaaggcaggaagguuaaagugcaagaaaggagggguaauggauguggcuuugugguggccugcuugucuaauguacacaagguccuggguuccaucacagcacuagagauagagagauggcuuguuuauuaagagugcuugcuucauaagcaugaagacugccauuuggauccuaguacccaaacaaaagcugggcauugucccacacacaccugagaccccaauggaacuuucuagcuuccagucuaaccaaaagagagagaggaauagacaggaagagggggagaauggagggggagugucuccagaguccuugccuuaaaggaaccaagugaagugugguagaggaauagaugacaugacacccacauguuccucuggccucugugagugugcacaggugcacagcuccaugcacucauacaaauuccuacacacacucacagacacacauggacacacaccacagggaagaugagagggugcaaaaacaggcuacaaagaugaaacagucucucaaugaacaagagaagaaagaaaccacagauaggaaggcauauuauuaguuccugagacaccacugacaauguaguugucccugugggauauugauuaccccuaaggaccagucagaaugucugucugucuuguuacaugucacaaagauucaaguagcuggaaguagagauagggaaaggaaaaauaaaaaccacaguaguccagaauagaaggaagaggcagaguaugcugaguggggaagucuaccugggagacuuuccugagacugaaauggggagugaacccuccaggcagggaaguaaaggcuggcaagcccucgguacagggaagggagaaagguagccggcagcauuaagaaccauuaacagcuggauguagcauaugccuuuaacaccagcacccagaaggcagaggcaggggcaggcagauaugagaccagccuggucuacauagugaguuccaggccagucagggagacggucucaaaagacaaaaaaauaaaaauaaaaauaaaaaaacaaacaaagaaaccagaauaaccuuuaaaacuguccaguauucccugaucugacccaucucaguggacuggggaaucacaggguugcuuuuuaagcuuuuuaaaauuuuuuuuuuauuuuuuauuuugcuauuguaucuucucaggcauagaggugccuauaguggaaucuucccuucaguuauagaaauauuugacaauucagaaaaaaaagcuaacuguaaguaauccuucaagauauuccuaagucuacccuuggcucauagcaguucucaaacuucgaaucuugucuagugucccagccaccagccuggcccugagagcucccuugugugggaggaaccugcaccuuccugaggcucccugcacuuuuguucaucacagcagcagacugcaggcuccuucuagugucucugguuggauuuccugggggccaguaaggccaggacuucucagguucuugaaagaggcauugauuuuggccuuuuucaguuggguacuauaugguaccaggaugaauacauggccuuuaauguuccuucuugacucugacaagcagucaguuauuuucuaaucugggaauagaaccaaugggugaacuggacuccaugucauagcucacucaguucauucucaccaucugaaucuucuaaccaaauuacuugagucccuagguauaauagagauacccaaaaugcuucaagauaacuauaggaagucuugggguuuaguaaugcuuuuuuguuuuguuuaugagacaggaucuuauuaugugggcuaggcuggccugaaacucaauauguagaugagacaagccucaaacucauagaaaucagccugccugugacucgucauugaugcuuuuuaaaugcugccaaguuaacuacucuuacaguuucugucucuucaguguucacaaagggacacuagcuuugcuuuugggggcuagcaaaguaggucacuggguuuuuccuaguuagaaaaugguagcauuucuuaggguguaauaaagugucugcuguauccuaguucuaagucccugggaaguagcagaccugucucacuccuuaacacacaccgcauccaggaagcugaagaugcacauccagggauuuccauuuuaauuugaggaagggaugucuucugacuuuccuuuuuccuugcucugcacauaccccucuaguaugguuuucuguuccuuagcucagagcaucuauagacuggauuaccuagcugcccuuacucuuguguaguagaaauaccuuucaggcuggggacuuggaggagaggaacuggauuccucccuccuucuguugccaggucuuucugcauuagcacuuuaucugcucaguauuucugacuguacugggcuuauuugugacaccgauauaucaauaaaguggacuuguucucugugugcuugucugagucucugaagcugaggagccaggacacagccuaagugcaucagcauuucugcuuagggcuccaaaugcaagccuuugugguuuucagcuucucagcugcugguacugcuucagcucccucuuaaagucuuugaaucucauugauuuguagucuaugaagcaaauagaaaagguauugaacucacagugccaagugagaacacccaugugaagugcuggguagucaggccuccauguaaagaacaaucagcacuguguggagaauuacuuuuagaaaaguaaauguuuauuuggauaacaaaugagagaggcuuggagccgggcaugguggcgcacgccuuuaaucccagcacucaggaggcagaggcagguagauuucugaguucgaggccagccuggucuacaaagugaguuccaggacagccagggcuauacagagaaacccugucucaaaagagagggggggggggaggcuugggaagggaaaggguugaacuagccuuauuauauagagcccuguacuaauaugagcaaaacuguagauacaaugcaacccccagcacaaaaaacaacagccaaaacaugcuguuuagaaauauggauuuaaauuccccgagauggca

SEQ ID NO: 4032 - RNA, 21264 nt, Mus musculus
cugggcccucacgugguuaacggucgcgggaagccgcggaacccgaacuugcggacgaacuugcggagccuuucgccagcacuggaccggccagucuccgcuggacaucccgcgccgcagccgucgccgucgccccgucgugagcuugacgggccucggaguugccgccgcgcaggcccgcugcagccucagcccggcgcgcccgaucgcacguggcggacccgcccccugugccagccgcgaccuggacgccgccggccucugcucgccgguccuguguucucccgugcuccgccgugacugcagccgggaaaugagcuuccugagccgacagcagccgccgcccacccgccgcguaggagccgcuuacagucugcggcagaagcucaucuucucgccgggcagcgacugugaggaagaggaggaggaggaggaggaaggcagcggccacaguacgggggaggacucggccuuccaggaaccggauucgccccugccuucugcacgcagcccugccgaggccgaggccgagcgccgccgucgcucgcccggcgcggagcccagcagcccgggagagcuggaggacgacuugcugcugcagggcggcggcggaggcgcgcaagcggcggguggaggcgccgagggcgacucuugggaggaggaggguuucggcuccucgucgcccgucaaaucaccuucgaccgccuacuuucugagcagcccguucucgccagugcgcugcggcggcccaggggaugccuccccgcaggguugcggggcuccgcgagccauggacgaccccugcucgccgcagcccgacuacccgagcaccccuccgcacaagaccuuccgcaagcugcgccuguucgacacgccgcacacucccaagguaauggagggggcggaggagccggcuccagggccuuuaaaaaaaaaggccgcggcgcugcagcccugcgcgccacugcccggguucgguuacauaaccgccccgccgcaccccgcucgcuguccugcgccgccacucaaaaaaaaaaaaaaaguuggcagccccccuuuuuggcucugccuagaaguugucgguuaagauuauguaacugaacaaugggccuggucuguaacuacuccacuuuacaaagggccugguccccgcuguccaggugguugaguauugggucucggugguccggugugccagggugccggauugcugcuggccaccugacacuccgagccauauggugccuguuaaauccgguguccgggccuguaauuuggggggcacggauggaaggaguuagguuuauuaaaggguuuguuccaacccccuggacuugugguuccaugugauauggcauuagagauucugcgcguccuuuugagucucuguguuuaccgucgugaacucauggauauuccagguugcuuuugauugucuuucgggauuuaguauuacggaagcuuuguguuuauucuggaguuuccccugccguuuuguuggucugugugucaaaacuaaugugucuuaaagcagaguguguucagaacccguuuggaauagccggugaauaugcauacugucaugguaauacuugagaagucacaaaaacauuaagaguagacaauuuccaaaauaaagacaggcaugguaccuguaaguuuaacacgggaaauaagccccccuuuuuugagagaacguuucucuguguaaccuuggcuguucuggaaccuacuuuguaggaacuaggaacucagagauccuccugucucugccucccgagugcuggaacuaaaggcgcccuaccaugccccucgacauaagccuuuuaaagggaaucuauugauuuccaugcaacuuuagucuuaaaucucgaacauccaggugcuuuugugcuuugcuaauuuuauaggcggacaggcccagggcaccaucccccuuaguaaggggaggaguccagggagguggccugcaaaagccuacuugagguggagguggggauuuuuuuuuuaugagagugaguguuuuuauuuuuagaauguuaaaagagccuguuaauuuuuagcuacugauaagaacuuuuuguguagucacugcaaaagguccauuuuaggauuagcuacggguuuuuacuuugcuaucuuuugcagauaaguaguuaguauucaaccugacuccuaagucagccgccauugguuuuacuugaaguauaacuaaggcuuguguguugcccccucccuuguucuuuucuuuccccaagucggguaacggaaccucucccugcauggguucuagugcagagcuucauucacaaugugcugcuuugggcuacauacuuggccacuuaggaaggcaaguuggagguuauauagagaagacuccagaagacuggguccugaagauuguauuucccuuuccuagaguuugcuuuccaaagcgcgaguuauugauuccggcucuguuaaacuccgggguaguucucuauucauggacacagaaaagucaggaaaaagagaauucgauacacggcaaacuccccaagugaauauuaaccccuuuacuccggauccuguacugcuccauuccucaggacggugucgugggagaaagagagcguauuuuaaugaguaaguauaguuugguuccucugcacaccuaagguauauacuaucacaauuaggugucugucugucugucuuucuuuuuuuuuuuuuuuuuuuuuuugcuuuuucaagacaggguuucucuguauagcccuggcuggccuggaacucacuuuguagacuagacuuucaaacucagaaauccaccugccucugccucccaagugcugggauuaaaggcgagugccaccaugccuggcacacaauuagguuucuacugaauggcaugaaugucuucacucugaaaguuuuucuuacauuagcacuuagcucucaggagacagauaaucaguuacaggaaagaaguggucugagaaagggaaagaauaagaauuggugauuccuaugccuggagaaguggcuuaggcggcuuagguguugagcucuuguucuugggguuuaguucucagcaccuauguggcaacucacaaauggcuguaccucuaguuccaggggcuccauugacccuucugauuauucaggcacuaggcaugcaugugacuuugauacccacaaaacgcuuuacacaaaucuuuaaaaaaaaaaaaaagccuagauuucuugucagguuuauggugucaacuaaugggagagaguuguugagcucagguggcaagagaagagguagcuacagcucauaccuuuggagccagugcuucggaaccuuccuaaugccuugacccuuugaccccucaacuagaguuauuuccuugcuauaacuguaaguguaacuguaauuuuguuucuguuaugcuuuauaaugugaguaucuaauauugagaaccauuguucugagcuauuuugguggcccgagacuucauuucuuuuuuuuuuuuucccuucuuuuuucuuuuuaguuuuucgagacagggugagacuucauuucuaaugcuuuaauuuuugucugugugaugccagucuaguuagugagcuuaacucacucaguagggacuuuuuuuuuucuaucauuugaguuagauuuuuuuuuuuaggguuacaaaauaagaugcuuucucuuuuguuuguauccauuaaaaaugcccuucacucuguaguuaguagguaaggucucaaguugauguuuugguaaaaacccacauuuuuuucaguuccucugaagacauggaagccagugauuaugaguuugaagaugaaacaagaccugccaaaguaaauaacuuuuuauuauuuaaaaguuaauauauguuugcauguuaaauaaacugcagaaccuaagguagaaugauauuuccaaguuucauaucuuuguauuauacauggauacucuucuuuuacagagaauuacaauuacugaaagcaacaugaagucacgguauacaacugaauuucaugagcuggagaaaauugguucuggagaauuugguucuguguuuaaaugugugaagagguuagauggaugcauuuaugccauuaaacgaucaaaaaaaccauuggcuggcucuguugaugaguauguauuaaacacuuuugguuuuugcucuuuauccccuuuguuauuaauaaacauuaagguuuuggguaaccaaauaccuaaugcuuuuauuuauuuauuuuuaaagguuuauuuuauguauaugaguacacuguagcugucuucagacacaccagaagagggcguuggaucccaauacagauaguugugagcuaccauguaguugcuaggaguugaacucaggaccucuggaaguccauugcuuuuaacugcuaggccaucucuucagcauccuaaugguuuuguguagcucagacuagccuaggugagcucacugacgauuuugaauucccauucuucugccucaguuucccuuaugguagguuuaaaguguguaccaccaugccaguuugcauaauucuuaauucucuuaagucaccuuuuagcauagugauaguuuaaaaaggcuaggcuuacuuuaugguuaucagauaaauugacuauuccugaguagaaaugauuuaacaucuuauuuacauuguuuuccuaggcagaaugcuuugagagaaguguaugcucacgcugugcuuggacagcacccccacgucguucgcuauuucucugccugggcagaggaugaccacaugcuuauacagaacgaauacuguaaugguaagcaccaugggaauauuuauuacaaucuuaaguuuuucuuuuggagggggggcggcaguuccucauguguuaggauacaucccuugcucucucuuuguguguguguacauugagauuucuuaaguuauauuuuauuuauuuauuuauuuauuuauuuauuuauuuauuuauuuuugagacaggguuucucuguauagcccuggcuguccuggaacucacuuuguagaccaggcuggccucgaacucagaaaucugccugccgaugccuccugagugcugggauuaaaggugugcgcccccccaacccccacccccaaaaaaaaagaaaaagaaaaaggagugcacuaccaugcccagcucuuaaaaaauguauuuuuaugugcacugguguuugagggugucagauucccuggagcuggaguugcagacauuugugagauggcaugugguugcugggaauugaacucaggaccccuggaagaccagccaauucuuuuaaccgcugaaucaucucuucaguauccuuauuaguauuuuuaagauaguuuuacuauguagcccuggcaacaugaguuuugaguuggaagccuuauuccuucugugacaucuucauaccucaguaauagaaccuguuaauuggguuuaugccuuucacucaauguugagcucccugggaagacugaauacugguugccuugcuguguauauuuugguauucccuaccauguaguauaguuuaugggcacacaggaaagauugucuuagucuuaucuuuaguuuggcaagaaugcaaagagaucagcaaugauauaauaaauugauuugguuuguuuuggaggcuaggaagucuaagaacaugguaucaacaucugagauggucaaucaugcuguauauuuucauguggauugcagguuuuacugugugguccuggauggcacucuguauuuucgauggcaaaucucauggugauaaucuuuuucuuugugguacuaggaauugaacugggagccuuuugaaugcucucaagugcccuaccacugaacuauauaucucuucaguucuuuuuuguauuuuguuuugugacugguuuuacuaagcaguuguccaggguuggccuugcucacacucuaggcaaggcaggccuugaucuuauauuccaucucaagucuuccaggcuuguuccacuaggccagacuuaauuuaacauuaaaccauucuugaagguccaaccuuguuuaucuuuuacuagcacccaguuucuaaaaauugaacuuugggaaacacauucaaaucauaacaaauauguuuucaaugaauacuuaccuuauuuagguuucucuuucuguuagaacauugguguuaguugcucaugaaaggacaaugaguccauuuguuuaaauuuagccauuucuugaagacauucugaaauccugcaauaaucccaccaucgguccagucuaguuaaugcuauaguucauuaauacuuaaguaaguaucuuagaguuuuauugcugugaagagacaccaugaccaagguaaagguaacucuugugaaagaaaacauuuaacugagacaguuugagagguucagugaucuuggugggaaacauggcaguguguagccagacaugguggcagaagagcagagaauucgacaucuuaaagauuuauuuauuuauuuuauguauauguauaugccucugcucgcucaggcccaaagauuuauuuauuauuagaaauaaguacacuguagcugucuucagacacaucugaagagggugucagaucucauuacugguaguugugagccaccacgugguugcugggauuugaacucaggaccuucaggagagcagucagugcucuuacccacugagccaucuaaccagccugagaauucuacaucuuggcagcagccaggaggagguucucccccacugggcggagcuuguucauaggcccucaaagccuacccacacagugacacauuuccucuaacaaggacaccuccuaauaguauuuccagugguccaagcauucagacacaugagucuaugagggccaaaucuauucuaaccacuguguaguaaguuaugguuuuuuguuuuuguuuuguuuuauauaauacacuuuaaugguaaaauuuugacaacacauuguauaucugacaccaucuucuacuugagccucuauccaggcaacucagaaacagaaagguagucacugcauguccacuagucacaggagcccuaagaaaacaaagacuuacuucucuggcuuagaguaguuaaguuuuacauguuacuauaguaacauuuacauguuacauguuuaacacauguuacauguuuaacaaguaaauuuuacauguuuuuuaaaauugucuauaugcgcuucuaccucaguuuaaacaaaauaggaaaauaaaggccagcuuuguauagcuuuucacaagucuuucaccuuccuuuuucauuaacccuuuaccagaaguucugaauuccgaucguuauaggaaucuucuuuuauuacaagcuacucuuuuguuuugauuuguuuuguauuuuguuauucaagacaggguuucacuuugguagcccuggcugucauggaacuugcucuauagacaacucacagagaucugccugcuuaggcaugaaccacuacauccagguuaaacauaccuuuuuaauacauaauagguuguuuuauuuuuaaguuguuuccauaaagauagagaaaauuaugguuuaggaggccaugaagauggcucaguaguuuagaguacuugcuggcaauaacaagcacuagaguacaaauuccaggcugucugcaacaagcuaggcuuccugaauaugccucugagccccaagucccggggaaacaaagacaggagagucacuggggcuucugcuuugcaggauagcagagaaaaugugaauaauuucuggguucuaggagagaucuugccucaaagggauagguggagagacaccaacacccuuuucugccuuccagaugugcauucacuuauacaggcacauaagcucauauauuuauaaaaauauaauuuuuuuuuaaagaaacagcugguuguugugguacacucuuuaauuucaguacuuuggagucagagauagacagaucuuuugaguuuguggccaaccagagcuacauagagacccuauuuccaaaaagaagagaaaagaaaagaaaagaaaaaaagaaauguaagguuuagaaacacuugauaguaaagguuuguuuuuuguuucauggcuaauggguaguaaagacccuuuccugguuuaaauuaguuucuuauuuagagacagggucuugcuguguagcucugucugaucuauaacuugcuguguagaucaggcuggccuuaaacuccgauaucugccagccccuaccuccagaaugcugggauuaaagauuuguguaaaauggucugguucuuguucuacucucaggaguuccccccauuucacuuaacaaauguacauucggccuauccacccuuacuccccagaauaagaaacugacaauuuauucugagaaagugaacaaaaguugguugcugagguugauggguuaaaagaaaauguaaauuguguuuccccccagugcugagaauugaaccuaggaucucuacaugcucagccagcauugcauccugcccuuaaauuuugagacuguggcuuaguaaguugucugggcuagcuaaccuuaaacucaauauguagccaaagcugggcucaaacuccuaccuuagccucucaaaagcuggaauuaugugccuaaucaccaggccugacauuuuguauuuucuauaauugcaaauauacuucauacuaaaacaauaaauaaaaguugauaucccaagaaaguugaaccaagagauucuaauaaauauaauuuucagggugcagaauugcaguuguugcguagagagagaagagaaaaucaaauguuaauuuuugcugucucuauuaggugggaguuuagcugaugcuauaagugagaacuacagagucaugagcuacuugacugaaguagagcugaaggaucuccuuuugcaaguuggccggggcuugagauacauacauucaaugucuuugguucacauggauauaaaaccuaguaaguauuacaggugcuuuggcuguguuguugagaucuggauauaggaaaugaaguacuucauuguagcaaugggaaagcguugugaaaguaucuuacuuucuugcuaggguuuuaugauuagaccacucugacacuggcccaagucuuucauaguuggucuguuuacauugguaucuauuucaggaccaugcuguaaucugguuauaucauuacccuuuucagguuuuauccugcuacuuuuucuuuucuuuaauaucuuaugcucauugguguuuugccuacguguaugguguauggcugugugaggaugucagaagcccugaaacuggaggcacaggcagcugugagcugccaugugggugcugggaguugaacucugguccucuggaagaacagccagugcuuaaaacugcugagccauuucuccagccccucuacuucuuaaaaaugguagacuuacuccuacagauaaacuucuguguuuaacugguggcuuucuuguauuuuuuaccuucugcuuucuguaugcuuccuaaaguuagaagaguuaaugaauucaaacuaauucuagcaggcaaggugcuuuucuuauuuaaaaacaaaaacuaaccaccaacacaacaacaaagcuaacuaguugauuaccuggguaugguguacacucucaauucuagcacucaugagccagaagcagguggaugugugacuaugaggccagccuggucuauaaaacaacaaagcaagccccgguacuguaaaaguaacuuuucuuuuccugauguaauuguuguuucugaggcuuacugcuucugucugcuauccuaguccuaguccuggaagccucuaaacucuauacaaucuuaucuaggccuagaauguuuuugccucugagacuugaugcugaguaagcucacccuuccuaguuaguucuuuucgaucucuggcgaguuauagaauuaacuguucuggcucagacucugaugcaagcuggcaccucucucucugccucuccugaacugcuguguuuggccucauacuaacuuuggcaaucuguucuuuuauuuguuuguuuguuuguuuauguguaggaguacaccauaguugucuucagacacaccagaagagagcaucagaucucauuucagaugguugugagccaccaugugguugcugggaauugaacucaggaccucuggaagagcagucagugcucuuaaccucugagccaacucuccagcccagcaaucuguuuuaaucuucugucuugugcucauucucuggcuuguucugucuucaccuguaucuagcuuguucuuuuucugcaaccugucucuguaagacugucccaguaaaauugcucucucuugcuccuuuuugcacuacucucucucucucuuuuuaaagauuuauuuauuauuauaucuaaguacacuguagcugucuucagaugcaccagaagagggagucagaucucauuaccgaugguugugagccaccaugugguugcugggaccuugggaagagcagucggugcucuccacugagccaucucuccagccccucugcacuauacucucuuaaauagcuucccuuuucucucuuuuuggagaguugggcauauucuuuuuuguccaaucuuucucugauuugucacuuugucugccacucaguuagacaucacauucaaacaugggugcuuucuuauacaaaguagcuuuaaugucauuguuuggaauuaaagauguaugcuaagggcauguugauauuacaauuaaagguguaugcuaaggacuuagccacaccacaacuagaagacagggguuggcuuguuuuugucuuuaagaaaauaacacagggccaggcaugguggcgcacgccuuucaucucagcacuugggaggcagaggcaggcgaauuucugaguucgaggccaggguggucuacagagugaguuccaggacagccagggcuacacagagaaacccugucucaaaaaaaaaaccaaaagaaaauaacacaauaucaggguucacacugugaucaaauaucuugcaacaaagagaaacuacccugaaaacaaaaacagcguuccuggggcauauagccuggccuuuaccccuugaaguuguuauucucacuaagauuaguauagaauguaauagucugcauuuuguaagacuuuaagaauuuguuguuuuguuuugggguuuuuuguuuguuuguuuuguuuuguuuuuuugagacaauguuucucuguguccuagaacucacucuguaucccagacuggucucuaacucagagguccgcuucuucugucuuucaaauacuagaauuaaaggcugugccgccgccacccagcaugucgauaauuuuuacaaccuggcaauaguugguuuucuccuuucgucauguggcuucuggggauuguacucagauuaucaggcuuggcagcaagugcccuuuacuuuuggagucaucucaccagccuuauggaugaucaucuaucuaucuaucuaucuaucuaucuauuuauuguauaugauguacacuguagcugucuuuagacacaucagaaaagggcaucggaucccauuacagaugguugugagccaccauguguuuaggaccuuuggaagaacaguuggugcucuuaacugcugaguuaucucuccagugggccccccccccuuuuuuuuuaagauuuauggauggauggauggauggauggcuuucuuuuauauuuggccuuguauaggcauaaauguuuuacaaccuacuuuuaauaaggguucaaccucuccucuagcccaccaccuagcagaaguaguggaagaggagcuggagagauggcucagugguuaagagcauugaguucaauucccagcaaucaccugguggcucacaaucaucuguaaugggaucugaugcccucuucuggugugucugaagacaaccacaauguauucacauauauaaauaaauaaaucuuuaaacaaaaaguaguggaagagaaaagcuauuaggauaugggggaagucgaccuguacagcaacaguucuuugggaggcaagcuugaucuucuuuuuuagcaauucaguccuguagcaaacaccaacuaugacucaacagcuguagaccaguccucuaggcaggcagaguccaggcaugaacuagcagcuaaaguccaguccuuucagcaggcagacaccaggcaugaaugccagcuggccugaggcaaggccacagaagcagcaagcuacccaggaaccucacacacagcagguuuuuuuuuuuuuuuuuuuuuuuuuuuuuugugguuuuucgagauaggguuucucuguauagcccuggcuguccuggaacucacucuauagaccaggccggccucgaacucagaaauucgccugccucugccucccgagugcugggauuaaaggcguguaccaccaccacccagcucacaagcagcucuuggugaguuucucucaauggcaguguuaucacaaguugagcucaacaacgcuauauaggaaccgauacacaagugucaucgccagucucccacugccauauuuauacuccuggucauauuuauacuucuucaucacagguacuucuacauguuauaucaaaacauucuuucauguuuuugcuuuagcaagacaucccuuuacuugugugcccagcaaaacaucauuuaacauaacuaauuuuccaaagaacuagaguuucuacuucagccuuguuuguuaaauauaguuauuuuuauccaacagguaauauuuuuauaucucgaaccucaaucccaaaugcugucucugaggaaggagaugaagaugacuggauauccaauaaaguuauguuuaaaauagguaaaacuauuuuguuuaacuauuaggguaacuguuaaaauuaaggguguggguguggugggaaagacugugccguagcauguguggauguuaguggacagguugaguguuaguucucauugcgccuuguuccaauguggguucuuuuuuguuuguuguguacugcuuuggauaccagggugguagccugugaacucugggauuuuucugucucuagcucccaucuagacguuguccuggguuuguagacauguguuccuguguugguuuuuacauagguucuagggauaugaacucugguccuuauuuuugugaggcaagcauuuuauccacugagacauuuccauaauacccuuuugaguguuagccucuuauaaaugcaccacuggaugcuuggcacccaaagaggccaggaaaagcaucagauccccagggacucaguaacaaguaguugugagcuacuguguggaugcugggaacagaacuuagguccuuagcaagagcaucaaauguucuugucugugagccaucaucucucuagccccuguuuauauacuuugagacaggauuucauguauccuggguauacauauaucccaggucugcuuccuugagcuuguuguguagcccaaaaagcugagaauuccccugccucuaccuugaaucauaggauuacaggcauguguugccaugguuaauuuaugugguuauagauaucaagccagggcuuugcauguuagauaaauugucuacuaacugaacuacuguacuuuucuaauaccucuaggugaucuugggcauguaacaagaaucucuaguccucaaguugaagaaggugauagucguuuucuagcaaaugaaguuuuacaagagguaauuucuucuuccuuggauuugcuucauaucaguugacagaagacugaauucuaauauguugaaaauuaaguagacuaaaaguagaaaguugaaaccuaucugugagggagucugauggcacugaaguuguuccagucauuacuaguugaacuucaaaguuguauagccuuucucuuuuuuuuuuuuaaagauuucuuuguuuauuauauguaaguucacuguagcugucuucagacacaccagaagagggcaucagaucucauuacagaugguuguaagccaccaugugguugcugggauuugaacucuggaccuuuggaagagcagucgggugcucuuacccacugagccaucucaccagcucuuguauagucuuucuagagaccaaauugucacuauauugauauuuuaaaaaaaucacauuuccagcuggagagaugguucaguauuuaagagcacugacugcucuuugagagacccucgguucaguucccagcacccauguggcagcucacaacugucuguaccuccaguuccagaggaucuagcccugugcacagaacagcaaugcacauaaaaagaaguaaagcuuuuuuguuugguugguuuuguuuuuguuuuuuugagacaggguuccucuguguaucccuggcuguccuggaacucacucuguauaccagacuggccucaaacucagaaauccaccugccucugccucccaagugcugggauuaaaggcaugggccaccacugcccggcaaaagaaguaaaucuuuaaaauaaauuaaauaaauaaauaaauaaauaaaucacauuuccauugaccuagaauuuuuaguucaagaaguuuuuuuguaagaaugauuauguauacauagagaacaaugugaaaauguuguaucuacuauugaaacgaaagguaaauuaugacgugugucacauaaagucuaauguaguuuccuugcucuucucuccaugcacauuggucugccuuauugaacauaugcauccccaaaggcuagaggcuugcuucccaaugucaugggcaacugauaaagcugcauuuguuuguagaucuauuuuuuauuauuaaauuauuuuauuuacauuucuaaauguucuccccuuucccaguuccuccucccaaguuuuucaccccauccccccucuccuuugcaucugagaggguacucucuuacccauccccaccucacuccugcuagcauuccccuucucuggggcaucaaguuucuacagcauuaggcgcaucuccacugaggcuagaaaagacaguccucugcuacauguaugcccagggccaaggaccaguccauguaugaucuuuaguugguggcuuagucucugggagcucugggaagucugaguuaauacuguuguucuuccuaugguguugacauccccuucuccuucaauccuuccucuaacucuuauaugggggucccuacccucaguccaaugguuggcuauaaguaucugcagaaagcuaguaacagaauaaaggggggugggccauuuuccagcccuagcaagcaucagagcacggcagcuuuggccaugugaccauguggcuuuagagugaaaacuaaaagggacuacugggguaauugaugcugguuagcugaagcuaagaaauuguuggugauuuaggagagaccagcaucacugaggugaaauuuucuggcaaguguuuucugagagcacuaagaagcuguguuccagauauagccaagguuguaccucacacugcagcucugcuuguuaauguauaauaacuacccaggcuguacugguuuugaaggcaugaaagggucaugaagaacaccugaggcuuggcagugugagaggcuauggaaggccauuggugaaggugcaaccucaguuucaguugaugucccaggacugaagggaucaugcaaaggaguuaaggcuuggcaccaugaagagagccuaugagagaggcuauuggugaagccuaguugcaguggaagaucccauuguguuggagaugccaguaccaugggaugaucaaccaagaacagcaacaguggaauggagucuaccagagccuagagugcuacagagggcagagcuagagaagugaugcaagcccuuugguggagcccagaagaucccagacauuggaacaagaaguuguaauguugaaguugccuuagagacucugagauguucaagaugccagagcugucgaauaccugcugaggaaagcugcuaagagggaauggaaucagcucaggagaaagaacuuuguuguaguuaacaaagaugagaaaggaaugaucugaagacuacuuuaacaucagacaugacagugcagaguuuggagucugcccagcugguuuccgguuuuaauuugggaauuacaguuaaguggauggaucucagaagagacuuuggacuuuuaacguuguugagacugcuauagacuaugaguacuuuggaaguuggucuaaauguauuuguuauuaugcuauggcuagguauggcccccauagacuuauguguuugaacaagccuaugaggggcagggaguagaaugugguaguuugaauaugguuggcacagggagugaugcgauggagguguggccuuguuggaggaagugugucacugggcuugggcuuuaagacccuucuccuaaccaccggauagccagucuucuagcagccuucagaugaagauguauaacucucuuccuguaccaugcaugcuccuaccuugaucauaauggacggaaccucugaauuuguaagcuagcccuaauuaaaugucuacaaguugucuugucaugauuauuucuucacagcaguaaaauacuaagacacccuacaucugauagagggcuaauauccagaauauacaaaguacucaagaaguugacuccaaaaaaaugaaauaaccgaauuaaaagagguccugaguucaaaucccagcaaccacaugguggcucacaaccaucugugaugagaucuggcgcccucuucuggugugucugaagacagcugcaguuuacucacauauaauaaauaaauaaauaaaucuuaaaaaaacaugaugaagaucuugagcuuuacucucuucccuagcccagugucaagcucuugccaguauucuugaaauggcauugagagcucuccacagugcagggaaaaggauagaacuagaaaauagcauccuaagcagaccuaagaggacauuauaagucuauauucaaccccuccuacuauauauuauuuguaguuucaucaucuuccuagauuuagcagcauauuuucugaauagaugcuuaaauguggcauucaaaaguguauuacagaaaccaucauggugugcaaucuuauuuuagcucauaucuuaauuuuuuucucuuuuaaauuuuacagaacuauagccaucuaccgaaagcagauauuuuugcucuugcucucacagucguaugugcugcuggugcugaaccccuucccagaaauggagagcaguggcacgagauccggcagggucgguuaccucggaucccacaagugcuuucccaggaggugacagaguugcugagagugaguauuguacaugggaagugcuuuauuaacuaaaccucaguauuauacuaaggagguuuuuuguuucuuuguuuuaguuuuuuuccuuuucuuagacagguucucuauguagcucuggcuguucugcgagcuugcucuauagaccaggcugggcucugccuccagagugcugggauuagaggaguaugucaucauauguugcucuaguuuguaagcauuacuuugcuuuuguuuuuuaggucaugauucauccugacccagagagaaggccuucagcaauggagcuggugaagcauucaguguuguugucugcaucuagaaagagcgcagagcaguuacgaauagaauugaaugcugaaaaauucaaaaauucucuuuugcagaaguaaggaggauuuuauuauuguuguugauuuuacucuaccuuucucacugauucucagauuuucauuuaggguuuugucagacuuuguaauuuugugugagagaaucaaagugaggcagugcucaggaggugagauaugccacacauacauuaggaccugagauuggauccccagcccacuguaaacacugggcacagaggcuugugucuauaauuucagcacuggcaaggcagaaauagguagguuccuaccagcucagcugaaucaugauguuccaaauuuagucagagauacuaucuuaaaaauaauaguguggcgagcuggagagaugacccagcaauuaugaguauuggcugcccuucccgagaggacugagguucaauucccagcacccacaucaagucucacaacugucuuaaguuuaauuccagggaauccauugcccucuucuagcuuccuugacacacaaaugaugcacagacauccaugcauauaaaacaaucacuuauacccauaaagauuuuuuuuuaaaguuuuauguugcaaaaccaaagauuuugaguauuaaaaaaauaagguggaugucaguugaggaagacaucugauguugaccucuggucucuaugcacuugcacaaauguaagaaggcucuguaguacagcucuuguugccugggauaugugaugcucuauauuuacuuuucauuacuuuuaaggcaaaaucaaagcaaaaauaugauuuaaaaauguguuugcuuacaaguggccauuaucuuuaagcucuaaaucaugguagaaccgaaaucaaucuguaacauuucucucagggucucaccaaaauuaauguuaaagcauuuuuucagccuguuuuacaaaacagugaauuaaauggcaauuauguggcuacaugauuuuuuauugguaauguauuauuguaggaggggcauaugucacugcauacauggaggucagaugauaccguuuagaagccuguuuucucauucugcuaucugggcuucuccagggauugaauuuagucuguagacuugugugacaagugucuugcuugcuaauccuugcuaaccaacucaccaacuuguaaugauucuuuuauuugaucugagggacuuggcaguuucagaaagcugcuugcaaagauaguugaucaaaauugcauggugugcauauguauaugcaucuguacaggaacugagggugaauaucagauaucuucuuuucuccaccuuaacauuccuauuucuucuuuaacacaaggauucucuguguagaccaggcuggccucagagaacugccugccucugacucugugaucaaauguguacaccacgauaccaguuuucuagauaagggucucucauugagccuggagcuugccaguucagcuagauuggcugucuggacaagcccuuagcguuucuuguuugcuucccaacucuuaagauuacaggcauaccuauacugcaucucacccucauagcugaagaccauaucuauggcucuacuacuaagcuaaauccucaacccccacccuacuuccugguugggugcuggggguccucauacuugggcagcaagcacuuuacccaucuucucauuccuguuuuguuuaucuuuucaacuuacauuucauuuauuuuuuggguguaugugcacaugccauguuuugaucuuagaaauucugguaugaauucuggccaucaaacucagguugucaggcuugguggcagguguuaucgcugaugaaucuuuucaccagcuccaggugugucauauaccauuauaaugcaucaagaguuaucgcccacaauggguuggccccucccacuccaaucacugauugggaaacagguuugcaccuagcagugguggcccaugccuuuaaucccagcacuugggaggcgcaggcagguggauuucugaguucgaggccagccuggucuacagagugaguuccaggacagccagggcuccacagagaaacccugucucgaggaacaaaaaaauaaauaaauaaauaaauaaauagaaacagguuugccugcagccugaccuuguagaggcauuuucucaauugaggcuccuaguuugugaugacucuauaguuuguuucaaauugacauaaaacuagccagcacaauguuugaguuuguauuuggcuucuuagacucuuuccauagaauuaaugcaguagguaaauuaaagucuugcuuccuucuuauuuuuguagagaacucaagaaagcccaaauggcagccaaaguugcagcugaggaacgggcacucuucacagaucggauggccacuagauccaccacccagaguaauagaacuucucgacuuauuggaaagaaaaugaaccgcucugucagccuuacuauauacugaacugcucacauuccccagcccuuccccacucaaaggaaaaaacugugacaagaggaagcuagguuggaaucacugcuagagcccacuucgugauuacuugcccauugguaucaguaguuuuccuaaaacguaacgccuucugugacuuugagaauuacaguugagagcuguauucugacuuggcucugucaggcuuuugucucaucucccgucuguuucauguaggaugugggucacuguuggauguuccagcccccuuugcggggugcgccacugugguggugugcugcuucucauucacuguugcaguguggugaaaggugucuuuccugguugugaccucuagaaaggacucaagggcuuuacugcgaacauccucucccuucaaaaagggaaaugcucagagacucaguacuccucugccuccaauguaccugugucagucuugcguuucuuuuuucuaugugaauuacacuuguauauccaacugggagcacuuuaggcaucgugugcgccaugggauggucauucuguggaggccuugccuugugaauuugcugcuauuuuaguuuccucuugcuguaaaacuagcauuaaacaaucauuguuguuaauaggcuuucuuucagaacaauuaugugaaauauauagcugcucuucaugaaaagcagcuucgcaucuuuuucuuuggacuuugaagcuacugcauugaaaaagugcaccuaccccucccuguuugaaugcuguauuaauguaguauaauuauuacugguuuuguaaauuuuucuuauaauguccccugucuuuaaaacauguuuccuuccuccugucaagucuuguacuugguuguaugguuagccuauuuuuaaauguuuugcccaguuucucuucaauauuuguguauauaaacugaucuugguaauacuguacauagcuguuuaaaaauaccagaaugacuucugacuauuccaaguuuuccacaaaauacauuuuaccugugaauagccauuugacuaacaauauuuggcuaguagaugcugcccuccaaaaggagggaaaugucucacuuguuuuccuauuaacuuuggucugaaacacauuugcacuugucuguuugacuugugucuuauuaacauugucugguguauuaaaagucauuccgugcuuaccuuaauugucuaaaucuuc

SEQ ID NO: 4033 - RNA, 3748 nt, Mus musculus
ggcggaagugcugaaaccuuuagucagaggucaguuugcaaaccacagaaaccaacuuggaugagggaaggcaaaaggugauuuaugggaacauucuuaaauaguucuccaguuccauggagggcagguggccuggcuugaacaguggcaggaaccaagggguaugggccuggggcggaugccacagacacacacaggucagcucuccuguugccccugccaucaguaagaacaauuauccaucgucucugguucugugccaggcgcuuuugagucagaguuccagggaacaauugcuuugccaagcucauuucuuguuccaccaagcucugcugccaagggcagguggcaaggucuguaugguggagucuguacugggagauggggcuucaccucccacaagaccccacugugcuauucucuagcugcaugaagcagccuagcccucugaaagcuugcccuuccucuguacuucagcacucucacugaccauagaagagcauuggcaaagaacacagaugcguaauggauagcuaugaacggggagugcaugucagggcugucugcggugcugcgcucagugguagacacuguauucuggagacuuccaaggagcucaagugugccucuagggggauuugggaucuggaagggguggugugguccuugccucuuuccuugcugcugcuguagagagcagaugcugcaggugacagugguugcccugccagaugacuugacucuguggcuccuuguuagacuugugccuugacacuguuggcguuuggcuacacugucugcguagugcaggcuugggcgguguauugguuuauuuauuuaaacacaaauguaguugacuaauccaagccagcuuguucuugcgacuagcacuuuggcgucaaacaccugcauugaaguccauuguguccucugcgguacacuuguggacacauuccuucaucugugacgagggaccgguaccuccaggauuguuuuguugguaauaggucuuuauuagaugaauaaauguuucaguguuguagcaacuaggcagguugcagagcuuggcuccuuggccuuacuucuucaucucagaugugacuacuaauugaacauaugugcacucugcaaagcagcggagaaaacacacuugacgcuguucuuaacauacacuugccacugucuaaaugcuaguuuucguuuuccuucauguaagauugaggacacuuggagcaggacaugcgggcugcucucaggcuuugugauagacacuccuuggcucccagucuccuuuaagaugggaggccucggaugacugagaugcucgucucugaaaugcuuguccaucuuggccaggguccccagcagggugugaccccgaguguccucuguguuacagguugcuggaggaagagucuucuaagagggcagagcuggaaaaguggcaccuggagcagcagcaggccauucagacaacagaggcggagaagcaggagcuggaacagcagcgugucaugaaggagcaggcauugcaggaggccauggcacagcuggaacaguuggaguuggagcggaagcaggcccuggagcaguaugagguggcuggacuuagcccugacacaccuguaacuggcaccugagaucagcugggguggggguggggcucugcaccuaacacugcacaaaccaauguaaacagacuccagcacucacuuggcggaaucuugcuuagcaaagagaagaaagaagcaguuuuauuuuguuuucuacagaggugucuguccacucagggaccaugcaggagugugaugaggaaguacaguuacaugcugugacagaggguccccacgcugcagaauugacuccaaggacacagggauagcaugcagguguaggcaguacccauugccccacccugagggugagcaccuagggaggucacuuacucccagccccucacucagaccuuauuggaggggcccaugguggcagagaggugcugacauucgagaccagaggaagucaccgagaagcuacguccucaacaccaaugucuuaguuacuguugcugugagaaaacacugugaccaaggcaacuuauaaaauaguauucaauuggacuuacgguuucagugguuagaguccaugaugggggaaugaagacaaaggcaaggacagcugagcacccacgucuucugaaagcaugaggcagagaaacacuggaauggcucuuuuggaaccucagagucuagcccagugacauagcuccuccaacaaagccacucuccuaauccuucccaaacagcuccacugacugggaaccaaguauucaaacauaugaaccuacuagggccacucauucaaggacaccguggccaugguuguccugacugugugccagcagaccagcccuuccuuuucauguccuucagaaccuauuccuauugaagcuaagacugacaguuauugugagagagcugagcuagcaacaagacaggccaggaagggcagguguggggcagaggcagaaagcugacacagaggggccuacugucacaugcaugaggugagaugagccuuggagucacaaggcuuggccuccacccugcuuccuccaccuugggcagaugcuuagcucucugagccugaguuuuugcuagugugcaguagauaacgauagcucuuccuccuuacagugacccuggucauuuaaugagggaguccacggguguacaguaggugccaguccacgcuacuuagaucuuaaucugccacuuuuguccuagggaguuaaaaagaagcuagagauggcaacacauaugaccaagagcuggaaggacaaaguggcccaucaugagggauuaauacgauugauagaaccagguaauauuuauauauauauauauauauauauauguauaauuaucuauuuuaacuuauuuucuguugcauuuaugcaguuuaauuuaugugaacaaacaacaguaacuuucuuaggggcacaaagcucuugcuucuauacauagcaccacauaaaacugggcauaggagcagcuaccuguacugcuagcacuuggggucugaagugugagcucauccuugagauggcucaaggguuaaggcacuauguaggccugacgacuuaaguucaaguccuuggaacccuuaccaaugccuggaugggggaauguacauuugcaaucccaggguuccuacagggagaugggagcagagagcccgcugaagccaugaugcuccuguggauucucuuaagcuuguccuccuuaguaagugcuccuggguaaccucccugcgugcauaguugcugcucuuuuggcuggcggaccuuuuuggguauuccucagagaaguaggaguguugucccccugaugcgaugacaggugcggagagagccagccuuccugcauugaaagcacgcuugucgcuuagguuccaagaacccucaucugaucaccaacuggggacccgcagcguucacccaggcagagcucgaggagagagagaagagcuggaaagagaagaagaccacagagugacggccgucccagcggucacccagucagucacaucagugaggagucaagagcuucauaccugggacaagaacauuggcuuugcugcuucuaagucuccccucagggcuccagcaggguccugugcugaggacgccauguuuaccuucuagagaugucucagcucuccuggcgagaacauaggcacaggugug

SEQ ID NO: 4034 - RNA, 2166 nt, Mus musculus
aucagcauugagacaguuuauugguuugcuuuuucccagaucacauauuuuauguaaauagauuauaggaaacacaauguuuuuucuucauccacaggcgauaaucaggcgcucuccaccuuacacacacacacacacacacacacacacacacacacacacggaaccaaacaaccuuacaccuugcugagacauucacgucuuaaaauaggggaaggugacaauauaaucacuuuaaaaugcccuuaauacaauauauaacguacaaaaauaucucuauauauuugaaguuacaaaaaaaaaaaccuugacagcaacaaacuuaaauacuauaguuaccuuuggcuggacaacaagcauugcacguuccucgcuagguuuuggaaaguucaaguaguaaugaggcuuaugccccgugagaaaccaguuuaugagcgggcaaggcaguggcucagaccccugcccggagaguaucagccuguaagucucgguuucuggcaugagccuggcuuggucuuggguuccucugccuccccuaggggcagccaggcagaucucugcaggauugucucaguccgccccggugcgaaguucucugauuccgcaggcgccaacgggauacucgcccgacuguucaaugcugucacccgcaccuauauccuaaagagucuggagaugugcgcccaggggccuggggcugugugugucugcuccugggaggacuccacaguccgggaccggaggaccuccagcagggaacgccggcgccggcggccauagccuugagggcugaucuuguuucugggagccaugccguccuugucuuugucuguuagcugguagaucuggugggccaauuucugaaaugugcaggucccgaagcggcauccauugcugcgggaacccugguucaugcucuggcgguagcguuugacacgaaugugggcuucgcucugauugcugugaagaaggaaggacaccucaucaaccggggcuuuggucccaaccaccugggaccggagccaugcaguacccgagggaccuggaacccguucccuccgccggagccucagcugcagugcagccaggacaauccccagggucagaguaguggagagggcacauccucugcagagagcauaguuaccuggcuuguagggggccaguuguguucugcucguccaggaauggaucaagagucuggguaggaacugucgucucaucagcgagucccguaggguagcugcuggaugcuuguaguucccucuucccacgacuuagcgcccacuuauuccaccuagaaaacacaagcagaugcguuuggccuaaguucaagugaugucccagccagcuccacucccuuuguaacaccuccagaccaucucucaguuuucucucauugccagguauucaaagugaagaaagaaagcacggcccaaacucacuucuuucggaacugcgaaggaguaucuggcccugcaguguccgcgccuaggaaagcgagugaacccaauaacaucagggugauggaaaccagcuucauucuguggcgaugcucugauacccuggaaaggaacaagacaccgagugugagcaaccgggccagcagcacgaucccgucagcacgcgaaggguggcggcaggacggggagccgcuuggcagcgcucuuccuggcucagcugcuuaucucccccacuggcgcagagaaacaccggagauuuuugcgcuggccgggugggugacaagcaaggcaaaggaagccauugagaagugccaggcuuccagagguuuccaacuaaagucccaggaucucagcccaaggaggaggggggaucucaagagagcuccagcugugcgcaugagcuagaccugggcaaugagguguucucuacauuggauacccuaaaguggguuguucccccuuguccagcucugcaaguuuuggggcuuuggcaaagccgucccccucccuaacaugcuggaggccagcgguuccuaccugauaaaggggugcguugucaagcacuugaagcagaaagaaguccuucugacaguagcaaaaccccaaaguccaagauugacugcgaugagaagccgagaaaccaggagcgggagcgguaacgcuggaguugcucugucuagugucaccaagaaaccacugacua

SEQ ID NO: 4035 - RNA, 9572 nt, Mus musculus
uccccugauagacaauggauguuuacuagucugugagcgagcacauagaggccuuaugccuggacaauaacaaaauaugcucuaaccacagcagcuaggacauaugagaacaugaacaaaacugcacgcuccuauggagucuacagcaagacaagauuguguuacaaggcacaugucacaaccacccccaggucccuuggggaaggccuucuggggagauggaugcuuuggccuggauaaaagagacugggccaaguaguguguguaaguacuugagauuccuaggaguugagcaucuacucaaaagggagagaauuggagucagcaggucuucaggcugaugugagcuuggcuuaacugggccuacuaagaaccagggucaguggucaggguaggccuagagguuauagcccaucucugugaaguggguugggggcugccuuuaaggaucccgggggacugggugguucucuggaagaugaaauugguggagcaugugaccucaaguccaugaacuccucaagucacccucaccauggagaggugagggugggguguuggguaaagagugagaagaaguaaaggagacccccaaacuugaggcagaguacucaggcgaucuuuagucuuuaggcuggcaugaggaggcuguagagaaugaccagggagagggaguaacuggcaacguuuucaggaauuauuaaugaauuagcacagccuugcagaagucuccuccugcccaggauuuaaaucgcaagcuccaccccuccuuugccucucugcaguuuugcucucuuaggcugaagagucaugagucuuguuugccaacuauuuccagcuuucuccucuuccaggcacgugacaggauugcucuucuuggcucccuguggcucgcuggagacagagugacaauuuauggcugguggauugugcaugggagggacauacaucauccccgggccagaguauuucaucgcuagugcagggccuuccaggacucucuuccugccagugguguggacgucguucaagaugguggcugcucucgcuacaauaaucgaaacugaccucuaguauggacagggaugaggaaaacacugcucugcuguuauaaugagauuucuauucacaaaaugccacugcagaccugcgucuccuaucuauucccacaaucauacugauuuucuuucuuaaagguucugggccuucuaagugaaugucuuucucucucccuccccucucccuucuucugucccucacuccuuuccucccucuuuuuuuuuccucuugcagguacauguauagauacacaugggugccccaaacugaagucagguuucuuccucaauuggucuccaccuuauuaauugugacagagucucucacugaaccaggagcucauaauucuaacuaaccuagcuauuuggcuuucccugggggaauccugugucuaccuccugaacgaugggguuauggguggucaggauaccugccugacuuuauguggguguugggaaacacacacugcuccucaugcuugugugguaaguguuuuauccacugagcgcuaucgcccaccacucccacuccccauuucuuuaccugguuaucaucauucaagcacgcauaucugggcuuaguucccauuuugagaccuuuaaaguucuuucuucuuugaccauggagaaaggugggcuccucucaagcaagacuggaggguagagauggagggaggguagagagugugugguggccgacauccaaggcggcucaugucaucucuucuuccuuacccacacccugugcaugcugcccuucauuugguagggcuggccucugugauagcugugauggggugugacagcagugguggcuuccaagauugggugaugaaugacaucugcguugauuuaggucauucuuuccacguuggaugauuugcuuugugggaagccaggucauaagaagccaugagaaccaucuuaagauaggugcuucagacccaaacaaaccucugaggauugucuaacuaacccuugaugauaaucucaggagagaccuugugcuagacagcccugcuaugccacuccugaauuucugacccccauaauuaauguguguuauuuuaaguuacugaguuuagaaggaaucaucauauaacaauaaacaacggauacagggaauguggcuggaagauuauguuugggacauuaaaguguggaaggauaaugaugguaagucucugcuuagcccagauguaucucuuguucugggauagacuuagccacccuggcauggcuggugguaccaaaggccagguuucccagauggccuugugaagagcuauccaggguuagcacuucucucaggagagaacaaaaccagcaguaacacauuucagugcuuagcccuuaaaagcaccuucguuucuugcuaaugucucacaggagccaggcuggccuugaaauugcuauguagccaaagauuuccucaaacuucuauucuucugccucuaccuccuuaaugucgggauuucugccaccauaccuaauuuaucccaugcugaggauagaacccgggccuuguguguguguguguguguguguguguguguguguguguguguaucaaaacuccaacugagcaacagcugcagcagcuucaaggugagcagagagacuugcucaggccuguccuguguuucaaggauuuucaaggacaagaugaagcucuuuuacaaaaaaacauugacacgacagccacauccccugaguaucuuugggugugacacacagagacaaagccuauaugacaucaucagugucucaugugccagugauggggcugacaggaaagaccagccuuugaaacuagagccccacagagucacauacauccauuauaagcaaagacagccagugggauacucccaccagagugacaguuuaccauguuaagggggaguguaggcuggagaaccuggaguuauuguuuagaccccgccccccacuuaugcuuguagcuuguagagcgugagaaaccuaucaucuagacauaaucgugagcacugccuccuucugcuuaagcacuuccaugucaaggacagacagauaugggccaaaagguaugaguucaguugcagcagagugugauggcgcaugccuuucaucccagcacuuuggaggagauggggcacugagugguucccacgugggugagaguucuugguccgguccaugucuggagcgcagaaaggccuuccggugggagauuagacuugacucuuuagaggaaagccuauuccaucauucaaguaugggggucuugaugaacagagacagucuauggcuuuagagcuuuauuguagaaaggcagagagaaagagagaagguagaaagaaagaaaccagccauggccacguggagagaagggggaagggaaggggagaaagagagcuaaagaugagaauaagagagguaagagcuuaagggagugaggaggggccaagcagccccuuuuuuagugggcugggcuaucuugcaauugcaggguaguuguggggaggagcauaccuggcuauugucagguaacugugagggugaagucuagccagaaugccaggaguuuggggacaugaucgauagucacaggauuauggaguugggggcucugugguauuaggcuaggagcaugucugucugggagcauggcucacuguucugucccuuguagaguuucuaccaggucuccggugcaagucucacuugaccagaaaacaggcugccuuucacagucccacagugacuauaguuaacauauuguugcaaauugcuaggacaguuuucacauaaaaaaguaaauguaauuauaaaguaaauguaaaguaauugcuaugaaacuuacuuugauguagccauuccacaauguacucuuagaucaaaccucaugcuauaugcugugaauacauacacuuuuuauuggcugacuuguuccaugauaaagaggugaacauaugaugaaauaucaaauccuguaaaauauaaauagaacauauuauaaauacaauauaaacacaaauauaaauaaaauacauuaaaaaccgaacuuaacaagacguaucuacuauccaucugacucuggaguaauuaacacgggcacaugauauuuugggaacuuuguaaaguggauauuauuugaauuucacaguugaagagucaggcauuacauaacuugcuucuucugaggugggaacgagguccacacagguaggugacagccacccuggaaggcacaguacucuagugcccccaucugacauggaacaucuaacuugugcuauauugugcacuccugaagcucggagcuugccuuugcugggcagguccccuggaaggaagaagcccuugccauggcuggacccaaggcucuuggcugagggcacugaucugcuuuuauccacagagucagcaaaugugggugauuaauaauagccauuaguggggugcauuugaggccaagugugagccucuugcacuucagcuuugcacagcucugugcaggagcaaagaggagucgaauuccuggagucaaucuaaucacagaaggugacccugucacuuuaagacuugaaugcaguuguagaaaggagagauggugaaggguugacugucuuagucaggguuucuauuccugcacaaacaccaugaccaugaaacaaguuggggaggaaaggguuuauucaucuuacacuuuccacauugcuguugaucaccaaaggaagucaggacuggaacucaaguaggccaggaagcaggagcugaugcagaggccauagagggauguuacuuaccggcuuguuuccccuggcuugcucaucuugcuuucuuauagaacccaagacuaccagcccagggaugguaccacccacaaggggccuuucccccuuaaucacuaacugaggaaaaugccuuacaacuggaucucauggaggcauuucuucaacugaagcuccuuucucugugauaacuccauuugugucaaguugacacacaaaaccagcuagaacaaggacaauaugaauauacuuaauucuacuagacuguuuuaaaaagugacuauagcauuuguuguuguuguguguauguguuuugucuuguauuuuugagacaggguuucucuguguagcccuggcuguccuggaacuugccuuaaaaaauaauaaaacaaaaaacagaacaaaaaccauuguucauuauuuauuguaugcauacauguuggaaugcaggugcuuuagcuguguguguguguguguguguguguguguguguguguguguguaguucagaggacaacuuuauggagcugauagucuccuuccaucacguggccuugggauggaacguggucaucaggcuuggugacuggagucuuuccgugaugaaccaucucaccagccccacauugacaaaugcuauguuguaugugugaauucuacaaguaaacauuaaagaauaaaaagaggggacccagagaaucaccaucaucuaggacaagggauccauggaaggacgcgccuguuugaacuguggagggauaggaguguagaaaacggggaggggggcacaggaaagaaagagauucucuguggggcuucucauuggccucucccauggugccagagagcugagaaacuucaacaccaacgauacagccaaaagugccugcaagcuucaugcuuuccuagugacaugucaaacacggauguuacaaauaacaaaugagccgugcugacuccgggccagggugagucuuacagucuuagcuuugcuugcucaucccuaaaucuaaacacugcucuucauaaaacugucugacaguuucauucacagaaggaaauccuaaagaucagaacgagguuaaaccagcccauauuuaucuuguuagguugucucauguggcccaggcuggccucguacuuacucuguagcugaggauaaccuugaacucuggagugcccugccccucucuccuaaguacugcaaucacgggcgugugccccuugcuuuggcuaucacacugguguaacaguagaccccagggaacuggaauuuccccuggaaucucaugcuggagaaaggaagagccaaauccuagugccagccagaaggagaacuugccugccaagaagagauuucacacaggggugacgucuugucagagcaccuugcaggauggccaggaguugaaacaauggcagacugaccccuggaccaggauugcugagucugcacacccauagcugucuauuagaauguaagcuacaugcuaguacccugcauacccauagcugucuauuagaauguaagccacaugcuagaacccugaccgcagacugggguggucacugcauccuuuuauuugucaucuucccaauugugguuauagugagugaagcuccacuuuucacugccauuuuugaucuauugaugacaaguaguugaccuagcuuguuagggcugccagucaaggcucugaccccaacuguucuggcaacacguggacacaaugucccuuauggucaucaucucuuggccaaggagaaauuccaaaugaacuaucuccugucugucagucugucuguuggucugucugagcuacacuuaaaauugcagcacaucacaggaagccaacaagagaugucagcccaagaccugacaacuuagaacaucagccucuuuucuucugggccucaccugugggcucccaggcucucggagaaagcuccuccuugaggcuugacgauaguaugggaaugaguugggaguugccuacuucugaaagcaugugacugccacaacuuugggagcucuuaugccuuuccaagacucuagauguacuuagcggucccucuucugucuagcuaaugggauagcuaaugggauuucccaaaccccuagacagggcaugagguaugcccccuacgugccuuuugacaugcuaucccaucaaagauuaaaaagugagcccuuggguuaggaaaauguuucauucaguaaaguauuugcuguguaagcaggaggaccugagcuugcaggaccugugugcaggaggaccugagcuugcauucccagcacccacacaaagagccaugcacgguggaacauuacaguucuccugugugguagcacugaggagacagagacgggaggaucucuggaucuugcugacaagccagacuaacugaaucaguagugagccacagguccauugagacagcuuauacgcuggucugaaugagaaauaucccguauagucucauuuauuugaacgcuugguucccagauggcggugcuguuuggggagauuacgaagucucucuaugaggaugugcuugcuggaggaagugugucccugagggcagaccuggagaguuuauugcccuacccaacucccuuuuguguagaugaaaguguggcuuccugauacauuuuucaugccuuuucugcuaugggagucugucuuuccauaacugggagcuaaaaauagaccucuucccccccucccccccgcuaagcugcuuuuagucaugguauuuuaucauagcaaaaaguaauuaacacacccuaucuuagggaaggaauuaaaggauuggggaagacacucaauauugaccaccagccuccacauacacuugcauacaugagaacacacacacacacacacacacacacacacacacacacagagagagagagagagagagagagagagagagagagagagagagaugcaugcacagaagcacaugcuaacacaccaaauaaauaaauaaauaaauaaauaaauaaauagauagauagauaaauaauagaccuccauuuuuuuuuguuuuuacagacuugcucacucccuucacccaucccuuuucuuagagaggacagguuuccauauuacccuccuagacugucauuugcaucaagaaagacccugacuugcugaguuagaguucauacacugucucuccucuucagcucuuggugcaucuuggcauaugaaccccagagcugucuucuugccuuuguccuguagaugaaucacccugcuucucucacgugcccuucaccaagcuuucccacguuccaguucgucuuagucuguagucucuagguuugccuuguauuccuuucucugaaaacucucccagauaaaucacagcugugaugccaacccugcaccucucccagaauagcaugaggcagaguuagccaggccuugggagagcauccaggaagccuuuguguuauagaugagaaaacaagcccuucugccuagaggauacgggacucauccaaggucuugacuuugaguuggggccagaaauaaacucuucugucuucacggcuuucugcuuuucuaguacuggacugcugccuccuucuuuaggcuuccaacgaacccuuuuuuggcuuugaucuuucaggugucacauccauagaggcaaguuaucggcucagcuuugcugagugucugauccagaacuguagaagaaagcuuggccaaaggaaugcagaugauagugaguggcucgcuugguagugcccagaggaaaugacuucuacugucaaaucauaguuugagaaugcaucaugcgaacaaauaguauccugguagacuucacgcugaaucugaacuuggugaagguucacggccgucggaacugcuguccuccccgucuguguucuggcaagaaaacuguuuuguuuuuguggcuuugggugguguuuuucucaucaacgggggcugauuccugacugaguuccaaccaacacuaccggcugugcccugagaguucuggagggaagaagauaaugacgccaucuacuaagcuccuucccaggcacacucagugacagcaagaaagcccuuauuagucucuuguuuacugaggauacuaugucccagagagguugagugcuuaacucaaggccacacagccaguaaguuaucacagccagggaaguugcugaagugcuucccacacaggcaugacauccugaguucagcucccuagaacccauguuuuuuguuuuguuuuguuuuguuuuuuaauuggguacagugcccuaugucuucugaucucagugcuugggagcagagaagagagguggaucuuugagucaggcucacuaaauuugugaauuuuaugucuacugagaaacccuguuucaauaaaugaaacaagccacccagugccagcucuagccacgcacacacaggugcauauguauacccacaaacacaugcacccacauaaauacuuauaucugccccagauaaaacagcccagucucaccauuaagcacaugguuucugucuccguuacucacugcgauggucugaaguugaggcuucaauaguuaugagaacuugaucguuccuuuggccacucuuuuucuucauguuuaaaauuggaaaucaaguaaguuucucaucagaacgguggcugauuaaaugcgucauuauauguaaaguucucauccaugcgucugaugggcagugaguucuuacuaugg

SEQ ID NO: 4036 - RNA, 869 nt, Mus musculus
ccaaaacucagaaaggaaaggaaccuucucccugugagcagaagucuggggcacuuucugcucaguucgucacaugauuuuggauuuugugcaucucuccauauaccgucugucccacagguaagugguuuauauggauugaaauguguguccccuggcaaguacuuugaaauguauguccucuggcccaaagcccaccacuuucaccucuggugacccuuguguccucaaagguucuugccugaauuucauauacucuuggaguuggaaauaccaacauggcccacccugugcuuuguauuuuggcugcauuagcucugccuggaccacuggacugcauccguuucagaaugaaaaccaaaacugauacucugcuguguuccacccauggucuaacauggggacccccugaaagaucuucaaaagcucauguccugauuuaccuuccagugagugacuugugaacccuaaguuugcgcagcaauaugucagaaauguugggcaucacauccagaccacucuuggacucuucuuccucagcugcuggggcgaguucaggugagacuccuggaaaauaagaguuuuccuuauagaaugccuguuucaaaucauacuaguacuauuggcaggucccacgagagcugucaacacucguaagcacguuguuacaugccagagaccuuauuaauuguuuucuauuuuacuuuacccucagaguggccugaagagcugcuucuuaaccaucccuuaaacagccugugcugccuccccaaaugaugcagggcuguaaccgggaaacggagagagcaggcuguaaaucucucuucugcuuguggauaguauaaggcucaauaaaguugguagcuugc

SEQ ID NO: 4037 - RNA, 54971 nt, Mus musculus
uaaggacaccaccacagaggacuacagccauccucaggacuucaucugauuuggccacauucaggccuuuagaguuggggauacaaugcagcccaucauaggggcaguccgggcugaguaugcaguacuccaggucucaggguccaacccugaggugacuacagcuccagucacacaaguccagugcauaaguuucuuuucuguugcugugaaaaaaagcucaggaccauacaugucaauguucaagaguuuauuuuggcuuaugguuguagaggaguccauaugggugaggaagaaauggcagcagucaguggccagagcagggagcuggcugauguaauuucugcugcacauaggaaacagugggugagccuauaagccuucaaguccugcccccuaccccagugauauaauuacccccagcaaggauccacuuucuagagguuuccuaaccucuccuaaccucuccaaauaguacaaucaacugggagaccaaguaugcagauacauguacguguacaggggacacugcccauucaagccaccaguaacuuuuguuaaggagaccaaaauagcuaauaagcuauuuauggagggaaggauuuauuuugggauacaguucaagagcauguagcccaugaugguagggaagccaugaugacagcagugugaggucacauaguacucacgaucaggaagcagagagagacaagugcuggaaaccucuucauccauucuucuguuaagaaaccccaauaagcuuggagagauggcucagugguuuaagagcacugacuacucuuccagagguccggaguucaauucccagcaaccacauggugacucacaaccuuaacaaugggaucggauaccucuucuggugugucugaguacagugacaauauccucauauacaucaaauaaguaagucauuaaaaagaaaucccaauaaacuagacuuggauaaaauuuugucagucauccagguucucucuggggugaauagacauuuguucacaucauuuccauucuaguaaaaguuacacaggagugcuuaaccaguauauagucacaugugauaggaccagguacagaaaaagggaaaauagaaagggggcugguagcauggcacucacugcucaagccagaugaucugaauuccaagaaccaguuuuaaaagccagcuguggugucucaugucuguaauuccagcacuccuacaaugagauggaaaguggagacaggagaaucagacagaaacucauauugcugugcuguagaacaagagagcuccuuccucauaaauaccauggaagagaauggacuucugaaaaaaacagucuccauaccuugccccaccuccccuucacauacaccuuacagaaucuuagaaagggcuugggcuggaggauggcucagugguuuaagagcacugacugcucucccagagguccugaguucaauucccagcaaccacaugguggcucacaaucaucuguaauggggucugaugccuucuucuggugugucugaagagagcaauggugugcucauacacauaaaauauuaaaaaaaaaaaaaaaaaaguggggggggguucauuccacaggcaugaaguuucucuggaugugauaguuaaccuuccuugccaacuugauuaaauuuguaaauaaguaaacugaagacccacuugaaagugguggcaucauccuugagcuggggaaguacucagacugaauagaggaagcaguaacuugaaucacaaugcaagauuucauugcaugugccacuuuaagagccucugguuugggaacuuuguaaacaucuuguacaagguauaugacuuauccaagucucagguucaucaguaaauuaaagagagcauaguaccugagauuagaugggaugaaucauaguaugucuacucugaucugacauacuaaaugcucaguguuggcuauguugacuagaauaaccaaauuuugcauuuagugaauaguaucccugauaacucucugagcacagcccguuucacuuugaauaguuggauugguucuaccaacgauuccaucgcucuccugcuucagaccaccuuucucugcuggaccauccugaccuuguuuaacauccaucuguauuucagggccugugguuuuagcucccuugucugaagguucuuccuguauguaggcuugauucccuccugaaauucaucucccccaaacaugggauucucaacacccuguuguaaguagcgcucacauggcucuccucccuuauccuuacuuuuugcuaccuguaaguaaauguuccuguugacuagaauguauuccagauguuuguucggcggcccuuaaggugucacuacuucugagccauauugaauccuucaguccguggggcaaaauucucacuuaucgcuccuucaagucuuuuuggaugaaggacaaagauccuuauaucuugucuaccaauguccaaucaggaggcuggggucuagcagaguucuaggaacacucuuggagggcggauggcuuuuuguccuguuuuucugacccaguuccaaguaauguaggggugaaaagugaaguccauacauaugacuucagugcuauuaugcuauuucuugaccaggacucuugucaggcugucucuaagacaaggugggguaagagcuuuguaauauccugguuuaccuuaacauugagagcuacagcugauccacaacacccaccucaaggauuuggaguuuacccaugccaugagcagucagucagucuuagagacugcuuucaagguacucaguuuucaaugugcguaaaguuauauaguaauuauuuaauauagaagauaguauaucauauauauuacauacaaaacauuacaaccaccacacugugaaggccaaauaauggguuggaggcauugugcaaugcaaugcuaggaucacgugguguaacaaaugaagaaaaaacccaggucacuauccaagcauuuauucauuacuaguuuuucuagugagugggguauacacagaucauuucaguuaguucuguuagcccuaacucaguuaucaugcagucaaucaagcuucagauucaaagacaaucuuuuauccagaacauuuuagauccuaaaccuaauuuugaauugcucuuaauuucuauuacugcaauucucuuaagauugaagcucacaaaacugaaauuuaucauccuacucagcaguggcugaagacacaucuacauuauucuccuuggagaucugcuuucaccaaggggugggguaaauggauaguggacuaaaacuaggcugagaugugggaugggccuccucagcuauccacuucaacucuucccaguuucuucuacucuacugcaaaucuucaaaacaagagccgccaaagcagacuacgguucugcugggaggcagcaagaguuuaucuguuccuacucuggucaccaguggagcuggggacaucugagaacagauauuugacagggacacaggacuugaccacccagucuauuucuguggucuacuguucucuggauuccaugccaaaauacaauuuuuucuuuugcagcagacuuugacacaaacauucucacugucccagcagagaaaggccaguucuuugacauuuauaucacaccugaagguuaaagggugaggggaccacugauuauuccagguaaaguaacugaauacgcaagggcaagaaaaaugaaaagcagcaagagggagccaauuuuaggaugacuuaaaagucugcuggguucuaaaccaugcagcaguuuuguuuuucaguuucuuguucugguuguuucgcugcaaagaacaaauggagaucaagggcuaaacagguaucucagcagagguugguggaugagacaagcuuauuccuuaggugcuuagaaagcagagccaaagaguugacacaaggucuguaauaguaaaggucagauuaaguugacaguuugcauuagauugauagggaauaguucugaggugaaaaaaaauuaaugcuugaauuaagggguguuauaggcucaaucacuacuaauuaagacuaugaaauuaaaaauuucccaaguucuuaaacggagauaaauccauaccucaaaaccaaaugaauucuucauuacuuugcagauacuauuugaagucauguacaacuacaucaaguaucacaauguuuauugauagauacaaguauauaaaaucagggcaugaacaugacuugauaaauuaaguagacuuaauuucaauacuauaauaagagggaccaauucaaauucucaccauuuguuucacacccacaaaaaccacuucaagggcauuaaugaucucucaaacugaucaguuuugugcaaguaaaccauguuucuuuuaaaaagacuugugcacuugcccaggcucaaggauuuuaaaaucuagcacauaaagcccauuacuagagguagaaauacaggcaauauacuauuacggcaacaaccaucaauuacaguuaagaauuuuucuguaacaaccaaauggauaaucaaauauugcaacaacucaaguauuacugagcaaagugcaucucuacaguauucaguguugcuauucaguuuucuaacuuaaaacagccuaugguaacuggcagcaaagaagguccuugcaauagacugccucugcuugagaacuuaggauguaauuauugcaugcugcuaauauucuaucuaaacauuaaggauacuccuaaaguauuugaugguagacuaugauuaagacaucacacuacaaaaaccuuaugcagaaggaaaccuuacugacgugcuucugcuuuaaauauugugaaaaaacguuacagcggaaugaauuuucgcagugguuaggucaaaugcaguuacaucauagcaacaguauguuuugcacaauuuaaggcuuuggcugguucuuuagucagcuucuuccucugauucuucuucuucagcaguuucuagccagguuagccacugauucaccuguaaauuaaauuuauaauuuaguaaaaauuaaguuuugguucaggauauaucuaaauagaaucagaacuuauuuaucugagucuuucccacagccuucuaaaacgacuguacaagcuguuuugcgccuguguaccaugugugugcagggccccacggcagcccgaaagggccaccggacccuuggaaccugagaacuacaagcacucugaauugccgauaugucuccaguugcuuaccagggaacaagaucucacaguccaguccaggcuuuccuugaauucaucauguaacagaguacaacucuaaaccuagucucuuguccuucuaaccuaacccaugcaccacaccuacuuuuaauuaacuagucguacacuucuguuugacaguucuacaaugacauuucaggaacacuguagucuuucuuaucuaguccaagacagcaacucuuccaaaccaaauguuaucagcaucuagauaggcaaggauggcaugccaagaugaauaccagaauuacuuaucagauucucuaaaguaggaguaggaauuaauccuuaaugaucuucacaaaguagccuacaaaccuuagaaacuuuuauaaaccagggcuuccuuaaaucugaagccuagaaaaacuacuacuaucugaauugugcuaaauaaagaaccuuuaguaccagacugggauccuacuauuaauuaaacucauucauuuauauacauucuggauuauggaauacuuugaugucaaguuccacucuuagaacuccauugauaacagaaaacuuaacuaguugcuuuuuucaccuaagguauaacuaauccuuuaaccaugcaaacagcucuaucaccaaaauugucaccuaauuuaacaccuuuacaucccacuauuucauccuguaacuuuaucucauuuugcuaacuaccuacuuaacuagaacuuguaucauugcugaccggcauacuuuuggacacauucaaguuagaaagagggccauuuaaaauacuaacaagaaaaacaaaaaccaagccaaguugacagucaaaaaaaaaucucaacaaagcacuuaccuggaacaaagccuugccuuuuccuggaaacucuugaguuaugucuuccuuccaagcuaagaaagcuuccucuucaauaauuuccaugucauagaagugaacaaaaaaucgaaguaacaugccuuaaaaggaaacacagcauauauuucauuauuuaacaugcuauuuaggcugccucucaauccccgacaccugaacagucaccucaccuuuugggaagcugcuguuguaacagugcaccugcaaagcauacagggcacugaccuguagauccacaugaucaugaagaaauuucugcaucacuggcuuaaaagagagcagcagcuguuuuuccugcucuaacugcucuuuggaaggagcagaggaagaaucuguuucaucgcugggugggcuuacuucacuagaaauguacuguaagaagcugaacagcaagcuuuuuguuagaaacccaaugguugucuagcucaacaaauuguuauuagacuucuggcaaaugaacuacucaucuuaccuggucauuaagauguucacgaauccuuuaucuacaugaaguuugggagagauguuaucuuuaauccauuuauauauaguuugaggggauggauccagcuuaauuugcuucaauaguuccuucuccaauuuaaggagugggaauaagaaacucagucccuuuccuuccaaaaucuccaacauucgauccuuauucugaucaauuucugcaaacacaaagcaauuucucauuuuaucagguugaccuuaccuaaacaaagcuuuacaaaugauuuccuaguaaacaaaauuccacucaaggacccaaauauccauuuaguguuaagucagcuggcucuuaccuggcagcauuuucugcauauugaccuugcuuuguugaaaaaguucgguuaaccacucucggucuugcaauuuagcuaauuguugaagacaaaguaagaagagagggaagugggugccacucuccagugguugagcuaguucggaaaugcucaccaacucugaaauuauagcacgagcugcaaacugugccaaguaagauuucaccaaggggaugucaaccuccaguuuggggcacugcuccaauacauucaggaaagccuugugaagaaaauccaacaguuucauuaauuuucaaucuuaaauggaaagaaguugcuuuaucacacuauugguagaauguucuaccugcaugaaguugucacuuguggcuaucccuuccuguuugaguaaacugauuaaagagcuugcuuuuucuuuaucuucaucacuucuaucaagugacaggaugaucacuuugcuuagcaucucaggaagaaaguguuuuggagcucucauuucucucacaccacugacagcgucguuggcauuuccacuguucagauagucagucacaacggcuuccuaaaaacacaauucaauucucauaagcauucccuacccucaaauguuuuccaaguaccagagaugauuuauuuaugaggcuuucugaaacuuacggucaguuuaaguaguucuuccuuugauggugguggcuuuuugcuagucuuggcaggcuuuuccuggauaagugguggauuaguuuugagaccaaguugaggugucuaaagacaagaaacacaacacauguuuaaucaaaaugaaacaaaccaaaaauagcaccaccaugaagcagagggaaggaaacacuugaguccucacccaccuucagggacacugagaagcguacuacacuuugggggcccauaccugucccagaggcgguguuugagugcgugguggcugugcacugggaggaaucauaguuaucuggggcugaagcuuuggcaccugauuuuuauucauuagaaacgacugagcaggccucaaacuaaucuaaaauugaaaacaaaucaacauacaaccaaguuaacagaacuaaugaacacaacuauaaacacuuucaauaacccacaacuaauucuauacaaaucuauuauggcagugauauaauucuccaaaaacuaaaaguuauuucaugucacauaaugaauuuuaacuuaugggaaaaauaccugcuuuaaagaguagauacugaaauuaaaaaaaaaaaaacaaaacacuucacaaaccuuauguuuguaccguucaagucucccaauaucagcaaugcagauaaacccuuuauucuacucaauaucuuuaccauuuucucaugauaacuauauaaauaacuuagaaacuugcccucauaucucauaaucuucgcucauaggacgcuggacauccagagagaaaaagcagagaaaaguagaaaagaaguugaagacauaagaguagaggagagaauaaaaggaaaaagaauuccagcuuuaaguccucuuuggcgucuuuuuauaaucaucgggcaagagacuucugcacugacaaacuacugcauagaaguaauguaggcaaauguaccucaucugcauuaagcuguccuuucuuagaaaaccgagguggcauauccuucgacuguccuuguagcugggauaagagucccugacucugguuaugguagagcuggcuuagccccuauuucagaaagggagaaagaaagucuagauaaaaauuaugguaaucaaguaccaaagggaugagccaagccauugcuuugcccagaaaagguggaacagggaagaauaucuaacauaucuguugaauaaagugaugugauuuuacuaaucuuaaggauaagcaucuuacucaauuucaaacaacugucaaauggaaauaugcuaaggaaaaaaaagcauaagaacucagcuucauuuaaaaacaauaaagggcaaaagguauuauaccuaaggcuggcccuaacacuaucaauaucuuaccuggcuuuucauaaacuugccccccaucucuccaaacugcgauugcgugggaggcaugaugugccccccauggccauugaagagcugauuugaacgaugacgucccauugugggugaaaaucuauccuggauaacuccuggaccaguaccaauuccacuaccuuaaaauacagacaacucuuagaaauucacuaaaauauuaacuuuugguuuauccaaaacacugcugcuuuuaaaauuaccuggcauuuguccaaacauaucagcaagucccccaagugggucccuauccauuuucauccuuggcggcaugaacggucccuccaggaagaagucauuccucccuugagccauaggagcaggaauaaacacuccuagauccuuugagaagaaaguggguaaguacuguccuuauuaaaauguaaugcuaccauucucccaaaugggaugaaggacacuacaaagcaauaccaauucuaauuucaagaguuaacaaaaaaggaggggcaggaaaucaaaaaucccuuacuuuuacugcaucuugacggauuugauugaucgucuuugguccauugucaagaaaagccuugcgaggaacccaauggugcucucgcaacucuacaguauccuguaauuuuaaaaaaauauaaauuuuauuuuaccauuccaaaugaaaaacucaaaaacuuugaacacuguaaaaaccaucuuaccugcaguaggaaacgaauccuggcuggcaauuccuuacuuaacauuaaggaacacauucuggcaaaguacugauccauuaaggacugauaaagagacagaaacacacaauuagcuagaugguaaauguguaagaugcuuuggauuauugcuauacaagccaaugacuagaguaaauacuaccacuucacaagacaccacccuuuacacuguucuuaacaaaaacauaccuuggcucguucauggucuaaucgaggucccacuguccucauuaucugacagaggcacuccaaauccucucccauaucuuugaguuggacucucuucuucuuuuccaaaagcuaccaaaagaacauguuuacgaucauuguuacucuugcuuauguaguuuuuccucuuuagauuuggacugacucauuugcaauuccuaaagcacgugagacaaugguuuccuaccaguuuucauugaagaaacccucuaagaauguuaacacaggcaaucuguucuaucucuacuuuauaaagcacacuacaaacuccuaaguuaucucuauuaucaaaaugugaauaauugugacugccucaccccuaacccacuacaccucgagucauacuuacuguuuugaugcacuuaugaaggauagauucaugaauaagaucaagcuugccaaguucuccaaugaauuugauguuccccaacaucuugaucuuagcaauggcucucuguuccuccuccucaggaaggaggggauuuucacgcuuaucauagacugagggaagggaggcaaacaaaauaaagaacacuuaggccaugaaagguguguacgcacacauaaaacuacccaagagcaaauuuaaauucuuaccaucaacauuucugguucgguuuucaaauucaucuugcaauuuggaaaucaagaggcgucugaaugucuauuugaaaacaaaaaguauuuguaaaaagaaaaaaaauuucaaauuaauuucaaaacaaagaaaaaaaacugucacucacugugcuuugcuucuguccugguugacccucugcugcugggccaucaaaguuuggugcaucuucugccaaucgcagacauagcugagcauacagcgagcuauacuuuggcucuucuaaggcuuuguccacaaucuacagaagucauuaaaaaacaaaccaccaugaacuagaagcugaaauagccucccuuuaaacagucauacucuuacuuuucacaacaaguuacaaucucaauuaauguuuacucuuacauuucacaaguuacaaucucaauuaauuuggacaacucaggaaaaaaaaacgcacuuuuaagcuuuaaaaauuuacuaugucugguacaauagacuagaucucauguuauauaccuccuccccaauuagaaaugaacuauaaaucauaaaaugcuggauuugggauccaacucugugguagucaugcaaaauaagaugccagaauucaguauaccauaaaauucccaaaaccacuuuuacuaaaggaaaacaacuguugggcgugguggcccaugcuuuuaaucccagcacuggggaggcagaauucuggguucaagccagccuggucuacagagugaguuccaggacagccaacaaaacaaaauaaaaaaaggaaaacaacuuaacagcuguuucuggacagcauggucaaccaaaugguucacccccuuggaucuugauagccauuaaagguguuuauuuuuauuagcaucauuacucaaucauaucuaccguguauguauauguaucauauacuuauccauaucuaagaaugaaucucaucauuuaaagcaauaacucagucaaacuugggucuguuaaauuccucacccucuuuuaagcuaacaucuuaaacuuaccagcaguaugaccccuuuaaggaugaguuuagacucuacacccacauugaggagcucaaggcauagcuugucaaacuuuucaggaguaagcuuauuuaguaugcuagggggaaaacacaaaaugugacuuaauauuuuucuugaacuaaaaaaagagcauuuaaaauuugacuuuuccuuuacuaggguccuaaacaagaaaauguuccucccccuccccaacuugagauuuccaucauguauuuuaaaaucauuauuuuuugacccaauccccccauguucucuaauuuauuccugaacuuaagacuugccuuggaguguggcugacauaucaacugauacucuccgguggggggggggggggaucccucucccagcagcauguauuugcuaguagcuucuuggcuaggaguagggcuuuugucuggcuugagcuuaugcaaaucuugugcaugguauuauagaaguguucaguuuucauccagagaugcuggaaucacuucucaguuacaacaucugaauuguauuugggcuuucccgcuguuucacaagaaacuucucuaaauacucaagagcaguagguuuucauuauauggaagugaccaugaguuaagaugguuauauuacccaugucacugaguuacacacuaaaccaacaauggaaaugccaucacuuccaacuuguagguuguaaacaaauaaaccuugcugucaaauaccaguaggcuauacuucuguuuaagauucuuuaaaauauuguugauauuugaauccacuacaauguaauggaugccuagugaaucuugccaaaaucaugccugaauuuuucaauucacauacuagaauauaguucaccaccacuucccucagaacagacuuuggcacuuacccucuuacuuuccugaagauugcaucaugucguucuuuuucauuugcggaguuguuugcugcggaguugucaucucgucuagugcuucgugcaggaauccauuucugagcguuuugcccugggguuuuccccaggaacucgcuaguuuaauaaaacauugaugaaguggcuuacaauuaugaaaaaacuugaacacagcauccacucacaacaaauaccauaaaacccuaaaaccgcuaaacagaggggaaaaggagccaccaaaccaaaggcuuuacuuccccccccacaacaaaacaauccuaaaaauuuuuucaaacagcaucagaauuguccagaugguaucuuaaaacagacucgaaggcccauucccaauuucuguucuaguagguuugggguaguacccaaaaauuuccacuucugaauauauauauucccaggcaaugccaaaacugcuggcccaggcaccaaaccuugagacuuaauacuaaaaugcuuaacaagcaaauuccacacagaccacuucacaaauacccuauaguagggaucguaauuuugaaauaccagcaaacauaaaccaagaggaugaaaagcaguuuggaauuaugaauccacaucaagauuacugaugacuucccaagaauuacccuguuagcauggaagucuuuaaucaaaucgacaguuuuaaguuaacugucuuuacaaguuuuaccauaccuguugccagcagucuugggauagugcugaggugcaccccuacuuccuccuccgcccgaagaagcacuauucaaaagaaaauuuuuacuauaccaauuaugccucacuuggaagggaaccuauuuauauuuuagaaacugcguaacaaagugaacuuuggccuaaaagaaagugaacuggaggcuagagauggcucagauauucaaagcaguucaguuccuaacauccacauggcagcucacaacuccagucucagaggaucugaugcccucuucugacacuguacacagaaauguaugcagacauacauucagacaaaauaaucccccaccccaccccuguaauccauuuacucuuuauucuagaaccacagcacauuagugggaauugguaacgacuuuguuuuuugagucaggguuucuuuguguagcccugccuguccuggaacucacucucuagaccagacuggccuugaaaucagaaauccgccugccucugccucccaagugcugggauuaaagccgugcgccaccacugccaggcuuuuaugacuggcccuuucugaacacccccuccaauguaucuacuacccacucccaaaaccauaccugaaacgagaagcacccccuucugcaaucgcacucuccacuuuggcggcuugacaacgaagaaucuucaaaagaauaauauuaauggaugggguggggaggggaggggaugguagaaaugaaaagccuggaaagagagaaaacaccaaaauuagguacugccauacugagcuauaaacuuucaaauauaauuuauuuccgcucccagcacugcagcugguugaacuuucacugcauugcagcccucagaagacuaaaauagaacgaagucaaaacccacaaauacacaauaaaaccuguuuagccccguggauucucuuaguauucaaggaugcaaagaacagcuuuugugagaaaaauaaaaugaaaaaaaaucuggaugcugccuaggaagcagccguauuauggggccuuuaaaauuaaacagaaaugcuaucaagaccggcggugcuacaagggauaugucugcgguacuaaaauggguggccgggguggugacaggccggccagagccucacuacccgguguugggcagcuuuuccuccgcucgucuuuauaagcccuuccuuuuacacagggcgcguguggaaagccgccggaaggccggggccacaacacaacauggcagcaggcaccuccgccccacuccgcgcgaacaaaagagcagcgaguuccucccccaggcccaggcuggcucagcuuccgagcggcgucuagcgagggcccaggccugggcgggaggcgcccccuccgggccggcccuuuguucucccgcaggaaggcggccuccugcccacccgccgccuccaccauaaaucccccggcugacagcgccucggcugccaaggcccacaaagggaccgagacucgcucuuggcgucgcccgagugggacaucccgcaguagggccacacaccuccuccccgccgggaggccgggcuccggacucguccgccucgcuggucccgcgccaacggccgggcccugccgcgggccgcgucccucccgccgaggcgcgaggccugccacgcucgcacgcuguucccggaucccacgucaggaucccggcugcgcccgccacucgaccgcacgucagccuagcucuucggucgacacaggaaggagcgcggaggccauagauuucuaaguagcccaaaggcagaggaaaggccgccccgcccggcuccgccugcggccgccauuuuguuccacucgacaagaagcggccaggggcggcggccaucuuagagggcuccgcucggcggcgacuccacucaccuucaccgagaacucagcagcugccaccgcagcugccuccucuggauccggucgucggggacggggaagggagggggaaggggaacggaaaacaaaaaagggggagggaagggggaggaaggagacgcggccggcuugaaagucucagcucagaggaguagcugcugcagccgccaccugguacccgccgccaccuccauagagcuccggcucgcugcuggcgcugaggcgugucugaagcccaacuuaucacucugaggcggccgacccacuagagccuccccgaguggcuccuucgcuauccaaucagcagccgggcuuccguccgcuaccaauccgcgcagggcggcggggaggagccagcgggcaagcucgguugcggcgcagccucgccgcagugcgcaaagccauauucgcgaaggcucuggggccaagccaguggcguaagggcggcgggccggcgcgcugcgggacucuugcguagcgccgggagcccagugagugugcgccgccgggccgccuggucuuccugggccggcgcuuuguuccggagucccagccucaugcuugcauagaagaaccuuuuccucgccucuccucccugacccgcccgggccuggcguccugagggcucggcguggccuugcggccuggccucgguuuagcgucugggagcuuugcugaagagagggacgugugcccaucgauaggaaugcguucuguuuguugguccuccaucugcagaguaacgagaaaaggaucaaaggaagggcuuuguaucccaggcuagaggcagcuuuaacucaaaugcucggccugcugucaccgagcuugacccagacaguauacuaggcuggcuugagaaguguuugcagagcgcgggcauuuggaaauugcaaagucauuuuuuaaaguuuuuccuucauuuuuaacaaacauuaaagacgggcagcgcagugcuuucauuuuauuuaagggcuauauaggaaaaugaagcauuucaaacuauacuuccaggugguauuuuaaaagauggguuauguauguaugccacaguaugcaacauuuuagcuuuccaaaaaugaagguauguaaacgagaaaugucccaucucuguuaagcaugcauuuuuuuuuuucaauaagauggguuacuaaacuaaagcacguguguuuucaacagucauggcuuggaauucauucccaagagcuggguuuucaaagacccaaacguaauuuggcaugucuugguguugaaagcccuaguucuuaaauagaauuuucagcagacaauuguacuuuccuuaguauuuaagucugcugaaaaguguggcuuugaagguuuauaauucuaguaaacuuaggucuuugccuuagaauuaaugcuauuaaauaaacuuucacuuaaacuaaaaacuguaaaaaccauuuuuauuuggggguuaaguguaaaaaagaaaagcauuuuuuaggagaggggcaauuuuuuucaauauaagagauuuugcuuuguauauauaacuuguauggcuuuauaacuaguagaaauauauacugugauauuuuaguuuuucacaagugauuuacauucauuaugauacacuaaagacaucugugugcuagaaacacagugguccaaaaacucaauacucacuauacuaguguaugugucaaauagccacuuggucuaaaacauggauauucuaaauacaaaggacuagaauguaaauauauccuaauauauuuauauuaugcauauaucuaauaaauaaaacagaaacuaaaauauaaagucuuaaaaacaggaucuugaauuuaaaaaaauguuaaaagggacagcaagguggugcugcugguaacgaacagcaccacgugcugccaagccucaugacugagcucagucuccagucccacauggaauaaagagagaaggcucacuuauacacacacauuuuaaaaagggcuuuuucaagcuuuguuaauugcaaaaaucugcuaugaauuuucuaugcagguaugugaggugcuaacugacagggaguaaaaccaagaagaaauucaaaaaaaaaaagaggcggagcgugguggcacucgggaggcagaggcaggcagauuucugaguucgaggccagcuuggucuacaaagugaguucaggacagccagggcuacacagagaaacccugucucgaaaaaaaccaaaacaaaacaaaacaaaacaaaaagauggaaauaaacauagauuuaaaaauuuuacuuuucagucauagauauaagcauucacaaauuuaaaguuucuaucauauuuuagauguguaaaacuucaaauaauuggauuugaaauguaaccaaacagcuuuauaugucauuuuauucauuucuaauuaagucuggaaaacugcuaagagucuuaacuuguuaauauauuuucacaugguuuuaauccuggcaguauuauuuuuguuuucugagccucucaccauggaguucaggauggccucaaccuuaauaucuuccagccucagcuuccuaaguguugguguuaucuauaccugggauuccugcaccacccaccucacugguuacuguucuaagcacacacugaugugucuacuaucauuucugcuuaaggauucccuaaucauguaacugaagaccagggcucucacuucugaauuucuaacaacuugaucagagaagcaaacuuguagccuuauuugguuugagccacaguaguuuuaagcaacuugacacugaaauauuaagagauuauauacaaggaaaaggcuuacaucuuuugugaaguucucuagccuuuacagccaguuuguuguuuugaagucuucaauagauucaauacaucaguacuggaucuugagaguauuuguuuguucucuuuuagaguuaugauugaaugagauuauauauggaagggacauagcauagucacugaaauauaaugaguuugaauugucccucucaggcauguuuugugagcauuuguucucugguuaguggcacuuuuugaaggucguuagccuuuuggaggcugacaaugacuagugaaauagguaccugaggcaggccuuuguuaguuacacuuacuccuggugcuguccaucucuuuucugcuuccugaucugguagcuucaccuuacacucucauuaccuugaagagcugaaaucucugaaauugugagccaaaauauuucuucccuuuaguuguuacuauuacaacaguaagaaaaucaauacagaaauguucauaaguuuauugggggcugcauauggcuugaaagugacaugucauccagaggcucuugcauuugaacaccuggucccagcuauugauccuagaccagauaauucugaauauuugguuuuggaucccagacaucaauaguauuuaaaguucucauuuuauuuccaggugcaaucaaguuuuacaaacacuaccauaaagaagagcauuucaaaaauuacguuugcaggccauaggaaagaaaacuagaaaauggaaauugucuuuuucaaagcaggguaacaaacauucaaaaccagggauuucagcuuuuuaguccuuuagauucugcuaaaucuuuagauaccuuucuguuggccuuauuuuucaccacucccaucucuuagggagccaguuagacagguauugcugcccuuaaaaaucaacuccugggcaagugagauggccuagugauuaaaggugcuugccccugagcuugacaaugaguuuggucccaaggacuaaugucuguaaguuguccucugaccugaacaaauguacugugauaagaauacgugaccuauucaucucacacauacaaaauaaauacaaaaguaauuuaaaaaaacauccacacauaauacucugcuguaugcauuuauuuccucugccaucuccuuucugaaguaacagauauuaaguaucaaacccuuacuguccuauugcuaugaagagauaccaugaccaaggcaauucuuauaaaagaaagcauuuaauugugggcuugcuuauaguuccauccaucauagcagacagcauggcagcaggcaggcaugguccuuggaggcauagcugagagcuacauccugaucuagaagcagagagucugggcuuggcauaggcuuuugaaaccucaaugcucacuaccagugauauacuuuuaacaaggccacaaccuccuaauccuuucaaauagugccacucccugauugcuaaucauuuuaauauaugagccuauuagggccauucuuauucaaaccaccacaaccacuccccagaccauauaaucuuguaguuauaucauaaugcaaaaagacauuaauuucaauuucaaaaguccccauaguuuaucauuuuaauuucuauuuauuuauuuguuuguuugguuuugguuuuucgagacaggguuucucuguauagcccuggcuguccuggaacucacuuuguagaccaggcuggccucaaacucagaaauccgccugccucugccucccaagugcugggauuaaaggcaugcaccaccaucgccaguuuaucauuuuaaaaguccaaaguucaaagucucuucugagacucaaggcaauuucuucccuguaaaaccaaaaucaaaagcagaucacauacuuccaacacacaguggcacagaauauacauuacuauuccaaaagggaggcaaggggcauagugagaaaauacuggaccaaagcaaaaccaaaaaccaguaggacaaacuccaaaugcugaaucucuaugucugaugucaaaacacucuucagaucuccaagucuuuucagcuuuguugacuacaacauacuuuucuuucuuuggcuaguuccacacccagucugcaacuuuucuugacaaguaucccauaacucuggcaucucuaacauauuggggucuccaacaaaaucuagguuucacuuucacagcuucuuauagaguguccucccuggaucucaaugcagguauaccccugacacaagccugaucaugguagcuuccauuagauguggaggcagauuccacagucucuucauuguauucccugacucuaauaucaaaaucacauagucaaaacugccaaguucugcagucaaguggggcuggcacguagccccuuccaauuccauucacaccaccuuuuguugcugauauuucccuucugcugcuuaagccucccuuuaacuccuuuucacaaguuagaagcuuagcagguugggaucuugcccucaaaucacuacuccauuuaucccauuuaccaucaggcuuuaaaaaacaaaaaacaaaaagcuuuuugggcuggagagauggcucagccauuaagagcacugacugcuauuccaaagguccuaaguucaauucccagcaaccucaugguggcucacaaccaucugaugcccucuucucgggugucuaaagacagcuacaauguacuuacauauauaaauaaauaaaucuuuagaaacaaaaccaaaaacuuuguauugcuuugagcuccauuauacuuccugguauugcuuuucacacuacacauuuuguauaucucuuuguccagcuugcuccuuuucauuguagauaugcauaggagugacuacuaauaaccacaugacagauauagucuaauauuaggcuauauugaaaucuuuuccugcuaaugccagccaucaguacaaaacucuucauuuuagccucaggcaaaaagcagccacauucuuucccgaaauuucacaagaauagucucuaggacaguuacuaauauucuuccccucuggaacuucuugagccaggccauaauaauuuacauugcucuuagcuccauugucauccaugcacuuacuaguauggcccauuaagcccugcuuuaaguauucaacugcuuuccuaauccaaagucccaaagcucacauuccacuaacuagcauggucaagccugucauggcaauaucccacucccaguauaauccucuaucuuagucacuguucuauugcugugaagagacuccaugaccaagacaacucucagaaaguauucaguuaggggauugauuacaguuucagaggcuuaauuaaauuaucaucauggcagagaacaugguggcaggcagagcuauaccuugaucuguaagcagaaaguuuaugggcuugacauggcuuugaaaaccucaaaguccacccccagugacacacuuccucuaacaagaccauaacuccuaauccuuuuaauccuuucaaauagugucauuaccuagugacuagacauuuaaaucuaugagccuauaagggucauucuuauucaaaccaucacacuaccuuuccuuuaacagaauaacuucugaauuccuuuccuuaguuuggcauuaaaggacuuuugcugguuucagacuaauccccuaucccuaaauccacccuuccuucaauccuauaguuaacccuacucuaguucuauggcacucauguuuugcuccauuguaccauguuuuauaucaaugguucugaacucuccuaaugcuguggcccuuugauucaguuccucauguuguggugauuccccaccauaaaauuauuuuuguugcuacuucauaacuacaauuuugcuaguuaugaaucauaauguaaauaucuguuuucuaauggucauagagugaccccugugaaagggcuguucaaugaauaccccccaaguuguaacccacagauugagaaccacuguuugaugauuaaaaaucaguagcuuuuguccauuuugggaaagaaguuagugaauuaauauaaugauuaugcaaggagcuuagguauaauuauuuuuaaagggguucacaguauaccccaaaaauaauuaugcugaucuaacacuugggagguagaggcuggcagaucucugugaguuugaggccaaccuggucuacguagaaaguuccaggacagcugaagggguuugcagccccauaggaggaauaacaacacgaaccaaccaguacccccagagcucccaggggcuaaaccaccuaccaaagaguacacauggaggaacccauggcucuagccgcauauguagcagaggauggccuuguuggucaucaaugggagaaaaggcccuuggucuugugaaggcucuaugccccaguguaggggaaugccagggccaggaagcuggagugguggguuggugagcagggggagggggaacgagguaggggguuuuuagaagggaaaccaggaaaggggauagcauuugaaauguaaauaaagaaaauaucuaauaaaaaaaagaaaaucauauaacaauuauaggcaaaagcuggacacuuaaguagaaauuuaauuuaaaaucuuauagccaguauaauaaaguuccaggagagcuagaguuacauagugaaacccuguugcaaaaauacaauccccaccccaaacaaaacaaacaaaaaaacaaaaaaagaaaugauggaaggaaugaaaaaauaugccaguuauaaauuaagggcagggaaggguuguaccaaugcuauauuggacaaccaagaagaaaauuuuauaaaaggaauauuaggagauaaaucuguugacgucuauccauuauggaacaaugcuuugagguuugacuauacaggcaaagaaaguucuugaacauuucugaacucugcucaauuuuauuuaagcaaauaccuuuuuauugacgagugaauggucucagggaaacaaaccaguaccgcagaagcuuccaccucaguuuccuacagagcugugucuucaccccauaguuuaggggucaaccuggucagaugccucugaagaaggcuucaccuggcuacagauguagcucggugacugccgagcaugcacaaggccuuggggucaaucccuagagcugcagggaauggaguagauacucccuuucucaguacucuauuccauuccccucacuucaaaguccuuauuuucugaaaugaauuucauucguauguauugucuacucauugcauuagcauguaagcucaaugacaguaggaaccuugccugucauguuacaucacuaagaguuuuuaaaaaugaauuguuuccggauagaaacaggcaaaaauuucugaacuagauaagagacacaaaugacccuucugaagaggacagcugaugcuuuuuagcuuacugugauuuauuauauauuuccuuuagaaaaaauaaaguuagagaauggaugauacucauuacauaagaagcauuccuggaaguuaaucaagauuaacuggcagugaguuaaaggaaagcugcuucaaguuguguauaauuccuuuccucuucucuccaauguaguaaaagauauauguuacugaaaauauuauuauagaaacaccaaauucuuucuccauuuuuccuaucuuuuaauucuuugagaauuaaguucugaucauauucacucccuccccuaacuacuuccagaucacucuucuuuccugaccacccaacuuuguguguuuuuuccccuacucauucaguauauguauuuauggauguguagucuuccacuagaguauggucaaccuaacagcagcaagucuuucaaagaaaacagauucuccuucccagcaguuaucauuugcaaguagcuccucagcuaggggugggacccugucuacuuuccuuccucauucuaggauuuggucuggcuugagcuugcacagggcuuguguauguuaaugacugcugugaguuuauaugugcagcuguccuguaugucuagaagcuacuguuuguuuguacuuauucacaccauuggcucuuauagucuuuccauucccucuuccaagagaucccugaguuuggggaggagggagaauguucaguaaagauauuccauuuaggguugaguguucugcagugucuuauucugugcaccucuuuggccauuugugggucuuuuaguuaaucauuguccacugcaaauagaaguuucugugacagagguugagagaugcacuaaucugcaucucuguacuaccaaauccuuuuuuauuucuuaaacaggagaguugcagcuuaguguagugguucaugucucuaauuacagcacuuaggaggcugaggaaggaguacugcuguaaguuuuaaaucagccugggcuacagaccauaucucaauaaaaacauuuacauauugaaauauuuuauauauuuuauuugcaacaguaauaguccauuuuauaauaaaauauaaucaaaaucugcuaaaaugaugcagcuaaagaauguuaucuuagaaaauagaaauuacuaaauugcaauuaaaaauuuaacugcuauaagccaauguuuuauuaggaggaaaguacauguuauucacacagacuaggaaguugauucucucucuucacgauguguguccuagagacagaagucauugggaggcuuggcggcaagcacuuuaccugcugagccaucuuaugggcccugaagaauguuuuuguauacaaggaaagaaaucuucuccugguaaggguugaauucaaggccucaaauauaagguucugggauuuccacuaugggagagauucuauuacugacucaaauuccuuacucauuggucuuuucagauuuucuauuuuuucauuuuuguuuuguuucaguaguguucuuuauuguauuuagaaucaaaguaagauuucagauauauuccuucuuugaauauaaaguuaaugaaagaccacugggauaaaaguuuaagacaauagauauagauuucaguuuuuuaaccuauuuuuucuauaaaaugaaauaaauauuucuugugggcuaugaauacagcucagugguagugcacacaguuagcauagucaggugcuuuggugucuguaggauaacucaguggguaauggugcuugccaucaagccuaacaaguugugugugugugcccacaccuacacccauacacaaguacacacaaacauaaaaugugaaacauuuuguaaaggugauuugcuaugguuagguggcauucauccuugagaugcaaauuucuuucaauguccagacaucuauaaauguaucacauuaacagaauaaagugaaucacuuuaauagacacaguaaagggauuugaaaacaauuuaacauucauucuucccuaaacccucagcaaauuuuguauagaagcauggcaccucaguauauaaaaccaggacaacccauaguuaaaauaauacucaacagaaagacuaugaaaacuuauauuuuaauagcugcauuauaauagaaguuggaaccagagaaauuccuguauaaauggcaggaaucagaaaaaagaaauagaaagauaucacauguucauagauuggaaaaauacuguuaagauguccauucuacauauauuaaucuagagaaucaaugcaauccuaucaacauaucaaugacauucuuuagaaaaauaaaaaaaauucaaaaguccauguggaaauagaaagacccuaaauagccaacccauacuacaggacuucaaaguuguuuuuaaccaaagcagcauacuaccagcauauaaauagacagaccaaugggacagaccagggaaccuagaaauaaauucgcacauugauacccaacugauuuuccaaaaaguugccaagaauacccaauuaauagucuuuucaauaaaaaaguguugggaaaacagaauaucacacaauguaucugugaaugaccucauuucauaaucauauauagaagucaacugaaggguuggugaguuggcucaggggguaagagcacugacugcucauccaaagguccugaguucaaaucccagcaaccacaugguggcucacaaccacucguaaagagaucugacacccucuucuggugcgucugaagucagcuacagugcacuuauguauaauaauaaauaaaucuuaaaaaaaaagaaaucaacugaaaaugaauuaaagacuuaacuauaaguccaggaaugauaaagcuaccaacagaacaagauaugcuucaugucauucuucugggaaugauuuuuuuggauacguuccccagaguacaggcaaucaaaacaagaagacaaggggguggagagaugguucagcgguuaagagcacugacugcucuuccgaagguccugaguucaaaucccaacaaccacaugguggcucacaaccauccuuaaugagaucugaugccuucuucuggugugucugaagacagcuacaguguacuuacauauaauuaauaaauaaaucuuuaaaaaacaaaaaaccaagaagacagaauuauaccaaacuugaauggcauagccaagaaaacaguaaacagaaugaaggacauguaggaugggagaaacuauuuuuaaacuaugcaucuguuaagagguuuauguccaaaauauacaaagaacucaacccccaaagcuaggaagcaaauaaucugauuaaaacccagauaaagaaccuaaacaugagccaggcgugguggcacaugccuuugaucucagcacuuaggaagcagagacagguggaucucugaguucaaggccagccuggucuacagagugaguuccaggacagccagggcuacacagagaaacccugucucgaaaaaccaaaaaaaaaaaaaaaaaaaaaaaaaagaaaaaagaauucaaagcuagucuggaauacauagaaguucaaagccagccugaagcacaucagaucuugucuggggaaagaaaaaaugugauacauauacucaauggaacuuuauucaaccacaaagagaaauguaauuaugaacuuuucagguaagaggauggagcuggaaaauauaucaaaugaggugacccuggcucagaauaauaaauaaugcaugauuucucucaugcagguccuagguucugaguuuuauguaucuguuuaugugguaguaaguauauguagaggacaagaaguuggaaggaggccaugaaaggggggaaagcuuuaaggaagagguauaauagaagaaauguccuaagaaaguagauggggugaaugcugggaauaaaaaaaacuuuaagcagggagaugggggagaggagguucaaccaaaacuaagauuauuugaaaaacauccauaaggaaaccuguuauuucauaaauuaauugagagagagagagagagagggagagggaagggggaggggaaggagggggagagguagaaagagcccaagcaugguagugauggccuuuaaucucagccuuugggaggaagaggcaggcagaccucugugaguaugaagccagccuggucuauauagugaguuucaggacaaccagagcuauguagccagacucugucucaagacaaacaaaacaaacaaaacacaaaacaaaaccaaaaauaauaaaaagaauuugaauggagguacuuuauggaugcauaaagcugcucccagguaaaauaagccacagguaaaaauaaaaugaaacgucuaguugugauacuuuuuaaaguguaaauacaguuauguaagacuguuaaguacucagucacuagggcaguaguucucagccugugggucacaaucccuuugcguaucaagccacccuuucacagaaguugccuaagaccaucaaaaccacagauauuacauuaugauucauaccaguugcaaaauuacaguuaugaaguagcaaugauauaauuuuauggcuagggggucaccacaugaauaguguauuauagggucaaaccauuagcaagguugagaaugacugcucuagagauguguuuauaauguuguaucacagcauaauucuagcucaaccaacuuguuugaaaacuuacuaauuuuuuuauuuugcauacuggaaauguuuuacacacacacacacaaacacauacacacacacaauuuccagagauaacgcuuuaaugaauauacaugcauauaauuuuguaaauccuucugcauuucucuaaugaaaggaaacaucaagaauauguacugcauauaaagauuauauaauaauuacaaaugaaagugcaucaaacuaugcagcacuguuuuuccaaguucuacacgucccuguaaucagagcucaguacccaagagaggagauuguaaugggaauuagaauuaucugagucuacaaaugaugaaacuaaagcaugagaucuauguuuagggucuugcccuuaaaguuguacaaggcauggaguagaugccagcacaagcccccugucccaauaccuucucuuugaaagucauuuguuucauaucuccuaagcuaggaauuucagacuuugguucugauccauguucagguaguguguuugcuguauggucagauacuccauauuuucaguaauuuugucacuaauugaaacauaacgucaaaggaccaugaggugguuugaaucagaauggcccucagaggcucagagguuugaauacuuggucaccaaguaguuacacuauuugaaaggauuagguguggccuuguuagaggaagugugucacuguggaugggcuuuaaguuuucaaaagcccaugccaggccaagugucucuuccugcugccugcagaucuggauguagaauucccagcuacuucuccagcacaugucugucuaugugcuaccaugcucccugccaugaugauaauggacuaaaucucugaacuguaagccagccccaguaaauguuuuccuuuauaagagcugcuguggucauggugucucuucauaccagcagaacacugauuaagauagucagcuuuaauaaugagaauuucaaauaucuguaaagacuauaaagaauuccaguauauuuggaccuggaauguagugcucuuaaaaggucuuauuuuuagguggcaauauuaguggauauaagaaagauaaugugaaaacaugaaaaaaaugagaauguuugugauggcaggugaagcaauucauaaauuuaauagcucaaucagccuuguccuuucuuuuuugucuucucucucucucucucucucccucucucucucucucucucucugugugugugugugugugugugugugugugugugugugugugugugucaugggggaggugaguguugaagacugaaucccagggccuuuuauauaccaggcaaauauuuuaccaucaucaaauuaaaacugaagcccauuauuuaaauacuuaaauuuuggcauuaaaauuaaaaauauagaagaacuuuaauuuuccuuaucaaauuaaaaagaaauuaagugaugcucucauucaacauaaaaauuaucuauaguaugcuauuauacuaauaauuuuggaagaauuuuuaucuuaaaauuauugggagauuaaugauuuacuaaaaauuugagggacaguuaaauaacuugguuggugcugcaaagccuguugaccugaguucaauuccugugugacucuacaguugugcccugaacuccacacauguguuaagguauagcccccacccccaauaaaggucauaaaauaaaaguaaaaagcuuuuauaauaaccaauuaaccuugauuuuauagucagaauggugagucaaaucuagaagggaaagaaauuuugagauaguaaggcgaaguuuugugaauucugguugcuauuaaacuaaaaaugccgaccuuuccuuagcuauaaacauccuguauuuguugacaguugcaucucaauauggcugaucagguaaaggguguguggcaccaaagaacuccauacagaaggccaacacuggugaaacaagcaaugcugucagaagacuaaucugucucucuguacucuuguuucccauguauccauuuucacauucuggcugcuaggcauccuccagaagggauaguacuugucagaacaaaaauaaagaugccucuuuagcuaauuaaccauaucuuucuuaagcuccacucucuccuccuuuugauucucaggcaucauuuauauuagaacuucauaguuuguuuuagaaaauguucucuauuaucuucuagugagaacauuuaaaaaguuugccucagccagguagugguagcacaugccuuugaucccaacacuugggaggcagaggcagguagaucucuaaguucaagaucagcuuggucuacagagcaaggucuaggacagccagagcuacauagauaaaccaaccccaaaacaaacaaacaaacaaacaccaaaagaaaaaagaaaaaaguuugucucuuuucuauauguuuucacuaaaucauaagccagugauaaauccagccagaucugaggagcaacuggugagaauggcccuaaacuaaguguagaugucucugacaccuuuacaauuaaaguuuaauccucccauccuguuaacacccaaagaggaaauguugguggacaaaaccaccaacucacaaagccagaaaaagaaaaccaaaaagacuggaaccagcucaagguuuaaagcuucugagaacuuggagaacugagaauuuggggaaugacaacauguaguuuuguuuuuguuugcuugcuugcuugcuugcuuuuuccuucuuccuuuaaaaaaauaaaauuuacaggucacuaguuugcucugggaauccugccaccuuguaagguuggaauuacaggccaguggccacacccacucaguacugacucagguucugaggguccaaacuccaguucucacacuugcaugguaaaugcuuuaacugcugagcggucucaccaucucuaauuuauuuuaaauaauaggaaaaguuauaauuuugacagucucuauuaaauuuacucaagagaaagggaaucauacagaccuaugaaugcaaaaucugcuucuguucuucugaagaaaacaauauauaguagccauuacaaaaagguacuuuccccugggauaucaggguauauacaauagcuaaccagguggcuuagcagccaggcauggaggcaaacccuuuaauuccagcacucaggaggcagaggcaggaggaucuugauaaauucgaggccggucuggucuauaaauagaauuccagggcaggaugagcucauagagaaaauggcucagcacacacugaaauguuagcacaaaucuguaauuccagcacucagggaaugcagaagaguugcuauaaguuugagacagccggugucacguggcaaguucaagccagccaauacuacuuauuaaccaaaagaaaccaacaaagcaguagagaugauaauaaaggaucaucuagaaaaacaguuauuccuugccauuaggacuaucaauagaacaaaugcugcucaugaaaauuagcauuaggguuuuuuuuguuuguuuuguuuuguuuuaucuuugugaucugcccagcauauugucugguucccaugguuaauaaacacuugcuaaauugcuacugugauauaaguacccugagucuuucucaaauaagguccauucaagcaugggugaaacacaaauguucaccauguuuuagucuauguucugaauauuucauauaugcauagauaguauuucuuuaaauacaucaggagagucagacacacaaaaauacauaaauaguaccuggauuugagacuaggaagcauagcuacaagaggaauaaacuauacuaacaggaguacuagcucagguaaauuagggaaaaaaccccagccaaccagagguuacucacuauauuaaacaagaguugaauauguauuugauccaagaaccaagaaugcuugcacagaguggcaugauugauucccucauauaauuuggguaguggauacuagagcaguggauuucagaagaucaucaaucucccggaugcuauaaggagacugcagagagccagagugagagaaacaaugaggagggaaguggagaagagguagaaggaggaaacagacagaggaaaacaaaguuagggacaaaaccuggcaaguggggugggguaaguaacagauggagucaagacggucaagcucagaaguugacuuguuugugguggcaauaaacuuggaauuuuaauauuucucccuaacucuaaaaucugacaaguaguaaugaucaugguuugaaaaaacugucugcuauggggugugaaaugugcuccccugggccaauucauaugcugaacucuuaacuccccggugauaguuuaagaaguaaggccuuugagaggugauuagaucaagaggggagaucccuuauuaauacaguaaaugcccugagauaaaggaggaccaagcaagcuuauuuugcuucuucaucgugugaggacaaagagaggaggugaaccaccuaagaaggagggcccuuacccaacacuggaucuacuaggacuuugguuuuugacuuuccauccuccagacaaaaaaauugcccagugaauggaaauguuauagccaccugaguggacuaauauacuuuugaauaaaucuucucuaacaaaaauauuagaagugggggcuagagagauggcucagugguuaagagcacuggcuguucuuccggaggaccuggguucaaaucccaguacucagauggcagcucacaacuguaaauccaagaccugaacccccauauagaccuacaugcaggcaaaacaccaaugcacauaaaauacaauaauuuuuaaaaauauuagaagugauauaugaaauuugguuuaacuuaauuaaguuuuuguuagccugagucucuauaauggaggcaaucaaggaaaaauggccuugguuaggugacuuuuuuuuucuuuucuuuuucauuaacugaagagacuugccaacucucuuguucaaccacuacagagagauucaaagaaagucuucucuuuuuaucuauuauguauugucuuagucaggguuucuauuccugcacaaacaucaugaccaagaagcaaguuggggaggaaaggauuuauucggcuuacacuuccaugcugcuguucaucaccaaaggaagucaggacuggaacucaagcaggucagggagcaggagcugaugcagaggccauggagggauguucuuuacuggcuuaccucaccuggcuugcucagccugcucucuuauagaacccaagacuaccagcccagagauggucccacccacaaggggccuucccccuugaucacuaauugagaaaaugccuuacaguuggaucucauggaggcauuuccucaacugaagcuccuuucucugugauaacuccagcugugucaaguugacacaaaacuaaccaguacauguauuuaucuuuauuuuauguacauugauguuuugcuugcauacacgucuguguguggguauuggaucuccuagaacuggaguaccagacaguugugaauugcuaugugguuucugggaauuaaaccugggugcucugagggaguagccaguggucuuaacugcugacccauuuucuuuucuuucuuucuuccuuucuuucuuucuuucuuucuuucuuucuuucuuucuuucuuucuuucuuucuuucuuuucuucuucuucuucuucuucuucuucuucuucuucuucuucuucuucuucuucuucuucuucuucuucuucuucuccuucuuccuccuucuuccuccuucuuccuccuucuuccuccuucuuccuccuccuccuccuucuucuucuucuccuccuccuccuuccuccuuccuucuccuuccuucuccuuuguuccuucuccuuccuuccuuccuccuuccucccuccucccuccucucuccuucuccuucuucuucugacccauaagcuucuuguauauuagugauuccccaagacucauacacuggaacuucagagaacaaaggguaggaagugcuagugugggauggucaggagggcuauugagcagaucuagugacccuaaacauugucaugugcgaaaacaggaaguuacaaguuacauuuucaagauuuaaaauuucuuguuuguacuuucccuggagguuuuuuguuguuguuguuuguuuuguuuuuuuuuuaaaguuuuuagagauaagguuucuaucucaggucuggcuguccuuguacuuacuauguagaguagguugaccucaaauucacagaaauuugccugccuaugccucccaagugcugggauuaaagaaggugugcgccccaucccccacccccgccuaggaguccauuauguuuuaacaacacauuuuguguaaaaaaaaaaguuucauugcacuaagaaugggacaaauaaauuuuguuauuuacuaauacguaucagaaacagcacuguauguauccaauaaauaucuacugaaugucugcuaugugcugggagcuaugucacuugcuggugaggugauagauaaugaauggaagcagaaaucauuuuggccuucuuguuaacuaaaagcucuuuggaagaaagacacugacaaagaaauuggcaugugauauguuauaaaacagaaguccaggguacuguggguauuaguggcuagaaaaguuagagaaaugggaacaggugcucuggccauuagaauagugaacagcuaaagacauaaaugagaaaauugaaaagaaaucaaaagccaacauaaaagcugggagggccaagaaugagucauaacagacagugguccaugaaaccaaaaucugauuugcuugacuagguugaacaguuaaggguuuuauuuuucuuucugggccuuuugucuagagaagagggacauucugaaggaguuggucugaauccauuuccuuauuaucuuuacagauuaauuuugugacacaugagcuagcacgauggcucauuggcuaaaagugcuuguuaugcaagcaugacaaggaguuccauccccagaacccaugguagaagaagagaacugacuccugcacucauacaacaaguacaaauagaaacuguuaaguacaauaagccuagaaaaugugacaagucugguuuguugucccccaaauugcucuuagucuucugggagaaacaguauauaaacauaaaauuaaagaagccuacuagacuauaaaggacuaacugcacauuaaugaagacagaggaaguuguuggcaggaaugauaagagauaggauaaucuuauacaacuacuaaauugacaaucuaaggacuauugggcaugcuccuauaguccuggcacucaggaggccgaggaggaagaaucacaaacaagucagacuagucaacauaguugaauaacaagacagccaggacuauguaaugagguccacucuaaaaaaaaaaaaaaaaaaaaaagauuugggucuaaaacuaagucaggauuucucaacuccaacauuauugauauauaaggguugaucguugcugugggagucuguuuugugggauguuuaucauacuuagccucuaucuacuagaacauuucucccaucuaugacaaagaaagaugucuugccggaauuaccaaaugucccauggaagacaaaaaugaucucucaguugauuaucccugcuuagauacugccauguuugucaaguuuggcaagcauguuuggcuugggugaugguagagggcaguguagcaauauaggggauaguuaagggucaauagcuaaucuauaguuaugagaaaauaaacugacagcaagauuauauguucugguauccagaaagagguuuucagaggucaggacaaaacuuuccuuuuagacugaagaaucaaaguauuuuugcccuuaagaauaaaaucuggcacacaccuuuaaucccagcacuugggaggcagaggcaggcgaauuucugaguucgaggccagccuggucuacagaguuccaggacagccagggcuauacagagaaacucugucucgagaaaaaaaaaaaaaagaauaaaauccagugauuaagacaagucagcuauuuugggggucaaucuccauacuaagacuccaaggaaauauuuuuaauaucuucccaauaaguaucaguugcggaucugagguacaacugugucaccauacagaggauaucaugucauucacuacacagaugaaucaucgaugagcuggcagggagaaacauguguagaauuuuguuuccuuugcuuuggguuuauuaguauugugggauuugucuagguuaucucuuauguucuuuccaacuccugaauucuaugagaugggaaagacacuuuaaugauauuauauaccaccuauguguuuacuucaggcacuuucauguauuauucuacuugcacaucucauugagaaaguauaauccucacaguacaguuaagguuuaaaaagguuuaauaacuugcucaagguuacauggcuacaaagaagccaacauuaaaacccauauuugucugacccccaaauccuugaauuuucuguacucacacacagaaggguucauaguaaauacuguaagaauuauuauaaucucaauuguaaaaauaguacaguguuuaauuaugguauuauguuuuagggaggugcuaauaaaagcaagggacauaaaauugaaaaaauauuuuuuuaaagaacuguguaaaauacagccaauauaacuagcaaaucuacaggauaauggcaauucuuugugggugugcaugcuugucagugagcuccagugaaccucugucuucaccuccucagcacuggaauuacucguuugcacugcuacacuuggcuaguucacauguaugcuggggacagaacucauguccuccugcauguaaccagcuggccuaucuccccagccuuauaacagugauucuucaauaaucaaugucaagagcugugaauugaugcuaugaguauaucacgggaguucacaagaaagcuaacaagugacagcucuggacuucaauuucauuuaggauucuagauucaguccaaugaacugcauuaagagaaauuaaaaauuaaaauaugagaaaagaugcguggauaaugugcuaugugaacuuuuuuuuuuuuuugguuuuucgagacaggguuucucuguguaguccuagcuguccuggaacuugcucuguagaccaggcuggccucgaacucaguaauccgccugccucugccucccaagcuaugugaacuuguuagaggcgacauauaugacucugaggccuuuucuaacaguagcaacauugguaauaugauuguauugugacagcacugguagcaacuacagccauaggcuuggagcuuuucuaauuacagcagaaauuagaguuguugugagcauuaaagacauuuccaaauaguuggaccuacagcuugauccuuuagacuuuuccguggguugucaguugucauuaaauccuuuuuuuuuucuuuuuuuuuuuugguuuuugguuuugguuuuucgacacaggguuucucuguauagcccuggcuguccuggaacucacucuguagacccggcuggccucgaacucagaaauucgccugccucugccucccaaaggcugggauuaaaggcgugcgccaccacgcccggcuuuuuuuuucuuauuuuugccuaaacuauccuugauauucuuuuaugcaacugaaccuuuaaauacaguaacaaaaguuguaggugggcacagugacucacaccuuuaauccuagcguuugggaagcugaagcaggaagaccacaaucaauucaaggccagcuaagacuacacagugaguuuucugcuaucccugguuacaguuugagacccuguuccucccaacccucaaaucaaaaccaaacaaaggugugcauauuaguuuggguuugguuaaccagaaucaacuugggaaggaaagaguuuauuucauuuacauguccugaucacaguccaucauuaagggacuugagggcaggaaaucaagcaggaacagaggaagaaagcuacauauuagcuugcuugcuuccuugcucuccuucagcuaucuuucacauauaaccuaggccucucuacccagggaugacaccaugcacaguguaagggaacagcuaucacuaauuuuagucuugggaaacucagagauagagagaggccuuguuguguagaauguacuauguaccucugagaaaagauccugcauaucaaggauaucuaaaguaucacacauaaaucuuucucucacuuuucccuaaaaaggacguaaaaguaaauaugcaugggcacagggguagggauauaucacauccuuaaagggauuauuagacagcaguguuaaucccuggugacccagaaugcuauacucacaagacucacugguuuuacugcacacuauaucccuguacugucuuguuuuaugugucaacuugacacagcuggaguuaucauagagaaaggagccucccuugaggaaaugccuccaugagauccagcuguaaggcauuuucucaauuagugauaaagugugggagggcccacuguggguggugccaucccugggcugguaguccuggguucuauaagaaagcaagcugagcaagccagaggaagcaauccaguaaggaacauuccuccaaagccucugcaucagcuccugcuuccaaguuccugcucugugugaguuccuauccugacuuccuuugaugaugaacagcaauguggaaguguaagcugaauaaacccuuuccuccccagcuuacuucuuggucaugauguuuuguucaggaaagaaauccugacuaagacaaucccauauccuguuuuuguacagacuuuaagaauauuuuuaugcugagagaugguggcucaugccuuuagucccagcacucaggaggcagaggcaggugaaucucugaguucaaggccaccccuaucuacagaaugaguuccaagauagccagaacuacauagauaaacucuugucuugaaaaacaaaacaaagagaauauucuuacaccuuaaaagggcuauaaacaaaaucaaagacuauggccucaaacucacagagauauguuauacagccuuaacauuuuucucauucuagacuguaaucuguguccuacagcauuauccuuagggagccagcaacaaacaucaagugcugucucucucuucuguuaugccugauaauccaacucauaaauuguguugcuuucuaguccuacaacuuugauaauuuuguuuuguuuugucuagagaucuuaguauccauggaaguaauaauauuuuccccagaaaucccaagaauagccuaacuuucauuuaacuggaaauuuaugcuauaguuuauuuuagugggcuuuguuuuuguuuuuuucuuuuuugagacagagucucucuacauagcccuuguugucguagaacuauguaaacuacgccugacucugccuccugagugcugggauuaaggaaugcaccaggcccuauuuugggcuuuucaugcuacuggaacaaugcaaggacacagaguuccauuuagccuugagaucaggggaaauaugguugcuacugcauaacaagaaacaaugaacaaugguuugaaagggacauguccauucauuguguugccauguauagugauaagugguacaagaagucacacaaguagaaacauuaagaacucaaaaguuuuaagacugaggguuaucaauucaugugaaaacucaaaucagcagaaugaacacugaagguaacaaaacauaguaaacagguauagaaauaaggauggaguaacuaccuccuuuuauuuagcacucaucuauacauguuaauuauucucauuuuuuguccuaguauauauaaggcuuauuccuaauuuuuaaaauggcuuuguucuuuuuuuuuuguagaugguucaucauuuuuauuuauuuauuuauuauauguaaguacacuguagcucagaucuuguuauggaugguugugagccaccaugugguugcugggauuugaacuccagaccuucggaagagcagucgggugcucuuacccacugagccaucucaccagccccagcuuuguucuuuuaaaauugauuuuaaucauuauuccacauucagaguuuagggggacucuuugugaagguaacuuuugagacuuuucuuuuuuuuuuuuuuuuuuuuuuuuuugguuuuucaagacaggguuucucugucuguguagcccuagcaguccuggaacucacucuguagaccagacuggucucgaacucagaaaucugccugccucugccucccaagugcugggauuaaagaugugugccaccacaauccggcuugagacuucugucagucuaaauuuacuucauaauaaagugauuguguauguuuacauguguauauuuauguauacaggcauguauguguggguauauauuucauaauaguuuuuguggaguuuuuuguuuuauuuuuugagagugucuugcuauguaguuuggccaguaggaaacucacuauguagaccaggcuggccucaaacucagagauaugucugugucugcgucccaaaugcuuggauuaaagauguguaccaucacacccaguuuuuuuuuuuuuuuuuuuuuuuuugagacaggguuucucuguguagcccuggcuguccuagaacucacucuguagaccagguuggccuugaacucagaaaucugccugccucuacacacacaguuucauacaguguuaggaacugaacccagggcuucaugaacuugaggcacuuuaccaacugagccacacccucaacccucuauuauuccuuuggaguacauuuucaaaacauguuacugaaacuuauucuuccaguuuuguuaauuuacaugcuguuuagccuuucuuucuuuucuuuucuuucuuucuuucuuucucucucucucucucucucucucucucucucucucucucucucucucuuucuuucuuucuuucuuucuuucuuucuuucuggcaguacuguguauucaauuuaggauguuauguaugugaagcaaaugcuuuuaacucugagcuauagcucugucccagagcaaagaucuaguuuuuguuguuguugcugcuuugagaacuaguucagaaugcccuuaaaacuauaaauccauucauuacuuuaaccuuguugaaaguaucuucuuauauuuuuuuuaaaagaaaaauucagauacuucuaaaauuuggaaguuauuucaaaccaaaaauaaaaaguuuaccucuuuauaucuaugaagaaaauguuuaagaugaauaauccuaggaaaaacaauuagaauggaagcagcuuauucuaucuuagagaacaaauauauuuuuaaaaagugaagaauugaagaagccaacauggaggcagauggacaggaagaagauccuuaucucaugugguuuuaacagccacaaguagcuaagauuuucacaagguuagaacaauugggguaaagcuuuuaucauuaucaacuggcucugaaauuauuguauuggcaucuuguaaauugugauauuauuguuauauagauccaauuggauaauuuaaauaagugaaugauuaauuucuagcaggauaaacgcuaguccaaugcauagucacuaugcauucacugggagaagaguaauugauggguguacuggccuuguucccaggcagaugggacucaagagucucagguuugcuacucauuaccuuugugaaacuggaaaagcaaguucaacucucccaggcugugggagaugucuccuaaaauggcugacaaucaucugcgccuccuuggacuuaugcccuuguguaauacucacacaccuugaauaggaacaggauccaugugacuuguuuuaaaugguaaaacacagcaaaaauucagggguaucaauucuaauacaacuagauuauaguagauggacuucagacugggagauguagcucaauaguguaggauuuaccuagcaugcacaaggcuugucucagcaacaaaaagacuuguaacagcaacaaaaagacugacuuuaguguuccuggcacuuucacuaauucaucuuaauagagccagcuuaaguaugcugugaucugcccugcagaaguccauguaucaaagaacuucaaacagacugagacaaaccacauccugcugacacaaauaagcuuggaagugcauuuuucucuaguggagucuccaaaugacuacaguccuggccaccacuugcacuaccagcucgugagagauucugaaucaggguuugaagcuaggcuguaucugauuccugacacguuaaaaauggacuuaaggcauacugcuguggccagagauguagcucaguggcagagugcuugucaaguauggacaaggcccuugguucaauauuuuaguacauaaauauauaaauauaaaaguugaugucuaaaagcuaguaaguuuugaguucuuuuaauacaucaaauuuaguuuccuaaucuuuaaaacaggauuaauagucuacuucacauguguauuaaauaagauuacauaaagcaacuggcaccuaguauauuauugaaaagaaaaauguuacuaugaauucaaaucuacucuugcagguuacauugcguuauaacacuguugguauaaaaauacugucuuuagauaagguuauagcauuuuccauggugauuuuaagcauuacaaucacuugccuuugcauagauuagaauaucacuuuguuuugagauggugagauggggucucauuagcuggagcuaguauugaacucaugucccuaccuuuaccucucaagugcuauaauuauagguguuuucucuauuaauauuaauaauguagcacauuauuauuauuaugccuggccaauuauuauuucccuuuaagagauaaagaaacuuagggucagaagacuuaagcgacuuguucaugguuuucuacaguuagaaaguuauuagaccuaaucucuuuucaucacuacuauguaacauuuaauuaaaacuaaauguuaaacuauuaaguaucagguguuauuuuaggcuuagaacacaaagauaaacucaaagauuuuguuuuuuugaaguuuauauuuccuuuuacauaccauaauaaauuggaaaagacaauuuaggcuuuuauuaagaaauagucaagcuuguguuucaaaauuuugacuuggaaaugcaauguuuaucauuagcuuugccaugaccgcucuaagguuauauaauuaauuagcaguuauauaacauauggcaguggcuugcuuuauuucacugacuaaauuccugauagagcuucauauauacacugaacaauuauuuguugguugugauaacauaauuugaguucucaacuucagaucuuuuacuucauaagcuuuauucaucucuuggcauauaguuuagcugauaaaagugucuuuucucuugaguauaaaaacaaucaaaaguacaacagauacagcuuauuuaguaguauugcagauaguguuagacugaugagaaauccaagaacaauaugaaaaugucuuaacucagcuuacugaguaaaugugagaagucacuaaacucagaauuuguaaacuacucauagaucaaagcaaaauacuguacuugucugaauacucuaaguuuuagaauaaauauaauuaccuguuggaacccacucucccaacacacacacacacacacacacacacacacacacaauuuucugaaagauuguuuaauuccugaugacaacugucugaucaaacuaugguguuuuuauagaucacauguguacauuuaaaugaucugcaauucacaagugaguugcuguuagguagaaguacucaguuguguccuuaaaacagggguuucauugagaaaagaaauggugaauuagaguugcugaaugaaacugguaaguuucuucaagcacucccagagagcauuugcguuuuuugaaaaugcuacagcacuuccuuucaguaaccuaucuagugucuuuucauuaucaucuggaauaguuaaaacuaacauuggccuuuuaaagauuccuguaaaaaauauuuccuaaguguuaaacaaugaauucuuacacagacaggauuugguucuauagcuuaugaagagugaauaaccuaacacauaugaagugcucuggguaagaauggacuaaauuuuaaacacuguuucagguagcaaagaaaagccuugggcuaaaguccuauuguucaaguuuauuuuuauucuauuuuuuuuuuauucagaucacuauucuccuuuacauacuuugggcagggaggaaaggauauuucuuuauauaagucuuaaaaaucaugauucaaggagaauagaauuuaaaaacuaagcuuaaaaauuccaacaaugacaucuccccaacaggauuuccuggaugagaggaacaguaggggagaggcauagcagcgaagacccagcagcugugcaguugaaggguccuagcuaaggaccuucaugugauaaucaucccuuucacuugauaaaaacaaaagcaaauguacuggugaguuuuauguuaacuugacacagcuagagucaucugcaaggagacagucucaguugagaaaauggcuggcuguauggcauuuucuuaaauagggaucagcaggagagcccaguucauuguggguggugccaccucuggguucuauaaaaaagcaggcugagcaagccaguaagcaguauuccuccauggccucugcaucagucccugccuccagguuccugcccuguuuugaauuucugaccugacuuccuuuaaugaugaacagugccuuuuggucaugcgguuucaucacagcaauagaaaucccaacuaagacagcaaauuuggggauuuuuauagauuaaaggccuggcuaguauacucuauuucucuaagauaaaacagguaauuguucaaguuacacaaagagccugguauaaaaggugcuauauaguaugaaaagcccaaaguauagucccuacucuuugaaaaaauggagucuuaagacaggaacaguggcugggcagugguggcgcaugccuuuaaucccagcacuugggaggcagaggcaggcagauuucugaguuugaggccagccuggucuacagagugaguuccaggacagccagggcuacacagagaaacccugucuccaaaaaccaaaaaccaaaaaccaaaaaccaaaaacuaaaaaccaaaaaccaaaaaccaaaauccaaaaaaaaaaaaaaggacaggaaugguguuuaccugcacucuuaguacuugggagguagaaguaagacagaguccuaggcuagcuugggcuucaaggagaauuuugugcuauccuggguuacagaguuccuaucuuaaagacaugaaaacagaagacugagucucuuuuaacuacuauauacauuucucaacauggucuuuaaagugaaagaucucagaaaucuuucaaaauacagcuagcauauaaacucaguuuuccaagaauaucuuguauggguacuaagcuuauauuaauggcuccuuuaggaagcuuauuuaaagcuuuugacagaaagcaacuuuuaagguagagaacuacucaaacuacuucugccuguuacuuccucuacaaaucaugacuuacuaagguguuuuuguuuuuaaaguuucaucaucuuacuaaccuccagcaaaugaaagaaaauugaacagguccuaaucucuaauuucaguuauauagccaauucaggacuaaccuagccuaagcuuaaaaaaaaaaaaaaauccaugaauuaccaaguugguccacugagagaaaagccauuugaugauacugaccaccaccacauguccugacugagcuccccaucuauacaauagaaaagacaacuggaccuaacuccucacacuucagccuuuccuuaaauguuucccaaaagucaaaacaugucucccucgcuccaaaacacuucauucuuuacagucaguauccaugaaaggcaauuuguuaauuuucauuugacugauaugaagugguaaaagaguaauugaaaaagguuggcuucuaaggaaaaaaacauuuuauuuuuaaagauuaaaaaaaauguguuugaguguuuugcuugcaaguauguaaguguacuacauaugugccugguacacucagagauccaaagaguuggauccccuggaacuagaguuucaaauugugaguuguaauaugggugcugacaaccaaacugggucuucagcaggaacaacaaauguucugaacaucugaaccauaucuccacaaauaucccaaauuuaaauuucaaauaacugagucccuaaugaaauggaaauuaaggguucuuuggaaagucguuucgaugguguuuugguggggcaaacaugggagggaacuuuuuguuaaaguggacacaggugugaaagauuaaagcagacucgugaagaaacauuuugcugaaguagacacaggagaaaggauguuuuguuaaagcaaacacaugaaaggauacaugauaaaggauucuuugcuaaugacaugcacauauugguuggcuuuaccuugcauaguugagcugcauuuguugagacucuguagacagaaacucgacaaaacacuucuaguggugugcugcaguuucuugcugcuucuauggauucaggcagggugaugucagcugagacagacacaugugcugaggcaagacucaugggagacaaguaauguuuggaggguauaaacaggacucuccgaacagugcaggaggcagagcuuggcuugcuuauagagcuagccgugcaacuguggguuccaugucuucacugaucuuucccuuuacugagagaggcacagcugagaacuucuccugguguuccugcuggucccuccuguugaaucaagccgaggcugaggccuggcugucucugcuaggucaugucaccacuguugcuaacccaacucuaccaaacugaacuguugguguauccaugagguguuugcaaguagaucaaguugcugccgccugcuaaccugugaaaugaauugcugauuuccagacaacacagacaggaguugcuccaaaaaaccuuucuaaacugguccacuucccccauauccuuucuuucccacuaccucuggugaguggugggcuaaagggaaauuaagcauuuaagaacaaucauuaaaaauagguuugaaaaaaauuaaaauuauacccuaauccuuauuugaauuuaaaauuugaucuuaucugguaagaauuuuagagcucacuucaguucaaucccuuucauuuaaaaaauuaacuaaagccuagagagggaugaacuuuaagacaguuaauuaguuacagaacauaagucucuugauacuuacuccagaauucuuuccauugugcuaauuaacaguagucaguuauaguaacuuaaaaugaaacaugaagcaguuccacaaauacauuuccaaagcugagagaccauuuuauaaguuauagguaaauuacauuuuagggaauaaaacaaucuuaaggcaauagggaauuucccuaaauaaaugcugccuuugaagcucuugaaauacagguucauuuuuaauacuguuuaaggaaggcuucaaaaaacuacucucucaugaauuauauuuuaccuuuuaacuagaaaauucaauccacuuuucuaucauuagaaaucuggcagccaagagaugguggugcacgccuuuaaucccagcacuugagaggcagaggcaggcggauuucugaguuggaggccagcuuggucuacagagugaguuucaggacagccagggcuacacagagaaacccugucuugaaaaaaccaaaaacccaaaacccaaaaaccaagcgggggguggggguagagggagagagggagagagggagagagggagagagggagagagggagagggagagggagagggagagggagagggagagggagagggagagggagaauaugaauaugaguaagaaccuggcugggugguaguggcacgugccuuuugaaccuggcugggugguaguggcacaugccuuuugccaggguuggaguguggcggggguggugagacagguuuuuuucuguauagaucuggcuguucugaaacuuguucuguagaccaagcuggcugacacaugccuuuaaucucagcacuugggagacagaggcaggcaaaucugaguuugaggcuaccuuguaacagagcuaguuccaggacagccaggacuauagagaaacaggucuuaaaaaaagaagagcaggaggaggaagaggaagaggaagaggaggaggaagaagaaacagacuuugacuaccacuguauuuaugugcagaugcauaucaagacuaaaaaggcacaauccucauuaagaaaucuaagcaauuugaacuauuugaaauacagagauuaaagauaagaaaguccuuugggguucaacacaucaaagugggcacugcuuuauagauacgcaggccagguagcugucauugcuggugccuugaaaauaucauuuaucccucaaguagcuauuuuauuaagugaaguuauuuauuucuccuuuuaacauuucuugugugugugugugugugugcaggagagugugcucauguguaagauauaucagauaguagcuuccuuccugcuggagagaaagguucccauacuauucuuaaaaaugcugccuggcacaauaaccacaggguuuguaaacagugaagaaagggagacaggcagaauggcuaacuuuggguuuuacagaacagccagccaauugugaaggacaaguguuuaaauacagaagaaaagaauuuucucuuuggggguccaguuguaacuaacagauuagaacgauuuagaagugugguauggaguuagucuauuuuucagcaggcaucagacccaccuuuacaugcuaaaguucauuuuccccaguuaccuacuucauaauagaauaggccagauagguuucagaacacuugaguuggugucaaguugggcaagaggucuaauagcaggaaacagggucccaguuaauaugacuggauaaauagaacaaaguggacggcuaaaaaugcgguuuaggaaaagauagggaaguaauacauuugaagagugagacauccuggagagagauuuaaucacauaagaaucuuuuaguugucagaguucaguacaagacagaugcagaaaugcuucucaaacugaggcauguuuaauaccagggcuugcacauaaaauguauugcauguauaggaaacuaugaugcauuuuugaauauuuaacuuuauauuaaagaaauuuguauuuuuuuuucagaaaaauaaaguuauaaaguagauaauccacuuuggaugaauuuagaagaaaacacggauuucaaagaauauuuggauuuuaggagcuacuguuguacugaacuuauaaagucacugucuucuuuucuuugaaaagucugcagggcagugacagagaaaaguaccgucuuugagaaagacuaaacuuugcuacucaguguguuaccucacucaagcccaagucuuccaguauuauuauaaacauaaucauaacacguuagccgggcagugguggcacacgccuuuaaauccagaggcaggcgaauuucuaaguucaaggccagccuggucuacagagugaguuccaggacagccagggcuauauagagaaacucugucucgagaaaaaagaaaaaaaaaaaaaaaaaaaaaaaaagaaaaguaggagucaccagagacuaugugaaugacugaggcuuuugggaucugaaagcaugaaacugauauuuuuaugggauggaaagacauuucauagaacuagauguuuguagggcaaggauggauaggaaaaagguagggagcauauccuaagugcuacacuaaguaaggaacuagacuuuuguuuuauagacugucauuuccuaguuguaacuauggaacccuuugaaauuuacaauguaagaaauaauagcaauaacauguuugaauuuuugacucauuuucuuaaaaucucaauaccagagauaaacccaucuuuuauuuucaucuuacauuaacaauaagacaugcaaaccccuucaauuucgaugagaauaguguuucuacgucuuuuuaccacacacauauuaggugugauguugcuaagucagauccgcauuuaagccgcagcaucaagucuuuuccuguacuuguuuuuguugcagcauaauauguaaacccaugucacauaggugcacugcuguaaaaggaagaaguaugugaucagcacaucuuacaguguuuggauauucuugaauuaggcuacuccaaaggugucaguucacugaaauguugcuucacuugggauucagauguuaaaucaaucaggcuuucgugguucugagcuacuaauuaggcugguuuaacaguuaccauaaauggauuucuaacucaagcauuaucaucacuugucacagaaaauauuuuaaaagagcagaacauaaaccccuuagaugcugcaugauagcaccacagauaacuuuauuaacuguauuaaagacauuuaucaaaauuugaguauagaaguaagguggcuuucucaaaguaaguuucuuauaagacuuugagcuuuggcucucuacucagaagaagagcugagcgcugagcagccauuuccucacauaaaauuuuuaguaacugggauugaugugauccagcuuuaauguaacugauaauguguacugcuugaucuagcacauuuucuacagauggaggcauuauuuuaacugcuaaugcaugccgauauaauaagcagugacuacugauucuuccuggagcuacauguucuaaggugacagccucagcuauuuucccauccacuacccuagaagcagcacugcaaacaucaacacauuucuucuguucaauuucaugucucugcauaaaauuguugauacaguugaauauuucuucaccaguuguaaagauccacauaagaguagguccuccuugauagauuuuuuaaaucuauagugaauaaacacaagcagcacagcaaguccugaaacaucagcugauucaucuaguugcagugaaaacccaucacaaaauuucagucuacaaacaaguucuucuucaauaucagcagccagaucuuuaauucgauggaccacaguacuguucaagaguuguacugcaucucucuuuuuacuauucaucaaccaucacuguuuauucaucaucuuuuuacacuguucaucaaccaucugcaucacugcaucuuuugcacaagguuuaauaaguaauucuucaacaguaugagcuucucuacucagggcuagguuguagcuuacacuguacgaugcuucuguaacacuuucagucucuguauugacaaucuuaggugcuggagguuuuguuuucagguaaaucaagcuguugcuugaaaaagcuuaugucuuuguccuuauacucaacauguuuaguuucuaaaugucuuccaagcugauagggacuaaagagcuaggggauaaaguuuucuuauauaguacacacuaagcaugagguucaucuagauuuccagaguaaauaaaugcaaaggacaaauaacuuucaucauauuuucuucuuauuuauuuaguuuuuuauuuauuuuuacaaaauguugcuauuuuauuggaauuggacauaaauuugacccuagaaagcucacguucugguuuuucagaaacugaagauugcagugguucaucuuuacuuuguacuguaccaaccuuuugacauucugauugagauacugguuggcaacaaacaagucuacuucuuauuuaagauuuccuuguuuuagcaaaggauccaaggguaaucaguuuguggcacaaaacaugguuaauuuagauuuaacacagaguaucacaaauguuuugaaauuguaggacaagaaacaaagaugagagagauauacagaagcacacauguuaauuuguaaugcuaccuacacauccucaugaagauggacaucacuuguucuuuuaucaggugaucucucaugcaacuuccuggugcucugguaugcacaucuuucuuuuuuuuuuuuuuuuuuuuuugguuuuugagacaggguuucucuguauagcccuggcuguccuggaacucacucuguagaccaggcuggccucgaacucagaaauccgccugccucugccucccgagugcugagauuaaaggcgugcgccaccaugcccggcugcacaucuuucuuaaagguagauuaucacauaaaaauaaaaacuauagaaauguguuuaguauucuuaaacuuacauucaaaucaucuuauacuaaaacuauaaagaaaaacuauuauugcuaguaucaauuuuuuuucucaaaacacucaagagaauauaacauuauucaaaauuaucugggaauuaguaggguaagaaauaaugaguuuguauguacacuuuuaaggaagggaucuuuagaaacaucuuuaggaacccuuccauggcaaagguugguaaauauuuaagaccauacaguaagaaugcuugcuuuguugguuauacagauucuguugcaacuauucaacucuguaguuauagcauaacaacagaugaaagaauggguggguguuccaauaaaacuuuuauguaccaaaacagacuuuguaggcuuaauuuaccaaccuaaucucauagugcauaauauuuuugaaucuuuuaucuuucugauaacuauugccauuagaugcacucaauguugcacucaauguugauaguauuauauaccagaacucucccuucagaguugcaagaauucuaauaagcuguauuaaaaauacacauuguuccaagacagagaacucuaguguauucuaagcauuauguguuaacaaucaaaaguaaacuauagaccaaaaaguagauacuacuucuccaguuuaaaauauaaacuuauauuaucuuaauuaagauauauuuaaaauaaugcauacuguuaugaguuauucugccuacuguugugccaaaggucagaaucuuaagaaaauauaaacucacuuuaauagauuuuccucucauguaacacaggguaauacaaacuuaagaccgucuagugaauauucccugagauuuaaauuaaauuuguaaaggaauacagauuguuccuguugauuuaaaugccaugugcuuaaggauuaagcucuauccuaucguuuuagcucuucaaucaaaaugguucuccuguuaacaccuaguagguaaaauaccugaaacaaugaacacgucuuucuguaauugcucucuccaccuugauagcuugaacugcagauucuucagaaaaauaaaauuaagggauagggugggaacgggaguaaccagaagccuagaauaagaaaaguuaaaaucagacacugcagcaagcagaaguaucaaugucuaccaugacaauuuaucauauuuuaaauauagucaauacaaaugauuuuucacuacaaugcagcucuugggauguaaacagagaaugccuaguauguaguaaaguaaauaugcuaauauuuuccauuccacuuacuguucugguaauuuccuugcuuugaaaugcuuuuuuacccacugacauagaaacauucguggguggugguggugggaauaaaaaccaacugaguuuuuuuuuuuuuuuuaaauacagccccauuucaauaucucuaaaacuaaaaacucaaucuaaaguggaaucagauaugcaaguguuacaugacauaugcuguuacuauaaccagucuguccccgaucuaacaauuaaugcuuacugaguaacucucuuauuuucuguggccuguuaguaucugugcccaauuccucauaaagguuaauucaucuaauugucaagaaccugagauuaucaacgacugcauuuuagagaaagauacagggaaguuggcaccugcuagguuaacacauuuagucagugaagaaugaacagaguucccaaacugacugugcagcccacgugccucgacaguacuugggaguuuucuacuucaucaagcauaacgagcauuugguacuagagguugguguguguguacaaacagauugccagcguguuguaacaggcgaaggcagcaaucuuaaacuaggcaguaguuagaaaaccuauuccuuagcaguggacucuccuuccagccucgauuuaaauuuagcaaaacagagagcuucucggagccacugguucaccauaaaaugaaguuuccccaccucguugucaagugggcacaaaaaaaaguagcuuuguuuucuuaaaagggccccguauuccuuucucuucugagguacaucccagcagcucuuggggacaaagcaucugcccuccuaaguuuccaguuccuuucagggaacacuagggucuccccuuaggggccuuuugcugccaggcggcccuaggugugaacgggagcgcaggccaaucgcaaagguuaagaagcagaaggggccgggcagcuccacuaggaccuagaaguauuucaacgcggucacuucgcccugcggccagugacagccaucccuccgggccaggcgugcacugcucgcagagcaccacgcccccggaggcaugcuucuugcccuagccuaccagugggugacacaggauuccucucgccccaggaaugucgacugugccaucgacaugaagucgugucaacacacccaacaccuuuccacuccaucuccaucgcccuaccgucucggcugcggcugggcugcagagccgcgucgcgguccccagccgagcacgagaccgccauuuuagacagcucaaggcagcggccauuucggagcggcccacucgccgguggcucagcucaccuucagcgagggucuagggccagucgucggggacuggagggaggagggagagaugaaaaacaaaacagaggagaggaggacgcgggacggggugaugcugucaacucagggauaccgccuaagccaccucaaagggccccgacucucggacggcgcggccugaagucugaauucagggacucuuagagcuccacugcggccagacgcgaugg

SEQ ID NO: 4038 - RNA, 2144 nt, Mus musculus
uggccuuuucagaaaucugaguaguguauuuaaagaauuuuuagucuacuuggauuuuuguuuuuauuuuguugauuguuuugggagaagguauuugacuguucugggagaaggagguagggauugaauucggaacgcucuguaugcuuggaaaguccuucaccacugcagcccaccuguuaaaacauaaaaauucuaguugacauuaggaaagauggaaaauuaguagcugaauuucaacaaaacccuuuguauggcuggaagcugaaacagauaaaaaugagcauuguauuaguaauaguaguugaaaaugcacuucuuccauuaggaucaaaaucuuuguggguuaccuuuuucagcuuaugacagcuauuaaagccaaguacagaaauaaccugaacacugaaucagauauuuuaauaaguguuucacaaagaauuagcuuuuaaaaaacuaaugaaaccuagucaaucagagugcguucacuaaauauuuucaguaggguuaauggauuuuuuuauaccauuacuacuuaaaaucucguuuauuuuaaaugucugucuuugcuauaauuuuuagaauuuguagauguuuuacagugccacaaauagcagaauucuaauaaaucuuacauaacuguauagagagcuuuucuugggugugggguguucaauaguaacaaguuuggcgaaccaauagcauagguaaaggaguuggcgcuguggaugcuggguacauggcacaauggaauuaacucagcaggcuguaagaggacuaguuugccaaaagucuucaugaaagacgucucacugggucuucauaauggaaggagugcggugaaggaaaaugacuaauaggagauuuguuuggucaaacacaugguauuuaccgucuggggagauuacaaaaaaaaacauauucaaaaggacagcacagguugaagcgcaccacagcucugcucucaaaaggcucccucagacuuggcccuguaggaggaugacagcaagccacccagaagggugcaggggagcaccucuaaguguagugaccccucuuuaaggggcuccaggggcuagcugaugggcaccgaggucccuaaggagaguggggcggccacgaaaacaugacagacgaggaccagagccuugagggcgaaagccagaaaggcgauuucucuacaaggcgcguuguuuaccagcucgaggccaaagguuccucaaguggggcugcagcggggucgcuggagaccaggaaagagucuggggacugcagggcugaaaggggggcuuugaacuggagcucguucgugacgcaggggccucgucccucccucggccgacagagggagccggaggaugggaggaccggcuuccccguagugaaaagcgccuacaccggcucucaaccagcguagcgcggcguaccccggggcugagcaagaggugagaagaucccgagcucacgacggccgccugcauaccccaggcgccagacgccgggccgcgcgcccacugcguugaauucucgcgagagcggcggccgccauuuuuccauugauugccgcgggccgggggaggggcggcggcggcggcggcagcggcggcggcagcagcggcgacggcggcggcgcccugggucggugucugcgcgcuggugucuaaggccugagcggaggccuccucaguugcuggagcgcaggcggcugggaggaugacugucgcugccguucucuccugagacacagccgccgccaccuccaccaggcccccgcaggcagggcggagacgagcggucggagucugagcgauggugcccggcgaggagaaccaacuggucccgaaggaggugaggggccggcgggccagacuaggcccgaagccugcgguccgcucgaagucgugcaggccccgagcgggaggcaaggcuagggccgggcaggcguggggccggguggacggugggcgcggcgggcaguuggagaccgcugguucccggggccacguagccgagggagagcuccggcugcgaggggcuaacgcaucaaagacuggacccgaggaguuggguucugcucccgggggugggggggaguauugcggagagaaaguggccuuugaaguccagacuucacacacgucgagccg

SEQ ID NO: 4039 - RNA, 2144 nt, Mus musculus
cggcucgacgugugugaagucuggacuucaaaggccacuuucucuccgcaauacucccccccacccccgggagcagaacccaacuccucggguccagucuuugaugcguuagccccucgcagccggagcucucccucggcuacguggccccgggaaccagcggucuccaacugcccgccgcgcccaccguccacccggccccacgccugcccggcccuagccuugccucccgcucggggccugcacgacuucgagcggaccgcaggcuucgggccuagucuggcccgccggccccucaccuccuucgggaccaguugguucuccucgccgggcaccaucgcucagacuccgaccgcucgucuccgcccugccugcgggggccugguggagguggcggcggcugugucucaggagagaacggcagcgacagucauccucccagccgccugcgcuccagcaacugaggaggccuccgcucaggccuuagacaccagcgcgcagacaccgacccagggcgccgccgccgucgccgcugcugccgccgccgcugccgccgccgccgccgccccucccccggcccgcggcaaucaauggaaaaauggcggccgccgcucucgcgagaauucaacgcagugggcgcgcggcccggcgucuggcgccugggguaugcaggcggccgucgugagcucgggaucuucucaccucuugcucagccccgggguacgccgcgcuacgcugguugagagccgguguaggcgcuuuucacuacggggaagccgguccucccauccuccggcucccucugucggccgagggagggacgaggccccugcgucacgaacgagcuccaguucaaagccccccuuucagcccugcaguccccagacucuuuccuggucuccagcgaccccgcugcagccccacuugaggaaccuuuggccucgagcugguaaacaacgcgccuuguagagaaaucgccuuucuggcuuucgcccucaaggcucugguccucgucugucauguuuucguggccgccccacucuccuuagggaccucggugcccaucagcuagccccuggagccccuuaaagaggggucacuacacuuagaggugcuccccugcacccuucuggguggcuugcugucauccuccuacagggccaagucugagggagccuuuugagagcagagcuguggugcgcuucaaccugugcuguccuuuugaauauguuuuuuuuuguaaucuccccagacgguaaauaccauguguuugaccaaacaaaucuccuauuagucauuuuccuucaccgcacuccuuccauuaugaagacccagugagacgucuuucaugaagacuuuuggcaaacuaguccucuuacagccugcugaguuaauuccauugugccauguacccagcauccacagcgccaacuccuuuaccuaugcuauugguucgccaaacuuguuacuauugaacaccccacacccaagaaaagcucucuauacaguuauguaagauuuauuagaauucugcuauuuguggcacuguaaaacaucuacaaauucuaaaaauuauagcaaagacagacauuuaaaauaaacgagauuuuaaguaguaaugguauaaaaaaauccauuaacccuacugaaaauauuuagugaacgcacucugauugacuagguuucauuaguuuuuuaaaagcuaauucuuugugaaacacuuauuaaaauaucugauucaguguucagguuauuucuguacuuggcuuuaauagcugucauaagcugaaaaagguaacccacaaagauuuugauccuaauggaagaagugcauuuucaacuacuauuacuaauacaaugcucauuuuuaucuguuucagcuuccagccauacaaaggguuuuguugaaauucagcuacuaauuuuccaucuuuccuaaugucaacuagaauuuuuauguuuuaacaggugggcugcaguggugaaggacuuuccaagcauacagagcguuccgaauucaaucccuaccuccuucucccagaacagucaaauaccuucucccaaaacaaucaacaaaauaaaaacaaaaauccaaguagacuaaaaauucuuuaaauacacuacucagauuucugaaaaggcca

SEQ ID NO: 4040 - RNA, 88623 nt, Mus musculus
cagagccuugagggcgaaagccagaaaggcgauuucucuacaaggcgcguuguuuaccagcucgaggccaaagguuccucaaguggggcugcagcggggucgcuggagaccaggaaagagucuggggacugcagggcugaaaggggggcuuugaacuggagcucguucgugacgcaggggccucgucccucccucggccgacagagggagccggaggaugggaggaccggcuuccccguagugaaaagcgccuacaccggcucucaaccagcguagcgcggcguaccccggggcugagcaagaggugagaagaucccgagcucacgacggccgccugcauaccccaggcgccagacgccgggccgcgcgcccacugcguugaauucucgcgagagcggcggccgccauuuuuccauugauugccgcgggccgggggaggggcggcggcggcggcggcagcggcggcggcagcagcggcgacggcggcggcgcccugggucggugucugcgcgcuggugucuaaggccugagcggaggccuccucaguugcuggagcgcaggcggcugggaggaugacugucgcugccguucucuccugagacacagccgccgccaccuccaccaggcccccgcaggcagggcggagacgagcggucggagucugagcgauggugcccggcgaggagaaccaacuggucccgaaggaggugaggggccggcgggccagacuaggcccgaagccugcgguccgcucgaagucgugcaggccccgagcgggaggcaaggcuagggccgggcaggcguggggccggguggacggugggcgcggcgggcaguuggagaccgcugguucccggggccacguagccgagggagagcuccggcugcgaggggcuaacgcaucaaagacuggacccgaggaguuggguucugcucccgggggugggggggaguauugcggagagaaaguggccuuugaaguccagacuucacacacgucgagccgagagaguuaagagagaucguuucaaagaaaacauucuggaacaguugcccgugggcaggacggggugacggugcugcuucugggguuugacagcguauagcuuacggggcuugugaaaucgacaccuaaguugagaucugugggagggcagacuuaacuguuaaagaguugucggucuccccaccccccuccccccagccuccauucccccuccuguuacuucguaguacuaucggccagccuaaauggggccuacccaggaucguugaaaaaguaguuaaguggggcuugaacgggaggguaagagauagccgaguuaauuucaccauauggagagacgaaacguuguuuuuguguguaauuuuggucuuuuucugguguugccaacuugggugacuuaaauucuuaaaagcgagugacauaagacucccggacuucuuggcuucccuugaacagucaguaguagaagauuaaagguagaauccugcacuggccaguggauuucgacauauuaauaguccguuggcuuuauaaauauccucagcauauucaaacauguauuuuuaacugcuggucgucaggcuuaaugcuuuggacuuuuauaucucauauaccuuaaauagaugccaaguguuaaguugaaauuaggaugguaggaucuugauauuuauacacgaucauuucggauuccuaaauguuuagguuuuguuuguuuguuuuuuaauuguagcaauuuguugcuacacagacaaccccuggcacaaugcaaagugacuuuauuuuguaccugaauaguuaaaauuucccaucuuuccuuagauggauaauaaguugauuuuuaggguuuuguuuugccguuuugagguaggaucuuacuauguggacuuugaaguacagacuuggcuggcuuggaacucacuuguagauaagcuggccuggaaauucuuaagagguuucccugucugucucccccgaugcugggauuaaaagugugugcuaucaaacucaguggagugccuguuugcuguuuaaggcugaguugugugugugucaguauuuuaucugucagacaucucuaagucucaguacagcagauaagcacgaacuaaagaucuugccucuggaacaguuucaacaacugagaguuaggaagucgggaaugugaguccuccuaugguccaguccggcauuuugaacuuuguacuaaguaacaaggaaggaaggaauagguuuuacgagaaagcuaaccuucauuuccuuuggugcugguuuccaaucuuaagaaacaaaauuaacccuuaauuuccaacauuuagaaaauagaacaacaaguacaacccugcauaauauuauauuaaugacucgguuuguagaaguccugauagagaugugcacauauccugcuuugcacaaacuuaccuguuguuuuaaaaacugauauugcaaugcuaguuucaccuccgggacgauugaacucucgauuaucugaggagaucucccuuaucagaugaaccuaacuuuuuuuuccuucuggauguuaugcuuuauuuccuguuccuggcuuucaguacuuuauccacaguuccugcuuccugggauauacaccgaagugcucuugaaaugcagacuuuuucuuuaccuagccagauagugguuuuguuuguuuguuuguuuacuugucagccucacucauucuucauucacagguugcuucuacuuccauauuugcuucugaguuaaccagggcuguaucccaaaaggaagcuagugaucucuuaaaccaaauaugugggcuucuccccuucucuuccuuuaguuaguuaguagcauuagauacuuuaaaacauggccuuucucuuguuuguguuuuuaguaaugaguuuuauuuucuuuguuaucaaauagcauuugaauuauacagugcuaaaucugagggcaaaucguguaauuuaaaccacuucacuucucacaggagugagaaguacagcucucagguugaaagugacuuguucaaauuaaggacucacaggugggggucuagagcuuggguccuccaucgggucuuuucauccucuuacguucaguccauguuaccuuggagcucuaagaauaguuucuauuucuccggguacuuguuuaguaagugacaauacagugcagaauuagaagcuuaccugugccuauuccagcuauauuaacaacccgagagagcuuuguuuugcuucagagaaggucugaccuuuauggauguggcuuucgauucuaugugugaauucauagaguuguuaaguaaguuaagauuauuuugguccuaaaacuccaggacaaaugucccuuggagaacugcuguaggcggcaucuuaguguacagauuaacuaauuguugcccagcucccagccuguuuugguuugaguuaggagugauuuuuaaauugcuggauuuaaaaaacuaaaaaaagaauagcuuucugugauacaugagcaugguugacaugggaauuucauuguuaggacacaguuuucagugguggcagcaguguugaguggcugcuguguaggcugugugcagccugguauucaaagugcaguacacuugcuucuggccauagccugcccuuuccuagcuuaucucucuucccauggaacaaguuuuuaauguagacaaacagguuucucuccagcuugcuuuauugugcugucccucuuuccuacuuacuucaccuguucaaauccuccguacacaguccauaaacccucuuugucaaagagucuggagcauuuuaaccuaaggauuuucuccauagaaggcuuuagcauaagagcagagcucacuuagcaguucauaaacaguauuuuggaacaucuacugugguuucugacuaugguacacauuuuaugauguucauugggaauuccuugacagcagaggugguguuucucacuuuuguuuuucuauauauauuacaagucuaggggaguguuuuugcuggagcauagauuaguaaauauucauuuguaugguuguaaggauggaaggagacuuugaauucuaacuggcuauuccucugcuuggagauuuuccauagcauaauuggcaagcuguuuccauauccaugacuuaucuugauaacagcuuuuucuucuuaaaauaacagaccucuguuauuuuaagguuuugcauugagauaaaucuagaucuuuagugucaucuuuugauaguugucaaugaucaacauuucuguuggagagcuuuucuuauggcugaagauagagaaagcagagcucacucacccuuucuguucuggagucugcauuccucagcucuucagcugcuuggugcuuguucauuuggacauguuccagcauucuaguacuccuaaauuauaccccaaaaagagcaaaaggagagggcgguguucauugaggagcgcaucacuguuuuacucugcuaugugacuuaauugcaauauugauuuugauguugagauugcuugcuuuuaguaccuucaguuuuaauuauugccuggugguuguuucuuuguuuccuuauaaggguuugggucauagcauauaggaguacucugcccuguaggagaaaguuagaauggacaccucgagugucaucggguaugaacagaaaggaacguguuuauuaauguuuugguuuuucuuuucaagacagggucucccuauguaguccuggcugaccuggagcucccuauauauagagaccagaaugcccuugaacucacagagcuucuccugccuuugugugccaucacaucugucacugaaguuuuuaaaaugauacuuucagcacacagaguauauaaauuuagauaaguggacauguaaauugcacaccuugauguuuuuucccugugcugucacuacucuuugcauuuggauauggguuuuggcaucuaaugaugauaguaauaacugaucuuuauugggauaccagauacggucacauauccuguguauguauuaacucauuugagggcagcaacuucacaacuguguaguagagaucgucaaugacuauugguuucucuguugucugauuucuuguagaagaaaucuuuucauccuugucuaccauaucaaaugaguauucuucuaauuuuaucucucuuuguuaaacuacuuggaauugcugcagugccacauuggucauuucugauuuuguuuauugcagagcaucgauucuugccugagagaugcuucccagauaauaccgucagcgucuuaaacugaguauuaguagaggucggcucauucugaagcuuaccauuuaaugcagugacaggagacugaaugcagacugugugugacuccagugcuuuugggaaacaguggacaugcaggagcaggagaggagacuuuggcacugauaguugacguuucugugugucuggaugauugggcuguguggcuggagcucggcaagcuuguuguuuuuagguaguuguugaugucguacuguacugucaaauuuuaugaucgugauuuuuauuucuucugcgucccugggcugacuguuucucuugaguaagcacaguugugcagccuuagucuugggugugauuuacauguuguaggugucucaucgauucucuacaucuaacucaucuauuuauuuguuuuguuuuuuuaaaaguauaguucuucauguaggaaacaucucuuauacgguuaccacuuuguaacucugccucuguaauuauuuuaucacucaaauguccuucuaagugguugcucugcuucccggcuggcugacccuagccacccucacuauaacuuuagaguuacuuucuaaagaugagaauaugacuuaggugcuuaaaagucugugcauacuaccucugguagcagauaauuaccuccauauuuuaaaauagaauuuuaguaguguucuguaguuguaugccccucaccacaaugggguugaauucacaguucucagguuuuuuucuaaauuaucaguuuagcagaugguccuuaaugggcgacagggggugaguauggcaguuuggggacucaggaaagagcagggguugugcugcugacauccaguggauagaaaccagguaugcugccaacgucuuuauaggaccagggcagccccuuuaacaaagaacuccuguacaucagguaugguggcacauucuuuuaauuccggcacucugggaggcagagucagguggauuucugugaguugguuuauguggaggguucugggacaggcucaggagccugucucugauuaaguaaaagaaaaagaaaaagaaaagaaaagaaagggaaggaaggaaaaaaaaaaaaaccaaccaaauuccuguaacuuagucaguagaaccaguguugaaaagccauaguuguuauaaagacuauugaguguacacauuuugcucuuacagucacaccuaccauuuuugucauuguaagaaauuaccagcucuacuagcuuuucugugaacuggaggccagccugauuuauguagauagcaaguuccaggcugacuuuggcuucgaugagacccugucuuaaacaaacuuuaguagaagagaguugaaagaaaaacuugggaaagaaaaaauugaugagaaacaacuccccuucccaccuaccacacacagacacacgcuuagagcaaguugguagagccaaggucuacauaguuagaauucaggagagagcagaagaaaugaaggaaggacgugaaagaaguuaagucacuuaaggaaaguuuccaggcccagugaguccugagugagcaggacggacuggccagaaccuagcaguacagcuaaaauagacgauguaauggagaccacuuggaauucuaagacuccuccagguauggguggcaagagcaagguaggacacuucaaaauagaagaagcugguguguucagcaacaucacaagaggaauuccuucaaaauuuuucugggugauaauucucugcccagcuaaacagucucuaaaauaaaagggaaaaucuuuuuugguuuugguuuuaguuugcuguaauaugcauuauuucuaaguuacaccuucucccaaauguuuaaaaauuauuguuagucuguuuuaugugugaaaugacuuaucucucuuuggaaaugcugguaguuuguuuguuuguuuuuuccucugcauacuuuuucguccgaauuaauuuguauuaauaauuugcuuguauugaguuuugucuuuccuacaguugcuuuccuucaaaggucuuugggggucuaugcagaauacaaacacugucaacccguguuuaugcuuuuguugaauggugacauacaugucuggauaauuuccuaacaaagucccaauaguuuagucuguuagggcugcugcagcaaauacaauaaacuaggugguuuguaaagaaauuugcuucucaaaguuucagaggcaaagaaguccaagaucaagguguuuccuugcucaaaaccagcgucucuuacucacugugucucauaguggauaagaaugaggcaugucucugggaugucuuuauaaagauauuuucucuuuaaugaggucugugccccugugagcuaauaaacuuccaaaggccucaucuccaaacauuauauuagugauuaggguucaguauauaaauuggugcuauguaaaaguauggguugggaccauagguucucagccuguggguugcaaccccucuggagguuguaugccagauauccugcaucuugcauauuuacauuaugauucauaccaguugcaaaauuacaguuaugaaauagcaacaaaauaauuuuaugguugguguuaccacaauaugaagagcuguauuaaauaaaggguuguggcguuaggaaguugagaaccccugcuuuagaccauagcaucuaggaacacaucauuuucuuuuguaacaggugaauugcacagaaagcacuuuucccccucaagcuuauaaauaggaaauagggaaguccuaugaaucuuaaucauggaguaugcagaugagauuucauucaguuuuccaguuuucagaauguugcauauguccuucauaaaugccugguuaugcuuuucaaagauuguucuuuugucaggaagaauucugaagaagagggaaccuggaaguucuaacugccacuuagauugcugucaguucuccuaggauaucugaaauggcuaguuucugcgccuccucuuuuuaaaagucuuuaugaaagaguugugggaagaauacaaaauucaugcauaccuuuucucuagcuuuuucucuuaguauuuccaugacuguaaagcaguucucaagucugaaucaaccuuaguacaaaugaguugccaaaguggaaaaaaaauucaaaauuuuaccagacuuccauuaagguuuuguuuguuuguuucugagaucagccucagaauccacaauguguuuaguugucuuuauuuuucuucuuuauuuguggcaauuuucuagucuuuacuaccauuuuccuaaccuuaaucauugaagaaugcagucaguuauuuuguggauuggccuuccuuuggcuuugucugcugcuuuuucaucaguauauugaacuuguguaucaaguagaaggauaucacagacaugcuguauccuuugugcauugaauaaggcaaagaggauggugcugaugugucucuggucauuugaaccaggugggaucccucagguaagauggucaucuuuccuacuguccccuaacaguucccccgaugaccuagaccacacagguggcagcuucuugguuaauuuuuauaagaugagacugauuuuuuuuuaacuuacuuauuuuauguguuuugccuacauguaugccugugcacaacaaauguucccgauacucuugguggucggaagaggauauccuucuauaagagaagccaauguucauaaccacugaaccaucucuuuggucccuuuguugaauuuuuauucauuaauuuuagcaucugucuggauguuuagacagcagucaucacggcuaguccuuuaguaauuucccacuauucuucugugaggaggaugccccuuuccuugcucaguuaucauucaucaguguggaccugcagguauuuauuuuuuuauuuuuuuuauucuuugguuuuaacucaguacaguuaccugauuuggugauuaaacuguucuaguuuggguaaagaggagcucuauucuguucaguguucuuacucuacaagcacuucuacaaugcugcuuuguuucucccuacacacacacacacacacacacagcccuggacuucacuucaugcuaaaauguaaauaagcauguauccgaggugccuggcuugcugcuuaagcuaggcagcaacagcuucuaguugccugcuguagucaauaccacuugccuugcuuucuaacuccuaagcuccuguuucuguuucuugugaguuugugcucuugaauuuuuucuuuucucuuguuuuagauauaaaguuggagaagcaugaaguaacugcauacguccagucuauacucuuuaaccagaaagaaauuccucacuuaguguuuggucugcugcacugggccagcuguguuugaauucccuucacucucucacuaggcuguucccauaugccccuugcauuugugucauucugugcuuaguccugagugaauguuaggaagguuguuguuguuguuacccaguuuuaaggaacuuuaaaugggugaaauuggauguuucaugaaagucaguguuuucuuagaauuccugauuuguuuguuuguuugaauuuuaauccacuaguuugaauuagugauguauccuccucaugucuugugucuagauucuauaauuuagggguaaagacaggauggagggagaagguucaaacauuuucagagcuacauggaugccacauuagaaagauuccauugaaaauaguugccaaaacaaacaaauaaaagacaguauuaauaugguaaaauacuuagaaaaaauuaaaguuucaaaaaccaucuuccacuuaaaaaguuccuuguuaaagauuuuuagucagcaaacuuagaacucuacagaggcagaguucuucuaugagguucauuacacagaguauuucuggaguuuaguggugucaaaucuaaggcaauuuuuuauuguagaaguuuuuuuucaccaaagugauuacaguuggcagaguuggcaaaugauugauaaaaaugauguggucauucucaucaagguucuuaaaaauacucccuaccccacccagcugcuugguguucuauugguauaguguagcagggguggaaauccuucucagccagcaagauggacccuucuugauucuucugccucaaucugauuguuguuuucuaguucugaagucccagcauuauaccuuuuaaauuuugaaaguuugugccuuuauuguaaauugucauuuguguucuuccuuuuguccugagauaggacagaauuuuuaguucaaaauacuaaugguaaaauacuuugggcaaguuacuuaaauuucuauaaggacaagaguaacaaccugcuagugugggaaagaguuacucaguaaacaauguauugcaauauuacccuuuguuaucaccuccauccuuacuucuuggaacagcauccucugugcauuguacaguguguuuguuaauuagauuuaaaggcagaauucugauugcuacucauauuaaugaauaucuuuauuauccauggugcuaguuuuuagacuugacaagagucucuuguaugaucaacuaagacuuguuuuuauugcuccuuuugagagcuggaauguguaacugaauacagauagugaaaauuaaagaaaagguuuuuuaagcuaugaaguccugagaaaauguggucugauauauauaaguaguuuuuaagguaauuuacuugauuaauaaguaucucaguuacuuuucuauugccauggcaaaauaccaugaccaaaaacaacuuguagaaaaagauauuuaauuuugagguucaggguuagagaggguaagaguccaugaauaucauggugggaagcaugguagcuagagcaguagcugagagcuuacaucugaucuauaagcaagaagcaaagagagcuaacugggaaugguguggguuuuugaaaccucaaagcccauuuccagugacauaccuccaacaagacuacaccuccuaaucuuucccaaacaauuccaccaucuagauaccagauauucagauacaugagucuaugggagccguucucauuuaaacaaccacauaaauugcucacuuguaaggauuugguguggaauguuguugcuaauaaugauccauguugagaacuuuauauugauguucugaucuucucuaacucugggguagaagauacugucucuaucaguguuguugacugugguuuagcugauugcucuaagaccuauagccuuuuguuggggaacugugcuuucaucauuauguguaguguuuauuguagagauaaauuaaacaaagacuguuuuguuuguuuguuuguuuguuuguuuucgagacaggguuucucuguauagcccuggcuguccuggaacucacuuuguagaccaggcuggccuugaacucagaaauccgccugcuucuguggcgguguaacuaaagugguguaacuaaaaauggcuaugugauauaaauaaaaacuuuuaagagcuuuuagggaaaauauuuuuaaaaacaaugaaucugaaaccuuugguaagaugauaggcuuaccuuuggggaaaccauguguccccagcauccacugcuuaaaacaguauaccuaacauaaacagaaggaagaaacauuuauuuuggcuuaugguuucaguccaugguuguuaguccccauuggccugugguguggaagugagaagagccauuaagugauuaagggacgagauuaagauauauucuagcgcagcaguucucaaccuguggguuguggccccuuuggggguugaauaauccguucacaugaagaacuauauuagagggucacaguauuaggaagguugagaaccacuguucuauugugugucuccaagauggcaugcuuggacacaucuauaauuucagaacuugggagguaguagugucaaugucagagguucauggucauccuugguuacauagagaguuucaggacauccuaaggcuauagagaccaugucccgaaacaaaaacaaaaaugucuccagucuuccaauaaucccacuuccugguuucuuauacuugccgguacuaaaaaucugucuauggaugaacccauuggugggguagaacccucaugauccagucaucugaccagugcugccuuggggagcaaaccuuucacuuaugagccuugcagggggauaguuuagauccagaaauguaucugucuuguucaugacuuaagagagaauuuuagcaucgggcagugguggugcaccccuuuaauuccagcacuugggaggcagaggcaggcagauuucugaguuugaggccagccuggucuacaaagugaguuccaggacagccagggauacacagaaaaauccugucucgaaaaaaccgagagagagagagagagagagagagagagagagagagagagagagagagagagagagagagagagaauuuuagcauaaccaaaacauuauaguuuguccuagaaauuccuuugugucaagugauacuuaauuauacauauacuuuuucuuaaugaagguuuuuguuacuuuugauuuugaggcauucauucaguucagauauggagcuuaaaaccugucaagaacacagaguuggagagauaagaaaugaccucauuuuaaaugccagucuagccuaaaggagaggaugacgugaugagacaaaugugcacuccagagauacuguggagcuauaaaagagggagcagcuggcuuuucuagggggauucucugaggauauaacauuugagcuggaccucagaggauggucaguguacaaagacagagcagagcuuucaguuacagggagcaacaguuaaaacagaaaaggcuguaauacauuuuaggaaguggcagauaauugcacuguggucagggcuugagccaauugaguguaagugccuaguucuggcaggcugaguccaaacguuccagaggcuuuguuuaucuugaaagauuuuacauuuuauugcacagacaucaagaaucaagaaauauaaguuuguuuucuagaaguucacagaaugccuuaauuuuuauacaguuuaguugcuaaagcuugcuuauggaaagaguuuuuuccaagauauuuuauguccuucaacuuguuaaaauuugcauauaagugaaaaugagaggaauacuuaacaaauguuuuaccugauuuuuuuuucauuugaaauaagauaauuagguacuuuuuuauuuuuuaauaaaaugcuuuucauaauaguacauuuuaguguauuuucuacauguguuauuuggcagaauguccuuucacauaauuacuugauugauuucgaugauacacuuaacaucuugaguaggcucaucagguaggucucucuugccuuuagaaaaugccaccaguuacagucugaucguggguguguccagaucuguuuguaaaauccucagcaguuucucaccuauugcuguaaggaaguuuacaagugagaaguuaguguucuaaaaauagcuugggauuuucacugagagccacacacacaaaccaggaugguguaguuuuuccuuaaccuucuguguuggcacaugcucaugaaugcuaugcagcuguuguuuccugagugcucuccuccaaucucuuugugagccuugagauuaauaaagagaucuauagcauauaauauguguaacuugggacuggauagguggcucaagaauuucuugaaguuaguccuugguucuuccucucagccccaugcucccagaaauaagacuuagacuuaaaguauauuuacaaauacauugaccuuauagcuaggcccuucuuuaacuagauauaacuuaaaacaucccauuuauucuacccuuaccacguggcugguuaccugugcucugguaccauguaucugacuagucacaucuuuccagugaaucucucaccuggcucuaucucaguuuucuuucuccuucuagaugucccaccucuauuuccuaccuaagccauaagccuuuuuaguugauaggugaugcauccauacaauauacaagauauucuuucuacagaaauuaggagcggguacugcuccuuuagaggacugaguucuguucucagcauucguguaggccuuuaacuuccuguaccaccagcuauaagagauauuacacccuaauauagaguauucccuacuaacucuaauaucuacuucuuuacucacuagagagugaccguaguguggcaacugcggagugauuacuggacaucccuccaggaauguuuuuauuuggggaugaaugaacuauuccuaaggauagcucaaugcucugagugaaguuaagacuuuacuacguaaggaaacuuugauugcagcuccaguuccagguuauauuaagaagucaaguuuuuguaugacucuucuaaaauacaaugcacugcuuuaguaaauacugauaagcugucuaugaucuuauauacagcuugucauguuuuauuaacauaaaaauguuuaauguuuuaauuuugaguuuacaccaugugguguaauuucuuuguauauuuuaguaguuugcgguuaugaaaaggaauuggugaaaaauuagauaccuauagccacuuuucuaauacaaaagacaugagagauacuaguuuugacauuuuaaauucauauguguuaaaauauuugcuaguguauuguuuaccaguaauacaauacagaaauaauuuaagaguucuaaaaaaaaauagacaugacauagcauguuucugcaaguauagucugauuuuaacucuguaaggagagcagagguuggaugucacagcccagcccuucauguccuaggugaagaaagucugaguaggcaucaggugucugagguguauuuuauguagaguaaaaucuuuucuguggagacagacagcuuuauacaguuaugcacccaccaccaagucaaauauagggugguccugccuccuuagaaaaguucucuccuguuuuagcuccugucccagucagauccuaguaaacugcugccagucugauugcuguccuucuguuuugcuguuuuucuuauguaucauuuuaguggaaccacacaguugugugaagcuuuggagguugaucuauguuguugcuuguauuagucuuuuuguuuuuguuguugcucagugcuacaauuuguuuagauauuuaccagcuaguggacauuugguuuuucucuggguuguugggggcuauuuuuugaggacagggucuuguguuguaccuuucccugaccagggacuuacuauguaggccaggcuguugcuacacuuuugaugauucugaauaaaacagccacauugugaucuaguggguaaggaaaugagauugacuaggacauacuuuuuguguggaaaguaucuguuuaacuuuguaaguaacugccaaaucuaccugaaaugcaugcacauguugcauucuacucagagaaguguggcagccccagaugcucagcuccuuguuacuuggcagugucaggccuuguuugcugcuuguuuuguugaguccauauuuuagcucuucguguaaaguaaggucucugugaugugacuuugucucucugaugaccaauggcacagugcaacuuugcaugagguugauuugguuuccuaguaaaccuaauccugcauacuuuaugcaaguagugugcuugauaauaccaggagagagggcaauaaaagacugucuacucuuaauaguuaauucugacuguuuaauggcccuaguauaauuuuacuaggcuuuuugagaaaggaguuuucacaguaccuaguuuggugagaaggauaacggcuacagaaucggggguggggguggggaguaauaagccaguaguuuaacaucacuucucuguguucuuucuguuucuuuugucuuggaacauuagccuagcuugccuguaacucacagagauccuccugccucugccucccaaaugcaaggauuaaauggauguaccaccacucccugcugggucuuuucuucauuuucaacuguuucaugaggaagugugaugacauaagcuaauaaaaguucucucuaacucaguuauauauguauacaaaaugugcuugccggauuaguuauuagccguugugagauggucauaugaaugaaaacaaaacuuuuucagauuucucccaauaugauaaaacucacauguucuccuugcagauaaucuuuugcauuuggggauaguauaauaaaaauucuauuauagucaaggauuagguguuuauuaaaucuguccugaggaggauaacugguaguuccauuaaugaugcguaacucucauggcauuaugaugcucuauuagaaucuguaauagaagguucauuucuaauacugagccagagugggguagaauuguguaggucuuacccagccaaaauguuaauuaugcuaaggacucuagccagaugcucugacuucagcacaaaguuccugaagcucacaaaggaauuccucaaaaagaauguccauagaaauagacagcuuugaauuuugaaaacuuuaacacuuuuuuaaaugcaacaucuuuaugaucagagcauuguuaagacucuuguauuaaaguuauccauguuuuuuaaaguaaaauauuugaugagcuaggguuguagcuuaaaagugcuugccucacaugcaccagggccugaguucaaucuccaucaccacaaaauagauaaguauaguauaauaguagauuguugagguuuggucuguugcaguauauuguaaugcuaaauucuguacccaaaggucuaguugccuacaaguguauucucacauuuaccagcuuuugcugugcaaaccuuguuccuuauuaaaaacuauugguuaauuacuggggaguuacccuaauguaauuuucuaacuacuagcccggcuacuuccccagugguguacccaaaguacuugguauuucuccuggccgcgugcuugugggucaucuccucugugacagcguccccuuccccuccccccucucucuccaaccccuagccagguaacucaaaacccaccuaccucuaaucccuucaguaagugguuguagccauuuuuauuuaaccacuaguuuugaauuaaggaacaaaguuugcacaacaaaagcagcagaaaaaccuccacacuaggucaagcuuuagaauauuggaauauugccaaccugugaacaggucaguugugucacaagcugaguaagucacugcuuaucagcagcaggaaucuaagcagaaaucagaaucacaaauaacaggaauaguaaacacuuacuguuucaccuccuaaaaauaauguuaguugcaaaguuugauacuuguuaguguauuuuuagcaugaccaacacaggacuuaucagcaggcagccaugggaagaucacuagcagaguugguauucuguaagaaaguggucugagaaagccaugagagcaagccuguaagcagcacuccuucaaggcauguuugaguuccugcccuggcuuccuucuaugaugagcagugauauguaugcauaagucaaaucaacucuuuccuccccaauuugcuuugguggguguuucaucacagcaauagaaacccuaagucacuagucuuuaaaguucuuacacuuuccuaugaauugaauaauugauugcagcaacuaaaaauaagcuacaugagaguaaaaacauuucuguuaauaugaguucuguaaguuuaugucaaaaauauuuucaaagacaguggaauguaguugcuugagugaugcauacacuaguauagagagcaggcauaaauauuacaagcauacuuuauccaagucagccuguauuuuaguacuugaauguuguuaugcuauuauaauuuggaaguaaaugcuauguauugaaauaauuuauaacauauuuauuaaauucagaaaaucuauaccauaguacauugaacaauaaauuaauaaaaguucauuuaucacacucuacccauaauuucauuacacuuugaauaugcuuuagaauagacacaaaguaaauuuuauuuguuuuuaagaauauuucauauacaaagaaagcaaacuaaaucaggggaauaauuaucaucaaaauaguuuaaaaaccuuuauuaagcuacuuuuuuuuucaaaauugguuuuuaaaacuuuuaauacuuuuuuuuuuuucuuuugagacaguguuucucucuauagcccuggcuguccuagaacucuagaccaggcuguccuggaacucaaagauccuccugccucuaccuccugaguacugcaauuaaaggcaugaguccccacaccuggcugcugaaaauacuuuuuuucuaaagguuucucaaggaauucuaacuaggccaaugauuguugcucuauaauaauuacugcugaucaucaguaccugaauguuugcuuaaaauuucagaauauguuccuacuuguuuguuucccauucuguaucauaaacaaauguuaacuuaaacugagugaaucauuugcuuaaguuugaauuauauagaacugaucaaugagaacaaccuuucaugggacucuuacacucucuugauauauuuugaguacuucuuuaaguacuuagguuuuuuuguaccuucucagaaauuucuaccaagacuuuaggauccuguuuuuguugugcaaaaugguaccugggaccuaaaaacauaaacucuggacauaucuguuguuagaaacaugucauugcuucuaaguccucaguagaaucagcuaaauaaauauaugcaggaagcauuucuuaagagugaaaucuguauuuuauacccaaagauuccauaauaaacagaugguuacauuuuuaacaucuuuuaaaagauguguuucuuuauauguauguguaugggcauacaaaugccauaguaugcauguggaagucaggacaacuuauguucucccuauaccagguggauuccagggaucaaacucaguuguuaguuaggcuugacagugagcacuuuucccacuaagccaucucaguggugagugcuuggacuucuuccacuuuugaguuguuguuacuauucaguugugaacauggauauuguacaaguugguuagcucuugucaguuuuuguuguuguugcuauaccuagaguuagaauuuccaguccuguaaaugggucuguuguuuuaugguauguuuguggcuguuacguaaacugaccuauuuauuauaggguagauguaucucacaggguagugugcuucugacagcagacuugacugcgacagcgcaaguggaguuucagguucgggcccugccaggcgcuguuuuugugugggaacaauaguggcccaucccuuuaucaaggaacaauuaauuguacuuggagugcuaauuaauuccaguuuucuuaccuuuuuccaaaggguggcaucacaaugggucuuggauuuacugaagaugcacuucuuggugcauucaaacacaccaccaugaccuaggcugagcccagagaaucuguaggcaguuugaccaacuauaggacaauacauuuuggggaaacuuuguugugacuuucagcuguuggucaagugccuuguugcuacuguuggguggugauugaguucagguuccccuuuccuugacaacuccucccuagacuggaagacaaguguacuugcuucugcccacgauggcuuccugaaggacaccucccugauucgggacuggugaacucuuuguuauagccaagugagugucucucuuggcaguugauggugcugugaggucaguuuuguucuuuggugauugguugugguagugugguuaguaaguuuccuguuuagugagacugcugcuuuccagagcuguucucagaguuuuuuaguuuguacacucacauaggaugccugccuccuuuccuuccacccuuucuucuccugcccccuuuuuugguuuauauaaaauuuuacugaucugauuuaaaaauaucaaauacuuuaaagauuagaguauuguauguggcuugaaaaacuguuacaauauuuagccacgaucuaaauaaaugcaguuuuaucuuuaagaggcuucuuuuccaucugagaauuuucuuguaauggguuaaaauauaucuaugaaucuuagaaaccaggguuuauuagaaaccucuguuaagguguccuugguuccuucaugcauuuucugacauaccaccuccaaauugcuucuauucuguguguugauguuuguuaauauuacaugacauguauuuccuguaggcauauuguucuuucuguuuguucacacuaaaaaugcauauuccuacacauuuuccuagauaaguuuuauggauucugaugccaaggcaaauugcuuuguuccuuuaucuuggguaacuauuuuuaucuuaugacuaggagggauaaugagaggauaguacuuuaauuuuuuuuauuuaauauaugccaguuaaauuugcuguuuucuucuuaagauuuaaauacaaaaauaaauacauauacauuauguagggauaaucucuaauguacuguguaaaaguaucaccugucaauaaagagcugaauggccuaugacagaggaggaaagaaauaggcagaaauuccagaaagagagaggaacucuaggagucagaugaaggaagaaguccgacauaugaaacugagagguagucauccaugacagacauaacaguauaaacagauuaauguaaguuaagagcuaguugaggagcaagccuaaagcuuuaagccauuaagcauuguaaauaaaaauaagccuccguguccuuauuugggagcugcagcaggcuuagaaaagcccaaacaguuagauaguaccaaaaccgcauagcucaguucauauuuuaaugguaccugcucuugguuuauccauuggauugcauuuggaacgcuugcaguuuuuguguuuuaagcaauggguauugcacaugucugugugucugcuauaacccagagcuucuauaggagauaaucaguagauggccagacagcagcgggacauaugaauauuuuuaaugaugaaagugguaaguuguaggauaagcacuuuuuguuuuauaggugauauaaugucaaacuuuccugaaggugaaaucgguuugcauucacaugaagaaugaaaaaucuugguuuuucgagugucuuuuuugcugaucgauaauuuuacauauuucagcauuucuuugugaacuauccugucuggguucuuguugguuacggcucagguagcaggcuuuuuaguuggcuuuacuguaaauauucuuuaccaacuuuccaacuuuuggcccuuucuguuuuguuaacucuacaugucuucaauuuuaauuaccauuaacuauccuuuucccuucauuuuugugguuuuuuuuccuaagcuuaaaauuuuaaagauauucuauaaaauuuuuuaaggauuuaggacuuuggcauugcuauuuaggucuuuaauauaccugaaaugggcauguuuucauguaggacauaagauaugcuuuaaauuuguauguauuuucccccucuauauauggcuacuuauccuugaaccauucaccaaaaaguuaagcuaauuuuauuuuuuuuaagacaguauauuauuauguagcccuguuuggccugaaacucuauguagaucagauuggcuuagaacucacaaagaucaaccugccucugcuucccuggguacugcgauuaaagacacagccagauuggcuggaaaauguaucuuucaucuagccuaauucccagauauaucugcuucuagauaaucuauaguuuuagcuauuauauuuaggucuuccaucuauugaguucauuuaaaauauaaaacauuuuuugagaaaggguggucuuauauaguccaggcugcccuggaacucauuauguaaauuagucuggcuuugaacuuggugccaugugcuacuguuguuuauagauauuuuuuuauuuuguauuucauuccucguaaagaacuuucugaccaagacugagcaaugaguaccaauuuuaauggcauaucugguuuuuuaguuaaauuguggggccaggguaguccuguguauuuugucuugccucaaaguagaagauuuuuggagacgaagacacuagguauuaacugcuaaucaggcagcuacaggaaccauggagacacuuaagaggacaggagaugagggguagcaggaagauuauaauuuuaagagggaagaggugaacuguucugauuaucuucaguuauguaacuacugguccccacuucuuccucacagaauacagcccaggcaagacaggcagcagcaacuuauuuuucugcugagugacaucaagguuaggccugaaagcauuugaaggaguccucagacugugaugucaaugcugguugucagcuggguucucacugaggcuaggaguagcauaucugcaaguggccuuuucauuugcuauuuaguuuccuuccaaccuacaagcugcaacuauaaaggcuuauagagccaagaaccuaaaguccuuucuaaccuaaccuuggaagucauguuguauagcauagaaaucacuaaggcccuuccauauauguaaagaguauggcacuagauuccuauguuagcuaaaaguuaugccaaagaauugguacacauguuuugaaaaugccacagugaaacuugggucaaagacgugaggcuaccaauggaaaagcagucuagguaccauggacagagaguggugagucccagacugcccggguuuguuaguggccugcuuuccacuguaugaugaaugacugcuccaagggcuaagcuuuguucacuguuacauucuaggccgcugcuagugcagcuuuaacagcugguugcaggucaguauuauuuugugaaaaauauagucaacauucugaaccaaacugaaauuuucaaacuaacuguucuggcacaggaaaguggguguuaaaagauaagaagcacaauucaaauuuugugccaaacagaaugaucauguugguuagaaacugagucacuguagaauagaaaagguuuugguagaacauauauugaauuugcuaaugauuguuauuuuagaauugcccuuaaaaaaaaacucuuguaguacagacuguucuugaacuaauuauguagcugaagauaccaugaauuucugacccuucugcccugaagucacuguuugaaaaaugauuacagcuauuagaauuauauuucuguuguaaaggcaaaaugaccuuucuuucauucaguauguucuccauauuaagcaaaggaggaggcaagagagaaauguguguagaagcauggauacugcagacucaggguuucaagaaauugcuucuugguaauuaaugguaacauuucuucuugcauacaaaugugugucugcuuucaucguuguuaaaaaauaguaccuauaguaagcguaccuuaaaggugccuuuuguuaaaaaugccaguucaugucaucacuguaccauagguuuucaguauauauauacgacugauacccagcauuaaaauugcaauauaaauuaugaguaaaauucuagauggucuuuaauuuuguaauuguaugugucuuagaauguauuuugcuuuuauuucacuugugccuuuauuuuauggaaauaauucauuuugucuuuauaugcuauaggauguguuuuggagaugcagacaaaauaucuuugaugaaaugaagaagaaauuuuuacagguagcuugcuggugucacugcuuuagugcgauagucagcagagcgaguaacagcaugcuuguguuuuguucaauagcaaagcaugucuuaaguuuucugcuugucuggcuacuuuacuccuaagcaguucuaguagcauacaagucaucuuaaaugaauuuuacaucuguacaguccuuuguauuuaacaagugaguaagggagaacugaaagaaaaugguagagcccuuaguuuugcauuugaauguaauauuaguacagauauauuuauuuucugcacuaaauaguacuaggggauuaaauaaauuacuuacaaaauuacugcuuauaaacuuuugauaugauuuauuuauucauuuauuuauuuauugggggggggugcuugcuccugugugugaaggucaaaggacagcuuguuagggaacuccauucucuguuuccaucauguaggcuccaggaauuaaguucaggucuucagcaugacagcaaaugucuuacacacugagcccuauaucuagaaagcuuauugaagaauuagauacaaauguuagcuucuugauccccugugguucuuucuaauaagcccaaacuucccugugcacuacacucuaaccaguaguucauaccucucucuccuucauuccuccacaucugcuuuuccccucaaguuucuucuuuguguuugcaugugucccaaguguuguuguaagugaccacuuagaaaacagauuacuugaguauguuagggguuuggauggaguauaaagagaaucuuaaaauaauuuuuaauguaaaucaagaucuucauuagucagcagaccaagauuuauaacuuaacuugaauacucuaaacaaggccaauaauuauauaaauuucagguagcaaaaaauauuuauacucaauaauaauguguugcaguguaguauuuaugaauagugacuagccacagcaaagacccaagacuggcuaucuuaccuuauggcaucuuuugcccagaaguagagaaauggacuuugcauguacauaaguuuguaaccauauucgcuuaguuuuaacaucauugaaggaagaaagccuggagagaaaacagauugacgguugaauguggaaguaaagaagacccuucacgcaggaagucauccaaagccaaguuagggcaaagcacaugugaagacacaguagcacaugcacacacauacacacgugcaagcacgcaugcgcacgcacacacacacacauauaguguguauaaacuacacagguauauacaaauauaauaaaugccauaggagaaggaaaagacccuucauagugauuuaauucuuuaacuuuuuucucucagaaaaaucaaauguugauaccuuugaguuuuguuauuuucuacaaaugacauugaacauaugccaucaacuauauaucuuuguauuuuuaaauaaaaaacaucuaagaacuguuuuguugucaggguuuuguuuuguugcugcuuuugagguauuggggauuaaguguaggacuucacaccucacaccugcuaggcaagcccagcacuaagccaugucucuagucucuuaguuuuuuauucugagucagccucacuaaguugccugacaggucuugaacuuggaaucuuccugccucagucucuuaaguucuuagaauuacaguauuguaagcccuagcaaagcuuggggauguuguugucaucaucguuagaaaaaucucaauguugacagcaauaaccucuuaaaguuugacuguuaagaauauuuuuuuuaaaaagcugauuugagaacguuauacgggcuggagagauggcucagccguuaaaggcuaggcucacaaccaaaaauauaagagaacguuauacauucaggguguaauugggauuucccuuaucagcuacuucuguauucuccuaguagcagagcaguuucuggaagaaaacacuaucugcucugugaauauccuaaugugguuacuuuuuugaaucaagauucuauuauuuauuuuaacuuuuugaggguuucuuuccauugugcuggaaaaucagcugcuugugcugggaauuuagacaccagacaucuuccacaugcagugcuuaggcuaauguacguacauguguguguguguguuuguaaaauaaauagauuugauuguccucguaguuuuucuauguagggaacuuugcucuuccaauaccuuauccuaagugcauuugucuuccuaaguggaaccuuuuguaggcuuuuaaaacuuuauagcuuucucucaucuugaguucuuagaacucuuuggacuaaacacuugcucccuacuuuaaagcaugagcugugcucagauguguucccacucccaccccacuauaccccaucaucaucacaucuucuguaauaguuugcaugugccugacuguaucuugccauguuuuuguuaccuucuguugauagcagccuagcauaacaauuaguggcuuaaaagaacaauuaauuuauuuacucaggauugugugggaugaaguuugagcaaaaacucagcuguugagcuuuguuccuugaggcaucuugccuuggcuccauuuagcuggugcuuggcuuuaaauggaaaguccaagaaugcuauucccacaugucacacaucuaccucagugcuuccacucagcggccacaauugcccauguagacugcuacggcuuccacauagcaagcuaaugcugguguaguuggaucucuuacauguggggugguuauagaaggggugguuucaggaugcauaguggaggcuacugguuucuuaaggcccaguuuuaaguagcacagugucacacauucugauggaccuaaacauagccaacucaaguucacgaaaaguggagaaaaggaaaaagaacaguaauucaccugaagaucauacuaccuuuuucuuugggucccaccauucugcaguagagccucaaagaauagguaucuacccaguugucucaaaucuaugaaauguauuuugaaauuuaauguuuuagaaaauuauuaaguugauacuguagagggguuuugcuuuugaaaagcuguuuauuauaaaauuacaauggcuuauuuauaauaccuuccaauggggaaauuuuuuuuuuuuuccuaaucaguuuccaaauuugaggugaggaaaagaaaacuuuuuacagggauuuuaaaguuaggugaaauguaugguugauagccacauauuaaauuuaauuauaggugaaguaaagaaaaaacaaauaauuggguauaaaauaaaguaauaguuuauaaagggcuaguuuagaccuuuaaagaacauuguauuuguuuaaauuauacuggaauuaaauucaagaguaaaacaugguagacaugggaauuuuagaaaacagaguagguacaaagcucuaucacauaauuguuuuuaaaaguuugugggcugggguguaguucaguagcaugcccaaugcucuggcucaguccucaacacugcucccaccccacccuaucucccuccccccaaauuccaaucuaggaaucgguaacauagaaugauaaaauauuauuaaucuaugcacuaauaauauuuuccagcuuaaaaugauaaagucuaauagaaaaagaauuggaugacauauuuauaaguaaagaauugcaaaacagcaugucugcucugauucaaugccuguaucugagaagccuguguaugugcauaggaaaaacacuggaaaguuguucaacaaaaucuuacuagguuucuuuugagauauagaauuauaaaucauuucucugucuuuuuuuauagucuucauuuauuuauauauuuauuuuauuuagugacaagguccagcucuggcuggcauagaacauucuuuguagaccaggcugucuuuaaacucaucuuugccuauuaauugcugggauuaaagguagguaccaccaugcccaggcuucacuguuuugaaaagggcaauauauacauacauauaaaauaauuauugccauuaaaagaaguaaaaggaacagauaaaauuaaauuuauguuuacuauagcacaguugcucuucacauggggucuauuauaguaacuucacuguauguucagguagaaagagaagagucuagauauuuuuuuuauacuuuacucucacacauguuaaagaaguugggcgcuaggaaugcagagcccugugauagugccauaauaucacuuuaguacaguaugcuauagcaucuuccauaucauauucuccuaacauauauuagaauuaugaaagcagauacuugaugggcaugguaggucauaccuuuaauaccagcacugggaaggcugaggcaagaaauucaagaucagccuggccuaggauguuaacagauucugucucaaaacaaacaaaaauccauaaacaaaaccaaaaaaaaaaaguucacuaguugaaauuauuuugaguucacucuuuuacagcagaccagauuuuuuuuaagucuggcuuauguuuauuaguuuuaguuuuaaguguguaaucuaauccauucuguguguuaauguccacuuuaaauacagaguugaaggcuuuuccucuguuucauagguauauuaauaauaauagccuuuuguuguagucaguuuuuauagauuagguauuuuuuauuuucauuuuuguuauuuauagauuggguauuuuuuauuuucauuuuuguuauuguuacuaauuaaaauuuuuauuugucugaaaugaagugcuagccaaucuguuguauagagauguauuucuauuccagucuaauaggauuaaccuuaauucacacaaucccuuacaaguccaaaauugacauugcagaaacaaugauugcagugauuuuacuuuaccucaccugacauaaacuuuguggcuauccuguuuucaguauucaucacugauacuaauucuaauuuuaaauuggauaauaagaacguaaaagguugaaguugauccuguuacagacaaggaauucuuguaaaugggacuuuaacuaagagcgagaguauuggcuaacauacagagacuauaaauucagucugcaguacgacacagugaggagaggugagaaugggagaagagaggaugggacaagaaggggaaaggagaagacaagaugcuuggcuagaacaccaggguguaaaggguguguuucugaagagccuuucacaaggaugccacccacagcuccuccagggaaagcacgagauguagcaccagagcuaguguuccaaguaaacuucucaggaugggaagggaagguguugccacaauuuugauagaagauacucugauuauagcaugagaacagagcaacaagggaugccuaaguagacuagaagaggaaagcuggaacuggaagacgcucagcuuggcucugguuucagaagcuggguagauauagguaacucauguugaggucgccauuagaugaggaagagggaauuucuucuacucaagcaucugguguguucagacacaguugauuuaacuguuaguaucaugagaaauggaaaaggaagucaguauuuucaagagcuuaagggaggguauagggcauacuuguuuuuuuuuuuuuuuugagaaggauauauauauuuuuuuaaauugucuugacauuuacugauaaaaagaaggaaggaaaauuuauaauucaguuuccagguugauagcugaaaagacuugguaaugauauauuuuuaaaggucaaacuuguuaauugagaacuuuuuacauguaugaguguuuugccagcaugugugucuguauaccaccaaaaugcuuggugccuguggaagccagaagagagcauuggaucuggagcugaguuagaagugcauaugaacucaugcucagcaugaguacugagaacuaauaaauucagguccuuuagaagagcaacaggcucucuuaaccugagucauugcuuuagcccuaaauuuuguaauuuuuaacuuuaaguuuucauggcuucuuggcucuauugcuuuauaaccuuaaaagguaaaagcagauacccauaggaauggcuacuucccccaaagcaaucauggugcuuauguuugacaugaucuauugggauguguuucaaacagaguaaaacaacacagagaaaauacugucuuauggguucuuuacgcugaucauaaaauuuuaugguuaguuauacuuguguuucuuuuaagaauaauugaaacuuuuuuaaaauuucagauagaaaaugcugcugaagaaccuagagucuuauguauaauacaagacacuacuaacucgaagacagugagugaacggaucacauuaaauuuaccagcaucuaccccaguccgaaagcucuuugaagauguggccaacaaaguaggcuacauaaauggaaccuuugauuugaccagggaaaauggagucacuacugcugacaugguaaacccucagacuuaaagcauuugcuuaagcugcuaauaauaaugucauagcugugauuacugcuguuguuaguggugcuaaaaugaaagcuuggacauuacaauuuccuuuauaugguuaucaaaaccguauagacacagugacugaucccucuucccuugccuugguucuagagucaccaguuguccuaaaauuugcauaauaucaggucaucaguuuuguauucauaaaaaggugacuauuauacauaucaacuaaaggaaauuuuucauguuuacuggaaguuuauuuuaauaaaaauuaugaauaaaaucacuuucauuuccuuuuauuuguguaacugugcauuuuaacucucaagcucaaagguauuucugauguaugcagucucagaugugugaguuuguuuuaugucucaguuucugugguaguaacugcuugcuuccuuugugauguuucuguuucauuuucuguguugucucauuucuauacugcagcaucuccccaaaggcuuagugauucuuguuuuacucggagaucuuuguagucaagaaucugcauggaggcugacuaaaugugcaguauucaguuuccauuuucauguuagagggauggggcgugccgauguuagcccaucucucugggguugagagaugaccagcaucugguugcaugguucugcucucuaccucgguggcuauaguauccagagagaauaaauucugauguccacugcuuaguccaaggaggaaaaggaggggcuggccugaccagaacgccuuuccucguuuguucacuaguguuuucuaccaccuuuaucuccauaagucuccuagaggcacuuugaacuguagguacuuugagcucuaggguuuuucuagauuuguuuuuuucauaagucauaacuguuuucuaucuuacuuuuuaauuucucagaauuucugguauguucauaguacucuguuuuccugugcuauugcuaaauuuuuaaaaacaaaaagcaaaaaaaaaaaaaaaccuuuugacauucuuggagauuggaggauuauucaguaguuauauaacuuuuucuaguuuuuaugaaaaucuauugcauugcauacauuuuagaaaaagaaaucuaugugcauguacaagcaguauugauuuuuaguacacauuaugcuuacaucaaucccuucgccuuuucuuuguuugggguuuuagaugcuggggaaugugacccucugggaugcucacagcauaaacugucaauugagcucagcaauucagcucgugauagagggguucauucaaaaucuagcuuaaaagaaauuuagccaaaucauuacugaaauauuuacauauaaauauguguguguuugguguuuuauuaucacauuuuuauauauacucuuaacauuauuuuguacccauaggcaccacuggaucacaccagugacaagucucuucuugaugcuaauuuugagccaggaaagaagaacuuucugcauuugacagauaaagauggugaaccgccucagauguuguugguaagcuauuuagaaagacauaauuuuugugcacuaggagugcaguuuuccgaaggaagaagggauguacaauugugugauaaugauaguugaaugugauggcaugagugccucaggucuccacagcaccauuguaacauuuaguuuguugccucacuggaacuacugcuaugcaaaggauggggaggcucagguuagaauaccaugcaaacuuguagucccauugccuuuccucuggcucaguauaaaacucauuaguucuuuugggagaccauuuccauucgcauucucuagacacccccauccccaugucaaucaggugcuuucucugacuuacucaccacaguucacuuacuugaacaggcuccuguugagcccacugacucccaauuagaagggcauuuuuccagaguuuugacuuuugaagaggugugcaaauagaaguaaaagcacuauccauucgagauacuauuucuuuuuaaacuacuguggugcuggagagaugguucggagauuaagagcacuggcugcucuuguaaaggaugaagguuugauuccuaccuagcacauacauggcagcccacaacugugauucuagucccagaagauucaauacucucuugguacugcaugcauauagugcacagacauauaugcaggcaaauacucaaacacacaaaauuuaaauauacaaucucaaagcaaaacaaaaacccacuaugguaaguaaaucuuguuugaugguuauaaguuccagaggauguagauguggaaaaauuuaaaggccuggucugauuugcguagguguuacagaauauggauuuuuuuucagagccuuucuuucucuucacuacaauuugcuuagaaugaguuguuguauuuaauggccucaguuagaaaugugcugugaauagagcugucccuuugagccggagacggugauaagcaguguguccaugcugaagcggcacucucaggcacccggaagccuguuuuguggcaucacagaguucugauugguuuugggugacucugaaauuggaauuagcuauuagagcagagcuccagagucucgguguuagaguugcagcuucaguugcuuagucaccgucauugccucauccccacugcuuaugcugguuugugcccuuuagcccuuugcaguguauuacacauuaacaggaagucucucguuagaggcugagcagcucuccauuccauccaguagcuccugaacagccucggcuucuaggccuaagcuuuaaaagugacuaugaagugcucacucaggacuugagugcuacaucuaaaacauuugaaggagggcuuuaaaggaaucuacaaaauuaaguucuuuggaaggggccagucuucugaguauugccuaguccucugagugagacaucuuucagagcugccugcaggaaacccaggacacacuuuccaugggugccuguuagaagcaaucuuagcaugcuucaacuuuuucucaguaaauccuggcugugcugcuuuuuaggaggacuccaauaacguggaugacagcgugcaugacagguucauagguccacugccaagagaagguucuguggccucuaccaaugauuaugucagccagaacuacuccuauucaucaauuuugaacaagucagaaacugguaagaccuauguauuguuguguuucauacagucauaaucucagcaaguucaggcuuaauugaauuucuucauuccaucaguaggaacugagcuucagagcaagaugacuggccagcaacagcagagucagcacuguaccauuucuucucucauccacuugcucucuuaacugcauuguuucuaccguuauuuaucugcaaucuaaaaaauaauggauauuguguucugaagaaaaguuauuuugguuacuuucugucaagagugcauucugacauuucugaagucagcuucucuggaaaugaagucuuuuuuucccuuuuuagauucagaugggcugugaggaaauaugcuuccaugaagcagacagaacacacuuauuuuauugggccuauuauaucuuuuaguuuaauuguuaugauugaaguaaauuagguuuucacacucauguggguucacaaucaucuguggcuccauccaggagauccgaugcccuuaucugaccucuacaggcacauaugugguauguauacauauguacacaugcagucaagacacauauacaaauaaaauaaaaagaaacaaaucuuuuuaaccuguuagauuuuuuuucugaauaugauuaagccuagauuucauuaaaguuuuuuguuuauuuaauguguauagguguuugauaaugcguaucuguauaccauauguguacguuacccacugaggacagaugagggugucugauccccuggaacuggaguuacagacaguugugagcuuccacauggguccucuggaagaacagccagugaucuuaacugcugagcccucucuccagcccuagauuauuaaaauuuuauuucaucuuacuaggcuagcuuauuugaagguuucauguauauaugauugguuaguuaccuuaugaauauaaucuagauccaugucaugucuucaucuuacaacaaaccuuuuucauaagguaguguuucauccauguugaaagaaauaaaaacaaguacagagaugucuuuuguacagcuaguuaaugcuaagcaugguuuuugaaucuuucuuuuuaaaaauuugaaaaagauuuuaaauaucgcauucaacaccuaucucaacaguaaagucauagauguacauuccaggcuuuguuuuaauaugaccuauaguauuauguuuguuauauuuuauaauuagaacuuagaaugauuuuuuuuucauagauaaucacgauggaguuuauuugcucuggaaauagcaaaagggacuauggucuuugguuuauaacuucugucaguggauuuuggaugcauaccacccaggauaaaagaggaugcagaauuauuucaaaguauagcacauagcaaaauugcuuguaaagucaaaaggauuuauuucuucaaaagucauguagaaaugauugcuuaaaacgucaauuuccagguuuacuucccaaaaugcuagugggacugcucugagucaggacaaaaaauuguucaucuuguuuuaaauaaguacuaugaagauuguucugagauuauuaggauacuuugaaaaaguugcagcuuuaacaaaucaagauucuugaaauaguuugauauuuguucugauagcuaaguccuuuauaugagacacuuauaaaaugcuggguauuagguccaaaucccuaucuugugaauucauugaaauuaagauaaugguuuuuagaaguguuguuauuuuugugcaaauaaaacaugccauuuguuacauuauaaaauuaaaaggcauugacaguacuccauguaguaaccacuuuuaguuauuuugcuuauuuuuaucuuaccucaugaaauaaugcuuuuaagaaaauggauaaugcuuacaaauauucauaagcauggggaucugaguuggcucccuguguuagugcugcagaucaaauaaauuugauucacaggguuggugacggggucggggagaggcaauuaggcaguugggcuaguuggaucuuccuguguuauauaugauguuuaaagugaaaaugcuuauauauuuccaucuuaauuauugguguuuagacuuagagaauaagauuauuuacacuaauauaaccuaguguaguacauuuguuauucuuaauaucuuguuaaauaucauauaauaccuauuuguaucuugguaacaaaguauccugacuuuuguugagaaaguuuaccuaauacauacugcagaagagagcuuucuuaaguggcauugaaaaaaaaaaaaacagaaauaauuuccaacuaaucagucuuguccucuguuauguauuuuuuguuuuuguaguguuuuagcccaagugcuaaucugucuauauuuguauuuucucuuuaaagguuaugugggauuaguaaaccaggcgaugacgugcuauuugaauagccuuuugcaaacacuuuuuaugacuccugaauuuaggaaugcauuauauaagugaguauuugaaaaauguucuauaagugaaaguaagaauaaaaguacaguuuuuaaauccuaaauuaaauuuaccuucauagauuuacuuguaauauuugggauauuucuuacuuuauaagcugacuuccuguauauuauauaugaacaagagucuaccgaaagacugacauaaaagcaauggggaggaagaaucauaaaugaucugauagaaaagggucaaauuauugaauguccccauucauaauuuuacugcuuuuguccauucauaauuuuacugcuuuuguagggaaggagugucugauuuugagagaguccagaacauaugcauugauuuucuucccucucuaaauuuaagauuucaguguugauuuuugaacucauaaacucucuaauuaaaauacgacauagcuuguuuguuaaauguguuuguauauuucuaagacuagcucauauaccuuaaaugcuuuauggaagaaguccacgucuaguaaauuucagccauuuuaugaauguuuucuuauaguauaguucauguacuucugcuuaguaaguaucuguaacuuagggagugcuuuguuuuguuuuguuuuccaaauaggguuucucuggguagccccaguuguccucauacucacgcuguagaucaugcuggucuugaacuuacagaaauccaccugcccaaaugcugggauuauaggcaugugccauaugcccagcaaauuagacuuuuaaagucuaaguaaacuucuuuuccuuuuucucuuccuuuugaguggcuccuuugaaauaaucuauguauuugaauucucuuuaaaguuguaguggcauugguuguauugcuuguguucucacccauauauucacuuguaagcuuguucucuggauuugcuuguagaaacagacacuuuuaauucauuaucauuuguugccuagcaauaauuauauucuagguucuugggaggauagagauguaggaaaaguaagaucuuuguuuucaaguaauuuaugaucugucuauaauaaguaccuguguguugugaaauaauuuauuucacauuuaacauuuggggucagcuaagugccacaagggcugaaagaggagagauauuagugaaauauggagaaauagugaaauagauauauuaggcuuagugaaauaaaguuugaaauaggucaugaaguagguguguuugggcuagguugacaagaaagagaacauuauaaggaaacuuuuagaugucauagugaauaguaguuagugcucccuaaauaauguguuaguacuauugagagcccuuuuauaugcuuacccacuucucagaauagcugugaauuauuuguuguuguuguuguuguuguugcugcugcugcuguuguuaucaccaccauuugguaaaaucaguuacuaaguacacagauacugcugaggccacacuagaggugccaggaugcaauugccguugucccugugcuauagcuguuggcaguugauucagguggguugcagaagccccuagaugcgcacaauggcugggaugggcuagaaccugcugggaagauuuaaguacuccaaaaugauugccugcugcuacaaaucugccuggcauccuaggugcuuguuuaacuguguguucucaaacucugaagguaaccugcaaauuugcagcucuguagagcaggcuauuggguagcaagcauuccuuggacacugacugcauuaccaugaguucuaucugacacagaguucacggcguuaauaagacuugaauucccccuuaagagcuuccauagagaaccuauauaaauaaguucauuuuacaagcccaguaugccaagggagauaauaaagcaaaguagagagaguaacuucuggaggaaauguugagaagggucauagcuuuagagagugaggaagggaaacagccaugagagcagccuucaagggaacccaagaacuguaaguagagaaguguuugagggccauugaaacccacuguaguggggauaaggguuaaaacacagauucaaugagguggacuuuugacauugagguuuuagauagaaguuuacagcagugugauaucagaguguagauaaaccuagggcccucacuggacugcacaggagcagcaccacagugaaagaugaaguugcacauucauccuuuguauguggcccacauagacgcuucacuguugacuugaaggcuugugauacagucugugaauuauuaggaagcuuauguaaugcaggucaaagaaugauuugaaagaaguccuuuugagggucugugauuaagcugagcugggaugcauggggucagaguggcaguuguggguaguacugguauuucugagugaaaaccugagaugacacucuggcaaccuuuuuaguaguaaaagaaugggaagaauugaaugugucaacaaagugucugacuauauaacuuaugaaauugcaagucccagcaaaauguauaaccuuuuaagguuguaauggaauuuugagauccuauaauuucaauucuaaaaccuuccauaaggauaacuaacaggagagcuaguggcugaguauagaggaagguaaagcacauguggucucagagaagaaaagugagucagagucugaaggguuugcccauggguaaaagggggcagagccauacaggugcaaccucucaguccuaauauaagaaacagugaacacuugacagagggacggagucaaagcaaaaccauuuguaaacaggaaaguaggaaacuuaauaguuagccucgaguaguggagugaucuuagcauugccaguuuuagacaggaaaccauuaauaguauucuuaauguuuggggguuugcauuuuguuuuguuaaauauguuuaacaccuuaagaauuccagaguauaguagccaacugggguuauccaaucuuuucucugccauaugauccuaaguuuuuuaucugggagucccuguagcuaggccuagaugaucacuuacaaauuuaugagaauaaaauucuacugggauuauuuuauuuacuuaauagcuuuuaaauuuuuaugugcauuggaauuuggccugcauguaugucuguauaaggaagucagauucacugaaacauaaguuacacacaguuaugagcugccauguggaugcugggaauugaacucugguccucuagaauaacagccaaugcucuuaaccacugauccaucucuacaaccucauuaauagcuuuuaaaaaauguauaguugaauauuugaaacauuuacaaaugaggaaaugguaccacaaguccauguguacucauuacccagcuuugaauggcaccaauugguaaucucaucuuuuuauaucagugguucuuaacuuguaggucacaacccuuggggauggggcauuaaacaacccuuucacgggggucacuauuagauaugcuacauaucagguagcuacauuacaguucauauuagugaaauuaaaguuaugaaguagcaaugaaaauaauauuaugguugggggucaccacaacaugaggaacugucuuaaacaaaugcaccauuagaaaguuugagaaccacugcuuuguauguaagcuuccaucgcgcuggcguggcaggcauagcuucauuucaccugugauaugacagcucaguguuugaguuccuggcauggcgauauaacuuuuugagccauuuguauaagucagauccaaacaagacauauaacauuauaauugauaauguauaaaccuuauaauugaucaguaugauucuuaauugauuuaaucuguuuuuaacuucuuuuguucuccuuuguaauucucugaaaacauauauugaauauguuuuuuccgaguuuggguuuuaauguuuugucaguggauauucuacauuuuuuugugaauuacuuacuggacaagguuuucaucagauucagaucugacccuuacauuuaagugagcuuugucuuuuauucucaagacuggagcugccuugugccuuuuguuuaguuuugaacuuguaaauuagagaaaaacugauuagauauucuuaguuuuaguuaauauccaaauucuguguauugccuagaauuaagaucuuaugugaugguuuugauauugaauaugaaaugaaauaauuugauauaauuaacaugaucucauccucuccuaggugggaauuugaagacucugaagaagauccuguaacgaguaucccauaccagcuucaaaggcuuuuuguuuuguuacaaaccagcaaaaagagagcaauugagaccacagauguuacaaggagcuuuggaugggauagcagugaggguaauaauucuuuuaaugauaacgacuucuaguguucagagauuucuggauuacagugucacaccuauuauuaucuuuaccugaaacaucuugcuuuuuauuuggauguuaaaguaauuuauuuuuaauuacuuaauaucugagagauaaauuuuaacaauuaagauucucuuacaauugaauuugauauguucuauuuuuaaugaguuuaaacuuuuuuauaguuuuuuuucaaacauauuuuuuacauaauaaagauacugggaaaaaaacuuuauuaaaaaggagcaaucuuuuuaacuuuguaacuuuaaaaaauauuauuucuuuuuuuaauuguuuuuugagauuauaguguaauuauaucauuucucugucuucuuucuucccuccaaacccucuuauauucuucuccuugcucucuuuaaaauucgugcccucuuuucuuagcuguguaguaguggcacacaucuuuaaucccaguacuaagaaggcagagagagguggaucucugugauuuugagaccagccuggucuacagagugagcugcaggagagccagggccacauagacacugucuugaaaaacaaaacaaaaaguauggccucuuuucucauuaauugucauuacauacauaucauagauauauccauuagaacuggacucuguagcucuacauuuugguugguugugguuuucugucugaugcaggaagaaauguccuuaauguggggugucuaacacauuucuuuacaauaaaaauuaacaaguauugcaguaccacaaagcuaaugcuacuuauacaacauugguuugauuauuuuuugugacuguccuuucauagcugcaguauuucuuccuauguucuuaaaacuucuuaaaauagauuuguccacguuuguauuuauguugaaacaguaacacaauguauacugucugauacuauuuuuaauuaaauuuuauauuaaauagcuuggcaacagcaugauguacaagaacugugccguguuauguuugaugcuuuggaacagaaauggaagcaaacagaacagguaaauucucucucucaagguaaagggacaaugugcuaagaaggcagauaggaucuuaaaauggcuuuuaauuuguuggauuuuuuuaagacgugggcaucagucugcuauaguuagaaguuaaauuccaacuauauggaacucucuuaaguuauugacugagucugaagcauuuucaucacaccacuacagaccuugguuucuucauuguccuaguuaugguuuguguugcugagaugaaacaccaugaccaaaagcaccuuggagacgaaagggauuauuugacuuaaacuuuuacaucauagucuaucauugaaggaagucaggacagaaacucaaacagggcaggaaccuggaggcaggagcuaauacagaggccauggaggaaugcugcuuacuggcuugcuccccguagauugcucagccugcucuuuuauagaauccaggagcaccagcccagggauggcaccaccuacaaugggcugggcccucccacaucgauuacuaauuaagaaaaugcccuacaagcuugccuacagcuagauauuacggaggcauuuucucaauugagguuccuuucucucugaugacccuagcuuguguggaguugauaugaaacuagcuagcacauucaucagcaaaauaauggaauuuggucuauaugagcaagaucuuuuuccacucaggaaaaagggaguguggauuuugaguaguuuuuccuucuuuuuuuuuuuaaauaaaugauaauuuguaccauauuauaaaguguauucauuaagcuuuauauucauuuugaugaucaaucagguguagucauaugcuuugacauuuaagguccuuauuuaucugaccuaacuaacugaguggcuugacucugggauuccauguggaugagaguauaauagagcagcccaggggugaaagaggaagagguccaaagguggcaggcacaaggaccugugauuggaauacugcgauggcuuggaagagaaucuuuuaaacaauaggugggacccauuuguacauuaugaagucaggccuauacccgaacuuuuaaaagaugaauagaaaauacauaagagaauuuauaaauaggaauaaguauuguuuuauaacuguugauuugcaaaaaaaaaaaaaaaaagguggggaaauaccagauuuuuuuuuuuuuuugacacuuguuugaaccaaaauucuauaugcagaagaccugacuggagcaggaaaaugaagaaagauccaucaagucaguuguauuagaguaggcagcuuuggugaaucuagucugaagguguguagaucuauccuggacauuucaaaagauguaaaauuaugaggaaggaaacuguuaguauguuuucucucugauuuguuuuuuacuuuuuuuuuaaagauuuguuuauuuauuauauguaaguacacuguaguugucuucagacacaccagaaaaggacgucagaucucauuacagagugagccaccaugugguugcugggauuuggacucaggaccuuuggaaaaguagucagugcucuuaaccacugagccaucucaccagcccgauuuguuuuuuacuugagaaauuauuaaaaaaaaaaacauuuaaacaaccuggugauuucucuguguaauccuaugggauugaguaauuuauauaaaugguauuaggggcuguuucuucuucauaggucugaaguuacccuuccuccuuguucacauuccucucugugagucagcacuucauuaagaucaguugaggcaucccuucugacuuccuaaaauuugauaacaagaaucuugagccagcauucgagaggcagaggcaggcagauuucugaguucaaggccagccuggucuacagagugaguuccaggacagucagggcuauacagagaaacccugucuccaaaaaaaacaaaaaacaaacaaacaaaagaaucuugaagcaagacauucauaugaagggucauuacuuagggaauuacuugccuacuuugagucagaagagcccuggcuggcugugagaaguaggugaaagaugcauucuuuuagaugaggauauuuugagggagauuaauucuaagguauuguuugaauuuucguaucuuaaccuucuuuaaauuauuuuaucuuuaguauuaaaauuuaaauuuuucuuugcccgaguuagcaguggaauuuuauaaaucagaauaaacugugagacuagugguguuuguguaaggcauucagaacacagacagcuccuuagcucuguaacaaccuaccugacuaguguggauuaggauccagucuaaagaaaaggaacauagugauugauaauugaugucauuaccaucuauuuuacuaccuaagaguuuuauugauuaagaguauugaaauaguuaauuauauacauuuugucuuaaauuaaugauaaucuaauuuuauuaauuucuuuuucaggugguuaguuuuucaauugucaacuuuguucccgaaauuuuagauauuuauuauauuggcuuucuaaaacuuuaguaggaaaaaaucaauaucauuuugugucucuuuuaauaccaaggaauuguauauugauauaacuuaaaauugcuuguaacaaggaacauuuuuuaaaguguggauguuguuuuuaggcugaucuuauaaaugagcuguaccaaggcaagcugaaagauuaugugaggugucuggaaugcgguuaugaaggcuggagaauugacacguaucuugauauuccacuggucauccgaccuuauggguccagccaagcguuugcuagugugguauguaccuuccagaugacuagauauuuacaaauaacacacacaccaaucuacacuuacauguuauguauacacauguacauacaacauugaugauuguguguucuguuuacuaagccacagaauuaaggauauguuagucagguuaaccuggaguuuuucagacaaguauaugaaguucuauuuaaaauuuuaguauuuuuucauuuaauuuaaaaugugugauauaguaauuaguuucauguuuaaguaaacaauaauauuuaagauuaaaacaucaagugagcaguuauccaaauuuaacaccuauaaucaucuuuuucuuuucuuuuuuuuuaauuuauuuauuuuauuggguauuuauuucauuuacauuuccaauacuaucccaaaagucccccacacgcucccccacccacucccccacccacccacucccacuucuuggcccugucguuccccuguacugaggcauauaaaguuugcacgaccaaugggccucucuuuccacugauggccgacuaggccaucuucugauucauaugcagcuagagacacgagcuccaggggguauugguuaguucauauuguuguuccaccuauaggguugcagaucccuuuagcuccuuggguacuuucucuagcuccuccauugggggcccugggauccauccaauagcugacugugagcauccacuucuguguuugcuaggccccggcauaaucucacaagagacagcucuaucuggguccuuucagcaaaaucuugcaucuuuuucauuuuaacauuucugaucaccucguaagauuuuuagcaugacuacagacuuagcaaucaaugcuaagaucucuuacaauuaagaaaggucuucucucauucauuauggaauuaucuuuuaauacuacaugucuucauuguauuuguaguaaccaguguucaagcacuuuucugcacuguagcuuguaggcacucauuuucacaagacucacuagauccucuuggaacccaaggaauuguauaccuguaauguuuuuuugaaagauagaagacauauuguaaauguuccagaaauuucuguaccagagaaauuuguuauaaguauuuuauuuguauuucuuucucuguggcacacuugauaauauuucaagguccauggagauucugaggaacauagauuguaagaucucuaauacggucuaggacaaauguaguggguuucccuuccuugccaagucuuuuaaauuauguuugaaccaaaauuauaaugcugucuaaugugauuuuuuuuuuuuaguacagguaaaagaaauauuuaagccaguugaucuauaaauggaauagggcauaagaccuuaggggcaguuggacacuguaauagaaguaauagaaggaugguguugauaaaccugauaacuaggacagugaucaaaaaaggaaaaggacccaagcauacucuagguacugcaguagaauuuuuuuaaauguuuaaguaauccuuggaaggcacaagaaagaaauaggaaugauaaccaaaauauauacaaaaaucugaaaauaguauggacaccuuagugacauguguguguauauaucagcugagaaacaguagauuuuuaaaacacaguccaauacuauguuguccagaaggaauuaugugcaugccuaugugagaugguggaaaguagugucauacaucagaagaaaucgggaguggcuguguauguuaggcagaugaggauaguuuuagaacauuuccauacuaucaagacauuaguaaacacauacauaucaacuaacagcuguaaagugcgugaaggaauagcuucuuuagaaaauacauacgaacuaauuuuuuucuaguuguaguuagagauuucaguauccuacuccuuugccaauucauagguaaaacaacuauacagaauggcaaagaaguuacagaagaauccaacagcaccaugauuugauugacaucaaauguuccauccaccugcaaaguacacauuuaaaugcccauaaaauauaguccagauaggccaaagcuugggcuguaaaaguacucuuaaauuuuuuaaucauauuaugugauuuccaacacagugaaguuggcauagauacuacuagcaaaaaaauaggaaaauaaccaaauaauuggaaucucaugugaaagaaaugaagagacuaaaggcuaaaagaacauuuacauaucauauaccagacaaaggaauaucuaaaacauauacaaaauuuuaaagcaucgaguuuuggguuuuuuuuuugggggggggggguugguugguuuguuuuuuuuuaauuucacaauccauuuagaaaauuagcaaaaggccaggcauugguggcauacaccuuuaauuccagcgcuugggaggcagagauaucucugaguucaaggacagccuguucuacaaaauaaguuccaggacagccagggcuacacuauaaaaccuugccucaaaaaagaaaaggaaaaaaaaagaagaagaaaauuagcaaaagacuuuaccagcaccagcauuuauuucauuagaggggauauucagaaauaaacaauaagcauggcuauuggucaaguagaaaaucucaauaggcauuuuaagaacuguuguaaaucagucuggcgguuccucaaaaaauuggacauagaacuaccagaagauccagcaguaccucuccugggcauauacucagaagauguuccaaacuauaauaaggacacaugcuccacuauguucauagcagccuuauuuauaauagucagaagcuggaaagaacccagaugucccuaaacagaggaauggauaagaaaaugugguacauuuacagaacagaguacuacucagcuauuaaaaacaaugaacuuaugaaauucuuaggcagauggauggaucugcaggauaucauccugugugagguaacccagucacaaaauaacacacaugauaugcacucacugauaaguagguauuagcccagaaacuuaaaauacccaagauaaaauuugcaaaacacaugaaacucaagaagaaggaagaccaaaguguggauacuucgucccuccuuagaauggggaacaaaauacccauggaaggaguuacagagacaaaguucagagcugagacagaaggaagggccauccagagacugucccacccggcgauccaucccauaaacaaccaccaaacccagacacuaucgcauaugccagcaagauuuugcugacaagacccugauauagcuuucucuugugaggcuaugccagugcuuggcaaauacagaaguggaugcuuacagucagcuauuggauggaacacagggcccccaauggaggagcuagagaaaguacccaaggagcuaaagggaucugcaacccuauagguggaacaacaauaugaacuaaccaguaccccccagagcuugugucucuaguagcagaggauggccuaguuggccaucaaugggaggagaggcccuuggucuuucgaagauuauaugcuccaguauagaggaaugccagggccaggaagugggaauggguggguuggggagcagggcggggggaggguauaggggacuuuugggauagcauuugaaauguaauaaaaaaauaucuaauaaaaacaaaaacaagaauuaaucaggcaaagaagggcuaaaaaaaaaaaccaacuguuguaauugagugaaaaaugaaauuauaacaucagauuuuaagacacaggugaaacaauuuugaaaagaaaacugaacacugaauaguccuuuuaaaaguaaauuucaagucaauaaucuguacuaaauuauaaugacccuaauaauaaccuaacuucuuaaaaggaaaguggaagauacccaauaaaagcaauuauauaaaagagcagaaagcaguggaaaaaaauaaauagggguguagagauaaucgguaaagcauuuuauucuuuaaaaacaguagguuuuaaaauacagcaagacagaaaaagagaggacaaaaauuccaagcauuggggaugaaaaaagaugcuacacaacacaaacugcaacuccucaccaagugcagauuagguucuuucaauaacccugcgcccagugaacuacuuaacuccacaacugaaacauuuuggaaaagaaaauuuucaggucugaauuguuucacaggacacuuguacuaaacauuuuaagaacaaaauaugaauucaaaauagucuuuucuuagaaagaaagaaggguucuucccuguuuguuuuguagagccuugauguccagguugucuuaagcagugguguuugcucucagcaguuuguucacugugaguucugccuaacucaguuaagcaugaggagcaaggacgaagcugaccuguuccugguuuuuaauauacaugaucauauagaaaauccuaagacagauuuaaaacaagcagauaacaagguaauaggauaggcuauaagaaaaacauucgaaacucauuauauuucaggguccaagcaaugaauaggugaaaaugaaauuuaaaauagaggacugaagaaaguacaagugcaaaugagaagacaacaguaacaaaauaguaauucagaauggacauacacuucaauauaaaauauguaaagcuuuaguaaaaacaaaaucauauaaaucuagacaucagaagagcuguaaugucaaaaauauaacucacaaaauuaaaaguauuuacuccugaaauagaauauuugugcaucauauaucugacaaaggaauauuuaaaauauauaauuucaagccaucaguuuuauuuuuuaaucucacaguccauuuagaaaauuggcaaaagauacuaccagcauuucaucagauuaggcagucauaugccagaaucaaaaaagacauuuuuagucaacuagcuacaggaaauguagguuuuacaaugaagaucuuucuuccugccccuggaacaguuaacaguacaaaucaugacaguggcugcgcuaguaaaguguuagccgugcaagcuugagaagcugauuuuccaucccagagcucacauagaaguugagcauagagaugcaugccaguacuuaaagugcuggggagauggagaaaggaaguuaacuuauguuuacuagcaagaugccuaagguuugcuagcuggccagauuggguggacugauggucaguaagagacccuguuucuaaaaauaaggugaagaacgauugaggaagacuuacaacauugacuuuuaacuucaguauacagauagaugccuauacacauacacaaauacauacauucacacacacaaaauaguuauagaacuuaaaacucacaaugcagagaaacuggguuacauugcuguauaauuguaaacauuacagauuaucuuuaugaaacugaauauggaauuaaaacaagucccaguaauuguauucugggccauuuaucuaaaagaaguaaauuuauaugccuauaaaaacuuauacauuaauauugguugcauuuuuauuuuuaauauuaaaaaauaaguaagauaagauuugccuuuacaaguaaaugauugaacaaauucuaauauguguaagcuguagauacaaugagcaguaauuggaaugaauggaggaaaugaacauggauggaagaaagccagucacaaaaguuggcauacugucugauuucauuugcauaaacuuggucauguaaauauuuuuuaugaauacauuuuagaauugcaccacuguuggucauuacuagaguuacugaauuuggucaauuccuaucuuuuauauagaaacuauuuaaugccuuggcuauccugugguaaagaggacccaauucagauaauaaauacacagaacuaacuuaauaaacagacuggggcaaacagugauuugagaauguuugaaugaaggaguaucauguuagugaccccaucaccauuaugauguucuauaguuugcaaaauaucauuuuuaggaagcagagcaauguauacagaguaucucuggguaauaucaauucuugcaaguaugugcaaauuuauaauuaucuuagaaaugaaaaugaaaacaagaugaaugaauggcuuagauaaagauaucuugaauucuuucccugacucagagcagagagucucauggagaugccugaauauagcuguuuguaaggaggcguguugcauugcugcugugugucacuaacaauaauugcucacagcaccagagaugcaggagauagugcucaguguguuguuccaguucuuauuauuuauaaagccuagaaauacugguuucccuauucuaaacaaagcaaaugcuaaauagugaagaaaaauggaucuguggagaauacgacaauauuguauaggccaacaaugagagcaugagaggagaauacagcuaggccaucacugagaagaugggguccgggcuauguuccuucugguugcacuugugccuagauuaugugcuauaaaauuguaaugauccuggcuuuauauuugcuaaccuaagaauguaagacucuccuuguucuacuuugacuucugaaaaauacacucuacaacuauaugagcaguuaaacuguucauagugugugagggaggggauggcccacguuaaagcaaagcucgucacccuagaaugauaaagucacaguuuggagcuaauuuagaagcuuaauuuguuaauagcuuaacauaucaaacuguagcuuaccagaagcaguccuuuucuguucugugugcuaacaacagcaugguauugguaauguucugucccuuucauagcucaggaccuaccuacuuucuaaagaucaggacuuuuccuuucuauagcauucagucuaacaccacaguguaaaagucaguaagaaauuagguagaagucggguggugguggcacacgccuuuaaugccagccagcacuugggaggcagaggcaggcagaucucuuugaguuccaggaccgcccaagcuacuuaauaaaauccugccuugaaaaacuuauuuaaaaaaaaaaaaaaaguaaaagugguugcaauauaaaauagugaccaaggcaauuuuuaugaagaaugaaauaacauaauuuuguuagaacuuuuaaugauaauuauaaugauacuuugcugcuaauuuuguucuaaucauuuuauucauaccaguuuuggugauuucaguuacaguuuuaacauuaagcaguguuuuaaauaauuguaaaacaauuacuuuuuuuucaaacuaggaagaagcguugcaugcauuuauucaaccagagaucuuggauggcccaaaucaauauuuuugugaacguuguaagaagaagugugaugcucggaagguaagagacuuguaaauauauuacuuugucuaagaugauauucaguauucuguccauuugucccccuaaccucacuugccucuuuuuagggccuucgguuuuugcauuuccccuaucugcugaccuuacaguugaaaagguuugauuuugauuauacaaccaugcauagaauuaaacugaaugaucgaaugucauuuccggaggagcuggauaugagcacauuuauugauauugaagaugagguaaauacuacauuuccuuguuaugcuuuucauuauacacuuuauauuuuuauuuuaauuuuuuaaaauuacuuuagguauaugaguguuuugccugaauaucuguguuacaugugugcgugaugcccuuuaggccagaagagggcgucggaucccuugaaauuagaauuugagacaguugugaggcacuauaugggcuaggaaucaagccccaggccucugggaaagcagccaguuuucuuaccacugcgcuaucuuuccagccccuauuuauuuugagaagaguugugugacgugaguuaagacugauauauuuaaagugugcucuugaugaaagcuuucuccuuucucauuuuccauuagcuuaccacaugagauuauugcuguggcuaaaaacuuuuccugaaacuguacauuucaaguauucuuauuuggucagaauagcauaagcucuuuaagagacaaaaggguuucaccucugggauucucucuugauuuuggauaacagucuuguuucauaguuucuuuauuaaugaaacuauauuauagcuggauuucugaucuuuaauacacauggugcaaauguaugagugaaugaacaaguaauauauaaccuuacugucuucuguuugugccaauacucuucgagaauuaagguacugguuaccaccacauaaguuuucuagcucuuaaacgaaguuacaaaaacaaauauacuagagguuuuaucuauuacucuuugauucuauauuuuguuuuaacuuggaacuuucaauaguuuauacauggaauuuugaugaaugcaggaaagguucauccguuucuuucuauucauugaccuccaaggguuuucuagcuuuauuuaaugugugugugugugugugugugugugugaugcucuccugauugcauugugugaacuauuuccaaucagaaaggguaguuguuacaggaugauaaauccuuguugcuguaaaaguuuuguguguuguuuuccugauugaaacugaauacuaguuguaaaaucucuuucuuccagggguucaaauacaaguguaaauggucaucaaguuucauuuaguauuugucuuaguuaagguuacuguugugauaaaacaccaaaggcaaguuugggaggaaaggguuuauuuggcuuaagcuuugacaaacuguucauuauugaagagaaucagggcagaaaccuggaggcaggagcugguacagagaucagaggggagcgcuucucacuggcuuguucaucuuggcuugcucagccugcuuucuuauagagcccagaaccaccagccaaggaauggcacugcuuggcucuccuacaggcuugacuacagcuugaucuuauggaaacauuuucucaauagagacucccuccucucugaugacuauagcaugugucaaaugacauaaaacuaaccaacauaguauuugugugagcaugaugaaaacaauguuuacugcaccucagcuguguugucccaguguugguagagaggagcuuccaucuuuguccugacagucuuuaacugcuucacuuguucuccaccugguccuuacaugucaccauuuagugcuagaaagcaccagagauaauaugccuuuauauuugguacauccuaguaaaucucuaaacuuuggcucucauuuuucugucuagcuauuguaagaagcugcuauaacugcaguggauauucacugaauggcagcugaugagcauuuguaaagaacugauaaaguagcggaucaggcuggauguguacacauguacggagagagacagagagggaauaacaagauuggauugugcuuaauuaaaguuaggaaaucuguugaacuugaaaagagauauucuucaucaaauuccuauuuaaauguagaugaagaucuggucuguguuuguauauuccugacauauuuguugugaagggaaaccuaucccaggggaaagaaauacagacuuugcuuguuuguuuggaauuuggggacuuuuuuuuuuuuuuuaaucuguuugguugguuuuguuuugcuuuuuugaaacagagucuuguuuauggcuggccugaaaugagcaguccuuaugccucugcaucccagaugcugggguugcaggugugugccuccaugcuuagcuugcaguucugggggugauuuuucaccuucauuuugucuugaaucaaauguccucacaggaagaagacuguacugagaacuagaggauaugcuuagaaaauguuauuacaaccaacaaaagcuauucuuguugaguauuacuuggugguuucaugaccuugagcuuacuuauguacaucaaagacuuucaucuuaaagaaaucuaaauuuauauuaauaaaaacauuguaggaaugugaaucaauuauaaaaggaaaggagaagaaaauuguuuggaguuuauaacaaguagaauucuucagcuuaagucucgguggcugugaguugaaagcagucaggcauaaaagugugauaucccugcacugaguacagcagacuccaaaguucucagggacaauggaugacuuaguucuucuuuuguaacccuuugcacaguaaucaagagaauguuuuguugggauugggaauaaaugauucuguuuggggcuuagcauaguugcugucuuaaauguugcagauggacugucuuaaauguugcugaggaaaauauuaauuuuucuauuguuacuucguagcaguaaucauaaaugggguuuaauauaauugagaauuacuauuugcaguauuaaaauuuuaugaacuguagaaauaguuuuagaguguaauuuuuuaguuguuaaacuuaaggucugaauuuaaaagaaaacaaauuuacuuaaaauaaaugcuucucuuaaucagaacgugguaaacugugagaacaugguaaaaaaaaaaacauaggaauaucuuuuccuuuauuuggcuuaagauguuaagauaacuuugucuuauuagaaaucuccucagacugaaaguugcacugauaguggagcagaaaaugaaggcaguugccacagcgaccagaugaguaaugauuucuccacggaugaugcuguugaugaagggauaugccuggagagcaguagugggagugagaagauuucaaaaccuggccuggaaaagguaccuuugaugauguuucuugguacugggcgcugagcaugcuaagcaaaugguccaccagagagcucuaccccuaguuccugcaugcuuuagcuaagauagaggauauaguaauuuuugaacuucaguauuauuuugugcuucguuuuuuauaaugaagacuuuuaacuguuuuugugcugaauacucauaauuguauuugggaaacacuacuugauacuucccaugaguguguacuguguugaaaauuguaccauguuagaaugggugcuaccucuccaaauccuuugucuucacugaguuugcucauagaggaaaauaagaguguugggcuugaucuguugcauuuuaagaauucuaacaguugugcccuucugaaacauuuaauaaaagagcuggccuugagucaagggaagccaaauccuugguugacuaugaugcucuuuuuaaaauuaugaucuggaaaccaaagaacuagaugucugggggguaggauuuuuuuucacuguaucagugauuuuaagggguuuuguuuguuuguuuuguuuuugcugguuucuuuuuuacuaagccauucuuuuaaagucauguaaacugcuuuauuaaaaggauaauuccuauuuuaaaaaagcucuugagcauagcauaaguaauaaaucauuaacuuuucucaagucacagaaucauuaaauauaaagauuuggagcaauauuuaagaaugaaguauuauagcaugaaucuauuuuuagaucagggccucucuucucaccaucaucuccacuauucuugacguuuuaaaguuaccaccucaauucagggaagagagcugaguggggauugcuaugcagugaauaaugcagcagauacauuacaacuccuuaugagacaucaaguugccaugagcccaguguagcuccaccuggccuauuguuauguguagauaaucauguuaucugcuaauaaagacagcuuggucucuucauucugauauggaugccuuuucuucauccugucugaguguccuugucaagauguccaguucaguacugaauaaggugacauccuugcuuugucccuaccuuagggacaugcuucaguguaacuguuaguaaacuauuguaccugaaaucccuugcuucucuguauaggcagaguugccuuuuacuaguaaugugauaccuauaauucuaguuuugaaagugauucaggucuacaaauauacuuaucuagaacuugcaaccucaaaauuuuucagaaauauaauuggggguagaauugcuaauuacaguaaaacuuaaaaauguguugcuaguagccaguugacaaaugccuagaaucccaguacuuggguaaaagagacaguaguaucucuuugaauaacaaguuccaaccagcaguuacuacugaguaagcccuguuucaaaaaauaauaaaugauguucuuagcacaaauucuagaugguagguaaauuuugaaaccugccugucauuacuuugauuaacuuuaguuuuggcaauaaaauuugaacuacucaaguuuucagaauuuguucuagaaguuucauuauguaauaauuauagucaguuuaaaguuaaggcaaacugagaugugcugauauuugauuuuguuggaaggucccaguauuuucuaagcaaagaauaaaggaaguaaguauauuuacuagcaugccugauuuguucccuggugcuacaaaacgaagaaagagcuucuucagaaaagugaaugagaucuaacaggccuauacaguagugucccagauguaggauaaaagucagagaauuggcugcaaguuugaggcuagucuggucuaacauagcuuguuccaguccagaaaggauugcaaagcaagacccucucuugcuuaaaacuuaaaaaaaacaaaaaacuuugcagaaucuacuuaugacaaagggucuuucuaaccuucugugucauaaccuuuccuaaagacuauauuucuuuuucuuuuaaaaauuauuuuauuugauguauauggauguuuucccuccaugucuacaccauguauauaccugguacccucaaagacugagaaggaugucuagaguuaaagacaguugugagcugcucugugagugcugggaacugaaucuagguccucuggaaaagcagcccuugcucuuccaaugagccaucuccagcccugggaacucuuauuuuuauucacuccagguagagauggcggagacagaccagagaaaggaucccauccaauuccagcuuggugaaccagugaguuuauugcacuucuuuaauggagcaugaugacucuuaugcugcucugucaccaaaaaguccacucuagcaugggguagcaaguuaaaagagucuccuuucucagcaccugguuacuacuguuuauauaaccugaaccucucaguugauaacauucuuguguuuggaggugguuguggaguuuucaagaaguauauguaugucuuaauuagaguuuccauugcugugaaaagacaccaugaccauggcaucucuuauaaagaaaaacauuucacuggggcuggcuuacaguuucagagguuuaguccauugucauucugggaagcaugguggcaugcaggcagacauugacuggaaaaguagcugagaguucucuaucuggauccgcagggagcaggaagaaacaaucaaacuaggacugauuugagcauuuguaaccuccaagaccacccccaaugacacacuuucuucaacaaagucacaacuacuccaacaaggccacaccuccuaauagugccagucugucugucugucugucugucugucucugucugucugucucucucucucucucucucucucucucucucucucucucucucucuuuuucucucucucugugugugugugugugauguauguauaugcacugugugcaugccugauaccuauggaccccagaagagggugguugugagcuauagugugggugcugagaaccaaaauccucugcaagagccucaagugcucuauaaccucaccucagaccugucucucuagccucucuugugaguucgauauaagccuucuaugcuauuauaucuuuaucucuauuauguauuguuuguuuguuugugauuuuugaaacaaugucucuuuauaguccagacuggccuugaauucucaacuguuguccugcucuagccucuuaagugcuaagaucaggccugagucugguggcuuucuauugauuuuagagguaaaaguacugguugcuagggucucuaguacuacuaauuguuuuaggaggugugaagugccaaagcuuccuaaagaaaaaguaauucaagcuaguguggaggcacaugucuuaauaauucuagcacuuggaaggcaagucuagaagagccaaaaguuuggggccuauccuaggcgacauaguggaucaaagcuaccugagcaacuuauacccuauaggcauauagccacacacuagaacacuugccucgcaucuaugaguucaaucucuacuaccaacaaaagaguaaagaaaaagagaaaaaguucuuaguguauuauagaaagcaucaggcguguucagagcagaacagcaauaaacugauuuauuauuacagaaauagcaacaguucugcauuuguggggagagguguggguggguaugcugagacaauggcucuucuauggagacuugucuauccuaaaauucacucuauggacuaggcuagucuuaaacucacagaguuaugucaguuucugccucccaggugcuauaauuuaaacuguaagccaccaugccuggcuugaauugauuauuaauauaaauaauagaugccagauuaauaugcuacauaucaaaaauacugcaugaguacuuuagaagauacuucaaauuagugucagaaauaaaauuuuauuuaaugggaaaaaagcaauguguuggugauuucuuucuugcuugcuugcuuuuguuuuuuuuugagacaggguuucucuauuuaaccuuggcuguccuggaauucacucuguagaccaagcugaccucaaacucagagauccaccugccucuaccucccaagugcagggaugaaaggcagugugcaccaccauugcuuggcugauaauuucuugaucuagacuauacauauuaaaacaaccuucuauuuaguacguacuucacaaaauugcagacuaauauuuuucauaaauaaucaagcauauguucauagacagauacaguuccaaagaucacaagacaucgcaauacaaauaugaaggaugaaagugucacacacuaauaagguuuuuggugacuuaccauuuuaauguuaccuaaggggcaaguuagcuuacaacagauagcugucauguuacguuacucuguauccacaggaaauagaguuucaaauaaggguuuauuacagucuucucuuccaaacuuuuucuucucucuuuagaacucccugauguaugagcucuucucagugauggugcauucagggagugcugcuggaggacacuauuaugcuugcauaaagucuuucagugacgaucaaugguacaguuucaaugaccaacaugugagcaggguaaggcuccugaaguggagaaguuaacucagugucaggugggguuuauucagagccgagauaccuauggugguaugucucaaguucccauugaacaagccuuuuucauuguuaguagugucuuuguucugcuuuguagagcuuguuacauguuuccaaaauagacuacccuuuccucuagcccuuagccuuccuuaugauugauguggugcuaggagucuugagccugauucaccagagcagccacugauaaacucugaauuaucaguaugauccuucauggaaauggcaugacacaucuaacucagacacuaagagguuggauuaaaguugggcuuagugauucacccccacaguuucuaguacugggaaggucguaacagaggauuguucaagcccagcccaggcuacauauuaagaaccugucucaggcccagggggaacuauuaaguuacauauuuacauaauaaccuuuguguuacugguuuuuacaaaaaaaaaaaaaaguaacauuacaacuuuuuagauaacacaagaagacauuaagaagacacauggugggucuucaggaagcagaggcuacuacuccagugcuuuugcaagguaagcaauagcaugaacuucaguguuggcucacuagaguaaguuuagcuucucugugggucuuacuaagaaagccuuacccaagggucagcagacugcaggccauggacaucuguucauaaguuuuuggcugauguuuucccacuguaacauaccuugaguugcaguacagaccaucugaccuacaaaaaaugaggguuuaauuugguuugguguguugugguauaguaugguuuggguuuuuugaggcaugguuucucuguagccuugacuacccuggaacucucucuguagacuaggcuggccuugaacacacauagaucugccugucucugccuccugggugcugggauuaaaggugugugccaccaccaaucagcaagacuaagggguuuuuuuucuugcuucuuuccagcaaagcaguuugcccaacccuuacuuagcuguaguaggcauugugacacacacccuacuuuauuaaacuucaucauguuaccaaaaggaauguuugaaccuucucauacaugugccauuaaugacaaaaaaggguuuuccuuuuuuucuggaaugcuuuaguauuagugugucagugaauggugguaugacuuuuuuucaaauaaagauuuggugcuuauaaauaaaagguacugucuacuuuaaaggaccugcuaaucuuuguuaauuucuccuagcucaacaaaugcauauaugcugauauacagacugaaggauccaacaagaaaugcaaguauguuagucuugaaaacacagauaacugcuuuuaggugauagaaaaguuaacaccuaagaauuuuguuaugccugggaaagugaauuaaaaacacuguuaugaaguaauacuaagugauaaaaacauuuuacaaaaaucuauagaucuggacauagugauaagugcuuguaauucuaguuacuuagagaagaaggcugaaugaggcggaggcgggggugggguuacaauccugaggccuacugacaguuuaacaggaucuugucucaaaaauaguaauuuuaaagaagccaaggcuauagcucagugauagaguucuuaguuaacauucauaagucccagaguucugauaaccaguacugcacauaggcaggcaugcagucacacacaagcacacccacacacagacaaacguuguuggaaaacuuuuaacagauuagguauuacuuuaagcuaauacccugugcagcaucacaguucacaagcuguguguacuagagcaaaucacuugacuuuucugagucuuugcagauuuguagacuggaaaugaugacacccuguaggguuguaauacaugaauggaagcacauguuagggucuugcagcauagccaguaugcuuguuucaguuucaagcuuucgggucuuuuaguaucuacaaaguuugagaggacuccagauggccugaaguacugcagaaauuguuuaaagauccaauacauuuuugugaaucuaguaaaaaaaaaaaauuguuauauuuuauuaagaaacccagggugggcagcaagauggcucaacugguauaagaugcuguugccaagccccauggccugauuucaaugcccagaaccuucagagcugcccacugaccucccaaaauaauccuuaguguuaaguguguuuguccuuuucuuuauauuuuugaauguuacuacuuuaaauuuuuaguugggggggggguccuugcuaauucuuacugauucacaguauugcaaacauguuaggauguguguauguuuguaucuagacacauacacagaugaugaguuauccuauauucuuuuuauaauucaaauaaucacugacuuugauccuagcauauuuauuuuuaguagcagaugugcucauauaucuguuucaaccauuauauauuuuuuucucauuuucaugaacaaaaguuggauuguggccucaccaguguauguuucaggaccuguaguaguuuggcuuagaggcacaacuaggguuguaauccacgcauccuguggaucuugcccuugaagcgcagugcuucagccccucuuggcuaacuaauccacucugguucuguggcaaacaccagggggcgcuguguuaccagacugggaaugcuuuguagcuacuugauugcaggaagguguauacagcagugaggguuaagggaaguguggugggagggcggguguuguuuagacuggaguugauuucuggaaacauugcauuuuuacucuuuaccaguccuauugaugaauaauacugauagucauuguuuuccuuaaaaaucaaacagucauuggcuuuauucaaguguccugauuucauauuguuuugaauaugcuuuuaagucacaugaaacugugcccaguucugugccucugccuucuuuuguuagaaggcagcugaagagcugcauugaggaggaagggaagguagugaugcuguagugaugcuguagugaguguagugacaguuucaggaguaaacauuuacucaauuguauuacaccaaaggcaauaaccuuugggccaggggcuuuuaauaaauguaaggagcugagggcugaaguaaaguugcccagggccacagaguuccuuggugaauuugaaauaaaaaaugacuuguaaguuuccaaggcuuuuaaaaauuuugguaucuuuguuggguucuaggauuugagccauuuacuagaucugaauauggucucacuaucaguaccucuucacuauugccugaaagaaugucucugcuccacauugaaaggaagcacuguagaacaaaaaguguacaggaaacugcucugagugacacuguuuuauguuccuagaguuucuagaaguggacgaguacccagaacacauuaagaaucuggugcagaaggagagagagcuggaagagcaggaaaagaggcaacgagagauugaacgcaacacgugcaagguuugauuccauguuugugagugacaacugcugcucagguuugcucuucugaccacugucguucuggggauaacucagucaguucuguggucauuaaucagguaguguggcuucaucacaaggagaagugugauuugauacugaaaccuagugauguguagcauggugggcggucaauguuucugcagcagugugaggcaggcauucccauauccugaguacaggaggacugggaaacauagaaauagaggcauacuucaguuacuguccuuuuacccucacuguucucuuguaaaccuuacacaggacuagggacaugcucagaaguuaaaggcacuggcugcuccucuagaggaccuggcuucaauucccagaacccacaugacaguucacaaccaccuuuaacuccaguuucaaggaaucugacauccuuucuggacuucaggggcaccaggcacacacguggugcagauagacaugcacgcaagcaaagcaccuauacacauuaauuuuuuuuaaguauauucaaaacuuaauauucuuggagauaauuucucuuagagagauaaccuugugaaauucuugcagauauuauaaaaauuuugagaagcauauuaaucagucuuuuccaaauuagaaaaaaaaacauaaauaaaaaaauugcuuacauauaauuauaugguuauugaaaguaauguuuugaguuuuuuaagacauaagacuuaaucacugucaaucaguuacaaauacagacaguaagaaaaaauagucucaacuauguuuuuugguuuuuaauuacauuguuuugacaaugaagaaaagugcuaucugccaaaggauucagcugagacacuugaucuagugaguugauggugguauuuucuguuuuguagauaaaauuauuuuguuugcauccugugaaacaaguaaugauggaaaacaagcuggagguucauaaggauaagacgcuaaaggaagccguugaaauggcuuauaagguuaguggaugguuggacuuaauuuugguaccaccaaagcuuuauaguuggaauagaugauuuaaguaccuugaaguuaacuguucaucuuccuccguccuccaacuguucuuugaacuauacucaguugauuuugaaaacuagucugccuucugaauccugaaauuagaauuagaaacacauuuauuuguuucuuucuguuuauuuagcagguaucuauugaguaccuucuguaugagccauuagagauaacagagggaagacggucuuggccucauggaauuuauaauccauuaggaaaaauuuuuauggugguuugcaauuauuuuauuguuuagguaucauaauauaaaucaguaguaauuuaagauaauuuauccuacaacuauaaacaugauaaggacacaacugugucauuguauaguuuguuauuuuaggacugaugaaaaguguuaauuaaauauauuuaagccaggcauggcugcucauacccuguaauaguguuugagagguggaagcaagaagaucaaguguucaagguccucuucuuuugcauaguggauucagggucagccuggguuacaugugguucuuucucaaaacaagcaaacaaacaaacacaaaacuauuuuuauuuugugggggauuauguuuuguuagaugauggauuuagaagaugugauucccuuggauugcugucgccugguaaaauaugacgaguuucaugauuaccuggaacgaucguaugagggagaagaagauacaccaaugggguugcuucuaggaggagucaaguccacauacauguuugaucugcuguuggaaacgagaaagccugaucaaauuuuucagucuuacaaaccuggagguaagcaauuuuauacucaaguuauaauggacuuuaaauuauuguaaucaaagaucaaauacuuuguucauagaagcaaaugaucuaaauuuuuuauauguucuuaaagugugcuuaguuuugauagguugagaaguagucagcaauuaauuugaaauuaaguuccagcuuuugcuggguuuguuggcacgugcugugauuucauuaguggggaggcacaucuuaaguucaaaugaacacguuuuuaagaccuugucuauacacagaacuuaaauaaugaacaacagcaacaagaaaacaccucucagucuucaguaggguuccaauguggagugccugucagauguuguaaaaugccuuagugaucaauucagcucccaaggguaucucugccaccaucuccuccucuuucucccuucucucuccuauuccuuauggaagccaaacacuuccuugcuuuguacagcucugcuguacaaaguauauuaaguauacucaccucacaagaaauuugccugucauuucugaaaccuugguggugcuuguguuagccagacucuguacucuguguagagucccauuaagagauuuuuccaaaugggguauuaaaaaagauaacaauaauuaaauacaugaaucaguaguaaaaccaauuucuaaaacaugaugaggucaucaagaugacucauagaaagagagaaccaauucuaacaaguguucucucguguguguaugugugugugugugugugugugugugugugugugugugugugugugagagagagagagagagagagagagagagagaaugugugugauauauaaccccucaauacaaaauaaauaaauauuaaaaaaagguuuuaaauagacuuuaaauacgaugauguauauuaauauuuaaggagucauuucuauuauuaaucaucaagaucuuauacuauuuugucauuuaagugagcagcauaaggggaaaauugagaauugacaauaaaacaaaauaacugcuaaauggaauacuuggcggcuguuucuuuuucaagugacuaaaauuuaguuauaaauaugaucuaaaagugaaagaaaaucagacaaacuauacugguuugggcauagaauuuuccauggaauuugagguauguuuuuuaaggagagcaguaaagucaugaauggcuuaauggggguguuuauaagcagucaggccucugucuuccccauuaguacuuauuuugcaaccucuacuuccauguaugcuuucagugcugugguuugguuucuauuuggaucuguuugcauaaaaaauauuuuacauuugauucuaagcagaagacuaagaaauaucugaauugaauuuuuaauauguguaauaaagcauagagugcagaagucaaaaguaauguuggauguaauauaugccuacuauauugaauaaugagagcauacucucuuugccaucuauuagaaacacacuuagaauguacuacucauguaaaauacaguuuuaaaaaauuaaccuacagcuacauuuuuauguuuuucaaugcaauagaagugauggugaaaguucauguuguugaucugaaagcagagacugucgcugcuccuguaacagugcgugcguauuuaaaucagacaguuacagaguuuaaacagcugaucucaaagguaagcgguaaaauuagaccaugaacaucuuugaguucuugcugcaugcacagaucacugugguaguuucaaguuguaaguuuucucuuaaaggggcaauauuuauaggcagaacacaacugaaauagaagggacacuucaaguaaaagaaacagacugagcagcuuugaguagcauuaaccuagacuauaauuugaacuagguuucugugaaacauacacuagggguuugaauuguuuguuuaauagaagggcuuugaacacuaacgggacccucauugguauagcauuaaauagacccuuuguuuuuuauauaaaugcuguagugguguaucagaugugugcuauagaauggaaaguaaguccagugacacuaaacugguauucaaggugcauggaggcuggguuugggguggcucugaggaagcugcuuaaaucauuuggggaaaggcauauggccaagaagcagauaccuccaggcugugguugcuauguuucaaaggaagacagaaguacagugaauuguuuguguuuauuauuuuacuuuguaggcagggucuuacuguauugugcuggcuggccucaaacucauguagaccaggcuagucuugaacucauaaauuauaccugccugccuccaccuccugggugcugggauuaaaggugugcaccaucacacccagcccuaaaauuuuuuuuuaauuacauuuauuuauuuugugguaugugugcuugcacucuggcuuaguggcauguuaauugcagcagugagguggggaagcaaacuugacaggaaaaaaguaauggauuaaauagugacucagaauauaggccagugcugaauguuugaguuggaaugagauggugaaaacauuuggaucucuuugaacaaauggacuggaccgucugagacaaaugacuguucccuuucaaguaucccacacuguguaccuuaagcgcacacacagguaauuuuucagccuuccuugcuguccagugacugcaaguuuaaaaaguucgaaguucuguugucaccccucugccuuaucuuauagcucaauaucuggggauuuuaauuccugugaaacaggguuguugugaccaucaguaaauguucuaguugugagagaucuugugaggucugucaggguugguggcuguuacuguguuuaagcaauaaccacuaagagauuuccaucacuguugccaguuacaacaucagaagacaaaucauaaugugcuauauaguuaguacaugauggcuaacuugugcacacaugcauaccaggugaucaccuggcucuauacauuuaaaauaagugccacgugcaaacauucaguccaaugcaaaauauaagcacugagcuuggauuuuuuaaaaaauuaaaaagaagacagacagcauauuagcccacugugaugaagcuaaugacacuccuuggggaaauggcuuaaagagcaagugcagucagaguuuugucauaagcaaaaagccuugaagguuagaaaguguuacucuguuccaguuuauagcauaaauauggagaugacuaagaauuuuuccuuugaguaaccaaaaauuguuaaaucuccacuuaaaauuauuuuccucugacaguucuucugagggcucaggguggguauuaggacuggcaucuaggguccugcucuccucaacuuuaaggaacucagcaugucuucugaagugucugaauccagguagaauucuuuugggaagcacucuauccugacacucucauugcaggccacgcacuuaccugcagacuccaugaggauagugcuggagcgcugcuacaaugaccugcgccuucucagcaugcccagcaagacccugaaggcugagggcuucuucagaaguaacaagguaugucuuuuaucuugucauugugucuucucugcugguaaccaauggaguaaagcugagguuuuauuguaagccuggcuacaaccaguacugucccaucugccugucuuucagugcacacagccuccccaaauuuccuuccuuuguccuccagucugccugacucagccuugcugcugcuccuuugaccucugcccaggagcacuuuuuccuguuuccccucccuuuagcugucaaacucugguauaauccaccuuucugagacuuggugauugagucucucuccucagugacugucuuccuaauuuucauguuugaguucccugcuaagacaguccuucacaccaagucaaaacuguacuuacgagacucucccacccuuguccccuuugccugcucuguuuaccaucuuuagcauggcuuguaucaucuuguugacuaucuucuauuaucacacuuuccagucguucauuuugguguaucuacacuuaacacauguaaucuucuuacuaucauuuuauuaauucuguauuuucuuauaguguguauguguuauuaaaaugcaaucuguggacuggcaagagcacucaucagauaagagaugcuuguagccaagccugacaaccuaaauuugauccaauggacauauaugacagagagagaauugacuaccucaaguuuuuucugaacucugcauguguuccacacacccauacacauauacacacucgugugcacaauaaaacauuuaaaucauaauaaugauaauuugggguaaaaagcgccagaaugcuccuuucccccacuuuuuuccuuaaaugguuaauagccugaauuuguaacauuaauuaaauaguaauagcuuuuuaugcaaaacacaacauacuguuaauuauugucaaaucuaucaauuauuguuuugcuuuguuuguuuguuggauacagugucuuguauuugcccuuagcuggccuugaacucaucucauaauccaggcuagccugugacaauuguccugccucuauucuccaacuacugagaucagaugccuggucaaauuuauucauaaugucacagauauuauaauaugcuguauacugucuuuuauugguaagaugugcuuaugaagaauaagaaugcuacuaacauagugcggaguguaacucugucauuuacuguuuagguguuuguugaaagcucugagacaguggaucaccaggcagccuuuacagacucccacuuguggaaacuccuggaucgacaugcaaauacaauccgguuauuuguuuugcugccugaacaaucuccaggaucauauucgaaaaggacagcauaccagaaagcuggaggugauucugguaauguggacgaugauugugaaagagucaaaggaccugcagggaauuuaaagucuguggaugcuauucuagaagagagcacugaaaaacugaaaagcuugucacugcagcagcagcagcaagauggggacaacggagacagcagcaaaagcacugagacaagugacuuugaaaauauugaauccccucucaaugagaggggcucuuccaccucuguggauaaucgagaacuugaacagcacauucagacuucugacccagaaaacuuucagucugaggaacgcucggacucagaugugaauaaugaccggaguacaaguucgguagacagugauauucuuagcuccagucacagcagugacacuuugugcaaugcagacagcgcucagauuccucuggccaauggacuugacucucacaguaucacaaguaguagaagaacuaaagcaaacgaggggaaaaaggagaccugggacacagcugaagaagacucugggacugacagugaauaugacgagaguggcaagagcaggggggacaugcaguacauguacuucaaagcugaccccuacacugcggaugaaggcucuggggaaggacacaaauguauguacuugagaggaaggcucuuugaaacagugucaguguguuucucacuucagcguugauuagcaauccagugcuuagcucuaagaccaccuuacauggacuguaagauaauuaagguuucuuucauuugcagugcagugcucuaggcaguaauugcaucaaguuaaguagaagaguauccaauauuagggaagucuaugguaagaaugcuaaggaauacuuuuaacauagcauacacucucacuacuuaagccaaacacuuuuagaaguuuuauuuuuguuuacgaaguuuauauaugcauauuacuguguuuugaucaaauccaccccuuauugccucuccuccauugcuauccccaccaccaccacuaccacuuuucccugccaacuucaugugcuauguuuaaacccauugagcuagugcugucuauauguacauggguauagggccauauucuggagcgugaguagccucucagaguuuuugggguuuuuuuuuccuuaaaguuuucucuuaagaaagcuuuauucuucuuucucuagcagggucuuuuguuuuuuguuuuuguuuuucugaugggaauggaacuuagugcucugccauugagccauauuccauuccuuugacuuugcuaauuuaauuuuguuaauuugauaguaagcaagagacaagcuagaguucugaauguuacagaucucaaaaaaaaaaaaaaaggaagagauucauagcugggacauuauggcacaagucuuuaaucccagcgcucaggacacagaggcagggaggaucucugugagcuggaagccagccuagucuacagagugaguucagggcagucaggguguuacacggagaaacccuauguugaaaaccaaaggagagagagagggauuugucaguguaagcauuugaguuggcaguaacaacagauacacccacaauguagaacuguaggagauauaagaagaacuuuaggaagggcuuuuacaaaaccaguggcuagagcuacccagacaauuaacaagaaagcuagagucaagauacacuucuuuccccaaguaugaaaaggaaguaacugaaagugaaaugcuuauuagcauuacucuuuagcaaauugugcauuagccuagcuugaugacgugggccucuuaucccagcacugagggggcagaggcaggaagaucucuaggaguuauaggccauccuuagcuacauagugagacucuguggaaaaaaaaaacacacacaaacaaagcauauauuaauauccccuuaugguuuuaguuuucaaaaucuuauaucuccaagugucuccaaauuacuaaagcaaauccugguguccuccauuugacagauuagagaacugaaguucacagagaauggaggucuggcucuuucaguaaaucuccaacacaaauaagccuggucagugaaaacacagcucaguuaauacgaauccaugcugugcgccuagacugggcagaucuaccacugcacuaccaucuuccccauauacauagaacuugcaguuucuccaagccaugugcuucugcuccacuuuccuucuuccucuucugucauccucuuucucuuucucugccaaaaccuucagcuccaccuuccccucuuucuccacccagucacuggcucuagccuuuauuuauaaguuaagguggaaagacgguuuaccgcaaaucaccugagugcugacucauuccuugacagaacuaacaucaaauacaauuagccccaggggauauuagcagcacuucccucuuucuguccaauuaaaagauuauuuuaucucagauacaauugaacacagcuauuacuauuuuguaauuuauaaaauacaagagaccuaauacccaguccaucaucuuuguuacauagaaccucugucaucuauccugucuaaaaagacauaauuauauaccuuacucauguccugacuuuagauuguaagucaucugaaaaccauccuuucaaaucuauauuagcuuucccaaugcuaaacagcuugguuggcuaugagacuaccagucuucauccccgucagaaaucuaagaaugacuaauauuaucugaaaauaugagaagccccaaauauagcuuccaaaacuuagccaauuuauagagacuauuggacaguuccuuauacuuaaaaagguuggagcaucagucuucagccuucuggcccagggucaucugacaaaccuuuguaaugcagaauuuugaauggcugauuacccugucuuggcauagauuaucagucaacuauuccacauagugugaccuuuuucuggacaauauuuugucugcagaugaaaugaggcaauucuugccuaguggcucucaugccacaacuggagcaacuccaauugaugcucaauuucuuauuugaauccaagaaagggaaugaugucaggagcagacuuguuucaacaagugaguaaauaacauugaaugucacauuuuguggacuucuggcguuuuugaaaaccaacuaugugaaguaaucuggacuguugucuguuaacuacucucagccauuucuaauuaaaauaacugaaaacacccuaacaguaaacucagagccaugaauuuccuauuugacacuuaacucacaggcucaaacaucucauaucuguuuauaauaacagcaauagaaggacugggucuaagcccugcacuucaaaauuuuuaguaucaauagaagaauuuuaaaccaaugaaaaccuuugauuuugcaucaaauuauguacauuuaagaaauuaugacuucggcuuaguaacaauuaaagagauuucugcuaaaugagauuaugacuaugcaaucaauucuagauauuccucccuguuccaauuaugaccacuccuacauucccuagaaagacaaccuauaauaaccacccccagccccaaagcccagggaacugggacgaugacucuucauaacuucuucaagcugaauaugggcguugagguauuuuugaagggagagggaaggguagggaaaauggaauugguuggccuuuauuagagucugaugucuguguccugacuggaucuggaugaaaaaccaaacaucaggaguucaggcaggucaguuuagcaugucugaugaugaaauucaccaagcuguauauucuguaauauauaaaucucaaaacaaaauuuuaguaucaagauaaccuuuuuguuugauucucuggaaucuuguucuucagggggucucccucuaucaagucugauccauagaacucuggaagguguaaacaccuuagucaccuuugccaaaaacacaaagacaaaaccuuuccccuaaaucaaccgguaaccaagaaaaccuguaguuugaacucugucccagaggaacaauaaaacaaccacaggacucaaucacacacauuuuagccuauuuaggccuuucuaauuugucauguuaggauauuaacccaaaauucccauggaguccacguuagaguauaugagucuccugcagacuuuauuauacuaacuuuaaaacaauugauucacacuucuaucuauaccugcuuauaagaggcagcuuuucaaaccaggauuuaaacccaagauucccguggagcccacauuagacagaauaugaguauuuuguaagacucauuagagcaauauauccuuauacuaucuuuaaaacaauccaaacuucaaacuuccacuaauaucugccuauaggaagcagauaguuuuuaauuguuaagcucucugccuagagcagcccuccuguugugcgcucuaccuggagccauagauuuauauuaauuaauacauguucauagcaggcgauuaucacugcucucucuacuuggagucagugacuaauauucccuaucuaguuccgaaccacaggugaaauuucccaucuuuaaguaucagaagguuauauuucucucuuuguaucaaugaauuaccugguccagagcccuuuguaccuuuguuuccugauucuuuauucacauggaggagccgaguauagaaagauaggcguugucugugucccuguuuggggguaggagaggcagacugaggagcgcaggauacaauacagggaagcgaacacgggcucucucggguguagaugcuucucugcuguucucugugagccccucaaacccagucagcuucaaauucacacugcugccccuagaucacugcccaagccccacucaggguuuggggggcagugaacuuuuaucucagguuaguugaguuucuaucaauaccuugggugccauuuuguugugguaaaucuccaacccaaauaugccccggcaaugaaaacacaacuuaauaugaauacaugcugucugccuagauugggcaggucuaccacuacacuaccaucuuccccaucuaugagaccccccuauaacuugugguuucuccaggccacgugcuucugcucugcuuuccuuccuccuccuccuccuucuccucuuccuccuccucuuccuccuccuccuccauauuccucucuuucucagcccaaaccuucagcuccaccuugcccucuuucucugcccaaucacuggcucuagccuuuauuuauaaguuaaggugggaagacaguuuacaggaagucaccugagugcugacucauuccuuguucacagucccucacaggagaacagaauuaacaucaaauacaauuagccccagggcucucugcaacaucuggcaaaagagcauacauauauaacauccaugcagugagcagcaggacugccacaaaguauaaagcuuccuuuuuuaaaagauuuuuuuuuuuacuugugggggcaggggguagauauauguauaugugccagggugucugagaaguccagaaguggacaucagaucaccugaaacuggaauuacagaugguugugagcugcccuacaugggagcagcaggccucuuaacuacugagccaacuuucuaauccuuguaaggcuucuaauugaauaugcaugguuccuuugccucugggaaagaacucccuaggugucaggcccuauauagcuguuagaaguggaaaugaggagagacacccugucaguaaagugcuugccuugcaaacaugaagaccugaguucauuucccaaaaccuauguaagaacaaacaaacaggcacaguggcauauacuuuugcacuuguagucccagcucuggggaggcagaaaacaagagagcaggcuccaaaggagcaguaccugagagugaucucuggccuccacaagcaggcaucacacaugugcgugcuuacuugcacacacaaagaggagauuuggcccagugagauagcccaucagguaaacauaauuccugcugagccuugaugaccuguguuugaucccuggaacccaaugguguaaccaacuccuacaaguugucaucugaccgccacauacacucuguguucccguauacauaacagagagaagucaauaaaugggaaagugucuccuaaaaagaaagagaagacggucugaaauugaaaaguuuuguuuuuuuaaaugaaaguaaucaauaauaggagugcauggauauauuuuuaacuaaugagcuauaacuaacaccagaauccuuugacacuguauuauuugucuuaaagaaacucaaguguagggcuggagagauggcucagugguuaagagcaccgacugcucuugcagagguccugaguucaauucccagcaaccacaugguggcucacaaccaucuguaaugggaucugaugcccucuucuggugugucugaagacagcuacaguguaaucauauauauaauaaauaguucuuuaaaaaagaaagaaacucaaguguaaaaguguagacuacuggacaaaauggugacagaaggguguuguacuagugcuuaagucuccauccagggcccucucaaaaggcgcauuagcuugcauaagugaguucauguuguccucucagcagcugugugaauccuguuugcucuggugaaauaccuaguucaaacagguucgguugucuguggucauauuccuguaaguugugcuccuaggauuccucuagccaccaucuagguaccacugucaguuugagcugcucacagugauguaguggucauaucuagcagaccaagaauuccauaucccaagaauguccugccuagcauuggcagcagagcccuagggaugacugaacugcauuaacucuguuaaaaaaaaaaaaaaaacaaaaacaaacaaacaaaaaaaacaccaaaaucgacauccugguguaaccuuguccuagugugaacucguuguagucuguagaacuuagggauaaacaaggaaggcaaauaauggauuuagugcacgagcuuugaaguguuuuccuauaauuuagauauccuaaaaauauuugaaguuguguuauaaggagcugaaucugucuuuuucucuuguaagcuuucuuucugugguuuuuauaagaggaaagaaagagguguaauggucaucucuaaaacaguuucaaccacgauagugagucuuugcugaagcuguaaguacaaagagucuagucucaggcuacaaaauggaaccaggaggucauugaaacuaaaccuuuagaccaccuggugcuuagcuccagacuagauuggcucaauaaccaacaguugagucuccugggaguuaggaaaggaaccaaaugcuauucaagucuuuguuggcuccuaggauccuaugggagaacugaggcucagauuggauccuugcuuacaagcccuuagcuucugaucuccugccacuuuccauuacacaucucccucagaaucuucagugucuugaagagugcaaauguaaauuuguuucccauaugauuucaauugggcccaucccuuaacacuuagaaguuagaauucuaggcaaguaaaaaaauaaaaaaaacugcuucagauguugcauaguaaaaccaagcucaucacuguccauauucacuccuaguuuauacuccuuacauccacugauaccuguuuuaugaccagggaaguagucaaugaagauuaauucacuugaaaaaaguacucagauguuucauccaaccaguugagcuggccugauaauguaagccauguaguuuauggccuucuguaaaguugaaaggaagccuacuaacaagggaggcuuagugcuguugaaggacagccugucagcaaggcugcucuuggguuguuaccuuauuacaagagaaaaagacagagagguuaggccugcaaccacuugugccagacugugaagaccaggauggcuagaugcauucuuacaaggcacagagggcugaaggagguaggcauuggaagaaauacagaaaauaacuuauuggccaggcauggugacacacaccuuuaaucccaacauugaagcagagcucuugaaucccaggucagccagggcuacauagaccugucuccaaaaaaguuuucaagagauaauccuaucacaaugccaagaaaguuucagauugagccugggagaggugagaacaacgcaucauuuacauacauccucuacagccagacacauuauaaauaugcaucucaguaugccaguccgaaggguuccaagcagaaaucccagaauuauuccaggcaauauugcuaacagauuuugaaacagcugcuauagaucuggcuauagaucugugcuaaaggcuuccuaaaugaggauggaagccaguggcucccugcuucuuguggcuagugagcagaggaccagaauuaguacuaugugaagugaaaacaguuguauuuuaagagucacccuagagcaguaguucucaaccuguggggguagucaaaugacccuucacaggaguugcucaagaccauuagaaaauauagauauuuccauuaugaucuauaacagcagaaaaucacagugaagaaguaacagugaaauaauuuuauggucagggaucaccacaacaugaggagcuauaucaaagggucacagcuuugggaagguugagaaccacuacccuagaaauuugguagauuauaccuaucaaguccucagucugcaucuagauuguuuauauucuguuuugcuguuuuauucaguguuauuaccuaaaaauccagccaaaagaagagagacuuuuuuccuguugacaguauaagaaauguggucuguuuuacuuaauauucucagggcugcuuucacauuuuuguuccuguuuuguuugguuuuuauacuuaggguugauggugcauguugauaagagaaucacccuggcagcuuucaaacagcauuuagaaccuuuuguuggaguccucuccucucacuucaagguuuuucgaguguacaccagcaaucaagaguuugagaccguccgguugaaugagacccuuucaucauuuucagaugacaauaagguugauugcaauaacccuuguaaaauuaguccguuuaagaauggguuugagagggcuggagagauggcucagugguuaagaguacugacugaacuuccaaagguccugaguucaauucccagcaaccacaugguggcucacaaccaucugugaugggaugugguacuguuuucuggugugucugaagauagcgacaguguacucacauacauaaaauaaauaagucuuuuaaaaaaaauggguuugagaggaccuuguaguccuuucagugaagaaauaggaaagauaggaggcuggcaacuacuagguuguuuacauugucuuuugcuuguuuauccagcaagcuugguuaaauaugaacuauguuuaaguuguaguuguagugcuauggagucaggggugaaggugcaccuguucuccaggagcccaugagauagaggauggggaaaacagaagcaaacaacagagugagccuagguugcucugccuaggcaguucaucucaaagaauauucuugauuugcagaucacaauccgacuggggagagcacugaagaagggagaguacagaguuaaagugugccagcucuuagucaaugagcaagaggugagugacacccaaggguagggauggcuucuaguccuucaucucucugcugcaguacucacucugcuaggaucguacaaaaguaaccuguaucccagugucauaauuagaguuucuauugcugugacaaaacaccaugaccaaaaaacaaguugggaggaaaggguugcuuuggcuuacacuucaacauugcuguuaauuaugaaaggaaaucaggacaggaacucaaauagggcaggaaccuggaggcaggagcugauacagaggccauggagggaugcuacuuacuggcuuucgcccccacagcuugcacagucugcuuguagagcccaggagcaccagcccagggguagcaccauccauagugggcuaggcccuccuucauugaucacuaauugagaaaaugcuuuacagcuagaucuuauggaggcauuuccuuaacugaagcuccuucucugaugacucuagcuuguauaaaguugacacaaaaccagccaguauacccagugaggucauauuuacaaaacaggcaaccaugaguuaacccuguggugugucgacaggcugcuggaguaagcagguuuuuuccgacuugaaaaggaaaugcaugguugcuuucugggagggauaacacuguacuccaaggcaguagcagcugaccuaugugagugccuucuguguccaaggucaucauggguuacgaggcaucgcuguaguguguucugugacaucacuuccuuccugcaaagacucaguuaaaccccauuaguuaucucggguguaaguccuguuuaguauucccagucuguaggugaagaaccagcacagggauguuaaguaaccugcucaagcucacacaguucaaaugcuggauaaaggcucugagcagguaugcauaagaguugggccuaauugcccaaaguauaagaaauauuuccgagagcucauacauaccauauagagugccaaacaaauaugaaagcuuugaacuuuuuauacagugccuuuauuaauugaacaauguuuuaucaaucaccuauuuucacucauaugccucuucugaguccuuuauuauauguuagagauugagugcauauucuuuuauuguaauccauggaacugugccuuuuacuuucaaaauaauuauaguuguauuacaaauaugaaugcauuauccuaguuaaucaucaugauaacucugaaaggaggcuauuguccccaguuuauagaugagaaaauugaggcauaggccauuaagcaaggcugcuuacauccacugagcuuauaaguuguagaauuaauacugggaacaaggagacagguucucaaacucaggcccuuucuugucacacuacccagcacaaauaaucucucuuccuaacccuuacuucacugugacacaagcucuaaucauguguuugcauuccuagccaugcaaguuucugcuagacgcuguguuugcuaaaggcaugacugugcggcaaucaaaagaggagcugauuccucaacucagggagcaguguggcuuagaccucagcaucgacagguagggaggccccacugcgaacugcuuucaugcugcuaugccuuuggucuacuguggagccacggauugggagcacuaagcagccaugcuagacuucuccuuucccuaagaauacaaaaugugaugugcuagaggcuggguuucugcaucacuuccccuaaaucuuaaugacuaaucauuauuuuguaccuugaacacaguugauuuugggugucaauuaauguagcuauuuuaguuaaauacuugaaauuauagcaguuuucaguguauuauuguaucuuuagguuucgucuaaggaagaaaacauggaagaauccuggcacugucuuuuuggauuaucauauuuaugaagaagauauuaauauuuccagcaacugggaaguuuuccuggaaguucuugaugguauugucauuguuuuauggagaaauaucaauuagaaagaccauagagcuaaugggagccugaccccagguugaguugugacaaguuccuuguacagugccuuagugcuguccugguugccucaggcuguggcuuggugaacugacaugauucuugcccugucccucagacucuucuuucuuuccuugucccuaauuuagcuguuugcauuauauuuagaagauaacuccugucuuuucccuucuguuacuucuucuuuucucucauuuucccuuacauaaaaauuauaauuuaaaaguuagauguuuuucauuuuucuggaaauucuguuguuguuuucugagacacucuuguuauuuucuuuauaauugucccagaguuguguugagaauacgcuauugaaggugugucagagauguugagagcagcuguguuagugaccugggccacugacacuucagagugcuaccagcaggcaggcaggcaggcaggcaugcaggcugaauggcagaagcucagucuuccugcgguuggaggucuaggugucagugggucaguuuccuuucuucuugaucucaugggggcaguguaucuucugcuuggugaguaccuuugccuuguagcuagauaucauaccccaacucuguuuucaucuccacauggugcucuccaugugggcuuguuuguacucaaacuuuucccccuuuguaaaguacacuggucaucuugaauugagguccacccuaaugaccuuauuuuaauuugauuccauaacuauaaaaaaguuaaauucugaguuauuugaaacuugaacuccaugucuuuuagagcaaauagcugugcccaugacagugaccuggagcagcgcuuguguccaacacaagcccacuuugacuuucagcacugggaccaacuaaauacucuucaagagugguggauggagaguuggcuucuggggggggggucacacugaagugaacaguuagcucugucuacaaucuagaaaauaaggucaugauaguucuuagagaauucaguauuccuucuuacuggcuguuucuaaucuaaaauaguuuaaauuuaacaaaguaaacuuucaguuacuuuacaaguuaacugagaaagcaaagaacuaccaggguaccaggcaaaugcugcaugcagguguucuugggaaugccuggggccugagagaauaacagccaugucugacagacugagacaggaucaugaaggagguagcaucacguaguagauaccugccuuguaucaugucuguauacauuuuagcaucaaaauaaauggguaagaaaugagucaugugauuaaaucccagcagcauuuauucagccauaauuuaccagaugcugcuagugucuggugcuauaaacaugaauaagcuagagacugucccccacaugcugagucugagaggaguggaccugcacaucuaucacuuguaaguuguuaguugcuaagagacuagacacaguagaaguuguuuguauguucuaccagauaggugaaugacagguagauuuugaagagccaccucuuagauucagugaaagugauacuaguuugggucaauaaagaaaauaaaaugaagauggcuugauaguaauuuagauugaagugggugcuacuggcacugaaggagcagcuuaagacccaaagggaagagugacuggaaaagcagucgguuagggacacugaugggcagauggugacuagggagaguugucuucugagagucggggggggggggggggcgggggggcggggggggcaccugcuuuaaaagaaaauagggacugcaggaguggcucagcagcuaaguguacuggcugcucuuguagaggacccaaguuccauuccuagcacucacauaguaccucucaaccauccauaacuccauuuccaucuaauguucucuucugaucuucaaggacaccaaacaugcaugugguacacagauacacauguaggcaaaacacccauucacauaaaauaaauacacuaauuuuuuaaagggaagagguagcucagugguuaaaagcucuuacuacucuuucagaggacaugaguuugauuccuagcauccacaucaggcaacucaacaaccuuugcaauuucagcuuuagucgagucccaauaccuucuggccuccauaagcgccugcacaugcacacccgcacacacaaacacacaaauguuuaaauucuuuuugucuaguuaggaacuacaggaaaguaagguuguaaucucuuagagaaguagagugcugggucuaacccuggguguuguuagguguggagaagaugaaguccaugucacagcuugccaucuuaacaagacgcuggaggccugcagagaugaaguuggaccccuuccaggagcuuguguuggaaagcaauaguguugaugaacuccgagagaagguaaguucauuuaugaggcauccaugucuuuguguuaucugggaaggaaguaccagccacugaaggcaggauuccuccuccgucucagacaaacuuuguaccacuagggucacuuggagcuccuuauguuuugaaaugacuuuauuucauuugucuagaggagaaccuucacuuuucauuauuuugccaccuuuguccuaaguauuuaagauuaucuagaagcuauuaaacugcuauauggcuaaauaaacaaacgaaagagaauugaauagagauccugggucauacuacucugaacauaccuuguggcaucugacacagaagcuaaacagauuugggugugguugacucuuaaagggaguagaauagagaaugaagauaggcuuugcauuuuacaguaauuaaggugucuagggaaggaggauugccuuucccaacagugguacgacuucagugggcauuuuacagaccuuuaacucccacagugugugccugaaguucccacacuuaagaaguaacucaguugcaguugccuggcaugugcaaggcccuggguuuaauuccccaaauaauucuaaauauauuaauauaugaaauaaaggaaaaugauacaugugcaucuuaaauauuuagagaacaauaauucugaucaugauucuaaaagccagaaaaaggauacauaaaaauguaaauguuccaugucacccaaguaauaagugugagcuuacaaacacagcuagaagacagggaagccaagaaaguauuugaaacuuauguggaacaugaugccccugugguaggagauugguuugguugagauggggucuuacucuguagaccaggcuggccuagaacucacagaaaucucuggccugugucucucaucauugagaucaaaggcaugugccacauuuacucgugcccuuuguuuaaaagcagccacugucuuaacaaagagaacauaagcaucuuaaucuuaaggugggcaaaggacguaagcaggcaguuuaaaagaaaaacaaaggaaagaauaaccuccauuugagcucucacuuggugaggauuuagaaaaucaaaaacuuagaaaauugccuugcccggcuuucaggacgaugacuguaucacucugguaaguuuucagagugacagguguugucuaggugcugucagcuucucagaggagcagaacugcauacuccacaagagauccaugagauuacucuggguucuguguuuccacguugaccaugugcagugaguagagauagcucagaguagaacuucugcuuugagaaauguaugaaugugauaaguaccagaauugggucuagaaggagugugcuagcauguucuagggacauggguuugcagggugggcagagaaguggauuucacugucugcuucuaauuuuugaauaucaaauauauuaauuuuaaauccuguuaauuuuguuucagaagaaaaggaaaauaacuucuugagaaaauuauucuuaaauagcuuacaugugacuuuuuuuuccuagcuaagugaaaucagugggauuccuuuggaagacauugaauuugccaagguaaagccucagaauguuugcgucccagugcuggugugccguagcugugcuuccaggugugauucaugcagucauccuuucucuccucaggguaggggaaccuuccccugugauauuucuguccuugauauucaucaagauuuggacuggaauccuaaagucucuacccugaauguuuggccucuuuauaucugugaugauggugccgucauauuuuauagguaaaguacaaugaugcuguuguugcuagugcugauguauuugugauauuguaucuuuaccuuugacacagcagcacugagcaguaauacaggaugcugcacaucacagcuugaagcuuagaguaccuuaguuaaauuaagaaaaagaacaccaugugcugccacacaccugugaccccagcaaaagagaaguagaggcaagaggaucaggguucagagccaguaucugcuaugaauagauuggagaccagccuaggcuacaugagaccuuaucuuaaaccaccaccaccacccaaaaaaaaauaaguagugagggaagacagacaagaugaccuagcagguaaaggcacuugccacccuagaaaaagaaaaacaauucuccccaaguuguccucuaaccuccacauccuugcuaugacacacauauacccauucacaguaacacauaaaaaauaaauauggggcuggugagauggcucaguggguaagagcacccgacugcucuuccggagguccaaaguucaaaucccagcaaccacaugguggcucacaaccacccguaaugagaucugaugcccucuucuggagugucugaagacagcuauaguguacuuacauauaauaaauaaauaaguaaauaauaauucuuuaaaaaaaaggacauguguaccuuuuuaaaaauaaauaaauaugaaaaagaaaccaauaaaauuguaauugcaagaaauucuuuuaauccauugcauaaaaaaauguuacuauagcaagccacugacaugauuauggguagaugucuaagagauucugaguauuacacucccagcaaggcuccauguggacaagacaugccucagaugcucuccagcuacucuguuggacauaguacaacacauucaaagggaacuagucuuugggaccuggaggucagaucuagcauugauguuuuccuggcucuuaccuguaaaaugguaacagugcugucucugcugagaauccaggcuauuuccuggagcuauugucuguuguaaguagaugucaguaaugcugacuguuuacuuuuaauacucacaugaguugauucuguccauucuaagaaaugaguucugugcacaugugauucccauuagcaaccuagugcauccuggugugucagagcaagaggaagcgcaccauaguauagagauguaagugaacaggguaaggggccagcuggacuaaugcauuuguguuuuacauaaagggauagaacagaagaagugauggaauugacagaugagcaaagaaaugaauugaugaaaaaggaaagcagccgacugcagaagacgggacaucgugugacauacuccccucgcaaagagaaagcacucaagaucuaccuggauggggcgccaaauaaagauguggcucaagacugacugccaguguagccuuuccccugagggcuuguuuaaguagaugguucacuacugcuggguagugccauuuuggccggacaugguuuggguaaucccaugacaccagcacugauuggacugcccuucaccaaucagaagcucagugcccagugggccacugucuugacuuggaaucauguugugcacuauggucagauguacuguaaagccaaggaugugcaaagagaaacaagcaaagccugcuacuaugaagggagggggacaaguagauucauugauugcggacaaaugugcacauagccgcuaguaaaacuagccucaaacaggaugcucauagcuuaauaauaaaagcugugcaaaggccaugaaugaaugaaucuucuguuuauuucauugauacacacauuaccucauugacaguucugaagcaaaugcaacuguguugacuuuugaaaagcagcaaagaggagcugaaggaguucuuagagccaguguagcccucagaggaauuaggaagguguguuauuuuauuugacuuuuuugcaaaguauuaagaaccuuagggagacagcccaacaucuguuuccucgggccacgcccaguaggugugcucagcugcuacagguuugugauuagagccaacugucuguaagcuauggauguagagaaugucucccuccuucacucgggccggccggcauguaaauacagcgguccuguugaguucucccagcugcagcuucgaugucugccaagguucuuugccucucauugucauguacauuuguguacacuaaagcuuagcggucggucugucuguguacuccucgguaagacuccauaggauguauuugcucguuaaugaggguucucuguucaguagcuucaagaucuuuucucuguacauuuauuuuccaaaaauugcuucaaguuugagucuucuagaaugcuuguaaagucccguuuuaauuuuaagagucgauuuguaguucuguaguguaacuuugggaaccaucugcccaucuauggaauaaaguuucucgggggccuuggcguagacucggugccacaugauucauugcagagcgugcuagcgucagcaggccucuucugcucugcuaaguacaguuucaaagaauacgauucuacauaaacuuugaaauacuaucuaauuuauaaaagucaauaaaagguuuugguaaaacuuuuucaugcaagaugcuguuuacaacaaugaacaugccaauaaaacauuuguucauguugcuguguuaucuuagucauuaaccucggggcacaauaauggaucuggguacagaauggauuugucgucuuuaaauacagugcuguguaauaaguacuaaguuacucugugacgaaguauauuuauagugaaguucucagaucaaaagauguauuuaaucuccugacuaucucagauucuuacccuuuuuuauuuucucuuaagaaauacuuaaugagaauauuagcaaauguugacucuuugguuugaguauaauuaacauuucugucuuaaaagucu

SEQ ID NO: 4041 - RNA, 4857 nt, Mus musculus
uccuguucuuacggucucugcucugucuucagcgcugguagcuauaagaucuguaaaucuuguagaguuucccugucuuaaucagugacccaguuaucccagaguugcuuuuauuucccaagugaaagccuggguuuggggcgggaggucauguucuaaccucucaucccagucucuaaucccuggcuccuucuucccucuucucagcuuccuaaagcuuaggacaccauugcugaacccugcccucaccguucccuccccagagcugucucacagugacugggacagaucuauccuggacaucuugcuuagccacuacauaguguaaaggccaucuuuccaaugaaagagacauaaaaauccacccaaaacuucuucagaacauguccugggaugcccagaguccagcuaccuggaggccagcaacauucuggaccaguuaauuggccguacccugugcuucgucagaggauugaggauuccuagccacuuccacaauucucacagcucguugcccugaguuguguaagguucagccuuaauugaaaauggcugcccuuucucuuacuggucacauuagcauauugauagccaguuuuucuccgauccaugaaaucucgucuaugacccccccacaccacaccccaaccccccgcccccaaucccucaguuuuucaaggucaagaagaaggaaguggcaggauucuucagcagcauccuuuccucuguuagaggccucuccugcacagccaccaucucuuuccugcagcucuuucucucuugccugggaaagcuggggaccgcuggccagcagccucccuguagccaucugacuccucuuuaaagagcauuucugauuugacuuacagccuacucuuucccaggguuuaaaaagauaguccccucccccaccugguucuuucucacaagccccccccucccccccgccuccuccucauccuuuuccagauagggucugucuccucgacacuguuucugcuguccgccucaugcuccaugcugucuguccuaucucuuccaucuuuagggacgaagcagaucuggaucuguuccagaaggugccucauacucaaacgaaaagagagcacagucuaucccgcuucaucuugaagggaugagaggugucugguccaggcucccagcuauuuagucacaggacaagggugagggcuucucuuccaucuuuggccucgccugggucgaagccaucuuuccuuggugcucugugcuuaagugaccccugagaaugcauggacagagucaguucggauccccuagagcugucuggggaaccacaaguagaugauggcgaggcugaagcaagcgccuuuuguuuccucagaggacaguucuccagccgcaggcucugagucaaauuucuauuuaccauacaucccagcagcaauguccuguccacacaccagccaaaagaaaacccuugguguuaaaauucuucagaggacuuuuagauccaggucuucuuucggcuucgauaccacaguggcguuagccaucauuuuuauacaaccacauguuauugaagucaccugauggucaguuuuacaaaccagguaccuguaauuuguauaauuuuguauaugcucuggcgucccauggaaggguagaauaccuguguguugguguccucaccugugacauuaggaugcuugaguuccuggccucuucuauguugauguuucuguggcuaagcccugcacgugucauuucugaaaagccuuaaaucuuagagaagucacaucgcagggugucagugugacaggcugccugggaaccgugagcccuuuuguaagcuggaagcauuucucuuacuacuguuacuuuucauaguuuucaguucacagcugccaaagccucccagaaaagccgugccuuaguacuaccuuguagccgccagccuuuucucagccuguucugggugcccacuugcuaauuggccccguaucagaagcaggacaagccaaaauccuucucauuuguguuucaaaagcccguuuuuaaauccagcucuauaggaagcugaugacuugguuucaaacaaccugaaucagaacccaagucgauucuuugaccaugcucucacgaacguauccauaccaaaacuaaaggcugcaccuccgcagcuugcuaugaagagcgaauuguacuuuucauugaugccuuuuucaauccaugaccaaauacuuagcuauuugugaaucuucugcacuccagcuugaaagugccuuuggcucgagauuccagcuuagaaagugccaccauaauaacgacaauuuguagagagaccaaaaauauuucgagaucaccauaaugccuuugguuaaccgggaugaauaaccaaccgcaggcuuguauucaugagagcaccgagcaacguguggucccugccugcugugagucugccugccaauggggaaccccaccaccacuguccuguacagcaguguggcagcggggagcccugcgaacucuugugucuguguaugccgccucucccggcauguccaccaacucaucacccggcucugcaucccugggaaggaacuuaugcgcaagcaccgaaucccggccagugggcagacaccauggcucugccuucccccacuguguccauguccagacuguggagacucauccacuggaacgacagugugcacuugccugccuacacguuugguuguuggaagccucgcauugagaugacagugcagaacaaaaauuaaaaauggguucauuagggucauugcaguugaagugucucugggcuguuuugcuggcucuggauguccgaaugugcugugagggacuugcgaagagcacaccauuugcaacucggcauuuucaaggacauucuagcccucagccaacucuuuaaagugugugucagcuuagaguaaaaccuuuuuuuuuuuaaucuggaaaccccauacuguaaggagaaagaacaaaggaggcaaaaagaagccaagaaaaaaaaauagguguuuuguuuuguuuuguuuuucuuccuuugcugauguaaguguaaaaguaaugacagacaacucugaaaguuagccucaaaacacuaccacacacucuucucuccgccccucccuggugucuaaggaauagccgcuccgggcucugaaauugcccacgugauuuguauccaccccaaguuguggguauguauaaaaguccaguuuuugguuuuuuguuuuguuuuuucaaagaaaaaauaacuaucaaauggaaaggauaauuucucagugcagguuagaguuagugguuugcucuuguguauucccccccaaccccuggcagggacacaccacaacuugaagaacuuagucaaauguguguucucucgugccucucucuagucauugcugucucguuugcaguaguuuucucuccugagcucuuugcuuauaucuuuuaaaaugaagguuuuuguauuuuaaauuuacuguguugcaaaggguaggccucacugaagucacgcaccauuaacuaagaugagauaucuguauuuauuguuccuuccuaagccguaacuuguuuucucugugaaucugcauugggucccguggcccacacuacaucauuuuagauaaaagcagccuuugugugugugucuugcacccaauucguucacgaccauggggucaggucccacuagaccugucauacccagccuugcucagccuggcccuugucgguucuuacuacggacauuuugucucuucucucucugaaagaggugggcagaauccacacauccaucauguuagaaaaccugucuaugaguuuuguguuuuuauuuuucaaauuaauuguuuucugugauuaguuucaauguguaaaauagauuauuaacugcacuucuuuaaaaaaaagaacaaaaggauguacaucuccuguuaccuccuugaaagaccaacuucucuaggccuuuuucagugggcuuaugacuucagacaagggaaaaaaaacaguaaaaacaaaaauaguacgugccugaaaaaugacaaaaaaaaaucuuuuuguaacauuuaaaaaaccugaaaagccuuuacuucuuugauaugcucaaauuuuauguaaauugguuuuugccacguguguuccuucggauucuaagcgacuucauggcuucucuguugucucguguaaaguguauaggaugggcuuguggcguaagcauuucaucuggucaguggcucuuuugauacuguacugcugcugggacugggcuggaaccugagccucuagagggugacuggguuccucuugggggagauuguggagaagagggugagguggcucauguuuucuuaaacuguuugcagaaacuuucaaaaggcauuuggcuaaaccucccggcaguacaguauucucguacucauuaacguuugugucuagguacugguaccuuucuguuuaaaaaaauguucuaaguguuggcuuuaaagugaauuuaucuuuaguaugauaguuauaugaaaauuauaggguuugugugcagagaauuuuuuuauaaagugcuuuguaaaaaaaaaaacaaaaaaacaaauguauucuagcuuucgcgguacauaugugugauaacuuuaauacccaugacaguuaagugcaauuauuucaucacucuaaaaaugcuauuuuugugucaguuccugcagguguuuucaugucuuugcaaagugacacauuuugaugccuucuugauaaagugguagacauuuuguagcuuucuagaaacuuuguauccauacgguaucaaugaaaaauaaagaaaaugaaagugugggucagcuuucuuaucugcaacag

SEQ ID NO: 4042 - RNA, 3499 nt, Mus musculus
cagagccagagccgcuggaaccugagccccggcgugcugcuuugggagaguccgccguccgagccgaaagcagccgcugcccgauuucaguacauaguccgggagaaaggcuagugaggccggagacagggucacggauucuacugcaguucgggagcugccagguugcccgcgcuggcccugcugcccuaauugcaccuagccggacuugcuccucacgucccgguugcgccauggauccuucggagaagaagauaucgguguggaucugccaggaggagaagcugguguccggccucucccgccgcaccaccugcucggacguggugcgggugcuuuuggaggacggcugccggcggcgcugcaggcagcggcggggccagcgacggggcuugacggaagacccuucgggccaguuggagcugcccgagcccccggacgaaaacgacgaggaugacgacgacgcgaugcccccgggcaugcuaugugggcccccgcagugcuauugcauuguggagaaguggcgcggcuuugagcgcauccugcccaacaagacgcggaucuugcgccucuggacugcuuggggcgacgagcaggagaauguacgcuucgugcuggugcgcagcgaagcgucgcugcccaacgccggaccgcgcagcgccgaggcgcggguagugcucagccgcgagcgccccugcuuggcccggggcgccccagcacggcccagccuggccuugacccaggagaagcagcggcgggugguacgcaaggccuuccgcaaacuggccaagcucaaccggaggcgccagcagcagccgucgucaccuuguucguccacgucgucguccaccgccucguccugcucgucgucugcucggacccacgagagcgcgucgguagaacguauggagacgcuggugcaucuggugcugucgcaggaccacacgauucgccagcaggugcagcggcuccgggagcuggaccgcgagauagaccgcuacgaagccaaggugcaccuagaccgcaugcggaggcacggagucaacuacgugcaggauaccuaucuagugggggccggcaucgaccuggacggacaaacuccugaaggggagccggaagaugcgacacuggaggagaaggggacagaaccggcggcaccccuggacagcgaggcgcaggcggcagcguuggaggagcuggccaggcgcugugacgaccuggugcggcugcaggaggagcgcgcccagcaggaggaguugcuagagcgccuguccgccgagauccaggaggaacugaaccagcgcuggaugcagcggcgcaaugaggagcuggcggcucgagaggagucccuagagcccgauggugguccggauggcgagcugcugcuggagcaggagcgggucaggacgcagcucagcaccagccuuuacaucgggcugaggcucagcacggaccuggaggccgucaaggcggacuuggauuacagccagcagcagagggacauuaaggagcgcgagcuucagggccuucuccagaguuugcacacuuuugagcagacgguggugcaugauggggcucuggguuccagcggacccucucgcgaaccucagccucagaccugugcagaaauguggguagaccaggcccggggacuggcuaagaguugcccgggcaacgaugaggacucagauacugggcugagcuccaugcauagccaagacucagacucgguacccccugugugugaaucccuuguguagaaguaguagggagcaagcuuagacgcuugcagaaugcacugguuuggccugcucagggacaugaagugaggccaugggggugagcucagaguucccacggaugggucuggagagugagugugaaggaggguccuggacaaggaagcccuaagcuucuaagcuuuagagggaaguggagucaggaggugagaaccccucccuguuuuuuaaaaacacauuagguaagugaugagguccaagcccauuuucaaaacaagagaaaaggaaaacauuacgggacauuuuuuuuuuaccacuccugugcaugggaaggacugaugacagcuagaacuuuggucuguggcauaaagugcugcuaaaagaaaacacuuggauggaaaggaaauuccuugaauguuaauugugacuggaaacguguucaaacuagccaaagagggcgcacuaguguuggucucugccuugcuuaacaucuuugauaaaacccauaggcaucaaaauccugacuguuuacauuucuucagguuugggaauuacccaucugcuaaaucauuugccuuuuauuucugucaaaggccaaacugcacugggaugcaaggcugggccucuccuuacuaaauacauuguguuaaaggcuccccaccuucagccugaaacauagcacuuugaguuauaaaauccuggcauacauaauccaggguaaaaauguagucuggcuuuuugggguguguuucugcaaaggcagaggugcuggcuuguaauucaugauucaauuacaguuaagaagggggagcugcagaagggggugcagccugcuuugcuguuuucaaagaacguucuggugucagcuacaaguuggaaguaagaaucuccgcauaguguuuagcugcuaacuacagcuccgugauuaaacaccagcuaugaucuucaugaauuuuacccagacccaaguccaacuucaguaucuucgguuggagaugagguucugguucucaaguaaacugcaagugccaauuaacuucaggugcaaacagcaggguuuacuagcaaaggccccaaaaggggggggggaggaaucugauaggccacgguggguaaacaaauagaauaaccauagauagcagggagccauggggaaagugcaugaagcugaguuaagacuuaaaaguugccccugguuggccauuccucugugcguggaggggggagauauaagggugacauugucuccuguagcuggugagagugcuggggagcacucgguguaauuguuccagguauuucaauuuaaaccuaucaguuguaguuagcuguugggccaguggaaggagccugcuuguccauuucccuguggagccaaguacuuucugaggaauguggaucuaaucuguccagaggaaguauuaacaaugguguguguguguguguguguguguguugucagugaggcgcagaaggcugguaucaacugaacuagugaggggcuggcuaccguucccacaaugacaugcaaagauauguacagaagcgugggauuuggaacuguuucuucccauucgugaucaccugucugaguguccccaaugggagcauguccuccugaacuccucaauucgcuauuggaacguccccuuuucacagacuguccccacucugaugccaccguaggauuauaacacaggcgaccgguuucagauguucaagcaaaaucaaaaugaaaagaguuuucuuaaauacuugau

SEQ ID NO: 4043 - RNA, 57679 nt, Mus musculus
cgcucuucagcagccggucgggggcggugaaaagcgagugaggagagcgcgaccacggcguagccaucgcugaagggagagcgaggcccgagcuuccgcgucgaggugagcggcacgggcucugucgcaggcucggccgcggccccuccgcacuuggccgccguuuugcgggaguccuaggccgggcugcguugagguggggccugcgaaccgccccgcccccgccccgccacggccgccuggaggcgggggcgccuccucugcugggacugucccugcgcggcguggccgggccgccgcccucccgacugccagggccgcggcgagggagcuuagaggccccuggccugcaacccggggaggcagggguuccgucugcggggggaggccgcgcagaggcggccacggugggggcccgaguuaacggaggaggguggcggccugggauugagaggaagaaagugaugggaaaggggugaugcucuggagagggcguccagugaggaggccccugcuccagagugggaucggccucugggaaguagguaucaauggcguugcggagaaaucagcugagagauggagaacugguuugggguuugaagguuaaggucucuggaccaauggggacagggcauguggagugugagaagguacacacagaaaccggaagguguccgaggaguggauuuuagaugagggguggauggaggcugucugacuagaaggcguuauuugguuucuuggaaaguacacaaggaacagucaagguggauuucugugugcuugcucaaggguggggaucuuuugugaacaguggagugaguugggaguacagaguugagagagaguaucucaggaugacagcucggaacacucaacguagcuaccuacugaggcugaucauuagcucaccuuuaugcuguccccuggaugauccaucugauuguuuagccacagcucacacaaacuuagcucuuagaaguaauggguauuaaguauucuuugauuuuuuuuuuuuuuuuuuuuggacugggaaauugcuuaauucuuaaagaaaagugcuaagggcaacauuuaaagagucugguuggggauggauaauggauggguaauaugacaugaggauggugcaaggugucuuacaaaaacagaagugauacugugugaauguaguugugcaguucugaaugagcaaucuuuuuaauguaguggaauuuguuuuaugcuuguugggcaguugcuuucacuuuugagacuaguuuuguaguuaaauaaacaaaaaauauuuucacuuaagaaagacauuaguauauguguguugcugucaacugcuuuccucuuugaagcuuuuauuuguaggguacagguagaauuaaauccacauuuucaguggauuuaaaugggagagauaauuucugcuuaaagauaggacaaaaggccggugaaaaguuacaguuugagggcagaauucaagagagcaguuguauaaauguuuucuuauucaccagcucagcauagaauuuuagcuaauggaucauucuuuaggacagagaagguauuuguggguaacacauuacuguaauuacauuuugcuuuuaguauaaucuaguucccaaagggcugaguuaccuguaagcagagagacaguucaagagaagggcaaguuuuuuggaaaaggugaauuuugggucauuugcaccaggaguugguguguggguuauuacuagacacaagaaugauuacaguaguuuggaugaaguauaagcagacuguggauuuaaaaaccucacaaguguaaauaguuucuaaguccaauuacagaucugucugaagaaaugguuagauauguagccaucaguuaagcuucuuccugcagcuugguugguugguaaauagugguucccugugauggcucgaaggaacagaacaguuggacugaagauggggcauauaugcaccccccaauuuuuuugauaguuagaaauuuauugguugcuacuuugugccagaaacuguuuugagcuuuccaaguaucauuauuugauuguauuucauaggugagggagagguucagacagauuugacuugccuaagguuacaccagcuauuauuacauggcaagucggauuuggcagaaucagacaugaauugaacauuugcuugaugacagacacuggagaaugcuggagauucaugauuuaccagaaaauccaaaggucagaccugagccuguuagagaaaagacuuguuauaaaagaaguaaaggaggcaugggggcuaggggauggugguguugggauugucagcacacgccuuuaaucccagcacgcaggaggcagagggaggugggcuuugaguucgaggccagccuggucuacaaagcaagcccaggacaauuagggcuauuacagagaaacagugucuugaaaaacaaaacaaagucaguaaaggauaaagauugcuuguaaagauuuuguagguacugaagaguaugcuguuuagagaagccuagagcugacuuuuuugaaagaaagaccuagagacugagaagaaagaugguuaaaagaagccacugaguuaaauaaggaaaaaagaaauguaaauguagagucaagaucacugaggucaaucaugauaugggucagcaaucaugcuugguguggucauaguuauggucacaugggggaggggaaucauagcagggccccuugcaauguuuuagucuuugacuaaagaagaucugaguacucaauaugcuuguacugaaaaaaaaaauuccagauaaaaaugagcauuguuuuuaucauuaagggauaacaucuauucaacagaaaugggacaguuggggcuauguaggucuacauagcuuggggugagagcagagauggacuuacuuaacaucugcuccaugugagcuauuuuggaaagcauguucugauguuggaaaugacugaguuguugugaauugaaaugguacauccuaaaagaugacuuuugcuuaaucugaaguauuagguuauugaagcaccuugaaucauagagauaggguccugacuuuucugaacauuuauuuuucuuagagauuaagaaaagaacuuaagguuaaaagaaagcugugaaccacucauagaacugggucauuuuuaacuguuucuuuuggucuuacauccuuccuucuucccauacauaguuucuuuaguuccucccauuguuggguuugauauggaccuaagaguuucaguucaguaaacaguauaaaagugcuacauuuauuuuuaacugauuaaacaguuaaaagcucaccacuaggacugguuagaugguucauucaguaaaguguuugcuguucaagcaugaaaacaguuuggauuucuggcacccuauggggcauuacacggcugaaaucucaguauugaggagguagagacauggggauccauggggcucgcaggcuugcuagucuaaucagagacuuugucuuaaaaauaaagcagagaagcaauugggggaaauagccuaugucaaccucuagcuuucauauauagaagacacacuuguauaaugcacacacaugacacacacaaaugccacauauacuucacucuuguauucccaauucaaauagagacauaucaaucaaauaguucuuuguuuagcaaguaauuauucccaagcaaacuaggaggaucuuuccaaggaucagugcagauugaguucaaucucauacaugaaaagggagaaauauuauaaauccauuuaguuuuaaccuucauuuggcauauagagauuguggaauaaguauacaugugauuucuguuucaucuggacacuguuauguuccuuaaauagauaaucacaauuaccuuuuguuuucuuaugugcgagcugcauuuuacaaaugagaaugaggcucagaaaacguagguuagagagcuaagugucagaacuaggauauaguccuuacuuuggcagggcaaggugucaugugcuuguaaucucagcacuggggaggcagaggcaggaggauucugaguuugaagcugccuggguugcauagcaagagucuguauaagagaaaaaacaaaacaaaacaaaaacaaaaaaccccaaaaaccuaaacccauguuuuguuucuuaaacucacaaagauaaggacuuacuuauuaauaucuguaauugaaaaacgugucauauaaccucuaguauuuaauagcuauuuaauaccuuaaaggauagguaggucucagcccccacuccccaacuuugaaacauaaucuguguuguccuggcuggcuuagaauucucuagguagaccaggcugauauugaacucacaauuauagucugcuuuugcuuucugagugcugagaccaaagguauaugccaccaugcuaaaauccugcuucaguuguuugugcccugugauccuaccucuaaauauguaguagugaguuuguuucauacaggguugauuauguuacauuuuccuguuuuagagauaugugucuacauuucaguauuuuuuaaauguuagaaauggauccuguaucuuaaagucaaauauaacugagaauugaggaaguaugggaguugcauguaguuuuuauguauaaugcuuuuagaauuuuuuugucuucauuuucuuccuagccucccccuuuuuauuuaacauucauuuacuuuucuuuaaauuauugcucauucucuugaguuaauacgguguagaaaaugugucauaauguaacaauucacaucaaacuuugaaucaguagguuugagguuuaauuuuggccuugucagcaauuucauguuuaacuguaagcaaguaacuuccccuuugugggcuuuagcuucuucgacugucacgguggcagggagagcuuuaaaaaugauuauugcuuuuuuuuuuaaccucauuuucccuuuuuaucuuccuuucuuuccuccugucauuuuugacauggauuccuaaggauauaguuauguucuuaauuauuauaaagagugaauuccuuguguuacugagacaggcuaucuuagcagauacucauuaaauuguuagcaaagaaacagauaaaugucaucucuucuccgagcuaauuaauaaaaacuaauaaaaacauguugguaaaguacauguaauuuuuaaaaagcuguugaaaaucuagcaucagagcuuaauggcagaaaaaguacuuagcguauguaaggcuuaagaguucaguccccaggacuacaaauaacaacaacaauaaaaugccagaucuuagcccuugggaggcagaggcauuggaucucuguaaguucaaggucagucuagucuacauagugaguuucuagacagccucuugucugguggcagugugugugugugugugugugugugugugugugugugugugacagaaagagagacagaggaguuucauugaaaggcaccuuugccuaaauaaauguguuuagcaaaacuaaaucagcucuauuuuuaacaaauguacaaaggagaaaacucguggaccugauuuuaagaauccuucuauuuuccuccagcuuuaaaaguuaugaaucuuuuugucuauauugcuucauagcuuguaccuccauucacuuuccccauaauuucgaagcaaauuaaagaaauaaaaaauuaaugccauacagccuaauagacauguuaaucaaaguggaauggaauuuuuuuuucauaaaaguguauuuugaaacucugcuuucuauuguauugugcaagagaaaucagauauaguaaggugcccuggggcagguagaguguuaggagggagccuaaauauguguacuagaaacaguguaguuaagcuggauugugcacuacaaauggguaguuaauugaacuauuuugaaauuaaguagaauuuagauagguugagauaggacuaauaguaggugguaaaggaacuuacacuuauuuaugcauacagauaaaaaaaucuaacuuuggcuuuacagaauaaaauauaucuuaaucugugucuuuuuaucuuuuagacccaaauaagauauuauguacauaguaaagaucuuuucucaguucuuggaaaaagccauuuguuguacugaaaaucaaggcacaauguuuugugaauguauuauugucccugguggauuauuuggcacauuccauuaaaaagugccaguaucguauaaauauuguaugccaacacguaauaaucgaugcacuuuggcuaaaguacuaguggauguguaccaccagcuuuuagguauaaaucacuuggagcuuuuacauuauuucacuuuuguguacauacacaugugcuaacuacuucagaaacuuagaauuuugaaauauauaguuuauugcauuucauggaauucuuagagauguggguguaaacauucaugagauaucuuugacuuaaaggaauuuauaccauggcuucuuaugaaauauucuaagaauaacauuuccuagaauucaggcaguuuuaagguuuaugaaccucuccgagcaucuucauaaagauuugucucuuuagaagaaaacaauacauuuaauuuuugguauaacuuuaguggcuucuuaaaauguucagaaccucagcuguagcucagugguuccccaacuuuccuuuuaaagcuuaguaaaaaaaaauuuuugaggucuguggauccuggcuugcugucccuuaccccuuugugcagugcuagagauugaaccagggcuuugcguaugcuagguaagugcucugucuacccacgaacuauauagucuuagcuaauaauuuauucuuuaauguuaggcagaaaacucaacucugcucuguuuuauauauuaugauuaccuuuaaguaagugacuuaauaggaguuauaaaauuaugaaacuuaucaugcaaauacuagcuuaaaaaguagaccaauuagauucucaauuggauucuuggggaaaaguaagccauagccagguuuuuguuuaacuguuguuuugaggugggucuuuuuccguggguuguacugacuugacuaaccaacuuucugccguagcuuccagaguacugggaguacagguacauggcaucauauuuagccauaagccauucaauaguauagaaguaacuauaaaaauuuuuggaauacguguauguauagugcuuuuguauacaggaugugaggcaguguaugcuugaaugaacagaaaguggaauauaguagaaugcauaaauaccuuuuacuuuucuugcagcagaagaaaauucuuuaacuuauucuuaacaaaguuuguggaggaaaaaauaaccuugguguuuuuuuuuugaagcucacaucuggguugaaaguaauucaggguuuuuguguccaaugggauugauugaucaugaaacucugaggccuauaagcacuuaugcuccccuuagaaugaagaaugguuuuaauauguuucuuagaaacaugugauuuuuaaaaccuugcagauuguauuuaaaguauaggucauaucaauauuaggucguuaccauaagcagaaucugcaggagagaggaagcagguaaauuggcaaauaaugggacauuugauaaauugauugauagauuguaaauaguaggugaauugcuuuaaagugauaaccuuggugaccuuuuggaguuaauaauucccuaaguaucaagugcaagacuaggaaacagaagaugauaagugaucuggccucucagugaaauugagcaagaaaccagagauguuaauuggcuugcccaaacauggucaugguggucccaguaguguaguaacugaguacacugaaucuuuuuaagucuuuuauacuuuuuuauaauuuugacuagagccaggaagaugacuuaaggaaaaaaacuguuguguaagaugugacccgagugugaucccuggaacucacgcaaaaaccuagauaggcugauucucaucugucaucccaguaagucuaaagcaacaggaggcagacagaagcaggucuuucaggggcagcacaucuaggugagaaccaaaucuagaaaguucuccccugaccucgugggccauggcauucauauacccacauucaugcauagaaacuuuuuuuuuuaauuugccuaucuuuucauuauaggucuuaguuauauagagaccaauauguuuuaguacuagagauuuuagcacuaugauugauaauuugaccaugaaagcccugaguuuauauagucucaaauguuuauuucugcugcauucuuaauguuguuaaugguuacaaggcuuauuuuagggugccagguacucaauucaguuuuacaacugaaaaccuacugcaaauccagaaaaucacuagacauugcuauccuugugacuuuuacauagccuguccuucaugcuaugucuuaaaagauacugaguuuuaagaagacauuauagaauuuaacccuuuaaagaccuccuugaaaauauuucuucucacucaaaacuaaaaaccagaaggaucauuggcauccaaauacagaugacccugauucugaguucuuuaucacuuuugcuugcuguggccagagagaaggcuccucccccacauuuauauccccuaaaucagcaaggauuuguaagagugacucuuucuaguggaauaauuguuacucugauccaagugugcuuuggguaaauuucauuaggaauaugguaguuccuaauugaauuacaaaaacggaaucuugguuagaaaaucaaugaugaaauuguagaaguuuaauaauaauuauaacuaaauuggcagugaaucuaaacuaauggugauuuuuuucaguuaaaaaucaagacaauaauugaaaaccauaacuagguaaagacagcaacgguuucucuugaaaauuacuaucauaguuucugaguaucagaugagguagcauuauuagcugaaguaaccagacuugaauacagaaagacgucuuucuuucauguauuuugauaaucuuuuucuugguaacuaguugaacauuguuauucauauauagccuuaugcaucaaaggacaauuguccuuucuuacaugauuuauauucagagguuugccccaguuuuagagaaguguuacuuagauggcugagcugaugaucacaaaugggcauuguuuuccuagguguguugagaaauuuguaaagggccugacuugaaguucaccuaguuucuuuacuucuagauagcuuguagucuuugauauguuaaucuccuuucuguaaucugauuggauauaguuuacaguuucccaaccucauuucacaacaaaacuucccuguuuuuagguuuaaccuuaaaaacagauucagaaaccuuaugaagaaguaauacaagaguagagauaaaguauaggcagggagucaggacaauuuccugcuuuaaggauuacauacaagucauucaaugugauaaucauauugagucagaacuaugcuugcaguuauggguguguuaauagaauacccaauuuugucacccuguuuugaaaguuuaacuuuguaaauagaguuuaauaaacuuuagacugugcaagauacaugauuauuaauuuaauaccauuuuggguauguaaucuauagguaauguuuuaggguuaaaguguacauuuuucuuuaacaucaauuuaagcucaguauuuuaauauugaucaugaaauacauuauguacaguaccaaucuucaugacuuuauaaaccaaagagaguauuuuaguuucuuuugcaggcuugacaagguuugaaauuacaccuuugguaacaugaaauaauaauaguacacuuuuguguuaaacacuuuuuuauuucucugaggcuaaaaauauuaagauaaaaauuucuuaauauggaaacauuuuuauuaaggaguaaauacagccuagucauuugucuauaaaguaguuugucuaaaauaaaaucacauaugacugacuuaaugggcaaguuucuuugaagaauucuuucccugcaauggaauugaauuuguuuuuccaagugguaaaaaugauucucauucccccacccuacuaaacucacuguuaggauuguuuguauuauuuucuugucauuucuuucuacuuaguacucuuuuuuuuuuuaaaucaugcuauguaugaacacgaacauaguucauuuucuauagguuuuauaguaauuagcaguuuaaaaacugaaaaaagaaaauguauaauacugaaaauuuuacaauauuuuuaaguguauaauuuuagugucauagaauugguacuuccucuuugauguaguguaaguugcuuauucuugagauggagucuccacaucuaaaauuuucaggauaauaagauccuagaagcauucuuguucuugugcaaguguugugcuuauagaaggacaucaauguacaaaaugguuguguaauagccaagaacuaaucuaauguaccauugagacuccucaauaccaaugccuuagacauuagagacacagaauacagauaucgcuauaucagugucuguguagacaaacagaguagcuauuaugucuacuucaauggaugcuuacagcagaguuggacacuagcaucuuuuauugaaaaaagaaauguuauccaagaugcuaaagcuauucuuuugucuguggaaaacugccugauaagccuuaauuuuugagaagaggaaaaagaacucacuguucuaugcugugugaccauaguuuguacauuuugaguuugcauuuugguuguuuauuuguugucuguauuauacuuuccuaaugaaaagacuacauauagauugcauucacaauguacauguguucaaaacauguuguguauauauauauauauauauauguguguguguauauauauauauauauauauauauauauauacauacauacaauuuucuugcuaauaaguguauucguuuaccuuuuguaguuaccaaaauagagugcaaaagacacuaacuagaucuuugucuuccaaugugccuucagaacuuuguguguguguguguguaugagugugcgugugugucaguguguauaaacauuugaaaguaugagacccaugggaacauauuuuuuaaaguuuugcuagcuuaaagaauaaaaauaauuaaauuaaaaaaauaauuaaaaaauaacgugggagaaagacgauggcucaguaggugcagugcgugucucucaagcaugaggaccugaguuugauuucuagaacccauaagaagccagcugugguguaugugucuucccaguacugggagggagagagggcuuauccuugggguucacuggguuacacagccuagccuauccagugugcucuaggcugaugugagacuuucaaaaaacaaaguggguggcuccuuaggaaugggaccugagguuggacucuggccuccacauaugugggcucaucuacaugcacacacaccaauuauuugcuguacucauuugguaaauaaaaauuacaagaagcuauuguaguaagauuccuguacuagucugucccuaccauacccuguauaaauaaaaauggagucauucauguaaaaguuguguauuaccaagcugaagcucucagcuguuuuuugacuuccuggaauauuauuagauuauagcuauaacagugaaacaucccauauuuucauuugguaugaaaauaaaguucacucuuccuuaaucuaaaaaagauaaccuuuaaaaaaaaucuaauauaacccaucagcuauuuugcuguucuaaagcugucucuaacuuuacaaggaaacggaguauaauuguggucuaccuuuuguuuuguuuuuucuuuuuuagccuuuuuuugggucuguuuuuguauagaaaaccaaccuuuuuauaauacaugguguauguaugcuuauaauucuagcauuuaggagauagaggcucuugaauccaaggccugucugacuuacauagcaagacucuguuuuaaugcaauaaaucaacaaacaaacaaaagauccuuggauuuuuuuauuuguccuaugcagugaaguauaauuugauuauagaauagaaaaugaagucaguuaggguuuuuuaaaaugcauguuguaaggcacuggggccagucuccaucacugaaaagcaaaaacagauuguuaaacuaaauuguucuuauauuuuccuuuggcagauuuggugacugaggaaaggacccagagacuccuugaacaacuaagacaagguacuguuagcccuguugagagucccuaucuaucuuauggagcaccuuaggguuucuaauaaauuccuccaggccacacucuguucuuuuugcauuaagccuagguuguuuuuaguuuggggguaccaugcuuaguuugcuuuguggguacucaucuuggacaugucccucaaaagaggaguuugugaccaugcugugcuuguauguaacugcauacugcacaugugcucaccugcuguccuagcuguaguuaaagguaguguucaaugauggcaguacuaaaagggaugagacacuuguccucagaauuuaauuuauuuucaucuuuuucuucuuggacauugaacuacaaaaaacaugagccaaguugggugaagggauccuauagccacagccacagcuugaggcaccguucuagccucauucagaaaccauuagaaugcuugccauggugagguaguguuuaucucuugagguugggcugucuuucgaucacuugucaauaaaaaguuauacuguagugacuucugacugucagaaaaggugagcucuucugccuggacauucacagucugguugugagcacauuggcagcucuguaagcagucuaaguagccugagguuacuguggagcccaggcugccuuguugcaagaggcaaugacacuuaaaaucaagaacuagggcuguucacuuggaauuguucuguggagccuuuucuaaauuccugacuugaagaaauugugagagaauuaagugguuguuauaaauuacuucguuaaaccaaaguguggacacuuugccccuucuuagaauugguaacaaaacacccauggaaggaguuacagagacaaaguuuggagcugagaugaaaggauggaccaucuagagacugccacacccggggauccaucccauaaucagccuccaaacgcugacaccauugcauaugccagcaagauuuugcugaaagaacccugauaauagcugucucuugugaggcuauaccagugccugccaaacacagaaguggauacucacagucagcuauuggauggaacacagggcccccaauggaggaacuagacaaaguacccaaggaguuaaaggggucugcaacccuauagguggaacaacaauaugaacuaaccaguacccccggagcuccugucucuagcugcuuauguagcaguaguuggccaucacugggaagagaggcccauuggucuugcaaacuuuauaugccucaguacaggggaaugccagggccaagaagugagaguggggguggggaggguaugggggacuuuugggauaacauuugaaauguaaaugaagaaaauaccuaauuaaaaaauaaauuacuucguuaaauagugauauaaaaccagaauacuacuuuuucugcaucugcugcuauuuacugagauuugaugacauacagauauauaacccauaagcacauguacccagaugauguauucuguguuuccaaccuucuugugaucuuucaucuuugguauguaaaacauuguuucuccuauucuuuccugugcuuguuugaaaagcuguuccagccuuaaguauuuagaauguauuuuuguagcugcagcuguuuuccuguguguugggaagaauguauauuuaucuugacaugaagcuuaagcaucaucuuuagaaggccauuugccuagggccuuaauuauagucacuaugacauuuggccuucuaucaguuuuuuagggugaugguuacaagucuucauauaguuuggcuccuuauuucaauggaaauuuauugucucaugguucuagaggcuggaagugugaaauaaguguggggagagccaugccuggcuugauuugaugcucuaugacucauuuggccuuguuagauaguguucuucuuguguuagugcuuuucuagacuguauuuuugaacugugaugcuuuucucauucaugcuucauuuuccugaaugcuugugaaauacuagaaauuauuguuuagaacuugucuuggcauccauggucugcaaaugguggcuuucugauuuuuuuuuuaaguuuuacugaaacauaguccauuuuguuuauuuucuauugcugccuaauccauguuuaugaaauaucugagacugaauaauuuauaaagaagaguuuauuuagcuuggaguugaaggcucaaggugcugcauauggugaugucuuccuuguucacaaagucccaagacagacaagguaugacaagagacggaguguauguguaugucuaaacauaauagcuggauuagauaucuauucccuuaauaauucacaguggagauuaaacugcagcaugaguuuuggugggaugacaaacaauuccaaacacaauccacuuuaugcuguaauagaaguuacaaaguuguuucugagcuaugggucacacaacugaaaaugcuuacuuuuuaguccuuuauggaaauccuugcugacccaugguuuagaauauuuuggauuucuuccucuuagggaauauuugaaauuacuuuucguuuaguuuuuuuaaauaagauuuauuuuguuuuuaguugggggggggggugagugcuggugucugcaaaggccaaaagcaugugauccccuugagcugaguuaaagggagugcucagaacccaucucagguucucugcaaaaacaguauguucucuucuaagccaucucucuagcuuacauuuuacuuuuuaagucauacaacuuaaggaauguuaaaagaucauggauagaccuggagggcaucauccugagugagguaacccaaucacaaaggaacucucacaauauguacucacugauaaauggauauuagcccagaaacuuaggauacccaagauauaagauacaauuugcuaaacacauuaaacucaagagaaugaagaccaaaguguggacacuuugccccuucuuagaauaggaaacaaaacacccauggaaggaguuacagagacaaaauuuggaagugugacgaaaggauggaccaucuagugauugccauauccagagauccaucccaugaucagcuuccaaacgcugacaccauugcauacacuagcaagauuuugcugaaaggacucagauagagcugucucuugugagacuaugccggggccuagcaaacacagaaguggaugcucacagucaguuauugaauggaucacagggcccccaauggaggagcuagagaaagcacccaaggaacuaaagggaacugcaacccuauagguggaacaauaauaugaacuaaccaguaccccggagcucuugucucuagcugcauauguaucaaaagauggccuaauaggccaucacuggaaagagaggcccauuggacuugcaaacuuuauaugccccaguacaggggaacgccagggccaaaaagggggaguggguggguaggggagugggagggguggguaugggggacuuuugguauagcauuggaaauguaaaugagcuaaauaccuaauaaaaaugggaaaaaaaaagaucauuuagcuuaacugucuugccugucugcugcugacaagagauuuuccaguugagguauagaaaaacaaaauaaacaaaauuaaggaauuaauuuuaaaccagcauuguauaugcuaugcuauacacaagaauuauaccaaauugggagcuuaaaaaugaauaaagauagauuuggugguguugaccuguaaucccagcugcuaggguuguugaggcacaagaguaacaaauuuaagccugucuggacaauucaaugagaacacugccuugucuuugaaugaaugaaugaaugaaugaaugaaugaaugaaugacaauucaaugagaacacugccuugucuuuaaauaaauaaauaaauaaauaaauaaauaaaugggugaggauauaggucccuuuccuauauaugcagggguuuuguuuauacacagacacacugugugucuauguauguauguauguauguauguauguauguauguaugugggggggggagagacagacagacagacagaaugaaugaaugagaacugaaauacuuucuucuuuguccaucuguuuacccagcugucuccacuaguggaccuuggcuaauguguuuguauauuaagugcauagagagacaguuuuaaaagaaaaggaaauagagccaaccuugaguuauagcuuuaggagauggaaauugauagaaagcaggauugaguaguuaggcauccauuuugaaacuuucacauucaguccuuaguaucucuaaauuuguagaagggaaaaauacagacaagcuaauucccugcauccccucuuuauaguuacagauaccuuucuucagaagccgccaguauuaccaaguuuuugguucuccuugagaaauaauccauaaaaacaugaauacauuuaagaaauuccuuuuccagaaaaguaguauccauguauugcauuuuuaauguuuuaaaguaauauuuggagagaggcaggagauauggcucagcaguuaagaauacuggguugcuuuucaguggacuuggguuugauucucagcauccgcacggcaucucaaggucaucuuuaacuucaguuccugagauccagcacucuguucugaccuccauggcacugcauguaagcagucgcugauacacauguaguaaaaauacacacauuaagaaaaacuuuuaaaagauuauuacauguuuuaaucucuuauuuuaauauuuuuaaaaauauuaaauauuuuuauaaauuuuguuagaauuucauacaugaauauagucauuuugaucauauucacucaagcugcuucuccuucuaacuauuccuagaucuacuuccaggcaacccccuuccaaauucaugucuuuuuuuuuuuuuuuuuuuccuuaacucacuaaugcaguuugugguguucauauacucagugggugugacgccauccacuguaguaugguccaucuacuaggauccauaucaugaaagauagcuggcuuuuccuuccccagaagccaacagccgucaguagcuccucagcuagggguagaggcuuuucuaugcuuuaauguugaauugcuugaucuuugcagguaaccacagcugugaguucauacguucagcaguccugacaugacaauguuuuggucugguccuccuggaacucuggcuuuucaagacuuguuaucccuuuccugauacccucacaauaugccuagcuuuauacuucucucucuccccagaaccuaaccuuaaaguaauggucucuacugaaaaugcuaguuagucccuaauauuccagacaauaacaacaaaauaaaacaaaacaaacccugaacuuuguggggaagggauaugauauugauaucaucuuggaauugcuacuuuauagcaauauauucaaugccacgccacuuuauucuuuguuuaaauacagaauauaccaccagaggaacauuuuaaguuuuaccugcuccucuguaaaaauggacauuaggguuuugcauuuugcugcaguggguacagccuuuucauacauguggaaagaagaacugggggauacuuuuuagaaauauuuucaagaucaagagguaaugagcauuugcauuuuuauagacauugccaaauuccauucucucauuaagauucuguuccuuuuguauacuuuauuaaaaaaaagaacaaaccuuuauuagugauuggaaaucugguagauaaaagugcaucuugcucuaccaguuagaacacuuugaaacacugccucaugucauuguggauauaugaugucaguguauaagaggagugaaugaaagagggaauauuuggaaacuucagugucuuuucauuaaaacuaauaucuauggcucagaggugaagacuacuggcagcuuuucuagagguccugaguucaauuccuagaacccacaugguggcuuacaaacaucuauaaaggagucugauggccucuuuugucauugaagguauacaugcagagcgaauacucauacauuaaaaaaauacauagauaagaaaaaaauauuaaaaagcaaaacaacaaaacagucaaaaacaacagcagaaauaaccaaaucauuauaaauuauuaaauagccuugcuacucaggggcacaggagcucuaucaguugguaguagacaugggucaguucagagcgaggccccaugaucacuuaguagcuuucaggaacaagggccaauugaauuagaaucagcauuuuaacagacccccaggugauuucuguguacuuuaauguuugggaaguucuagucaaguguucauuuguggcucccaaggaacacacgugaaagauacauuuaaagaaggguagacauggagggguauccugaacuugguuguuaauuggauugguaaagacauuugagguguuggaguguguagaggaauuacagcagaagucuauguggcuuuaccacuuaaaucuuucauauaggggguuuuguuuuguuuuuuguuuuugucugcaauauuagggacuagcauuuucaguagagaccauuauguuagaguuagguucuggggagagaguaguauaauaacuaggcauauugugagugugucagcguuugagucaagaguuuaagggacagugauaaaucagaaugcauuccuagaacaggaacacaaacuuaguauuuuugucuaagcuuuuucuauaaaaggccagauggaauauuuuaggcuuugggacuauauaacucuuugggacuauguaacuguuaguuauagugaaaguagacagguugaaauucuagauuauuuaugguuauuacaauaaaauguuauaugcaaaaccagggaauaggagagauuuggccuuaggguggugguuuguugcucugucuagugucuuuggagaaucaggaaugaacuagaguguuguggguaguugaacaccuuaacaguugaugcacuaaguaacagaauuuagguuuaagguuuugggcuccuuaugagucgaggcuuuguaaagcugugcuugucuuucuuguaagcauaaugccuaaguggcacccagcuucagauugaaguuuuugaguucuugggccagacucagguaguauacuuguaguuaauaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuuuaaauacuguuacuucuucuuuuuuuuuuuuuuuuuuuuuugguuuuucgagacaggguuucucuguguaguccuggcuguccuggaacuugaucuguagaccaggcuggccucaaacucagaaauaugccugccucugccucccaagugcugggauuaaaggcgugcgccaccacgcccggcuaauacuguuacuucuaaagaggccuauaccaaugguucucaaccucauguuguggugaccccaaccauaaaguuacuuuuguugcuacuuuauaacuaauguugcuacuguucugaguuguaauguaaguaucugacauacaggauauuugauguaggacacuuuugaaagaguuguuugacccccaggcaaugcugcuuauauuagaauacaguuaaauguggaggacuacuuaggagggaugaugcagcguagaaaugacauaggaguugcuauauaaaaaaacuuucucaagucuaaucagauguuuacaaguacagcuuuauuagugaauaaucauaagguaagcucacucauguagucaacuugugccaagggaguggaaagauuuagauccccauaaagccuacuuugugccccuuccuucucccugagauaucuugacuuuguguguguguguguguguguguguguguguguaaacaaagagaaucucacagacuauauuauuuuuaucuguauucuuuggcuaacauuuaagagcucuuuucaacugcauugcuauauaaaauguugcuguaauuacauuuuacuaccaaugggcauuugagaguuuuuaaagauaauacuguuguuugaaaauguuccuaaauacugcugggaagcuuuccaaaguuaucauacccauuuuuuacucuauuaguacuauuuugguucaucuccauuucuauguuuaaaaguuucagaccagccuaaguaaaggggcuacauguauggcuggcggugguggugcaugcuuuuaaucccagacuuccgagaggcugaagcaaguugaucucugaguuugaggccagccugcucuacagagaaaguuccaggacagccaagacuagacagagaaauccuaucucgaaaaacaaagugggggguggggggagugacuacauguguguguuguaucuacuggaguagucugagaguagcaccagagcccuucagaguguuuggggacuuguuaauuauugucagccaguaagugaguaguucugguuuauuucuaugaaccuucauauacuugauauaagccugguuuugcuaaaaucauuaauuuaaauaauuaauuguuauaguuuguauuauuuguauaucauuaaccguauuuaacaaauaaauagauaaugcuguuuuuuaaauaaucuuauuacugaggcuuaacaauuacacuauaaaauuaaugauucuuugaaaaauuacuuguuuauuaguucaaaugauucugguauggguacugaauuuugccuguaucaccagaaggcuuaauuuucuugaaaaauuuucauacauuuuuucaguuauuuugucaguaauuucuauucauugcauccugucuuuggugaacagaauccugcugaccaugccuguugccaugaaugagcuaugacagcuaugacaaacuguggcuugugucuuuccacagugucagaaagauauugaaugaaguuuucgagccuuuuaaauguuaccagcucaucuucaccaauauuccugguuucacuugaaauuguguuucuuauacucauuaaaucauuuguuaacaaugcaacacuaaaauugcauaauacacuucaaauaauauuuagauuauagaacauuguaaaaaagagaauauaaaggagcuaaacaauagguuaaauacagguagcuaguauuaggcuuacaaaccaauugauagaaaggugaaaggucuggauagugucaaaguggacaguugaauuauaggauugugcugagcugaggacagaaacaggaguuuguugccuggugauuuuggcagaggcaggagggagauaggauuaguccuugagaaagugaugguuuagugcucuaugcugcagucuauaugucuugcuuuugcuuugauccauuucuguccuagguuugugggccauuuacauguauuguuuuucagugccuugcuuuagugugucuugguaauuuuaauguacaaaguuaauccuaauauauggugguaguuguuuauuuguauaaauaagguuauucaccuuuacguuggugccuaaguggggaagcuugggacaagguacagucaagaaacuggggcugcacaguuucuucauagccauagcuugcugguuuucagaaacauuuaaaucaaagucagagagcuuuaaaugaggaaauauccuacagucacacuuagaacagugucucauuaaugccuggguuuuuuaaucuuaucugguugaaaauugaaauuaaccaucacagcauuauauuggaagcuuuaauuacauuuuuuguuucaucuuauuuuguuucaucacaggguaaggggaugucuguuucuuggcaauaaaaauauacuucuuuuaaagagguaaauuuucuuagaguuaaaaaugaagaggaccuuaauuuuaauuacuuaaguuuccaaaacuauuaaccugauuacaacuuccauuaguacuaggauauuuguuaggcaaauacacuuaaaaguaguuuauuuuguauguaaguugcuauccuagucauuuucuaauucuucacguggucacuuuaggauuuguuugccuauaagaccugcaugcuguauguuuuacaaauaaaacagguucugauuuguaguagcuuuagcuuaaguggcagaaucuagauuugaaguuuuaguuaagaauauaucuuaagucucucuaugguauguuucucuuaaugagauuuuaagugaaaauauucuuuuuuaaaacagcuguuggaaaacacuuuuggcaaguaaaccuuagugaauuccuugaaggcagugguaauauuugguaaacagcacuuugugagacuuuuaacuucuuuuugccaaacuuuugaauaggagaauauagugucacuuagagaaacaucuacuugcuaagagcuuuccccuuuccugaaugauaauuuuuuguuguucuuaggagugccaauagcuaacuccuugcccauccaugauaggagcuuguuaaacucauucacuaauucuuuguaaguuauuccuuggauuuucuaccuuuaucuggcuugcuaauuuccaaacaugguauaucuuuguuccuuuuuguaguacuuauuuuguagauguaauacuuuaaaacuuuuaaugaauuuguuuugauaacuuuauacaugugcaaucccuuaauguccuuucuguugucccguaucuccuuucuaaccccauuagucuccauucuaauucucccuuucucugucugucccucccugucugucugucucucucuuugucucucucugugugucucugucugucucucucuuucucuaagauccauagaguuuaacuaggauuaucuggguauaaauguagauauuuggaaaacagcuuguugcugugguaauuuaccugggcaacaauaguaagcuuccccuguagugucuaaguuguuuguagccaugggguuucagaucaaguuacaguaccagauaugaauucucuguuguggaguaggccucaaauacaguaaaguaaaaagcaguuguuauuuccauaacaguuauacaccauugcaugggugagcacaucuugccuggccgguugguauugcagauuuuaggguucauggcugaguaagacaguugaugccuuuacuccagcaaacggcauaguacuuucagguacaaugaaagcuaacuaacaggaagaagcuuucaacuugguuccagcaaugccuuacaaccaguguauguggugucuucagcaacagggucuuauuaaaguaguucuggugggcagucuacaagagugguaagagccuaauauuguuugugaagcuuccuugauccuaaggcuuagccuauaucaguuuugucucaaacacccaucuggauacccuucucaaacauauacaaauauuaaggcuagagcaauguucauacagaaaaucagacugauaaugagugguuuggcuguucugugcaugcuuuuugaguacuucgacuuuauacucugauccuguguuugguguuuucuccuggguuucaguugagaugauaaauacagcucugaccuccuuacauuacuuuucuucuaccauggccucucugucaguucauucucaucuguucuucuaggaguuauucuguuuuauucuaaacaccuuuugcuuaucuauagauuuuuguuccuauauuuuaaaaaaauugaaauaaaaugccaucccuucccccucuauuuccuuccuccaaccauuccuaacuacuuucucucuaacuccuccuauacuccccacaacucuaaaauugauagccuuuuuuccuuugguuguauuuguuacauccauauauguuuauauguguaugcaaaaauagguggagccuguugaguccacuuuuacugcuuuuauguauauggcuucaaggcugaccagucugcauuggacaaccaguaagggagaggauaauucuccuucuuccagcguuuaggaguucccuguaguucuuugucuaggggugagauguugcuagauuucccugucccacguuaacuugcccauuguguuucaaucuuguuuauguagccauuuccaggagagacuguuuuauggcugacuuccugaucuucuggcuuuuuaaaucuuuccauuccccuuaagugauauucccugauggaggagcugugauaaagauguagauauauauguuggggcugggcuccgcacgauugauuucugucuuauguacaguuguuuucugugaugcucuccauuugcuguaaagagaagccuuuuugaggagugguugccacguuugucuagggaagaugggccacaccuucagaacacauguaaguuagaagacucuaggacauaaaacauaugcaucuguuacacuuuucagcuuaaaugagacuaaaguacuauugaagcuuuuucucuucuuugauuguacugcaugcccuugggcauguguuacuauuucauucuauggguaugaauuucuaaauagcauagaguuuagauuucaauauaguguaauagucucguauaguaacauacuucauagaccuucuuguacucaccccauucacacacacaucaauuucuuguguauuuuucacaacuuuuuuuuuucuuacuaucaaguauguguagaagaaaggauucgauguuaccucuuccuguuucagggguugaugacuggugaugugacaccuggcaguguuauuuaagcagagugaguuugcugacauccauucaguguuauaaauuucuuugggaacagaaucauaauucaguuguauucaggguuuaacagagguugaaucaauauuugcguucuuauuguaaggaaguuuuagagauauuuuuaauacaacugaacuaagguaaagaaacuugggaccagaaaacgugagugauuugucugauaugauccaggaaagagcuagcucuugagggagcugcaauccauucuugcuuccacuguaguauaaugaaccaaagguuggauucuucuauugucaaaauucaauuuugauuuuugccaaccuuuuaaaauauuuauguggaaacugagagauccuaguaagauugaacauacauuuguaaacuaauguugucauguuuuucucagucaggaugguuucaaucccagaauacuacgaggggaagaauauccuucucacaggagccacugguuucuuaggcaaggugcuucuggaaaaguugcugagaucuugucccagggugaauucugucuauguuuuggugaggcaaaaagcuggucagacaccccaagagcgaguggaggaaauccucaguagcaagguaaguuugggagcugagcguauggaaggggguuaaaagaacaugcuuguguggauuuugugaagcauuauuagcuuaauauuuugcuucaguauucaaaaguaaaucuggggaaaaauuaguaaguuucugcaauauggcagugaacuagaaucaggaaaagaaaaaagcuuucuuuuaugauagaccaaauuuucuaauaagguuuaaauuacucuuuguuuuuuuuuuuuuauuuuuauuuugagguaggauuucacuguguagccuugacuguacuggaacucuguagcccaccaugauuuugaaacagaaauaaagaacauagauagaauauauauauuauuaauauauuaacaguauuggggugggggagguauuacuuauuuaacugugcugaagacauuuucacacuggauaguauuuucuuauaaaguacugguguguuuuugggugaucaacaggaucccuggccuauauacauuaggauccaguucugacaaguauuucacauaucaccaaauguuuacuggggaccaaaauuaccucagguugagaaccauugauuuauaggaaugccucaaggaaaagaaacuugauuggaugguggagauucaacuaaaauaguugaucaugggcuguggauguaaauaaauaacuuagauguagagugcuuaacaagaauaugugaagaagcucagaguuccacccucaguaugcucucagcaaguaaaauagcugaucaugaaguauguuuuagaacguugaaaagguaucaguaaacuuaaaguaggaaguaacgggaguauuggugagcagaaagcaggucuacuuauccagagcacggacaguuaguguuuguguugcugacuaccaucuguuuucuuggagcacuucuugaacucgcugagucuuaagucugugucuguaaggugagcagucuucugugccccaugaaaucuaaaauguuaaaauaacugucuuugguggggagagaguuuacaguaggcuuugaaaguagauuagaauaaauaacuacccauagaauaaauaucuucccauuugauagcuuuucgacagguugagagaugaaaauccagauuuuagagagaaaauuauagcgaucaacagugaacuuacccaaccuaaacuggcucucagugaagaagauaaggagaucauuauagauucuacaaaugucauauuccacugugcggcuacuguaagauuuaaugaaaauuuaagguaagaacagauacuuacuaacauuugaauuucauacuuuauagacauaauguuaacuccucuuuuuauugaaguuguuuugagagugaugcgaaauugucauaaguuaauagugacuuucgauaacagaauucucuuuuuuuguuaucauuuugaaaugaaacauagaaaauagcuauuauauggaagauagcuaguauaugccaauuagaaaaccuugccaugacuucaugaaauaggauauaagcaaacagugaacuagaagaaaauaggauguacuuggguaggaagguaggaauaguucacucaguaguuguuuuagucaccuuuucauguagugucagaauccccuaugcuuccauucuaccuacacacuauauagaacagugaucaaaauuaggcucaaguuuugcauauuaagaaauggcuuguauguuauagucacucuguuuauauuugaaaaacucugguggcauuguuaagggacaagguaaugucaaaaauaaaguuaaauuuaaaacauuugaacuucaggcuacauccuucuucuaaaaacaaaaacaaaaaaacauuccacuauuaaguauuuuaaaaauaauaggguuauuugguucuagaagggggaacaaaauacccauggaaggaguuaaaaaguuuggagcaaagacugaaggaaugaccauccugagacugccccaucuggggauccaucccauguacaaccaccaaauccagacacuauuguuaaugccaacaagagcuugcuggcaggagccugauauagcugucuccugccagugucugacaaauacagaaguggauacucacaacuauccauuggacaaagcgcagggucuccaaugaaggagcuagagaaaguacccaaggagcugaagggguuugcagccccguaggaggaacaacaauaugaacuagccaguacccccagagcuccuugggacuaaacugccaaccaaagaaaacucauggugugacucgugucucuagcugcauaauauaguagaggauggucuagucgguccaaugggaggagaggcccuugguccuaugaaggcucuaugccccaguaugggggaaugccagggccaggaagcaggaauggguggguugaugaagggggguggagugagggugggguuggaggggaaaccaggaaaggagauaacauuugaaauguaaauaaagaaaauaucuaauaaagauaaauaaauaaacauaaaaugaagggcuggagagauggcucagcagcaaagagcacuggcuacucuuccagagguccucgguugauugccagcacccuuaugauggcuugcacucauucuaggagauuggccgcucucuucuguccccuguggacacuagcaaauacaugguucacagacauauaugcagguaaaacaaccauacacauaaacuaaaaauaaauccuuuuagaaaguaaaugaauauaaauuucaaauaauggcauuuaauucauaggacuguuauuuuugacggugugucuaaauauacaaguuaaucucauuauauagucuuauacuaguuuaaaugagaaugcauuuguuuuuagguuuaagaauauuugugaugcccuccucuucaaaaaugcuuaaaaggcaaagcucugauuguaaauggcuuuggcaguacuccccauaauuuuuuuuuaacauaaaaguguaacucuuaauagcgaucacacugugugagagcacaauaccaagcauuuugguguaugcaguugcuaccacucucuuacaguuucaggguugugcuuuacagcccucaaagcauugcucacuugccaguuucuuccuaacuuuaccaagcuuauccuaggcgaauccauuuuauuccugagguggcugagguaacacuauggagaaaagggaagaagucuuggaguuacauacauaaguguuuacauagccaccuuaaacuuagugaguuuucaggagcuggugcacaguagauacuauaguucuuguccacuuaaagggggaaauuaggugcuuuuaaagggaaguuuuauuaacagaaaacauuaauuaggguaaaacacaucaaaauaaccuuaacauuuuuugaugacuccuuuuucuuuuuuuauguacauugguguuuugcuugcaugugucuacauaaguguguuggaagcccuggaacuggaguuggaguuaugaacugccaaacuggugcugggaauugaaccaggguccucugaaagagcagccaauguucuuaaccucuaagccauuucuccagcccccaaaauaaaccuuaccggaaggaccacaguauauuacuuuuguguucuuuuuggaucacuauuauuucuuauaccagagagagaccauguuagaaagccuagguaauuuauuauuuuucucuucuaugucaagauaugaauguucacuauucuagcucuagucacaucauaauuauuucugugaaucagauuuaauagauguucacauuuaaauauugauagaacauuagacuugggccagauauucagaaauacuggaaauagccuauaauagccauuuaggggaaaaccaguuauaacagucaccaucugcuaagucacagauaucacaugguauaaaacuguuacuaucgaggggacucaggaggagggaauucaccauaucuggguccuuggagaggagccaagaugaguuuguguauggacucuuucacaaagcccugggguauguguuaacuuuguugauauagaacuaaaugcaggcagcacuggacagcauauguugagaguugaggaggcaaagcucauuaguuuuagauauuuuucaaauauuaaauggggagaaauugacaggacuaaaaggugaggaagaggggaauaagcaguugcuuaaguaguuggucaugaggucuuguauucacuagaugggacaguaucaguugcauggaaaggaauauuaagaagugagaagccaucaugaggucaaaaacagucagaagagagagaauaaucuaguggcuuggggaaaauacaugagauauuaggaauggaacagugaugaggcucaagggggaugaguauggaaguagguuucuaaaaggagugaaagcaccgauuaagauauaggaacgguggaaucuuaaguguauuauucagacucuaagaauguaauaugacuagaauaaugcugggaagggcuugugguggauccuggugcuuguuugggcauuuugugaugacuauuuuucuaguucugucucuggcucugucucagguugugagcuuuuuuagaagugcuccuguagggaaauccucccuuuucuaccucuaaauagaaaacuauaauaacuggaaaacauguuuuaaaaaguagguuccuugaguguacuugacccagcaguuuuggaggcuccuccuuccauuuagcagaaacauuggcucuccuggagagcugcugcacuuaugcuucucuuucagagcccuugcuuuggacacagcuuaacaauuacagaugccuacuucuaaguuugaugucacugacccuaaacaucugucucuaucaaguuuaauuuuuaaaagugacucuuacaauaguaauaagagauaauugagacaguaguuuguggggaaugagaagaguggaaaagaaaauugucaaaauggccuuacuuagaauguaguuucuugguccuuauuucaaucauuaaaaagguaccuucaucuuuauauacucccaaguguaucuuaagcuuaguauaagcucuggaguaaaguuuauaaaaacaucaaauagauuuugaauaauuugggauaucuguaggaaacaaagaggaaagcuuauuagccauuaaaauggaauauuuuuuccuuacuaauuuuuucuuucugaagugauuuuuaugucugcauuagggaaaugcuacacuagcuuauuugcuuucuagcaagccugucuuaagaugcuuuuccaacaaaauauaauuuuauuucuguuuacuuucuggucuaguauguaaagaacucagccugaagucaaacaaaauagaaacuaggguuuccauugagugagguuaacuagucuugcagauacuaaaguaacuuauguuauuuuauuauggcuuuaggcuugggcucucagaugcagacagaguggagagacucaaggcacaggagugugucuuuugaguuauucucauuuucugugaccuagaaacucugucaccauucucaggacgaugcaacagaauaucccuucugauccccauuguuuuguaaaugagaaagaaaauagugcauccucuaaugcccugguggauaguauccucucugugaaaggucucuugcuagauuuccauuugaacagauuuuuuuuucacuccuuaguugagauuugaagugauuuuaagaccccacccuagugucauuaaaaauguuuuuuuuuccuucuaauuuuucucaauaagauaucaggugcaauuaaaagaaaaaaaauagucuaaagucauuugcuuauuuauuuuccuuuuaugagauaguccuuguuucuggugacccagaacuucuuguccuguccucaggagcuuguaauaaaauauucucuguuucucaguauaccucuuccuaaacaauaaccuccuuguccccauuauuuucggacagaucaauaucaaaguauugcuguacagucagguagauggaauugucugugacauauuuuuuaaauacugacaauaugagcauuuuugcaaagugcucgaagccauuuucauuuuuauaaauguauuucacacuuggagugaugcugcauguguguaaucccaggauucaagagguggagguaggaagaucauaaaauugaggucauccuaggcaacauagguaguuccaggccagcccugggcuacaugacucugucuuaaaaagacaucccucaaaguucuuugaaucuauguuuaaacauaacuguuuuacugcugugaagagacaccauggccaaggcaacucuuauaaggaugacauuaaaguagggcuggcuuacagguucaguccauuaucgucaaggcaggagcauggcagcauccaggcaggcaugguggaggaggagcagaguucuacauuuuguccugaaggcaaacagaagacugacuuccaggaagcuaggaggaaggucucaaaggccacaucaaggccagaucuccuaauagugcuacucccugaucaagcauacucaaaccacaguaacauuuuuacauagcccugaaaauuaauuuaauaauuucaccuuuuaaauuuagcauagaaauaauuuacauuuuucucucuuccucccucaccuccucuuuuuuccaagacaggguuucucccuguaaccuuggcuguccuggaacucacucuguagcugaggcuggccuugaacucaaagaaaucugccuacuucugcuucuccagugcugggacuuaaggugucaccaccacugccuggcaguuuauagguuucuaauauuuuacaugguuauauuuuagugacuauaugauauucuaucauguugauauauaauguguaauuuucacuugguauaaaaacuuuauuucuuguuugaaaaauuaggcuuagggugagcuuuugcuuugaaaauuggauuauuagauuaauaaaugcauaauuucaauaauuacugguacuuuauccuaguuucuuuuagauuaguuguauuaauuugugguuauaacaaaacuacucugccaguuuuaccacucaguaguguugaguauuccaaccugucacuuccucuaccuuuauauaugugcagguguguguguuugaaagccauaggacaacuugaggauuccuuaggugccauucaguuuucauuuucucacuuugacguaggauaucuugggcucagccauuaaaggcuacugaaaagauaagagacaggaugucacuggccugggacucccucuauauguuuacauguauaguacaugugcaguggcuaaacugaacuaauuaauaggugugugaccucacauaacuuuucuuguauugagaucacuuuaaaaaccagugauuucuaguacucugguauauuguuauuaagucuaauaauuacuauauuguacaauaaaugucuucauggaccauuaaggaacaauuguauagaaaaacauuuuucugcuaucucuucauuaauacucacuagcugccuguuuugagaugcuuacaagaauaacauacuaaaugcauacaaguuauucuuuucauuuagucuuuccuaauucugguaggagauuuuguuucuuguucccauuuacugaugagaaagcugaggguugaguacuugugcaacuaagcauuuuaagugaauauuuaagugagaccacaccgaucugagcccaaucugauuccauagcuuuguacauaaucuuguuguacaucacaauguaugcuuuguuuuucaaacccuuauuggaguuuauauucagaaaacuuacacauaauugguauagugaagucuuuauacuaaaauaaaauauaacaacucagagcuaaaggaggaauugcaaauuaaccaugcuuuuuuucucuguacuucuuuaauacaauucagauuugguuuguaaauagauuaaagaaaaaagauaagguuucuaaguuucguugucucuuucucuugcagagaugcuguccaguuaaaugugauagcuacacgacagcuuauucuccuugcacagcaaaugaagaaucuggaaguguucaugcaugucucaacagcguaugccuacugcaaucgaaagcauauugaugaaguaguuuauccacccccuguagaucccaagaagcugauugauucuuuagaguauguuugaauuuauacacguugcuuuuaauucuaagacucugaguccaaauauauauacccuucacucccucuaaccccugugguacaaauauacauaugcauguauuuacucugcauauccucugccauauuguucaugguuaugucuguugaugaggucaauguagaguuuucccuuucgauuagcuaaugauuagagaaaggccucugaauaauuuauccauguguuagaggcuugguuuuuuuagguagucaauucuagcuucauuggaucagagaccaauggcugcuuaauuacaagguucuaacuuacuaaaggaccuccucuccugcaauggacaauaccuauagagaagcuguucggguuaagagaaucauaggaauuauaacccuuuaguuacagucuucucuaaggccuggggucucaucagcaguuguuacuaaggacuacauguguauuugguagaggauuaugugaaguguauacacacagcugccacuugcuuuuuagucuaugcuuucuuagcaugggcucuuggguuuguuuuuuuguuuuuguuuuuuuuuggacuacaauuauagaggcauuccaacagcuauuacauccuuacauaauuuguuuucaaacaguauauaucucugaguuguuuuggguuuuuuuuuuuuuuuuguuacaguuuuuguuuuuccuugguuccaucuuuccucacagauauucuacuuacuuuugauucucaucaugccuugauuucuucagaauuaaacacacaugaucuuuaagaaaggcuuuucauguugaggaaaugaauuguaagaaaagcaauaccagagaugacugagacauuucuugugagaauuaucuacuuuuauuuuaugacucaguuucauagauguuccuaaauauauaccucauuuaccuuacagaucaauagauguauuuggauucuggagaaaacugaaguuaaugaaacaauacuacuuuuugacuucuuagucuuggcuuaugcaggcauguaaagaaaugagaagagcuuaugaccugaaucuuuuuucuccuuuccuugcuuacaaagaaaucuaucuaguaaaugauugacgaguuugcucuguaaacucaggagaaauaagguuuacuggcccaagucuuucuucagcaagauuuuuuuguggggugugggugggugguagucucccaccuaccaacuaccuauccuguucacuuuucagaacucauccuuuaucauuuuucucacauuggauauguauuugccugcaguuuaacauucuuagucuuccacauacacaaaguacuuccauaugugaagcauuuuaagcuucccuaguuguuaguaugcuuaguuguuagugacugugcagaaucuaaguguauacuuaguaggcaaaaagacaaguaucuggaaacaagaacacagcgccuuagaguaaaggaggaaagacugggacaucaccugacugugguuguuuuacaggggaucuucagagcuguugagaucauuaaagcauuaaaccugcauuguagguuguuaacugauuuuucauaacaugcuucaaugcuuuuacuaauccuaguaauuguuaaugucacuugugaagauguacaauuccaguaguucaucuuaaauauuuagauuauuagaccuuuuauauuaaauguaaacaugugaauaacaaauguguuuauuuguugguuacucuguuagauaguaauaaacaucuuuaauuucuaaugaaauauuugaggcuugauacauuuuggaauuuauuuggacuuuggaaaggagcucuaauuaacucuuugauaguaaauuacuucauuuugcuuuuccuuagcauuccugaucacccugaucaaagacacaugaaaugcuaaauguuuaaacuaaaugauaccuucuaaagaccuaugguugguuuaggucaguuaaauuugcuaucuaacauacgauuuauaaaaggacuauugguucuuauuugauccaggcguugcagauuguggaucugugauugauauuuaaagagaccacuuuuuuucuucaguuauuuugaaagcugggugugcuggcacaggccuuuaaucccagcacucaggagacagaagcaggugaaucugaguuaaaacucagccugguuuacaagcaagguccuggacagccagggaggggugcacagagaaaucaugucuuaaaaaaaacaacaaugacaacagcacacacagagagagaaaagaaaauguuuuuuuugcgaaaauguuugaaucagagcaauacauagguucauacaaaguucaauuaaguagguuuuuaucuaugauaaaauauuuggaauuuuuguacauguaauuuuuuuuuuuuguuugccagauggauggaugauggccuaguaaaugauaucacaccaaaauugauaggcgacaggccuaacacguacauauacaccaaggcauuggcagaguauguugugcagcaggaaggagcaaagcuaaauguugccauuguaaggccgucgaucgucggcgccaguuggaaagaaccuuuuccaguaagcucuucaaagcuguuaagcucuugggacucagaguuucaaguuagaacuguguaaagacuugggauguaauuuaagagcaggugcuaacaugaugaauguguuuuaccauggcagagcuaacgagcauagaaagagguaauauuacugauacuuauauuucucaggugcuucuugaguguauggaauguagauuaacaguuuuaaguuuuaauugaaaaaucagaaguauucaguaaagaagaccaugguuucaucuguuuucauugcgaaaagcaagccuugcaagaaguguauuuuuccauguguagauuagaaagcuaagaaaaguauaagagauuucuuuuguaacuggcuacuaaaaagaaaaaaaaagauguugggauacuuuuaaauccuccagauaagagaaggcagaaacaaaagccaguaaguaagcugauacaggaaaacccacaaaaacaaaaaaaccccaaguucuguauacuuaccaguaagugauagccucuccuuuguuguuuugauaauuauccuguuuucuucugauuuacucacuaaauuugaggaacauguaucauuuuucccuuaaaaugcugcauuaauaaauaguauaaagucaguggggaacaggguuaauuuaggaaaagugaugcaaaguauauacuuuuuuuuuuuccuuugcagagacuuagcagaacuagguaauccuuuaaaaauacuuucauucagucauuuaugacuccagaggaaacuuuuugggagauucuuggggacuaagaacaauauucugcauggaguguagcgcuuucuuagguuuugggagaaaacuacaaaguauacauuuggaguuagaacuuucaaauaauaaaucuacuuggauguuaauuuauucucuucucuuuuuuuccuuuaauuuuugguauuagggauggauugauaacuuuaauggaccaaguggucucuucauugcgguaaauaaacuuuuuaugauuuacuauuuuauauauuuuccuguaucuuuauacauaugugcacauauacauguuuuggcuauguauuuuaagguguuguuuuuaauuucaacaaaggcagggaaaggaauucuucgaacaaugcgugccuccaacaaugcccuugcagaucucguuccuguagauguaguggucaacacgagccuugcugcagccugguauucuggaguuaauagguauaugaggcaacaucguuguuuacuaacuguagaaacugagggaaaggagcuucugcucuucauccccugguccugguuggcuaaguuagugguaaaaugccuuuugcauauaggaaauaccagugcucauucuaagagcuuguacaguggacacaaugccauguggaccuaucuguggugaagaggaaaugauguuuaaucucauguauuugcagaauguauagguuuguuaggaacuaaaaauggagucugggagggauccuuaugaaggaugauuuaagacaaagucaaacuuaguauaaacucaaguugaaauucacaagaaaugcuccaucugugucaaccauggcacacuagagcagucauaauuaaccugugagcauccuuuuagaugguaauaguagcauuuauaguuaaagccuaaacacuuaaaaaauaaucccuuaaggguaccuuuuacaugauaaaaaaagguacucauuaucaucuugucuuccuacuuagauaguacauaagauuuagcuuagacacuuuugacuuccucuuauguuuccuugcuuucaucuuugucuuugcagaccaagaaacaucaugguguauaauugcacaacaggcagcacuaauccuuuccacuggggggaaguugguaugauuuuaucuauguuuuugaauguuagaacauaaaguguucacugacuuuuuaauguuagaauaccauaagguauuagggccucugaguuacaaagguauuccuauuucaguugcuguuugaaaauaacuaccaguccugccuugugauccaucuuuaauguuucccaauaugagaauagccugauguauguguucagugaccuagucaggcccuaguuguucucuuguuaucugcagcacccucauagacuuaucuguagcuuggggcaguuuuuuuccuaacuaaugagcacacucaggccugauauuaccagucuguaguuaauauuauuugcaccuguaagaguagguguaccaguuggucccuagaguuaacagugaaggaguuaggaaguaggagacauuuggccaagguauguucuucuaaauucaaagauccauagcagauaguacauuuguuaacuagcucuaaaauagggcuaguauaacuugaagcaugcucauuuuaaauuauuaagugagucaaauaugaauguauuuauggcauugcuuuuugcaauggaucauuuuauuuguaguugaaauuuugcuauccuuacagaguaauuuguuuuuaaaguagauuggugcugggaaucagccugccccuuuccucacccacccacuaggucuugugcaugcuagcuacgcacacacuguacugcuacguuucuagcccuuguucugccuugucaguuuuuugagauaaagucucacuaaguagcucagacuggccuggaacuugcaguauagcccaggcuggcuucaaacuaucuauccugccuuagccucccaagugcuggaauuacaggcauacaccaccacaccuagcuaccuuaacauaaucuuaugugacauuauccuaggguuuuucuguggcauuuguauuuaaauuuaaagauugacuguugaaguaaguaagaaaagaacuguagagugauuucacaguauuuuaagucacuguccuucagggauauugaagugguguaagugagugagguuuuuauaacuuuuguugugcuguacaguuuugugauaaaucaaauucaacauucuucguuggugaaugccuaaguauacauuuccauuaaaguauuaaaauagaagauaccaaguuuguguugauguugaguaauguaaauaagcuacagcagagguuaauucuggguuguuucaagcuugucugauguauguugaguaacuaaaucauucauaaacagaguaugaugauuuuccuuuucuuuuuaaguaaguacaguauaagaaucuggaaagaggaacagaaagaaagaagcuaucgugagaggugaaauauagagagugacauuauuaacugaccuagguaaaacauuaagauuuucagagugaauuucaguaaaaauucauucauuuaauuaaaauacuggaaguauuuuagcuccuuggacccagcaguuuaauacaaucuucucuuagcuguggagaguagaaaagcuuguuuuuuaaaugaaugaacucugccucugguaaaauauuuugcauuguacaaacauuucuuuuucaaaacuucauuacaugguuauuaucaaagcuguuacacaacuuuucuuccucagaauaccauguaauuuccacuuucaagaggaauccucucgaacaggccuucagacggcccaauguaaaucuaaccuccaaucaccuuuuauaucauuacuggauugcuguaagccauaaggccccagcauuccuguaugauaucuaccucaggaugacuggaagaagcccaagguaauggugacuagcucugucuuuucuguuccucugacuguuaaacaacccaugcuuaacacugaaaugcacauuaacucuguaucuguucgugcuuaugauaaggcuuaagggccuuuugugaaugagaagacuguugaaaaagacauugucagaaaagcaaagguaguguuguaagucauauuauuuauucuaaaguuuggauaauaaauuacugucauauugaauucuaggucuaacuuuaggugcuuuucugaauaacaaauaauauuuaaaaugcuuuaacacuuauuuuuccuacaggagauuaucuaaaucauuccuucaagaugaauccuuuaaaccaaguauucaggcaccccuauguuaaauucuguuccaacaaccuaaugcuucauuauuggaagggugucaaacauacaguaccugcauuauugcucgaucuugcucucagguugacaggucagaaaccgugguaagaagaauagcaguauuacacuguguauugguaaggugguggaagcuugcuggagagacaccaugucgcuagcaugagcuuacuuuuagaauuacuaacccgaugaagugcaaucacaaucaagaugccaggacauuuccuagaaauuggagauguuuggaggccaagaauggaccucaucauauugggucauugauucuccaaaaucucauuauaauaggaaauguccuacuucaggauugucauuguuauuauaagcugaaauugaaucucuucccucucucccuuaauaaucuaggggugaguuuuuaugggggagucagaguaaaauauuuugcuuuaaaguagaugguuuaguuuuauauggaaaauauaggaugcuucuagaaaauuacuugaaauauuuuagcuacuuauucagcuuauaauaugguaauuacaguuuuugacuaauguucuaguuuuuaaaaguuuaaacacagaaaacuugcuauuuucauauaguuguaauauccuuucuuucuuuucuuuuuuccauugaaacccuacaaaguucuccugucuuaaucacauaguuagugaaauguacuagaaaauguuuauuuuuaaacuauauuaguaucuuugauuggcaaguucaggauuugaguauguauuuucaaagaagaugauuccaggacuuccaucacugcugaaaaaauaaaaguuagguauuugccaguuggaguaucucaggaugagaguaaccauagagacuuucaguauguugaguaguuuaggauguuucuaacuauacauucacuauugaaaugggggggggggguuauugaauagaacaacuuauagaacaaacauuucagguuuucuagaaugauuugcaaaaguaguuuugcuauauuggugcuuuuucauggcuaaaaaucagaugaaauuaaugauuugcuaaugcauauuuauguuaguauaguugcuauaauuagggcagaaaaggcaaaacugguuccaaaacauaaaauagauuauauaccuuauaguaucuuacaaagagaauggguuaauuccuauuaauuaaaaauuaauucauuuuauuaauucuuugagaauuuuuguacaguaauugauauauuuugaucauauucacaccaacucuuucuauacccaccuuuauauuuuuuugggggggaaggaguauugguuuuuaugagacaggguuucuuuguguaacaauccuggcuguucugaaauucacuuuauagacuaggcugacacugaacucagugauuugccugccucugcuucccaaguucugggauuaaaggcgugugccacggccaccuggcuuauauuauuuuaaguaacccauugaguacccacuuauguuguguccuuauagcauugguguggggcauuccacugaaauauguuggaccuacccagagccccaugccuguggaaaacugacucucccuccacugacaacugucaacuaucaauugagcuuuuuagcuagggguggagacacaugagaaccuaccccucccuuuuggauguuaacuggcuuuaucuuguucaggucuaaugaaggcagccacagcugacagcucaguaaacuuaaaaauauguauaauaaaaaggaaaaaaacuccauaguuacuaagaguauagaaaugauacugcuggagcuaaaagagcugaagucugauggaggcugggguauuccaucagccagggccagguauuauugugucucaucaggauugcuuuuuguaggaucuuuuuaaggccuagggguugccucuaagaauuaacuuuugcauagcagcuaaagugguggaacaaguaaaguggaagcuagaaaauccugcauuuuugccuuguuuguucuuugagauaggaucucauguagcccaggcuggucucagguugagagccagaaucauaagcaaaugccaccacgucuggcuuaccucuuuuuuuauuuauuuuuuuuaguugcaagcagaucacaaauccucuuagauguaaggaaaguggguguucuggagaggacucagauccugaaaaugaggaagugagaauggcuuuuagccauuuuuggaaaguacagucuguaauaguuuaccuucuggcccagagaauucacauucuucugccugaacaaugcaguuaauuuuuuucuucuacaaaccccuaugguaucagcuggaugucaggguuuuaccauuuaaaccugauccagucacagaaaugguuguuuauugcagaugauacuccucauaugaaagaaaaccuaugaaacaaaacaaguuagcagcugcccauauauucuacauauauugagagaaguauaagacaguguauuaaacaugagaaaaauggaaggcacacagcagacacuguucuauacaguuucaauugaaguccagguauauguugacagcugggucaacuccuacucucugaguauucuccaacaaccccccccccccccguaagacugaacagauuacuaauucuacuuccugcccauaaaaaguuagauuccaggaaaagggucagaaaaccuuucuuauaaagggccauguuguaaacauuuagaccuuguaagcgcauaguucuguuguuaccucucugccuugguguuaaagaaagaaagcagucauagacaguuuauaaauaaugaacaugauugcuuuaauaaaacuuuauucacaagauaguaauagaguguacuggcugugugggcuuuuguuugcugacuuauguuacagagacauuuuuauugguauacuuucccuucuuauuuaaauucguguggcuuuuaaaaaguuuccacugaguauucuaaagauaauccgaagagauggacucagaucagauagaucagagccuauucacaaaucucuuugagacaagccuuuaggucucaucaggaugcuguggagcaguaccuauagauauuaaauauuuucuccuuaaagccugucauccaacaguagaaaaugugauacgugucuuuacacucugaagaaguuuuucucauuuguuuuguuuauuuguuuuugucuuucugucugaaagguaccacaauguagucuuaaagaaucuuauaucucuaucuuuuaucucuacccugaauuugauuuaugcucagaaacuaucuuuuccccuuuuguuuuuauuuauuaaauaauugaugugauacaaccuaaaauuucugaauuccagauauaaaaauuacacuuuuugaacauuugauguuacuuacaauucacagacuuguuaauagccugacaguagauuagcaucugucuucuccugucuugucaagucucuugcuacuuuuuacuuuccuaagggauuaccuccugucuucuuuuaaauaaauucuuagcaaacugguuaacuguuacuugcaagggugccaucacuggagugguccagucagcuuucaguguaaaaaucuagggaauuucuagcuuuccuauacguauguuucucccagcuuacugugugcagcaguuccuuugcggugaaauaugcugcaugcuuuucagcucccaaggcaauacagcuguguucccucugccuagcacuguucugcuauuauaagccuacagugugguacuugcauauuagcauacuagcuuauguacgugagugagagagauacacuacaguuagaaauuacuuuuuaaauaaauccugaguagccuucuacauuuuuuccaaauuucauucagauaguucacuuucuaagaucagcuuugucuucauucaagaaaucuugacuagauuaaauuuuaggaaaauaggucuaguuuuuaucuuccauguuguauaaauucaaguuccguaaagcuuccugugacuuucuuuucauggcccuuucagauuucaguaaaugaacucaaaggccacaauagagucuucuacuuaauucuaaaaugccacaaacuuuagauuuuuuuuauuauugccaguucuucccaguacuaagauauauuacucuguugcacgacaagucaucacauccauaauuccuuaaagaaaguuguuuuuuuaaaugugucacagugccuguaaguaaagaauucuagaaagauuggugugaaugacuuuggcuaaaggucuuuaagucaaauggaccugaacacuagagagaguuguuaagggagaguaagguugcguaguagcuaggcagcuuucucucuucauguagaguuagacucuccauguguugucugcacauggucugcuuugagcuuccuugcagcgugaaaaccucaggggucauugagcagcaugcagagugacugaagucuuccagggugaguaugauaacgagcaaggcagagcacucuuaguaccuuucuuuuccagccugugacgucaccaccucauucuagugcuuaacagauauuuccccuuguggugggacguuagucuagguaacaguguaccuuacaggaugggugauaauagucuuaccuguaucagagcaggaauaaccugagaccucucuaaguguauaaaauaaaagcaacaaggaguaggguauggugcugcagacuguacuuugcgcacucuggaagcugaagcagaaggaucuccacgcauuugaggccagccugggcaacagaguuccaggucagcauagaauaauuaaaacccuugucucacaaaaacagaaguaaaugaaagcaucaagagauauaaaaguuuacuuaggcaaugcauacauguuaacuuaugucucaguuuauucuuuggauguuuacuuagucaagaguaaguaaauauuacaacuuauauaacccugauauaauacuucauucuacauuaaacuaauguaauucaugguauccagcuuacucauuuacaugauuuugaguguaagcuagauaaaaucugacuugcuguacauuuugaaauaauuauaaguucuauuucauaauauaugaauuuuugcuuauaaagagaccagaguacauaucuagaaucaucauuaaauuuucacuuaacauuacaucauugcuacuuaacauuacaucauugcuacagacggcaucuuuugaaaaguugcuucauguuuuuuuuuguuguuguuguuguuuaguuuagcaucucugaaccugacauuuuucauccauacaauucucagcuugaggacauuugacaauauuuggaguucgucaucacaaaggggaagggugugcuucuccucaacccccagugugcuaaggccauggaugcugccaagugucuuaguacauagauuauuugugaucgcuaagguugagaaacccuagauuagauaauuauuaggaucuggccuugcuguuaacuaugaguauacuuuagaaguuauuguaguaaagaauaaguacauccucagcagguggacgacaguguagucacaagcauucacucuggccugaugaaccagagugauggugcaguuuuaaguguacuuugguuuucugauaauauugucuguuaauuucuccuguauaugaauuuucaaaucucccacccccuucccucuccuguuuuggagacaggguugaauuuuaaaccaugcucacuccacauucauggcaguucuuuggcucacccucccaagugugugauuauaagcaugugugagcuaccaugccugggcccucucucucuuuuuuuuaaauaaauauuuuuugaugaaucaaggguugauuuuuagggcuccuguaucacuugaaugaauuuacacaugaaaauaggcaaaaccugacauuuaaggaaucagggagaaaaauguuucaggagacuacuaauuggaaaaacgaugugaacuauguauauuugggaugaaauuaauguauauuauuauuauucuaccugugauauuguauugauuauuacagauuuguuacaucuguaaagaaauuuuuauagaaaagucuuguuuuuuaaaagcaacuucccccaaucuauaugguuuauucuagauaauagccuuggguguuggauaauucuuuucauguuuaauggaggauuuauuuuggaauucuuuagugaaugaaaguuuuucuuuacauugucuguacugccucauuuucuuuaaguauuuagguuuugggguuucuuuauaaauguauugaauguguuaucauuguuucuuggcuaaugaugcugcuuuuauuuucuucauuacuuuucauauucugcuuuucucccauguccuccauuuguaaagcccuuaguuugggguguuucuaaauuucauauacuuuaagcuaauucuugugggaauguaaacggaauucuuauauuucuugauuauuuuucugguguuuugguguauauuugauucagaagcucuuaauuacugcuuggauuagugcuuugauaucaaugacuuguagcaagcgauaauaaauaaaauuucagauaagauuaagguuccuugcccuuaaaaagaaacaaagaaguauuauacuguuuuguuucucuaagggagaacauaggugaggccugaggagaagaauauuucugaaaauccucaguauuagucauugauuucauagcacauccagauaaucaggaguggugccaaucacuguugaagagaaaguucuuguauuuuuuuaaaagcguugacuaaauggcaaaagaauauuucuguauaucugccucagugaugcuggagcacugggauuagaacauaguuguaggauccuuguuauggauucuccuaaguucagggaagcuaaaggaagacuaaacugaauccuuuugcguagugugauauauagaaaauuugaauuuaaacuuuaguguugcauaucauuugagaauucuguaucagcagaacuuuaugcaggcaauauuaaauuuuaaauucccuuugcugcugcuuauaauuuguuucuccauuuuauaauuauaaauuauucucccaagaugcagaaauauucuaauucucuacugguuugauaacuuacugaaucacaguugggaauacgugauugggaccugugugguaauggauuuuacacauucuauauacuauaugaauuucuugauuuuucuugaaacacaggaugaugaaaacaaucacucgucuucacaaagccaugguauuccuugaguauuuuacaaguaacucuuggguuuggaauacugauaaugucaauauguuaaugaaccaacuaaacccugaagauaaaaaggcaaguauuuucuauuuugggguuagaaaaugaccaguaggcacccugaaaccuagccauuucuaauaacuaucacauaggaaagucauugaucucauauuuucucaguguuuaaaucauaauauuuauaaggagauaaaauuugcuuugucuuaaaacugauacagaguauuugagaguaacaaaugcuuuucagauuaaguuguuauuccuuccuauaagguugaguugaaagagaacuuuaacaucuuuguggguuuuauguaaagaauuccuuguuuucucuaaauggguggggggucgugcuaagaggaaguggacuccaauugcuuuuuuauauuguaugagcuuugccauuucauuuugcuuauuugaaaguuuaaacuguguuccuucugaaguuaacucagauuuuguuuuguuuuguuuuuguuuugugagacacugucucucuauagcuauugugauacucacuaugugguccaggcuggccucaagcucccaaagauccaccugccucugccuccugaguguuggauuacaggccugugcuacuaugacccagcuaccgcauauauuuuaguauauuuaucugucuuaaguuaaacguauuuaguuauuuuacuuuaggggauagaaguacuaggggcugaaccuagagccuuauucucuguaguuuccuccuuaagguaguuacguuuugcuaugcuaaugucuugaguccuccagggaugugggaguuuaccucuaacugguucuccaggucaagccccacaauuaaaagacauuugcuccaucuacuuucauucuuggagcuucucuuuauuaucauuuuuuuuucugucugacauguauuuagaauaccagaguauggcuaaauuaggagauugaucauagugaacuuucagcuuuugauuguuagucuuuaguucacccuaggguuuucauuuuguuuuguuuuuaacacuagugcagcacauuaaggauuauuuuauguucugucaguuuuguugcaguugaaaugucaguuauuuguuuuucuggcucuuuucuagguuuuccacguuugguuuucugaaacuuugggcuuucucuaccuuuagauggguguuuuucagcaauuugggaauuucuuaagcauuuguuucuucaaauguugcuacuucucuaccuucucacagaauuguuauaugguagaccaauguguccuuaggucuauaacugcaaauaaauacuuugcuuuuggacuaaaguguaaauaauuuaaauuuuucaacagaaagucagcuggguugaaaccauuccauugaguuuauauguuuucauuuuuagaaaguucaacuuaaucuuggauaucuccucauaauugcuguaaauccuuucucucauaguucacauuuaaaugauaggcaguguccgauucugcuguuugagcccagucuaaaaccaggguaccuuguuuccaaguugucguuuuguuaaucauuauucauuuuucuuuaauucauauucuuugaggauucuauugaauuuugggggauguagauuaaaguugaagcuuuuuauaagaauuugcuaucaaggaggccuucauaaagcagagccucuaaaacaugugcugaguauuucaccuuuguugaggugaaugcaguuauauagaccagaauacugggucaggguuaguuuuccaaagagacuuucuguuuuccauccagugcauuaauuuuuuuaaaguauuugauuuaaccugaucucucaaaaauacuuugaacauaucaaaacuuuaaaauaauuuagaucauuucaguuaauuuuucauugacacccaaugugccuuugcaucuuagcauaguucauguugcuugugaauuccauauugaaaguagagaaccaacucauuccacuagcucgguagauaagagguuucaaucuaaauguuuuauuugauuuuuuccuuugcucugaagauacagcucuuuuauuuuacuuagugugugagugcguauguguguuugugucuugauaucaguaucuguuuucuaauacaaugcuuacauagaaacaguggugucagcaauucauugcaucauaggcuaaggagaggaacaauuuacagaaaaugauuugugacuauuuaaaaacauuuguaagaaugaaagucaaaaguagacugaauuguauuuguuauuuaccagauuuuuaaaccugcaggcuuugacagcauacucuaguaggccuuggccaaauucauuuauuacuaguaguaauguguggcuugccugucuucaacuuuguguucagcuaguuugcauucuuaucuuuuagucaggugucuuguaaacaacauaguuguuauaguuguuauuacagucuguuaguuauugacccauuuuggagaauuuaaccuguacuauaaccuguaauuuuguuggaguuacauguuguuguacuaagacagaccuuugcaagggggugagcuacaucccaaccucaauuuuagauuuaaguuuuagugcuuaauuuuguuguaccuagcuuaauuaucuuuucuguucucuuuuuuucccugguuuuuagucucuuagacauagucaaaguaagacacaagcuggccuuaaacuuuaccuuaaacuuccuaccuucuuaaacgcugagauuguaggcaugcucuauacaccugacccuuuagguuguuuguuguuuuucauaauuuuaauuugccacuuccuuuaguuguaucaaaaugcauucuuuuccaacuuuuuuaguacuuuacuuuagaaaauacagguauuggguauaguauucaagacaggauuucccuggaacucucuguaaaccagguugaccuugaacucucagagauccacuugucucugucucuuggguguugggaugaaaggcauaagcuaccaccacaguaucuuuucuuaagccuaacauaaauggauacugugaccuuuuuuuggauagagaauaaacaaugccucuauuuugcuauaacaggucauuuguuauuaguuuuuauuauuuauuuauuuauuauuuuauuauuuauuuguuguuauuagucuguuuuaugcugguguaggagaaaaauagguaauuucuaauuaauagaaguucacaguucuggcugcuaagcagggacugacaucugauaaaugccuccucuugcuucauuucaugguaaaagagcaagagagaauaggagauugaacuuacaaccuuaucuccuuuaauuggcauugauucauucaugaggguugucuacccuuacaauguagccgccuccuguuaguccuccccuuucaaaacuucuguuaaagauuaaacuccaccauguauuuugaaaggaacagaaguaaaauuagugcagucuaugcaaaacauacucauauaauuagucaggaucaucaccuuucugcugccuugauuuucuuccaccugccgguauccacagagacuucuguggagagucuggaaucuggagucauucuacuucuguccuaaagaauacuaaagaauucuucauuguggaugauaccauaucgcuccaguuuuuauucuucuggaaauaucuuuauuucaucuuaauuuuucaaauaucuuuacauugguguggauuguuacauuaguugcaucgguuacauuaguuaaaucuguuguauacuuggaaaacauggucuuuuggguucuacuguaucuguugucugguaguuauuuuguagguaaccuaucuggacuucuuucugacuuauucuuagaugccugaauguguauguauguauauaugguagguaugguauuuaaauuuguguuugguguuucaucauuuuugcaggcaacaugcucuuacguacuguuugggcucuuuuuuuucucuuguggagcuccagucaguuggguauggcuccuuugugaaaucaagucugcaucuguguuggugccaugacacuaucuuuucauuucaguacuuuauuuauaauauuucccccucuagaacuuguuauuuuuggaugaugguuuauagugaauaauuuacuugucauuucacaaaaauaccugacugccuguuugcucaagaguacugaacaguuauaacccucuuacuucuccucuacuuuauagaguagcauuucuauaaagucugcuuuucuagacuuaucuacacuuuucaucaaauuacauaagagcuguuacuaaaauccuaagccagaauuuaugcgguuccgcuuuuuauuguuugucuuagucacugugaagagacaccauuuaaucagguucuugcuuauacucucaaaguccauugucaucauggcaaaggcauggcggcuugcaggcaggcucugaaauaguugcugauucuuaagcagagagguagagagccuaggccugguaugggcuuuugaaaccucaaaggccaccccagugacucuuuauccaacaaagccacacucucuaauccuuucaaagaguuacacucccuagugacuauucaaauauaugagccuaugugggugauucuuauucaaaccaccacauagagacuggcuucaaacugaugacccuccugccuacugugugcucauauaauagugugugccaccauguucugcuugauuucucuugauguaaauauuuuucucuaggagaauuaaccuuuauccuacagaaacuauauaagaaggggaggcugcagauggaaaaaauuugaaauguauaucaguucauauguaaguaguuaggagaaauauagauaaguugacaguagaaaagguaauacuauaucgaaguguuuguaaucuuuucauuugggauuauaguucagaagaauaauuuuuggcaaauuauaauaacuuuuuucuuuguacuauagaccuuuaauauugauguacggcaguuacauugggcagaauauauagaaaacuacugcauggggacuaagaaguacguguugaaugaagagaugucuggccucccugcugcucggaagcaucucaacaaguaagcacgcccaggcuugaugagccuuuuccugauuugugaacuguuacacgguugccuugguaaaggacuguucugaauacaaauaacguagcauauuaaaaaaugcuugcccuuggguuuguaacaaugugauaguuaucuaacuuaagauuauuaaaagacuggagagauggcucagugguugagaacaccggcugcuguuccaaaguaaagauaauuaaaacuuaauaucuuuauuaauguauguguauuccugaauauggacuuugaguagaacuuaguuucaaaaaucacuauuugcuucuaauaaauuucuauugaaaaaguaaaaauguuagcagaaaaugaaaauaucuuuugaaccagaaguuacuuacauauuuuuuuaacauauugcacagaauaaugguuccuuagucucuuaguagaaguaguucuugcugauuuaaaacauaauacacucagaaaauagaggagucaagauuagcuguagucagucauucagagauuuaguucuacuaaggauuaucgauuucugagauucauacuuuucacuugccaaggccacagcacuauggagcuggcaaaaugccagauuuguugauaaggaaacugagguuuacaaaacuauauuuuacuaauuggaagggaaacugaaacauaaauguuuugacugcuuauuuaaagccacagucucuacuucuacacuuucacugcuacagccugucuugaacugcaauauaaaaaaaauaaaauauaaauauaaauaaaguuccuggaauuuauaauauaccuaucugaaggguuaaauuucuucaggcaaccaucaaaagccauaaaaaaauguuuagaaauaugcacauuguaacaugcuugcugaucuuugaaagcagaaagguauucuauggagcuaaugcugcauuauucuuagaugaggacuuguuaguuggcuuuugaguuuggggacuauuagcuauucgaggcucuuuuagauuagauagacgcuccagaaauucagcacacacaagagacuguuuuacuucauuuguuugcuugcuugcuugcuugcuugcucacucucuuccuucuugccuccuuuucuuccuuuccagauuucuccccacaccuuuuuauuucugacagaaucucauucuguggccuagucugaccucaaacucagaucuuccugccuagguucagccuccaaaaugcuaggaucacaggaaugaggccaggcuuggcuuaaccuguaguuugaugaugucuaccauaggaauugguacacaggaugcucaguuugauugaugcuuacuaagucuguaguccagguacacugacaagauguuguuguacuccuuguugcuagaguaaugcauugaugugcuacuguccaguuguaggcagauauguuugaaaugugcuaacuugaauuuaauaacuuuaguuuuguuuaguuuuuaaauauugaaaguuaaaagauguuguagaauuuugauuaaauuuauaacuuaauuagcuccuauccaaaaauaauuuuauuauagaaaauacuuagugugucuuuugcuuugcuuuucagguugcggaauauccguuaugguuucaauacaauccuugugauacuuaucuggcgcauuuuuauugcaagaucacaaauggcaagaaacaucugguauuuugugguuagucuguguuacaaauuucugucauacuuccgagcauccagcacuaugagauacugaagaccaagaauuuagcauuagaacaucuaugcauauggugaucuaaaugcacaaaauguaaaauguacuuaagacaucucaccuuuuguuaagacauuaaaccaucuuaaauuggagcguggaguaaauuaugguccauuuuauguagcauuuuaauguuuaugcucaaaaccuagugaacacacugugguaugccagcucagaacugcaguagucacucaaauuaugauucaacauuuuaauccuuggaaugcaaaggguaggaagggggcagaaguggggcuaugggagcauugaccaguauaacugugcaguucuggaacauauuaauuaaaacaugccuuaacaugaaguccuaauauucagugcaauggaaaaugugcagacagaaggccuagauaaauuaguuaaggauuugauuugauuugauucuucaauguugauuucuuuuuucuuuuuaauccuuugagaggugggguuuaauuuugcuaagaccacagccauguguuuuuucuuccuguaaguuacagguggugucaaacgcaaagacucguucugauuuucuuucugaauaaauguguguugcauaucauuuuuuauaaguaauuaguugcucuuaugaucagaaggccaaauauuauucuaaagacacuaauagaucuggaugaauuuaagauucuguaucaauguauacucugcauuugaagcaaagugaaaacaugcacgguaaaggaaaccacuuuucuagucugcauuuuguucaaauggaacucuggugagauguguuuucauuuugaagaggauuucuugagacgugaugagaggugggauuggggaaggauucauuauauuuauccucuccuccuuauaaauuuucccacaggacuugccccauaugaacaugcauuauuaugaaggaauguaguugcagcuuuuaacauuaagaaaauguccucauguguuugccaacacacacuaauuugaucuugaaagcugaauuccuuuaaaaaugaauaaugcauaaguauguguauaaaauuaaauaaaggauuuuaccauguaaaguagcaaacuguugaaugaguuucaagucaucauuucuuugcauguuguuuuagcuuuagaaagacaugcguuauagaaacaaguaauagcaaaaaauugauguauauuuauugauucaauucccuuuaaaucuuacuaguuuguuacuauuuuauccauauuuuuaauggcuuguucagcauaacacaguuauaauuaagcugaucaaguuguacuacauuuaaaucaucagcaguguaucuugaaagugcuuaaaggguuaguucauaguacaagaaauuaaaugcaacuuuacauuuuaauuuuuugucaauuaaaauacaauguagaaguuuauuuuacuauuguggacacaaaauguaaaggaaaccaacuuuuuccauacugauguauaaucuugaaaaggaaaaaaaaaaaaagcuucucuguugaagccagacuuuguguaguaaaacuuuuaaacauuauuuuaaaagaaauauguauauaaguaucuguguauucuuuggaaugauucugaagucucuggucuaggaccaugccuguauaaggugugagagaccaugauggugugugagaauggaauaaaugaugccuuugauuuaagguggcccauauaauauacauugaguacuccaugucuccaaauggauuuccaugauguaaugaaaacacacuaaccuuuuuaugauuuuuauacaucugccaaaauauacugagaaucugauaaauugucuuugggucucugaaaagaaucaggugcaaugugggcaggccuguaaacugaaccagauaugugucuucuauuuuauugcucuuguaaucuaauguaaagaauugcuaacuaaggcugugcugaggaggucaaauuaauuuuuauuuguuuagaauucuguugucaaaagaaagguaaugaauaaaugaugcucauccuagaauguauaauuuugaaauuaguauggaguaaaaugugagagcguugagcuuuaucagcuacacuugcauucaagucauauuguaagaguuuggagauguaugcucuuuguaauuugcuacaguguuuuuaguucugauuauauuuuucauauagauuauucaauaggacaacucuguuaaauaaauuaauuucauucaccucauuuggcaaaacuguauucugaaccauuuaggguuuuucccuuaucuuuccuucucugaacucuggcauacauauuuguacacuguaaugucauuguaacuguuuaauugccuuggcaaugcuaauguaucguaacacuuaguugagaaaagcaugaccgggucauauguuguuugacuuaaggguaacauagaauaaguguuucuccagucugccagacaaagcuugguagugggaggggacucugaccucucccuuuuguguuugucuauaggaauugauugggaaacuuuuguuuuguguuuuuuguuuguuuguuugaaguguaaacugauacucuuuuauaagaaguaaauacaaacauuauugggugccuuuguuuguaaaccaaaaaguaauaaaugaaucccuauauuucuauuauagcaucuauuguauuuuuacauuguggaaaccauccaugaguuaaaauggcuacgauggcaaaaguaguccuuggaucuuuuuucuuucuuagguguccucaucuauucucaucaucuuuuuauuuaugucuugaguuguucacacagcacuuuaggggaagcauauaggcagaaugaacauuuauuuaaaaguauuuuuauauagugauuaauaaugagacagauuuuuuuuuaauguaaauaaaaccgggagaccaccagcguguuccaaggaugaaugacauuauguuaguuuauagguucuucaccaguaguagaucugacuucauuuaaaggauuauucauuuucauagagauugagugaaguacuuggcgggggugcugagagugugucaggaugggguuagaguguaaauggcuuuguaagcauuccuuucuaggcugacuuccagcucugacuugaaaccguuugcaccgacuugcucugcuuuaagaaaaacauucuaacugcaugagaagcuuagagaaaaggguaugugcugcguaacuuacuacaaaaaaugaguuuaucagucuguuuauauaugaaauauuuucuuaauaaagaaaauuugagcaacauuaag

SEQ ID NO: 4044 - RNA, 34501 nt, Mus musculus
auccauguauugcauuuuuaauguuuuaaaguaauauuuggagagaggcaggagauauggcucagcaguuaagaauacuggguugcuuuucaguggacuuggguuugauucucagcauccgcacggcaucucaaggucaucuuuaacuucaguuccugagauccagcacucuguucugaccuccauggcacugcauguaagcagucgcugauacacauguaguaaaaauacacacauuaagaaaaacuuuuaaaagauuauuacauguuuuaaucucuuauuuuaauauuuuuaaaaauauuaaauauuuuuauaaauuuuguuagaauuucauacaugaauauagucauuuugaucauauucacucaagcugcuucuccuucuaacuauuccuagaucuacuuccaggcaacccccuuccaaauucaugucuuuuuuuuuuuuuuuuuuuccuuaacucacuaaugcaguuugugguguucauauacucagugggugugacgccauccacuguaguaugguccaucuacuaggauccauaucaugaaagauagcuggcuuuuccuuccccagaagccaacagccgucaguagcuccucagcuagggguagaggcuuuucuaugcuuuaauguugaauugcuugaucuuugcagguaaccacagcugugaguucauacguucagcaguccugacaugacaauguuuuggucugguccuccuggaacucuggcuuuucaagacuuguuaucccuuuccugauacccucacaauaugccuagcuuuauacuucucucucuccccagaaccuaaccuuaaaguaauggucucuacugaaaaugcuaguuagucccuaauauuccagacaauaacaacaaaauaaaacaaaacaaacccugaacuuuguggggaagggauaugauauugauaucaucuuggaauugcuacuuuauagcaauauauucaaugccacgccacuuuauucuuuguuuaaauacagaauauaccaccagaggaacauuuuaaguuuuaccugcuccucuguaaaaauggacauuaggguuuugcauuuugcugcaguggguacagccuuuucauacauguggaaagaagaacugggggauacuuuuuagaaauauuuucaagaucaagagguaaugagcauuugcauuuuuauagacauugccaaauuccauucucucauuaagauucuguuccuuuuguauacuuuauuaaaaaaaagaacaaaccuuuauuagugauuggaaaucugguagauaaaagugcaucuugcucuaccaguuagaacacuuugaaacacugccucaugucauuguggauauaugaugucaguguauaagaggagugaaugaaagagggaauauuuggaaacuucagugucuuuucauuaaaacuaauaucuauggcucagaggugaagacuacuggcagcuuuucuagagguccugaguucaauuccuagaacccacaugguggcuuacaaacaucuauaaaggagucugauggccucuuuugucauugaagguauacaugcagagcgaauacucauacauuaaaaaaauacauagauaagaaaaaaauauuaaaaagcaaaacaacaaaacagucaaaaacaacagcagaaauaaccaaaucauuauaaauuauuaaauagccuugcuacucaggggcacaggagcucuaucaguugguaguagacaugggucaguucagagcgaggccccaugaucacuuaguagcuuucaggaacaagggccaauugaauuagaaucagcauuuuaacagacccccaggugauuucuguguacuuuaauguuugggaaguucuagucaaguguucauuuguggcucccaaggaacacacgugaaagauacauuuaaagaaggguagacauggagggguauccugaacuugguuguuaauuggauugguaaagacauuugagguguuggaguguguagaggaauuacagcagaagucuauguggcuuuaccacuuaaaucuuucauauaggggguuuuguuuuguuuuuuguuuuugucugcaauauuagggacuagcauuuucaguagagaccauuauguuagaguuagguucuggggagagaguaguauaauaacuaggcauauugugagugugucagcguuugagucaagaguuuaagggacagugauaaaucagaaugcauuccuagaacaggaacacaaacuuaguauuuuugucuaagcuuuuucuauaaaaggccagauggaauauuuuaggcuuugggacuauauaacucuuugggacuauguaacuguuaguuauagugaaaguagacagguugaaauucuagauuauuuaugguuauuacaauaaaauguuauaugcaaaaccagggaauaggagagauuuggccuuaggguggugguuuguugcucugucuagugucuuuggagaaucaggaaugaacuagaguguuguggguaguugaacaccuuaacaguugaugcacuaaguaacagaauuuagguuuaagguuuugggcuccuuaugagucgaggcuuuguaaagcugugcuugucuuucuuguaagcauaaugccuaaguggcacccagcuucagauugaaguuuuugaguucuugggccagacucagguaguauacuuguaguuaauaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuugggccagacucagguaguauacuuguaguuaguaugcuuuaaauacuguuacuucuucuuuuuuuuuuuuuuuuuuuuuugguuuuucgagacaggguuucucuguguaguccuggcuguccuggaacuugaucuguagaccaggcuggccucaaacucagaaauaugccugccucugccucccaagugcugggauuaaaggcgugcgccaccacgcccggcuaauacuguuacuucuaaagaggccuauaccaaugguucucaaccucauguuguggugaccccaaccauaaaguuacuuuuguugcuacuuuauaacuaauguugcuacuguucugaguuguaauguaaguaucugacauacaggauauuugauguaggacacuuuugaaagaguuguuugacccccaggcaaugcugcuuauauuagaauacaguuaaauguggaggacuacuuaggagggaugaugcagcguagaaaugacauaggaguugcuauauaaaaaaacuuucucaagucuaaucagauguuuacaaguacagcuuuauuagugaauaaucauaagguaagcucacucauguagucaacuugugccaagggaguggaaagauuuagauccccauaaagccuacuuugugccccuuccuucucccugagauaucuugacuuuguguguguguguguguguguguguguguguguaaacaaagagaaucucacagacuauauuauuuuuaucuguauucuuuggcuaacauuuaagagcucuuuucaacugcauugcuauauaaaauguugcuguaauuacauuuuacuaccaaugggcauuugagaguuuuuaaagauaauacuguuguuugaaaauguuccuaaauacugcugggaagcuuuccaaaguuaucauacccauuuuuuacucuauuaguacuauuuugguucaucuccauuucuauguuuaaaaguuucagaccagccuaaguaaaggggcuacauguauggcuggcggugguggugcaugcuuuuaaucccagacuuccgagaggcugaagcaaguugaucucugaguuugaggccagccugcucuacagagaaaguuccaggacagccaagacuagacagagaaauccuaucucgaaaaacaaagugggggguggggggagugacuacauguguguguuguaucuacuggaguagucugagaguagcaccagagcccuucagaguguuuggggacuuguuaauuauugucagccaguaagugaguaguucugguuuauuucuaugaaccuucauauacuugauauaagccugguuuugcuaaaaucauuaauuuaaauaauuaauuguuauaguuuguauuauuuguauaucauuaaccguauuuaacaaauaaauagauaaugcuguuuuuuaaauaaucuuauuacugaggcuuaacaauuacacuauaaaauuaaugauucuuugaaaaauuacuuguuuauuaguucaaaugauucugguauggguacugaauuuugccuguaucaccagaaggcuuaauuuucuugaaaaauuuucauacauuuuuucaguuauuuugucaguaauuucuauucauugcauccugucuuuggugaacagaauccugcugaccaugccuguugccaugaaugagcuaugacagcuaugacaaacuguggcuugugucuuuccacagugucagaaagauauugaaugaaguuuucgagccuuuuaaauguuaccagcucaucuucaccaauauuccugguuucacuugaaauuguguuucuuauacucauuaaaucauuuguuaacaaugcaacacuaaaauugcauaauacacuucaaauaauauuuagauuauagaacauuguaaaaaagagaauauaaaggagcuaaacaauagguuaaauacagguagcuaguauuaggcuuacaaaccaauugauagaaaggugaaaggucuggauagugucaaaguggacaguugaauuauaggauugugcugagcugaggacagaaacaggaguuuguugccuggugauuuuggcagaggcaggagggagauaggauuaguccuugagaaagugaugguuuagugcucuaugcugcagucuauaugucuugcuuuugcuuugauccauuucuguccuagguuugugggccauuuacauguauuguuuuucagugccuugcuuuagugugucuugguaauuuuaauguacaaaguuaauccuaauauauggugguaguuguuuauuuguauaaauaagguuauucaccuuuacguuggugccuaaguggggaagcuugggacaagguacagucaagaaacuggggcugcacaguuucuucauagccauagcuugcugguuuucagaaacauuuaaaucaaagucagagagcuuuaaaugaggaaauauccuacagucacacuuagaacagugucucauuaaugccuggguuuuuuaaucuuaucugguugaaaauugaaauuaaccaucacagcauuauauuggaagcuuuaauuacauuuuuuguuucaucuuauuuuguuucaucacaggguaaggggaugucuguuucuuggcaauaaaaauauacuucuuuuaaagagguaaauuuucuuagaguuaaaaaugaagaggaccuuaauuuuaauuacuuaaguuuccaaaacuauuaaccugauuacaacuuccauuaguacuaggauauuuguuaggcaaauacacuuaaaaguaguuuauuuuguauguaaguugcuauccuagucauuuucuaauucuucacguggucacuuuaggauuuguuugccuauaagaccugcaugcuguauguuuuacaaauaaaacagguucugauuuguaguagcuuuagcuuaaguggcagaaucuagauuugaaguuuuaguuaagaauauaucuuaagucucucuaugguauguuucucuuaaugagauuuuaagugaaaauauucuuuuuuaaaacagcuguuggaaaacacuuuuggcaaguaaaccuuagugaauuccuugaaggcagugguaauauuugguaaacagcacuuugugagacuuuuaacuucuuuuugccaaacuuuugaauaggagaauauagugucacuuagagaaacaucuacuugcuaagagcuuuccccuuuccugaaugauaauuuuuuguuguucuuaggagugccaauagcuaacuccuugcccauccaugauaggagcuuguuaaacucauucacuaauucuuuguaaguuauuccuuggauuuucuaccuuuaucuggcuugcuaauuuccaaacaugguauaucuuuguuccuuuuuguaguacuuauuuuguagauguaauacuuuaaaacuuuuaaugaauuuguuuugauaacuuuauacaugugcaaucccuuaauguccuuucuguugucccguaucuccuuucuaaccccauuagucuccauucuaauucucccuuucucugucugucccucccugucugucugucucucucuuugucucucucugugugucucugucugucucucucuuucucuaagauccauagaguuuaacuaggauuaucuggguauaaauguagauauuuggaaaacagcuuguugcugugguaauuuaccugggcaacaauaguaagcuuccccuguagugucuaaguuguuuguagccaugggguuucagaucaaguuacaguaccagauaugaauucucuguuguggaguaggccucaaauacaguaaaguaaaaagcaguuguuauuuccauaacaguuauacaccauugcaugggugagcacaucuugccuggccgguugguauugcagauuuuaggguucauggcugaguaagacaguugaugccuuuacuccagcaaacggcauaguacuuucagguacaaugaaagcuaacuaacaggaagaagcuuucaacuugguuccagcaaugccuuacaaccaguguauguggugucuucagcaacagggucuuauuaaaguaguucuggugggcagucuacaagagugguaagagccuaauauuguuugugaagcuuccuugauccuaaggcuuagccuauaucaguuuugucucaaacacccaucuggauacccuucucaaacauauacaaauauuaaggcuagagcaauguucauacagaaaaucagacugauaaugagugguuuggcuguucugugcaugcuuuuugaguacuucgacuuuauacucugauccuguguuugguguuuucuccuggguuucaguugagaugauaaauacagcucugaccuccuuacauuacuuuucuucuaccauggccucucugucaguucauucucaucuguucuucuaggaguuauucuguuuuauucuaaacaccuuuugcuuaucuauagauuuuuguuccuauauuuuaaaaaaauugaaauaaaaugccaucccuucccccucuauuuccuuccuccaaccauuccuaacuacuuucucucuaacuccuccuauacuccccacaacucuaaaauugauagccuuuuuuccuuugguuguauuuguuacauccauauauguuuauauguguaugcaaaaauagguggagccuguugaguccacuuuuacugcuuuuauguauauggcuucaaggcugaccagucugcauuggacaaccaguaagggagaggauaauucuccuucuuccagcguuuaggaguucccuguaguucuuugucuaggggugagauguugcuagauuucccugucccacguuaacuugcccauuguguuucaaucuuguuuauguagccauuuccaggagagacuguuuuauggcugacuuccugaucuucuggcuuuuuaaaucuuuccauuccccuuaagugauauucccugauggaggagcugugauaaagauguagauauauauguuggggcugggcuccgcacgauugauuucugucuuauguacaguuguuuucugugaugcucuccauuugcuguaaagagaagccuuuuugaggagugguugccacguuugucuagggaagaugggccacaccuucagaacacauguaaguuagaagacucuaggacauaaaacauaugcaucuguuacacuuuucagcuuaaaugagacuaaaguacuauugaagcuuuuucucuucuuugauuguacugcaugcccuugggcauguguuacuauuucauucuauggguaugaauuucuaaauagcauagaguuuagauuucaauauaguguaauagucucguauaguaacauacuucauagaccuucuuguacucaccccauucacacacacaucaauuucuuguguauuuuucacaacuuuuuuuuuucuuacuaucaaguauguguagaagaaaggauucgauguuaccucuuccuguuucagggguugaugacuggugaugugacaccuggcaguguuauuuaagcagagugaguuugcugacauccauucaguguuauaaauuucuuugggaacagaaucauaauucaguuguauucaggguuuaacagagguugaaucaauauuugcguucuuauuguaaggaaguuuuagagauauuuuuaauacaacugaacuaagguaaagaaacuugggaccagaaaacgugagugauuugucugauaugauccaggaaagagcuagcucuugagggagcugcaauccauucuugcuuccacuguaguauaaugaaccaaagguuggauucuucuauugucaaaauucaauuuugauuuuugccaaccuuuuaaaauauuuauguggaaacugagagauccuaguaagauugaacauacauuuguaaacuaauguugucauguuuuucucagucaggaugguuucaaucccagaauacuacgaggggaagaauauccuucucacaggagccacugguuucuuaggcaaggugcuucuggaaaaguugcugagaucuugucccagggugaauucugucuauguuuuggugaggcaaaaagcuggucagacaccccaagagcgaguggaggaaauccucaguagcaagguaaguuugggagcugagcguauggaaggggguuaaaagaacaugcuuguguggauuuugugaagcauuauuagcuuaauauuuugcuucaguauucaaaaguaaaucuggggaaaaauuaguaaguuucugcaauauggcagugaacuagaaucaggaaaagaaaaaagcuuucuuuuaugauagaccaaauuuucuaauaagguuuaaauuacucuuuguuuuuuuuuuuuuauuuuuauuuugagguaggauuucacuguguagccuugacuguacuggaacucuguagcccaccaugauuuugaaacagaaauaaagaacauagauagaauauauauauuauuaauauauuaacaguauuggggugggggagguauuacuuauuuaacugugcugaagacauuuucacacuggauaguauuuucuuauaaaguacugguguguuuuugggugaucaacaggaucccuggccuauauacauuaggauccaguucugacaaguauuucacauaucaccaaauguuuacuggggaccaaaauuaccucagguugagaaccauugauuuauaggaaugccucaaggaaaagaaacuugauuggaugguggagauucaacuaaaauaguugaucaugggcuguggauguaaauaaauaacuuagauguagagugcuuaacaagaauaugugaagaagcucagaguuccacccucaguaugcucucagcaaguaaaauagcugaucaugaaguauguuuuagaacguugaaaagguaucaguaaacuuaaaguaggaaguaacgggaguauuggugagcagaaagcaggucuacuuauccagagcacggacaguuaguguuuguguugcugacuaccaucuguuuucuuggagcacuucuugaacucgcugagucuuaagucugugucuguaaggugagcagucuucugugccccaugaaaucuaaaauguuaaaauaacugucuuugguggggagagaguuuacaguaggcuuugaaaguagauuagaauaaauaacuacccauagaauaaauaucuucccauuugauagcuuuucgacagguugagagaugaaaauccagauuuuagagagaaaauuauagcgaucaacagugaacuuacccaaccuaaacuggcucucagugaagaagauaaggagaucauuauagauucuacaaaugucauauuccacugugcggcuacuguaagauuuaaugaaaauuuaagguaagaacagauacuuacuaacauuugaauuucauacuuuauagacauaauguuaacuccucuuuuuauugaaguuguuuugagagugaugcgaaauugucauaaguuaauagugacuuucgauaacagaauucucuuuuuuuguuaucauuuugaaaugaaacauagaaaauagcuauuauauggaagauagcuaguauaugccaauuagaaaaccuugccaugacuucaugaaauaggauauaagcaaacagugaacuagaagaaaauaggauguacuuggguaggaagguaggaauaguucacucaguaguuguuuuagucaccuuuucauguagugucagaauccccuaugcuuccauucuaccuacacacuauauagaacagugaucaaaauuaggcucaaguuuugcauauuaagaaauggcuuguauguuauagucacucuguuuauauuugaaaaacucugguggcauuguuaagggacaagguaaugucaaaaauaaaguuaaauuuaaaacauuugaacuucaggcuacauccuucuucuaaaaacaaaaacaaaaaaacauuccacuauuaaguauuuuaaaaauaauaggguuauuugguucuagaagggggaacaaaauacccauggaaggaguuaaaaaguuuggagcaaagacugaaggaaugaccauccugagacugccccaucuggggauccaucccauguacaaccaccaaauccagacacuauuguuaaugccaacaagagcuugcuggcaggagccugauauagcugucuccugccagugucugacaaauacagaaguggauacucacaacuauccauuggacaaagcgcagggucuccaaugaaggagcuagagaaaguacccaaggagcugaagggguuugcagccccguaggaggaacaacaauaugaacuagccaguacccccagagcuccuugggacuaaacugccaaccaaagaaaacucauggugugacucgugucucuagcugcauaauauaguagaggauggucuagucgguccaaugggaggagaggcccuugguccuaugaaggcucuaugccccaguaugggggaaugccagggccaggaagcaggaauggguggguugaugaagggggguggagugagggugggguuggaggggaaaccaggaaaggagauaacauuugaaauguaaauaaagaaaauaucuaauaaagauaaauaaauaaacauaaaaugaagggcuggagagauggcucagcagcaaagagcacuggcuacucuuccagagguccucgguugauugccagcacccuuaugauggcuugcacucauucuaggagauuggccgcucucuucuguccccuguggacacuagcaaauacaugguucacagacauauaugcagguaaaacaaccauacacauaaacuaaaaauaaauccuuuuagaaaguaaaugaauauaaauuucaaauaauggcauuuaauucauaggacuguuauuuuugacggugugucuaaauauacaaguuaaucucauuauauagucuuauacuaguuuaaaugagaaugcauuuguuuuuagguuuaagaauauuugugaugcccuccucuucaaaaaugcuuaaaaggcaaagcucugauuguaaauggcuuuggcaguacuccccauaauuuuuuuuuaacauaaaaguguaacucuuaauagcgaucacacugugugagagcacaauaccaagcauuuugguguaugcaguugcuaccacucucuuacaguuucaggguugugcuuuacagcccucaaagcauugcucacuugccaguuucuuccuaacuuuaccaagcuuauccuaggcgaauccauuuuauuccugagguggcugagguaacacuauggagaaaagggaagaagucuuggaguuacauacauaaguguuuacauagccaccuuaaacuuagugaguuuucaggagcuggugcacaguagauacuauaguucuuguccacuuaaagggggaaauuaggugcuuuuaaagggaaguuuuauuaacagaaaacauuaauuaggguaaaacacaucaaaauaaccuuaacauuuuuugaugacuccuuuuucuuuuuuuauguacauugguguuuugcuugcaugugucuacauaaguguguuggaagcccuggaacuggaguuggaguuaugaacugccaaacuggugcugggaauugaaccaggguccucugaaagagcagccaauguucuuaaccucuaagccauuucuccagcccccaaaauaaaccuuaccggaaggaccacaguauauuacuuuuguguucuuuuuggaucacuauuauuucuuauaccagagagagaccauguuagaaagccuagguaauuuauuauuuuucucuucuaugucaagauaugaauguucacuauucuagcucuagucacaucauaauuauuucugugaaucagauuuaauagauguucacauuuaaauauugauagaacauuagacuugggccagauauucagaaauacuggaaauagccuauaauagccauuuaggggaaaaccaguuauaacagucaccaucugcuaagucacagauaucacaugguauaaaacuguuacuaucgaggggacucaggaggagggaauucaccauaucuggguccuuggagaggagccaagaugaguuuguguauggacucuuucacaaagcccugggguauguguuaacuuuguugauauagaacuaaaugcaggcagcacuggacagcauauguugagaguugaggaggcaaagcucauuaguuuuagauauuuuucaaauauuaaauggggagaaauugacaggacuaaaaggugaggaagaggggaauaagcaguugcuuaaguaguuggucaugaggucuuguauucacuagaugggacaguaucaguugcauggaaaggaauauuaagaagugagaagccaucaugaggucaaaaacagucagaagagagagaauaaucuaguggcuuggggaaaauacaugagauauuaggaauggaacagugaugaggcucaagggggaugaguauggaaguagguuucuaaaaggagugaaagcaccgauuaagauauaggaacgguggaaucuuaaguguauuauucagacucuaagaauguaauaugacuagaauaaugcugggaagggcuugugguggauccuggugcuuguuugggcauuuugugaugacuauuuuucuaguucugucucuggcucugucucagguugugagcuuuuuuagaagugcuccuguagggaaauccucccuuuucuaccucuaaauagaaaacuauaauaacuggaaaacauguuuuaaaaaguagguuccuugaguguacuugacccagcaguuuuggaggcuccuccuuccauuuagcagaaacauuggcucuccuggagagcugcugcacuuaugcuucucuuucagagcccuugcuuuggacacagcuuaacaauuacagaugccuacuucuaaguuugaugucacugacccuaaacaucugucucuaucaaguuuaauuuuuaaaagugacucuuacaauaguaauaagagauaauugagacaguaguuuguggggaaugagaagaguggaaaagaaaauugucaaaauggccuuacuuagaauguaguuucuugguccuuauuucaaucauuaaaaagguaccuucaucuuuauauacucccaaguguaucuuaagcuuaguauaagcucuggaguaaaguuuauaaaaacaucaaauagauuuugaauaauuugggauaucuguaggaaacaaagaggaaagcuuauuagccauuaaaauggaauauuuuuuccuuacuaauuuuuucuuucugaagugauuuuuaugucugcauuagggaaaugcuacacuagcuuauuugcuuucuagcaagccugucuuaagaugcuuuuccaacaaaauauaauuuuauuucuguuuacuuucuggucuaguauguaaagaacucagccugaagucaaacaaaauagaaacuaggguuuccauugagugagguuaacuagucuugcagauacuaaaguaacuuauguuauuuuauuauggcuuuaggcuugggcucucagaugcagacagaguggagagacucaaggcacaggagugugucuuuugaguuauucucauuuucugugaccuagaaacucugucaccauucucaggacgaugcaacagaauaucccuucugauccccauuguuuuguaaaugagaaagaaaauagugcauccucuaaugcccugguggauaguauccucucugugaaaggucucuugcuagauuuccauuugaacagauuuuuuuuucacuccuuaguugagauuugaagugauuuuaagaccccacccuagugucauuaaaaauguuuuuuuuuccuucuaauuuuucucaauaagauaucaggugcaauuaaaagaaaaaaaauagucuaaagucauuugcuuauuuauuuuccuuuuaugagauaguccuuguuucuggugacccagaacuucuuguccuguccucaggagcuuguaauaaaauauucucuguuucucaguauaccucuuccuaaacaauaaccuccuuguccccauuauuuucggacagaucaauaucaaaguauugcuguacagucagguagauggaauugucugugacauauuuuuuaaauacugacaauaugagcauuuuugcaaagugcucgaagccauuuucauuuuuauaaauguauuucacacuuggagugaugcugcauguguguaaucccaggauucaagagguggagguaggaagaucauaaaauugaggucauccuaggcaacauagguaguuccaggccagcccugggcuacaugacucugucuuaaaaagacaucccucaaaguucuuugaaucuauguuuaaacauaacuguuuuacugcugugaagagacaccauggccaaggcaacucuuauaaggaugacauuaaaguagggcuggcuuacagguucaguccauuaucgucaaggcaggagcauggcagcauccaggcaggcaugguggaggaggagcagaguucuacauuuuguccugaaggcaaacagaagacugacuuccaggaagcuaggaggaaggucucaaaggccacaucaaggccagaucuccuaauagugcuacucccugaucaagcauacucaaaccacaguaacauuuuuacauagcccugaaaauuaauuuaauaauuucaccuuuuaaauuuagcauagaaauaauuuacauuuuucucucuuccucccucaccuccucuuuuuuccaagacaggguuucucccuguaaccuuggcuguccuggaacucacucuguagcugaggcuggccuugaacucaaagaaaucugccuacuucugcuucuccagugcugggacuuaaggugucaccaccacugccuggcaguuuauagguuucuaauauuuuacaugguuauauuuuagugacuauaugauauucuaucauguugauauauaauguguaauuuucacuugguauaaaaacuuuauuucuuguuugaaaaauuaggcuuagggugagcuuuugcuuugaaaauuggauuauuagauuaauaaaugcauaauuucaauaauuacugguacuuuauccuaguuucuuuuagauuaguuguauuaauuugugguuauaacaaaacuacucugccaguuuuaccacucaguaguguugaguauuccaaccugucacuuccucuaccuuuauauaugugcagguguguguguuugaaagccauaggacaacuugaggauuccuuaggugccauucaguuuucauuuucucacuuugacguaggauaucuugggcucagccauuaaaggcuacugaaaagauaagagacaggaugucacuggccugggacucccucuauauguuuacauguauaguacaugugcaguggcuaaacugaacuaauuaauaggugugugaccucacauaacuuuucuuguauugagaucacuuuaaaaaccagugauuucuaguacucugguauauuguuauuaagucuaauaauuacuauauuguacaauaaaugucuucauggaccauuaaggaacaauuguauagaaaaacauuuuucugcuaucucuucauuaauacucacuagcugccuguuuugagaugcuuacaagaauaacauacuaaaugcauacaaguuauucuuuucauuuagucuuuccuaauucugguaggagauuuuguuucuuguucccauuuacugaugagaaagcugaggguugaguacuugugcaacuaagcauuuuaagugaauauuuaagugagaccacaccgaucugagcccaaucugauuccauagcuuuguacauaaucuuguuguacaucacaauguaugcuuuguuuuucaaacccuuauuggaguuuauauucagaaaacuuacacauaauugguauagugaagucuuuauacuaaaauaaaauauaacaacucagagcuaaaggaggaauugcaaauuaaccaugcuuuuuuucucuguacuucuuuaauacaauucagauuugguuuguaaauagauuaaagaaaaaagauaagguuucuaaguuucguugucucuuucucuugcagagaugcuguccaguuaaaugugauagcuacacgacagcuuauucuccuugcacagcaaaugaagaaucuggaaguguucaugcaugucucaacagcguaugccuacugcaaucgaaagcauauugaugaaguaguuuauccacccccuguagaucccaagaagcugauugauucuuuagaguauguuugaauuuauacacguugcuuuuaauucuaagacucugaguccaaauauauauacccuucacucccucuaaccccugugguacaaauauacauaugcauguauuuacucugcauauccucugccauauuguucaugguuaugucuguugaugaggucaauguagaguuuucccuuucgauuagcuaaugauuagagaaaggccucugaauaauuuauccauguguuagaggcuugguuuuuuuagguagucaauucuagcuucauuggaucagagaccaauggcugcuuaauuacaagguucuaacuuacuaaaggaccuccucuccugcaauggacaauaccuauagagaagcuguucggguuaagagaaucauaggaauuauaacccuuuaguuacagucuucucuaaggccuggggucucaucagcaguuguuacuaaggacuacauguguauuugguagaggauuaugugaaguguauacacacagcugccacuugcuuuuuagucuaugcuuucuuagcaugggcucuuggguuuguuuuuuuguuuuuguuuuuuuuuggacuacaauuauagaggcauuccaacagcuauuacauccuuacauaauuuguuuucaaacaguauauaucucugaguuguuuuggguuuuuuuuuuuuuuuuguuacaguuuuuguuuuuccuugguuccaucuuuccucacagauauucuacuuacuuuugauucucaucaugccuugauuucuucagaauuaaacacacaugaucuuuaagaaaggcuuuucauguugaggaaaugaauuguaagaaaagcaauaccagagaugacugagacauuucuugugagaauuaucuacuuuuauuuuaugacucaguuucauagauguuccuaaauauauaccucauuuaccuuacagaucaauagauguauuuggauucuggagaaaacugaaguuaaugaaacaauacuacuuuuugacuucuuagucuuggcuuaugcaggcauguaaagaaaugagaagagcuuaugaccugaaucuuuuuucuccuuuccuugcuuacaaagaaaucuaucuaguaaaugauugacgaguuugcucuguaaacucaggagaaauaagguuuacuggcccaagucuuucuucagcaagauuuuuuuguggggugugggugggugguagucucccaccuaccaacuaccuauccuguucacuuuucagaacucauccuuuaucauuuuucucacauuggauauguauuugccugcaguuuaacauucuuagucuuccacauacacaaaguacuuccauaugugaagcauuuuaagcuucccuaguuguuaguaugcuuaguuguuagugacugugcagaaucuaaguguauacuuaguaggcaaaaagacaaguaucuggaaacaagaacacagcgccuuagaguaaaggaggaaagacugggacaucaccugacugugguuguuuuacaggggaucuucagagcuguugagaucauuaaagcauuaaaccugcauuguagguuguuaacugauuuuucauaacaugcuucaaugcuuuuacuaauccuaguaauuguuaaugucacuugugaagauguacaauuccaguaguucaucuuaaauauuuagauuauuagaccuuuuauauuaaauguaaacaugugaauaacaaauguguuuauuuguugguuacucuguuagauaguaauaaacaucuuuaauuucuaaugaaauauuugaggcuugauacauuuuggaauuuauuuggacuuuggaaaggagcucuaauuaacucuuugauaguaaauuacuucauuuugcuuuuccuuagcauuccugaucacccugaucaaagacacaugaaaugcuaaauguuuaaacuaaaugauaccuucuaaagaccuaugguugguuuaggucaguuaaauuugcuaucuaacauacgauuuauaaaaggacuauugguucuuauuugauccaggcguugcagauuguggaucugugauugauauuuaaagagaccacuuuuuuucuucaguuauuuugaaagcugggugugcuggcacaggccuuuaaucccagcacucaggagacagaagcaggugaaucugaguuaaaacucagccugguuuacaagcaagguccuggacagccagggaggggugcacagagaaaucaugucuuaaaaaaaacaacaaugacaacagcacacacagagagagaaaagaaaauguuuuuuuugcgaaaauguuugaaucagagcaauacauagguucauacaaaguucaauuaaguagguuuuuaucuaugauaaaauauuuggaauuuuuguacauguaauuuuuuuuuuuuguuugccagauggauggaugauggccuaguaaaugauaucacaccaaaauugauaggcgacaggccuaacacguacauauacaccaaggcauuggcagaguauguugugcagcaggaaggagcaaagcuaaauguugccauuguaaggccgucgaucgucggcgccaguuggaaagaaccuuuuccaguaagcucuucaaagcuguuaagcucuugggacucagaguuucaaguuagaacuguguaaagacuugggauguaauuuaagagcaggugcuaacaugaugaauguguuuuaccauggcagagcuaacgagcauagaaagagguaauauuacugauacuuauauuucucaggugcuucuugaguguauggaauguagauuaacaguuuuaaguuuuaauugaaaaaucagaaguauucaguaaagaagaccaugguuucaucuguuuucauugcgaaaagcaagccuugcaagaaguguauuuuuccauguguagauuagaaagcuaagaaaaguauaagagauuucuuuuguaacuggcuacuaaaaagaaaaaaaaagauguugggauacuuuuaaauccuccagauaagagaaggcagaaacaaaagccaguaaguaagcugauacaggaaaacccacaaaaacaaaaaaaccccaaguucuguauacuuaccaguaagugauagccucuccuuuguuguuuugauaauuauccuguuuucuucugauuuacucacuaaauuugaggaacauguaucauuuuucccuuaaaaugcugcauuaauaaauaguauaaagucaguggggaacaggguuaauuuaggaaaagugaugcaaaguauauacuuuuuuuuuuuccuuugcagagacuuagcagaacuagguaauccuuuaaaaauacuuucauucagucauuuaugacuccagaggaaacuuuuugggagauucuuggggacuaagaacaauauucugcauggaguguagcgcuuucuuagguuuugggagaaaacuacaaaguauacauuuggaguuagaacuuucaaauaauaaaucuacuuggauguuaauuuauucucuucucuuuuuuuccuuuaauuuuugguauuagggauggauugauaacuuuaauggaccaaguggucucuucauugcgguaaauaaacuuuuuaugauuuacuauuuuauauauuuuccuguaucuuuauacauaugugcacauauacauguuuuggcuauguauuuuaagguguuguuuuuaauuucaacaaaggcagggaaaggaauucuucgaacaaugcgugccuccaacaaugcccuugcagaucucguuccuguagauguaguggucaacacgagccuugcugcagccugguauucuggaguuaauagguauaugaggcaacaucguuguuuacuaacuguagaaacugagggaaaggagcuucugcucuucauccccugguccugguuggcuaaguuagugguaaaaugccuuuugcauauaggaaauaccagugcucauucuaagagcuuguacaguggacacaaugccauguggaccuaucuguggugaagaggaaaugauguuuaaucucauguauuugcagaauguauagguuuguuaggaacuaaaaauggagucugggagggauccuuaugaaggaugauuuaagacaaagucaaacuuaguauaaacucaaguugaaauucacaagaaaugcuccaucugugucaaccauggcacacuagagcagucauaauuaaccugugagcauccuuuuagaugguaauaguagcauuuauaguuaaagccuaaacacuuaaaaaauaaucccuuaaggguaccuuuuacaugauaaaaaaagguacucauuaucaucuugucuuccuacuuagauaguacauaagauuuagcuuagacacuuuugacuuccucuuauguuuccuugcuuucaucuuugucuuugcagaccaagaaacaucaugguguauaauugcacaacaggcagcacuaauccuuuccacuggggggaaguugguaugauuuuaucuauguuuuugaauguuagaacauaaaguguucacugacuuuuuaauguuagaauaccauaagguauuagggccucugaguuacaaagguauuccuauuucaguugcuguuugaaaauaacuaccaguccugccuugugauccaucuuuaauguuucccaauaugagaauagccugauguauguguucagugaccuagucaggcccuaguuguucucuuguuaucugcagcacccucauagacuuaucuguagcuuggggcaguuuuuuuccuaacuaaugagcacacucaggccugauauuaccagucuguaguuaauauuauuugcaccuguaagaguagguguaccaguuggucccuagaguuaacagugaaggaguuaggaaguaggagacauuuggccaagguauguucuucuaaauucaaagauccauagcagauaguacauuuguuaacuagcucuaaaauagggcuaguauaacuugaagcaugcucauuuuaaauuauuaagugagucaaauaugaauguauuuauggcauugcuuuuugcaauggaucauuuuauuuguaguugaaauuuugcuauccuuacagaguaauuuguuuuuaaaguagauuggugcugggaaucagccugccccuuuccucacccacccacuaggucuugugcaugcuagcuacgcacacacuguacugcuacguuucuagcccuuguucugccuugucaguuuuuugagauaaagucucacuaaguagcucagacuggccuggaacuugcaguauagcccaggcuggcuucaaacuaucuauccugccuuagccucccaagugcuggaauuacaggcauacaccaccacaccuagcuaccuuaacauaaucuuaugugacauuauccuaggguuuuucuguggcauuuguauuuaaauuuaaagauugacuguugaaguaaguaagaaaagaacuguagagugauuucacaguauuuuaagucacuguccuucagggauauugaagugguguaagugagugagguuuuuauaacuuuuguugugcuguacaguuuugugauaaaucaaauucaacauucuucguuggugaaugccuaaguauacauuuccauuaaaguauuaaaauagaagauaccaaguuuguguugauguugaguaauguaaauaagcuacagcagagguuaauucuggguuguuucaagcuugucugauguauguugaguaacuaaaucauucauaaacagaguaugaugauuuuccuuuucuuuuuaaguaaguacaguauaagaaucuggaaagaggaacagaaagaaagaagcuaucgugagaggugaaauauagagagugacauuauuaacugaccuagguaaaacauuaagauuuucagagugaauuucaguaaaaauucauucauuuaauuaaaauacuggaaguauuuuagcuccuuggacccagcaguuuaauacaaucuucucuuagcuguggagaguagaaaagcuuguuuuuuaaaugaaugaacucugccucugguaaaauauuuugcauuguacaaacauuucuuuuucaaaacuucauuacaugguuauuaucaaagcuguuacacaacuuuucuuccucagaauaccauguaauuuccacuuucaagaggaauccucucgaacaggccuucagacggcccaauguaaaucuaaccuccaaucaccuuuuauaucauuacuggauugcuguaagccauaaggccccagcauuccuguaugauaucuaccucaggaugacuggaagaagcccaagguaauggugacuagcucugucuuuucuguuccucugacuguuaaacaacccaugcuuaacacugaaaugcacauuaacucuguaucuguucgugcuuaugauaaggcuuaagggccuuuugugaaugagaagacuguugaaaaagacauugucagaaaagcaaagguaguguuguaagucauauuauuuauucuaaaguuuggauaauaaauuacugucauauugaauucuaggucuaacuuuaggugcuuuucugaauaacaaauaauauuuaaaaugcuuuaacacuuauuuuuccuacaggagauuaucuaaaucauuccuucaagaugaauccuuuaaaccaaguauucaggcaccccuauguuaaauucuguuccaacaaccuaaugcuucauuauuggaagggugucaaacauacaguaccugcauuauugcucgaucuugcucucagguugacaggucagaaaccgugguaagaagaauagcaguauuacacuguguauugguaaggugguggaagcuugcuggagagacaccaugucgcuagcaugagcuuacuuuuagaauuacuaacccgaugaagugcaaucacaaucaagaugccaggacauuuccuagaaauuggagauguuuggaggccaagaauggaccucaucauauugggucauugauucuccaaaaucucauuauaauaggaaauguccuacuucaggauugucauuguuauuauaagcugaaauugaaucucuucccucucucccuuaauaaucuaggggugaguuuuuaugggggagucagaguaaaauauuuugcuuuaaaguagaugguuuaguuuuauauggaaaauauaggaugcuucuagaaaauuacuugaaauauuuuagcuacuuauucagcuuauaauaugguaauuacaguuuuugacuaauguucuaguuuuuaaaaguuuaaacacagaaaacuugcuauuuucauauaguuguaauauccuuucuuucuuuucuuuuuuccauugaaacccuacaaaguucuccugucuuaaucacauaguuagugaaauguacuagaaaauguuuauuuuuaaacuauauuaguaucuuugauuggcaaguucaggauuugaguauguauuuucaaagaagaugauuccaggacuuccaucacugcugaaaaaauaaaaguuagguauuugccaguuggaguaucucaggaugagaguaaccauagagacuuucaguauguugaguaguuuaggauguuucuaacuauacauucacuauugaaaugggggggggggguuauugaauagaacaacuuauagaacaaacauuucagguuuucuagaaugauuugcaaaaguaguuuugcuauauuggugcuuuuucauggcuaaaaaucagaugaaauuaaugauuugcuaaugcauauuuauguuaguauaguugcuauaauuagggcagaaaaggcaaaacugguuccaaaacauaaaauagauuauauaccuuauaguaucuuacaaagagaauggguuaauuccuauuaauuaaaaauuaauucauuuuauuaauucuuugagaauuuuuguacaguaauugauauauuuugaucauauucacaccaacucuuucuauacccaccuuuauauuuuuuugggggggaaggaguauugguuuuuaugagacaggguuucuuuguguaacaauccuggcuguucugaaauucacuuuauagacuaggcugacacugaacucagugauuugccugccucugcuucccaaguucugggauuaaaggcgugugccacggccaccuggcuuauauuauuuuaaguaacccauugaguacccacuuauguuguguccuuauagcauugguguggggcauuccacugaaauauguuggaccuacccagagccccaugccuguggaaaacugacucucccuccacugacaacugucaacuaucaauugagcuuuuuagcuagggguggagacacaugagaaccuaccccucccuuuuggauguuaacuggcuuuaucuuguucaggucuaaugaaggcagccacagcugacagcucaguaaacuuaaaaauauguauaauaaaaaggaaaaaaacuccauaguuacuaagaguauagaaaugauacugcuggagcuaaaagagcugaagucugauggaggcugggguauuccaucagccagggccagguauuauugugucucaucaggauugcuuuuuguaggaucuuuuuaaggccuagggguugccucuaagaauuaacuuuugcauagcagcuaaagugguggaacaaguaaaguggaagcuagaaaauccugcauuuuugccuuguuuguucuuugagauaggaucucauguagcccaggcuggucucagguugagagccagaaucauaagcaaaugccaccacgucuggcuuaccucuuuuuuuauuuauuuuuuuuaguugcaagcagaucacaaauccucuuagauguaaggaaaguggguguucuggagaggacucagauccugaaaaugaggaagugagaauggcuuuuagccauuuuuggaaaguacagucuguaauaguuuaccuucuggcccagagaauucacauucuucugccugaacaaugcaguuaauuuuuuucuucuacaaaccccuaugguaucagcuggaugucaggguuuuaccauuuaaaccugauccagucacagaaaugguuguuuauugcagaugauacuccucauaugaaagaaaaccuaugaaacaaaacaaguuagcagcugcccauauauucuacauauauugagagaaguauaagacaguguauuaaacaugagaaaaauggaaggcacacagcagacacuguucuauacaguuucaauugaaguccagguauauguugacagcugggucaacuccuacucucugaguauucuccaacaaccccccccccccccguaagacugaacagauuacuaauucuacuuccugcccauaaaaaguuagauuccaggaaaagggucagaaaaccuuucuuauaaagggccauguuguaaacauuuagaccuuguaagcgcauaguucuguuguuaccucucugccuugguguuaaagaaagaaagcagucauagacaguuuauaaauaaugaacaugauugcuuuaauaaaacuuuauucacaagauaguaauagaguguacuggcugugugggcuuuuguuugcugacuuauguuacagagacauuuuuauugguauacuuucccuucuuauuuaaauucguguggcuuuuaaaaaguuuccacugaguauucuaaagauaauccgaagagauggacucagaucagauagaucagagccuauucacaaaucucuuugagacaagccuuuaggucucaucaggaugcuguggagcaguaccuauagauauuaaauauuuucuccuuaaagccugucauccaacaguagaaaaugugauacgugucuuuacacucugaagaaguuuuucucauuuguuuuguuuauuuguuuuugucuuucugucugaaagguaccacaauguagucuuaaagaaucuuauaucucuaucuuuuaucucuacccugaauuugauuuaugcucagaaacuaucuuuuccccuuuuguuuuuauuuauuaaauaauugaugugauacaaccuaaaauuucugaauuccagauauaaaaauuacacuuuuugaacauuugauguuacuuacaauucacagacuuguuaauagccugacaguagauuagcaucugucuucuccugucuugucaagucucuugcuacuuuuuacuuuccuaagggauuaccuccugucuucuuuuaaauaaauucuuagcaaacugguuaacuguuacuugcaagggugccaucacuggagugguccagucagcuuucaguguaaaaaucuagggaauuucuagcuuuccuauacguauguuucucccagcuuacugugugcagcaguuccuuugcggugaaauaugcugcaugcuuuucagcucccaaggcaauacagcuguguucccucugccuagcacuguucugcuauuauaagccuacagugugguacuugcauauuagcauacuagcuuauguacgugagugagagagauacacuacaguuagaaauuacuuuuuaaauaaauccugaguagccuucuacauuuuuuccaaauuucauucagauaguucacuuucuaagaucagcuuugucuucauucaagaaaucuugacuagauuaaauuuuaggaaaauaggucuaguuuuuaucuuccauguuguauaaauucaaguuccguaaagcuuccugugacuuucuuuucauggcccuuucagauuucaguaaaugaacucaaaggccacaauagagucuucuacuuaauucuaaaaugccacaaacuuuagauuuuuuuuauuauugccaguucuucccaguacuaagauauauuacucuguugcacgacaagucaucacauccauaauuccuuaaagaaaguuguuuuuuuaaaugugucacagugccuguaaguaaagaauucuagaaagauuggugugaaugacuuuggcuaaaggucuuuaagucaaauggaccugaacacuagagagaguuguuaagggagaguaagguugcguaguagcuaggcagcuuucucucuucauguagaguuagacucuccauguguugucugcacauggucugcuuugagcuuccuugcagcgugaaaaccucaggggucauugagcagcaugcagagugacugaagucuuccagggugaguaugauaacgagcaaggcagagcacucuuaguaccuuucuuuuccagccugugacgucaccaccucauucuagugcuuaacagauauuuccccuuguggugggacguuagucuagguaacaguguaccuuacaggaugggugauaauagucuuaccuguaucagagcaggaauaaccugagaccucucuaaguguauaaaauaaaagcaacaaggaguaggguauggugcugcagacuguacuuugcgcacucuggaagcugaagcagaaggaucuccacgcauuugaggccagccugggcaacagaguuccaggucagcauagaauaauuaaaacccuugucucacaaaaacagaaguaaaugaaagcaucaagagauauaaaaguuuacuuaggcaaugcauacauguuaacuuaugucucaguuuauucuuuggauguuuacuuagucaagaguaaguaaauauuacaacuuauauaacccugauauaauacuucauucuacauuaaacuaauguaauucaugguauccagcuuacucauuuacaugauuuugaguguaagcuagauaaaaucugacuugcuguacauuuugaaauaauuauaaguucuauuucauaauauaugaauuuuugcuuauaaagagaccagaguacauaucuagaaucaucauuaaauuuucacuuaacauuacaucauugcuacuuaacauuacaucauugcuacagacggcaucuuuugaaaaguugcuucauguuuuuuuuuguuguuguuguuguuuaguuuagcaucucugaaccugacauuuuucauccauacaauucucagcuugaggacauuugacaauauuuggaguucgucaucacaaaggggaagggugugcuucuccucaacccccagugugcuaaggccauggaugcugccaagugucuuaguacauagauuauuugugaucgcuaagguugagaaacccuagauuagauaauuauuaggaucuggccuugcuguuaacuaugaguauacuuuagaaguuauuguaguaaagaauaaguacauccucagcagguggacgacaguguagucacaagcauucacucuggccugaugaaccagagugauggugcaguuuuaaguguacuuugguuuucugauaauauugucuguuaauuucuccuguauaugaauuuucaaaucucccacccccuucccucuccuguuuuggagacaggguugaauuuuaaaccaugcucacuccacauucauggcaguucuuuggcucacccucccaagugugugauuauaagcaugugugagcuaccaugccugggcccucucucucuuuuuuuuaaauaaauauuuuuugaugaaucaaggguugauuuuuagggcuccuguaucacuugaaugaauuuacacaugaaaauaggcaaaaccugacauuuaaggaaucagggagaaaaauguuucaggagacuacuaauuggaaaaacgaugugaacuauguauauuugggaugaaauuaauguauauuauuauuauucuaccugugauauuguauugauuauuacagauuuguuacaucuguaaagaaauuuuuauagaaaagucuuguuuuuuaaaagcaacuucccccaaucuauaugguuuauucuagauaauagccuuggguguuggauaauucuuuucauguuuaauggaggauuuauuuuggaauucuuuagugaaugaaaguuuuucuuuacauugucuguacugccucauuuucuuuaaguauuuagguuuugggguuucuuuauaaauguauugaauguguuaucauuguuucuuggcuaaugaugcugcuuuuauuuucuucauuacuuuucauauucugcuuuucucccauguccuccauuuguaaagcccuuaguuugggguguuucuaaauuucauauacuuuaagcuaauucuugugggaauguaaacggaauucuuauauuucuugauuauuuuucugguguuuugguguauauuugauucagaagcucuuaauuacugcuuggauuagugcuuugauaucaaugacuuguagcaagcgauaauaaauaaaauuucagauaagauuaagguuccuugcccuuaaaaagaaacaaagaaguauuauacuguuuuguuucucuaagggagaacauaggugaggccugaggagaagaauauuucugaaaauccucaguauuagucauugauuucauagcacauccagauaaucaggaguggugccaaucacuguugaagagaaaguucuuguauuuuuuuaaaagcguugacuaaauggcaaaagaauauuucuguauaucugccucagugaugcuggagcacugggauuagaacauaguuguaggauccuuguuauggauucuccuaaguucagggaagcuaaaggaagacuaaacugaauccuuuugcguagugugauauauagaaaauuugaauuuaaacuuuaguguugcauaucauuugagaauucuguaucagcagaacuuuaugcaggcaauauuaaauuuuaaauucccuuugcugcugcuuauaauuuguuucuccauuuuauaauuauaaauuauucucccaagaugcagaaauauucuaauucucuacugguuugauaacuuacugaaucacaguugggaauacgugauugggaccugugugguaauggauuuuacacauucuauauacuauaugaauuucuugauuuuucuugaaacacaggaugaugaaaacaaucacucgucuucacaaagccaugguauuccuugaguauuuuacaaguaacucuuggguuuggaauacugauaaugucaauauguuaaugaaccaacuaaacccugaagauaaaaaggcaaguauuuucuauuuugggguuagaaaaugaccaguaggcacccugaaaccuagccauuucuaauaacuaucacauaggaaagucauugaucucauauuuucucaguguuuaaaucauaauauuuauaaggagauaaaauuugcuuugucuuaaaacugauacagaguauuugagaguaacaaaugcuuuucagauuaaguuguuauuccuuccuauaagguugaguugaaagagaacuuuaacaucuuuguggguuuuauguaaagaauuccuuguuuucucuaaauggguggggggucgugcuaagaggaaguggacuccaauugcuuuuuuauauuguaugagcuuugccauuucauuuugcuuauuugaaaguuuaaacuguguuccuucugaaguuaacucagauuuuguuuuguuuuguuuuuguuuugugagacacugucucucuauagcuauugugauacucacuaugugguccaggcuggccucaagcucccaaagauccaccugccucugccuccugaguguuggauuacaggccugugcuacuaugacccagcuaccgcauauauuuuaguauauuuaucugucuuaaguuaaacguauuuaguuauuuuacuuuaggggauagaaguacuaggggcugaaccuagagccuuauucucuguaguuuccuccuuaagguaguuacguuuugcuaugcuaaugucuugaguccuccagggaugugggaguuuaccucuaacugguucuccaggucaagccccacaauuaaaagacauuugcuccaucuacuuucauucuuggagcuucucuuuauuaucauuuuuuuuucugucugacauguauuuagaauaccagaguauggcuaaauuaggagauugaucauagugaacuuucagcuuuugauuguuagucuuuaguucacccuaggguuuucauuuuguuuuguuuuuaacacuagugcagcacauuaaggauuauuuuauguucugucaguuuuguugcaguugaaaugucaguuauuuguuuuucuggcucuuuucuagguuuuccacguuugguuuucugaaacuuugggcuuucucuaccuuuagauggguguuuuucagcaauuugggaauuucuuaagcauuuguuucuucaaauguugcuacuucucuaccuucucacagaauuguuauaugguagaccaauguguccuuaggucuauaacugcaaauaaauacuuugcuuuuggacuaaaguguaaauaauuuaaauuuuucaacagaaagucagcuggguugaaaccauuccauugaguuuauauguuuucauuuuuagaaaguucaacuuaaucuuggauaucuccucauaauugcuguaaauccuuucucucauaguucacauuuaaaugauaggcaguguccgauucugcuguuugagcccagucuaaaaccaggguaccuuguuuccaaguugucguuuuguuaaucauuauucauuuuucuuuaauucauauucuuugaggauucuauugaauuuugggggauguagauuaaaguugaagcuuuuuauaagaauuugcuaucaaggaggccuucauaaagcagagccucuaaaacaugugcugaguauuucaccuuuguugaggugaaugcaguuauauagaccagaauacugggucaggguuaguuuuccaaagagacuuucuguuuuccauccagugcauuaauuuuuuuaaaguauuugauuuaaccugaucucucaaaaauacuuugaacauaucaaaacuuuaaaauaauuuagaucauuucaguuaauuuuucauugacacccaaugugccuuugcaucuuagcauaguucauguugcuugugaauuccauauugaaaguagagaaccaacucauuccacuagcucgguagauaagagguuucaaucuaaauguuuuauuugauuuuuuccuuugcucugaagauacagcucuuuuauuuuacuuagugugugagugcguauguguguuugugucuugauaucaguaucuguuuucuaauacaaugcuuacauagaaacaguggugucagcaauucauugcaucauaggcuaaggagaggaacaauuuacagaaaaugauuugugacuauuuaaaaacauuuguaagaaugaaagucaaaaguagacugaauuguauuuguuauuuaccagauuuuuaaaccugcaggcuuugacagcauacucuaguaggccuuggccaaauucauuuauuacuaguaguaauguguggcuugccugucuucaacuuuguguucagcuaguuugcauucuuaucuuuuagucaggugucuuguaaacaacauaguuguuauaguuguuauuacagucuguuaguuauugacccauuuuggagaauuuaaccuguacuauaaccuguaauuuuguuggaguuacauguuguuguacuaagacagaccuuugcaagggggugagcuacaucccaaccucaauuuuagauuuaaguuuuagugcuuaauuuuguuguaccuagcuuaauuaucuuuucuguucucuuuuuuucccugguuuuuagucucuuagacauagucaaaguaagacacaagcuggccuuaaacuuuaccuuaaacuuccuaccuucuuaaacgcugagauuguaggcaugcucuauacaccugacccuuuagguuguuuguuguuuuucauaauuuuaauuugccacuuccuuuaguuguaucaaaaugcauucuuuuccaacuuuuuuaguacuuuacuuuagaaaauacagguauuggguauaguauucaagacaggauuucccuggaacucucuguaaaccagguugaccuugaacucucagagauccacuugucucugucucuuggguguugggaugaaaggcauaagcuaccaccacaguaucuuuucuuaagccuaacauaaauggauacugugaccuuuuuuuggauagagaauaaacaaugccucuauuuugcuauaacaggucauuuguuauuaguuuuuauuauuuauuuauuuauuauuuuauuauuuauuuguuguuauuagucuguuuuaugcugguguaggagaaaaauagguaauuucuaauuaauagaaguucacaguucuggcugcuaagcagggacugacaucugauaaaugccuccucuugcuucauuucaugguaaaagagcaagagagaauaggagauugaacuuacaaccuuaucuccuuuaauuggcauugauucauucaugaggguugucuacccuuacaauguagccgccuccuguuaguccuccccuuucaaaacuucuguuaaagauuaaacuccaccauguauuuugaaaggaacagaaguaaaauuagugcagucuaugcaaaacauacucauauaauuagucaggaucaucaccuuucugcugccuugauuuucuuccaccugccgguauccacagagacuucuguggagagucug

SEQ ID NO: 4045 - RNA, 1539 nt, Mus musculus
gcucacggccaccugcaacuagcuccagagacucugaagcucccuuuugaccaggacagguaucccccagugcagacacgcaggcauagaaguuagggaccccauccaaagccaggaagcuaauggcuacuggaacugaauggcccccaaaccugcccccgcccccagcagccaccuucagaaauauaaugcugcaagcagggcagugcacuuguguggucccagcacucggagcagaggcaggaaaacugccccaaguucaagcccuagguuuaaccagggcucacagugagccccagccucaacagagggaggcaaagggggaagaugggagagaggggagaagggagaguggggggaagggagagaggggagagaggggaaagaggggagaaagggaagagaggagaggggggaagagagggggcagaggggagagaggaaaagagagaagacaggggagagagggaaagggggagacagggacagagggaaaaagagagaagacgggagacaggagggaaggaacgaaacacuucuacuuucuucauacguguggaguaaauguucagauuuuuucaagaguuucucccacacacucagucaacccuggcauuuggcaaugacgccaagcuggcaagcaggcagaggauguccuaggucugggggcagagccucacucucuccuacaacugcagauaacaacgguaccuuagccacgaauaaugaaggauuucuucuccuugcccaaggaggagauuuucaacacauuuaucucauuccugguauugaagugaucaaaggcugggaaccuccugaggagcuuuguaguagagggacauaaaauggguuuuauuuuucagaguuaaagaaaauagcuaugugugaucaaaacagccaaaaccuucaaaaauaaaccagcgaaaagaaucccacgugacauuaugaaaaggauuaguucccuugaccacaaugugaggaucuaaaauucagaccuucaucaacaaggagcugcccacccaaagggaaaaggagcuugcugaauaaaugaucucaaagaagacuuaaaagcuacuaaacaacacgccugcagucgcaggucuaccgugggcuaaccaucgugaaaauguuuaaacaauaaggaacgauaccagaaaaaaagucagugcgaagagugcaaagaucaaagguuuucuuccugcgugauucaauuuguuuauuuaaguuguagacugcccacccaccacaccccacaaaaaagucggguucacuugagggcuucacccuccugcuguuuccuuugcagugaggcugcaggcacaggcuguaaucuguucauugagcagaaagcaacugagugagacacaagcgccucuggcaccccgugaaaccacaagagagcagauucuaguuuucccauguucuaacacaucuuuucaaagcuguuuuucuucaagggcaauacacuugucuagagucacgcgauugguaccaaaagccaaaggccaauugacacugaaggcuauaaauuaaucaaaa

SEQ ID NO: 4046 - RNA, 2241 nt, Mus musculus
caugccgggaccuuugaucuccagcacaaaguaaguaaaauaaacuccagcuacuaaguauuuuaucugugccaggugcaacgcugagugcuuuuucccaugacaucuauaguccucauaaugacccugugaggggaaacugcugucaucauuugcagauuauggcuacagucuuagaagagguuaaguuacuuaaggcuuaaaagagaugagcccagauauaaaaccaggguaucuuguaguuaaucucauuaucacuucuaccuguucuugugccuuaucccucgccuuguaugugaggguucuuguaucuacuuuccagaguugaugccgugauauaauacauuuauaguaccacacuugguauuauaguaaacauucaccaguaaaugugcauuccuuucguccccauucacccuucuuacaaaaagaggaaaaccaauccaauuauuuugccucccucagaauuuaguuccuuguuuuauauucuacuugugugcuuuuugguguuuuuuacuuagaagaaguuuucuuuucuugagacguuuuugagauaucacugcgccucaacugucuuguguuguuuucauaaaguucuugacccuucacuuaucaaguugucucaguuguggcuaucuacccauauuccuaaggauggucucuaauagguaggcuugauuacuuggagaaugacagucacaugacugguccuuuaaaaacauguaucaguuacaguagcagagugcugucuagggauuucugaucaucugaccacauccucccuguguucuccaucuagcaguagcagcgcaucuuugauugggacuugugccaugcagugagugacaagagugcaggcaggauucauguguuuuaccugagguucuacaugcuauguaggguucuaagaacacuccagugcuuguaucugaaauaaaaguaaggccaguaggauguacaguagauagcagcuugguggacugacagucgugaacaaggcuaaucccaacucucuaaguagcuuucugaaaauaaugccuggaccugucuuguuaucuauaaaaugaaacaguuuagcuaauucacuucuggagugucuagcuuaaaaaaaaaauccauaccccccaccaaaagccuuguauuuuaccauuaucuccuuaacaugaaaugggggggaggggugcagcucagugggagaccucuugccuaacaugugacagguaugggcucagucccagcacugaagaaauauaugucacacccuaaaucuucugcuguguucugugucacuuugcuagaaaccuuaauucugcuuucccauucaucaaauucuaaauucuauguuuccuucuucaguauucuuguaguuuguuuuguuguuuguuuugaggguuuuuguuuuguuuuuuguuuuuaucccaaagacagugucauuacccuaacguaguuucuugucuucuuuaacacacacuacaguagccuaaacauaaauuuuauguauaacuuuuaaaauuaugcuuuuuaaaaaaagaggagugagccaggcaugguggccaugcuuuuaauccuagcacucaggaggcagaggcagguggaucucuaaauuugagaccagccugcuguacauugugaggacauccaugacaaucuagagaagcccuccuguauuaaaaaaaauaaaaaaauaaaaaguagcacaggaggccuacaugccgccgcugucugugccaccgccgugucucuagugaucccugagaagucccagcacauuuucgaggcucaacaccaacaucgaugggcgggggaaauagccuucaccaucacugccauuaagggcauggggcggagcuaugcucaugugguguugaggaaagcagauacugaccucaccaagagggcuggagaacucacauggaguaugagauggagcgagugaucaccaucaugcagaacccacgacaguacaagauuccggauugguuccuggacagauagaaggaugugaagaaugggaaguacagccagguucuggccaacggucuagacaacaagcugcgugaggaccuggagcggcugaagaaaauucgagcccauagagggcugcgccacuuuugggaccuucgugucugcggucagcacaccaagaucacuggcugcaggggccauacuguggguauauccaagaagaaaugagucucccggccuugcuguuaauaaaucguuuauauaccuaugaaaaaa

SEQ ID NO: 4047 - RNA, 11665 nt, Mus musculus
cacuuccugcgucgccgccgucaagacuccgcaggcuucuuugacgaucaccgaaccguaguuggggccguguuccuguguccgcugcugggucagguugucgcugcgccggagcuaugguguguugagccccgaguccucgaaggguuuggggcugagguacacugacguggucggggaucggccucuguucccuggggcguggggcggugggagagggagcuuaccucacggacagucuccuacagugauucagcaucugcggccuggccggcgggaaacgaucaguaaccugggcggccuuucgcucagcuucuccaccuuacgugggguccaggcgcucucccucgcccagccagaggcccuccccucucaauuuacuuagguggccgauuucaagaugcccuaugguccuuugucaucugcauaggaggaaggcuauaggaauggaggggugcaccuggcaucgccugcgcagaccugagccugcagucaggucuuuagaccaaauucaucuuccuugugggucugucuuaaucugucucauuagaaugccgucgggaaagacuccauacagucacuuuguucuaaaaggggaaguaauggauucagguuuacagcacagggcccugagcugcuucuguggagucugccaugcgaacucuugccuuuuuugccauuaugaguauucuccuaagagccgauacacuugcuuuaguaaugacauuauggcuguagugggucugccacgguagcaauuugugcccaccucuuuacugaggauuuguguauauguuaauucauccagugacagggugcagguagagagcucaaaguuaaaccaaacauaacuuuauucauacuauaaagauaaaaaagguauguuggaagguguuaugguacacgaguuuaaucccagcacuuaggaagcagagaggcagaauucugugaguuugaggcaagccuaagucaaaguuccaggacauccauaguguagagaccgacaccaaaaaaaaaaaaaaaaaaaaaaaaaaggaaggaagaaaagaagaaaaaaauauguauaguuggucaugauagcagacaccuguaaucugagcacuugguagguugagacaggacuucaagaucauuuucccagguauauaggaaaaagccagacugggcuucaugaaaccuguaucucaaagcucugcuggaauauugugcugagaauuuucagagaaaagaagaaaccuucaagcucuguuggaauauugugcugagaauuuucggagaaaagaagaaaccuucaaagauagacauuugagucaauguacagaaaaggccuuugccagauuauuagagcccuguguagagaacaguaugagcaaaguggagggaaaguuggugugugcauucuuuagcacuugacuacccaaggggagugcuguggagaauggcaggauauagaguuagggagaaccuaguccauucaucccaacagcuccagcaugguuaagggaccuuguuaagguagaauugcauugcaaacugagugcuguaauaaugucucaagaaagcugcacuaggagagaggcuguaacaauugaaacacaugucuuaauguuaaaauuugaacuuuguaauguucucauuuaaucuuucuuccacuuucaguuucgaaaccaguaugacaaugaugucacuguuuggagcccucagguaaaaaauguuuuaugccauaucaaugaagugacuuuucauggcugaaguagguucagggaccuaugagauuguaaacugggcuuggugguacacaucuuaaucuucauuggucugccguuggcugaagccauaggaucauggagucagugggcaauuugagcagcuuaguagaacuccuuaaaagaaaaggaaacaaagcuugugagauuauaggcugugaccuucaaguuagaauuaaaauucguuuauugguuuuaaaacgugaaaaaaaauguuugucuuuagggcaggauucaucaaauugaauaugcaauggaagcuguuaagcaagguucagcaacaguuggucuaaaaucaaaaacgcacgcagugcugguugcacugaaggugagugaaauauaacccugucuucuuccucaggaacagaacuaucaaauguagauuccacugauaaacagugaaccucugaacuaaaauaccauauugugucuauuuagagagcacagucagagcuugccgcucaccagaagaaaauucuccauguugacaaccauauugguaucucaauugcgggucuaacugcugaugccagacuguuaugguauguaugaugaugaaaaaugaaacauccauuuugauucuuaauagacuauuuuucuaaaaaaagaaauaccuaaauaagauauaggaagucaucucccagaauauuguaauuuuuaauuguuuauuuuauuugugugcauguuuugccugucuguaugucugugcacuagagugugccugguuuccucagaagccagaagaagacauuagauucccccaguauugggguaacagaagauugugagguucuauguggauacuggaauugaaacuggguucucuggaagaacagcuaagcuaucuaucucuccaguccccagaauauuaaaauuuguacuauuguaaauaccuuaguggguuugaguaugaaacuaaguauuucuauuucuuaauuuuuauagugcuauuaaaaugauuuugaaagucccuuaaagugauacuugcugacauguauauugucucaagcccuucaugccuaagagcugggcacucuucuguugaaggaugaccuaaaccauucuaguuuucuucauaaugucaauauuuaguauauauaagccggguagugguggcucacgccuuuaauuccaacacuugggaagcagaggcagguggauuucugaguuugaggccagccuggucuacagagugaauuccaggacagccagggcuacacagagaaacccugccucgaaaaacaaaaacaaaaacaaaaaaauauuuaguauacauuuguguucauaaaguucaggagcauauaauuguaugcaguuauagaucuugucugcagagagcuuaaaccauauuuuauuuguaaaacaaggugggaaacagagcaacagguacauuuccguagcugucugaggaggcagguacuuccuguugggaaauagcacaugagugaagugacaggacuuuggggucacacuaguuaacuucucacucaucgcuuaguaucugagacugagcuaguccccugacauguaaaccacuuaacacagcuuucagaaagagggacaggacugaaaguggccagugcuaaucucuuuaguucagcaugguuuuauuaggaaaaagcaagguaaggguaaggacuaaguugcuguuuguuaacguuuucaaaugauuccgccagugucuuaagucaguagcagauccucugugcuucugcucucagaguguaaaguguagucaaccugcuguuuaaccuaggugucugaaauagugucaugccaacauucagucaguaugaaaacuucaucagcaagaugcugugugugguuucgguguugucuuuucaaguuugauguauguuuugugcuuaaaguacuuuuuagccuggugguggugguggcacaugccuuuagucucagugcuugggaggcagagaggaauggaucucuaugcguuccaggccagccuggucugcagagugaguuccaggacacccagggcuacacagagaacuccuguuucagaaaaacaaaacaaaacaagaaaauacauuuuaguuagcuacuuuucaagaccuuagacccacauguaauuagugcuugccauguuaaauaguguauacacacacacacacacacacacacacacauauauauauauauauauauauauuuuuuuuuuuuuuuuuuuuuugguuuuucgagacaggguuucuccguauaguccuggcuguccuggaacucacuuuguagaccaggcuggccucgaacucagaaauccaccugcuucugccucccgagugcugggauuaaaggcgugcaacaccacacccagcaguauaauuuuagaaagccuuaaaaaauuggcuuuaauauacuggacagcuugauguugucaacagcuugacaucuagucaacauuugaugagggccaggaggucaaggaguuuaccuaucuuauuagcggccugggguauggcuucugcacuagaaaaacagccccaaaauaaaacuuggucaucagaugugacaugaugucuuaggaagccaguguggagacaggagcauagcuuuuucuaacuguccccuuccaugggcaccggcuuuccucuccuugcuacuuaccuggcuuggaucuuguuagaguuaucagugagauucagccguaguauggcugacaucuccucuagggugacacuuaagccugcuuucaagaaaaaaacaaaacuuuuucucuuuuucugguuugaaaccuaaaauuaaggcaugugauugcugacaauaggaaggacaagagaagagaagguacuuuuuuuggcuucuccucuagucuauaaaguacugaguccaggauuuuguacugaguaauaguaagaucauuuauucaguuacuaaguuacuaagcauuuuacauuaugaagcugguuccaaacaucuggucuucuugcugucacuuugcaaaugcuugauugucggggugugaugccuugccucacccgucauuuauuuuuaaaacuucauauggucccagaguuuaguucacacacaaaaaaaggaaucuaaacauagcuuaccuuucugauuuuuuuuauggauguauuccaugaaaaugcuugcaggaaagcaaaauggaaucaaacuacuuuguuuaaauguuauauuguauuuauucucuguaauccgaacugauuaauuuuuuuguuuucuuuuuuagcaacuuuaugcgccaggaguguuuggauuccagauuuguguuugacagaccacuuccugugucucgucuugugucucuaauuggaagcaguauccuuuauguuggcauuucuaaauguaaacuguaaaguuuggguuaccuaguguuugcuuaguuacuuggaaagugauaguauaaacauaaaucagauuguaaagguuugaagaacuggauuacucuuucacuagccuuuauaaacaguugauauuuccaaaauacaauagcucaauuuaaggaaacaauucaguuauuuuuagacaauaaaguuucugaaugguuuugguuagccgcuccccccccccccccccccaguucuugccccucauauucaaaauaaguuccuuuauaggaagagauuacuuuguuaguguucauuauuggcuuuggugaaaauucaaacuuuguauauuaggccaaaggcauacucuucuguuacuuucuuguagaaaauuaugaaacaaucaagcuagaaguccccaggugugguaguaccuuuagucccagcgcuugggagauaaccagguggaucucugaguucaaggccagccugaucuacauagugaguuccaggacagccagggcuacaaugagacaugagacccugucucaaaaaccaaaaaaaaaaaaaaaaagaagaagaagaagcuagaaguuuuuuuaauuuauuacauguugaaacaggcuccuuaacuagcuucagaaacccagaucccaacacagcgauauggccggaggccguaugguguugggcugcucauugcugguuaugauguaaguucuuguauuaucuacuuuacugcuucugugacagaguaccuuacacaaaccaccuggggaagaaggguuuauucugauguaggguugaggagccgagagcgugcugugauggggaaccugagguggccggccagucaugcugcauugcaguuagaaugcaggagagaugagcacugauguucagcuuguuugcuccuguagguaauccaggacagagccuauaagauggugcuagucaaugucagacugaguuuucccuguucauuuaaaugugucuggagccgggcaugggcuugcaugcuuuuaaucucaguacuagggagucagaugcaauuggaucucugacuucagauuuauuaaaauaauaaccuucacacuuaucacaguuauauccuaacaaugguuuagccuagaaauuuuaugauuucuagucaauugaaaguaaagaauuauauaaucuguuuuucuguuuauaggauaugggcccucauauuuuccaaaccuguccaucugcuaacuauuuugacugcagagcuaugucuauuggagcccguucucaaucagcucguacuuaccuggagagacauaugucugaauuuauggaguguaaguguaguuuggcuuacuuuauuuuguuuugccucuucuagucuauauaguuagcaaaucuacccuaagugaggaaaacuaauagucuuuaguuuuuuaaaaaucuuaaggucauaaagugucuauuguuuuauuuaauucuagcuacuaagagaacuuuaucaaaauauaaauauguuugccgggcgugguagcgcacaccuuuaaucccagcacuugggaggcagaggcaggcagauuucugaguucaaggccagccucgucuacaaagugaguuccaggacagccagggcuauacagagaaacccugucucgaaaaacaaaaaacaaaaacaacaacaaaaauaaauaugucuccaaccuugaaaagucuugacauuuagucugaaguaggccccagucaggguugaaacccauuauacuaguuguuauuuguaaauucuguuuacaacuuaauuguuuguaagucuguuucuacuuuaggacacauagaauuucugcauuaaguggcccauaagcaguauaacugugggaaaagagggugaaggguguaagaugaugaagugguuuucaagcgcuuugcuuugcauuagaagaaggguuaauagcagggcuuuuguuuuguuuugguuuuuuucucaagauuuuuuuugucuugguuucauaaauuuuccuguggcaguauaguauuuuuugaaggaaauaggaguucccaagaucacccacauauugggagauuuuugagaacucagcuugcugucauauccuagccaagacuuaacguguguggcauaaggguccuagcuuggucacagaaggaaacaggaaccugcaggcuucccugugcuccuacccuucuccugagugucagggcagcugagugaugcuucugucuaaggagcuuugcuagagagucguuccaaccuggcggguacuuagggaauaguucaguguuguaauauagaugacacugccuuaugauggcuuagcucaggaugucuugacuuuauaauaugcaaaaacaacaugcacugcaaaggaaaugaaguccugaauuuagauuuuuaucuccuccuggguuagccacuucguuaagauccucuaucuaaugcagggcagcagcagugagucaugagccuaagccagccacacagucacauacgcuacgcugcaacauuugguaggcaagguguguuguaugcacauuuuacuuaacauuggccauuuacuguggguacucccauuguaaguuaggcaacaucuggacauagacuuuuguuacauuuacuuaagucuuucagugguauuuuguaauuuuuacuuuauaagucuuguguuucuuuuguuuaacuuauucauacuuuauucuuuucauauuguuuuaagcguuuucucaauaucauuugcagauugcuuauaagaacuugauauuuacauauugauugcaugucuugaaacccuaagaacacuucauuaauuccaaucuaguggauuccuuagaucugagauuauaucacuaggucacaucauuugcaguagaggugguuuuacuuacuuccuagucuuaaugugugcuguuucuuucuugcuucccagauaggugcauuuuguuuuuauugaaugccuuggcuagaacugucaguauagugaugaguggaagugaugagggcauuuguccuuauuuuauuccugagacugagggaaagcguucagucauucucuuagguaugaugugagcugugagaugaguaaguguuuuuauuagguaggaguugggaguuuaucacgugcuuguuauagcugacucaaauggucguaccuuuuuuccucuuagucuauuaauguauuguguuacaucaguuggcuuuucaaauguuaaccaugucuacauuccugagaaaaaauacaguugguuauuauguauaaucuuuucuccuuuguuguuggguucuggugguggugguagaaauggugguaguaauuuuauuuugguuaagaugaggucccauuguguaauugggauugaccuagaauucucuauguagcucaaacuacucauaaucuccaccccagccccauacccucccaagugcuaagguaauagauaugcaccacuuauuugggugucuuuauucauagggaagauuggucuguaauugucuguaaugacuuugauaucagguaauacugaccacaaagaauugaaggcucauuauuuaugaauauaaaaaccugaauucuacaaaacacauucuauaaaauugaaaugucauuugugaccaggacuuuuauuuaaucuagugaaagacagaucauauuuauuacuaaaaagcaucaaguagucauugauguugguugauauuagauuagauuagaugcuaacauuacacuuuuggcuguuuuauucuauauaauaugucauucaagccacaauuaaagacuacagacuugauaauuaaaagaagccuuauuaugauggugaaauuaagaaauuauuuuguaauuuauugcauacaggcaauuuggaugaacugguuaaacauggucugcgugccuuaagagaaacacucccugcagagcaggaccugaccacaaagguaacucaaggucccaauuguagguauaguuuaauccucagucacaagggauaaaacagcauguccuuaagucauuuuaauugcuuuguucguuauuuccuuucuagucaccaaauucucugguuuugaaaugucauguuuaaauuggggugggagguuauacagcaauaaaaugucugcaguuuuuauuuuguuuugucuacaguagguauucguaccuuuaucagauauuuacauuagauuccuaacagucucagaagugcaguuaugaagaagcaaugaaaauaauuuccugguugggggucacaacagcgugaggagcuguauuaaaguauuaggaagaugaaaaccacugguugaggggagacuucauuacuaaugacauggaccuuugagauuucucauaauaaccgacagugaauauuggaucuguaauugaaagagccaugguuuccugccucuuuucacuccuaccuauagguuuuaaaacuuugaacuuaauugcuauauaauuuuuucuacuuugugcccagcguuuuauuauccauauguuaauuucccccccacccccaucagaauguuuccauuggaaucguugguaaagacuuggaauuuacaaucuacgaugaugaugauguaucuccauuccuggauggucuugaagaaagaccacagagaaaagcacagguauguuccauguuacgcaucauaacaugagguuucagcuuuacuguaaacugcuguuccuaucacaaccauguaaauucuggcuuuugucuuucauuauugagguagguccauaauugaaauaacaauuaagaaagcacugacucaaguaaaauauuuuuauaguagugaucuccagaaacacaaagaggaagaaggguuugguucucuaucacugcauaacuaaggucaccccagaauuuacagauuuagaucacauuucuuagaguucuguuguugacugaggcauggaugguagacugcugcucuuacuugggaccucacaaaugcugccaucugacugaagcaggggcagagcaaccaagacgacuucauuccuuaccuacccacucacuagcaaucucagugacccagguagaaggcugugaggccgcagacugcuagaaugacuaggcuucggucuacaaaaggccccuucuacaaaguggcaggucagaacuuccaaaaccugaaaagugaagguugccagccauucuugaggcuagaacucaggacugauucaacuucaguuuagcacauuuuuagguuaaagagaaugagaggaccagccuggauucuucugagaaaaguccagaagagaauacauguuggaagcuaacauuggacacuaaguuagcuauccauaaauggugacaaaaaagcacuaagaaauauugaucucagacaaaacacaaccugaaaauaaaagugguuaagucuaggguuaugaaucuuuccugacaauaugcguuugauuuuuuuccccucaauccuguuaaccucuaagcagguagaauuacagacauucacucuacauacagcucaaguuugcugcuaauggauguggauuuuaugguuguggaacauaaagagugguacaggaauucuuuucuacagauuauaagaucaugcuacaauccuagcacaaugaccggcauucuccaaaaagggggugguggugguagaguuuuuuccagcuugaguuuuuaaguuuaucuuaaauuggcaaagauacuauugguacuguuugggagaacgagauuugcauuuuagauguuagcaagaacuagcauuuagaaagaaugcuuggaguuccacauagcugcuguaacuuuuuucuauuuguugguugaacagaaggaagucuaaaaggugcuggcuguguucuaaacacagcagugaaacauaagaaaggcuuaacucuuaaggaagacaaaugauaaacaguggaauugucuuuaaguugacagaacugaaauuacauauauauauauaauuuuuuaaaguuuuauucaaaaguuuaacaggcuuuuguacuaaaaucaaguaucugcaaaaucuuauaauccucuuacugauauuuuuauauuauaauacuugugauuuaaugguguauauuaagugcucacuuuacaucuucaauucuucuuuuuuaaagccuucacaggcugcugaggaaccugcagaaaaagccgaugaaccaauggaacauuaagugauaaagguuacaaggacauaagaaugcagggacauacacuggcgacaauaaucuguauuuuaaaccaacagcugcaguguauugggugguauguuuuagaaaucaguccagauguaaguuuucucuaagcaacuucacagaaaccauauaauggggugcauuuucuuugaaaggguauacauaaucauuuucuaggaaguauagguaucuauaccaauguuuuuauaugaagaaaauaagugucuuugcaguuuuaaagacaacugugaaauaaaauuguuucaccaccuauugugucaaguuuuuguuuuuaaguaguuucaacuguacauggaagcuaauauuacaauggucacuuacuauaucucucagauuauauuguuuuggcauuuuuuagugauauagaaaaaugccucuuaacaauaaaacuuuaagcaacuua

SEQ ID NO: 4048 - RNA, 4880 nt, Mus musculus
ugaggauauugaaaauacauuuguuuuuaauuuugauuacauucacaagugacaauauuaagaguucuuuaagcauaugguuccauugagucacaacauuaccauguguccccagaagagcaagaggcaguguuucauauccccuugagguuuagcagagucaucaacaucaacaggaugguuuauggggaccauauuugcuaccagauaagccagaaccaugcugucauguuuauuggauacagagucacauacaacacgaugcacaauaggcaacuuauucugcacuuagcuuuagcuccugucaaagggagaaggguuuuucaauacuaagaaggaugcaaauauaugugucuuucaucagccuuucuuauacauaacuuuaauuauacaugaauagaauuagaguuuaucuuuauuguguaaccuaggagaaaaaaaaagaacaaaguuuagguauuaauugucaagcucuugacauuauuccauuuaguuuucuguuaauauuaagagauagguucuguugaugucccuaguuuauaaaguggaaaaauugagacucagugagaguuaaaugaccauccaaugguuauauauccaguagugaaccaauucaguccuuaaacuuauggcuucucuuacauuguaguguauacuacuaggauaaugucauuggcuuucaaacccauaugguagaauggucacaauuagagugaugaauauauggguucuguaucucuuggcccuagagcacagcaucacagaagagagcagaaaggcaggguaggcaggcagggagaaggaaaggcuaggggaagguuuaaaaaaaaacuguaagaugggaucugauucauaggccaagugaccuucagaguaugucuucuaucccugagauauguggacauucauuuuccuaccaguuguacaaggaagucaccuucauucuggggcuguuaucuguucaggccugaaggucccugcggcggcggccgaaggcuucagagcccacauuggugggaacaaaguuguccuucaccacaccuccugaucugcucagcagaccugccagccgaugggucacacagguggcaguguugcaggaucucuucugagcagugacacugauauucaggauggggcagugggagggggaugggggagagagagagagagagagagagagagagagagagagagagagagagagagagagagagagagaggcugucauugaggcuggggaggugucugccucaugggacuaugaugggaauauugcugcucucagaagcaccaauuagcuuuaaguguuucucccaaacaugguuaucagaacagacaaucacaaggccauuaggggaaaugcugugaucacuuuccuuagacauucccagcgguauucaaaaacccaaauggguuuggguuuacuggccacggaacacagggcuguaacugccaaccaugcccauauaaauacaaauaagcaaggcuuuauaagucuagaguaaacuuugaugccaccuccgagcccauucacaaggacucuugucccagucagacacaaguggcccuucuuaguaaagugaaagcaccccagucuuaccugaaggaagacagaguuuggagcauccagucccagcaguguuuaccuguuccuugucgccgcucuucuuacugcuugagcugagucauggccaucgcucaccaaacuacgacugauuaaccuuagggcuaaaaacuacuucuaaccacagguccugaacuccaugaagucugagaugugggcuagaucaaugaccaccaugguucaaaucuuuuuaaaaaauaguuuuauuucccaaacaaccaacacuuccagaagcaagacuagaagcucuacuaggaagccagaugacugcccuugcucucugccaucuuccugagugugcccuugcucucugccaucuuccugggugauucucuuuuagccugugggacuuucuccucacccacuggggauuucagauaccauucuuugccucaggaaagcaaccaguaauagccuggagagcaaccagagaggaacuacaugcaucaaguuauaggaagaaagcaagaaggaaacuagaaaggagagaaggagcuuaguugccaaaaugggauuggugguuugucuccaaguccuuggccacaucccuuuucuugccaggugcuucaaccccaauugaaguuugggggaaggugugaaacuuguugaggucuuguguguacgugcccagcaugcagguacucagauucccacaccgcuuagaucuggggcuguccaagcugcagggaaaagacaugcgaggcagugccaugcaccagggcugacccugugggcagucugcagguuaaaucagucacaggauuagaagcugggacggggcugguaggagguugguucacacauacacuaucgggaaggcuuggggugugguaggccagaagaauguggggaagggcagaggagaagggugacuuuucugacauuccaugugcucuuuaaucuuucaugcuuggcaggguguuucucgggaugguuguaggguaacacaugcuuuuccuuggguaaugcaggagccagaccaggguuggucuguuucuaagcugggggcacacaggcaggcaaggauagggaggggugcucuccuuggcccuguggccacaaugccaucucugcagacuuuaggcuuuaccagucuucgcucauacuauugcaggaagucuccccaauguuagcagacugauuucuacaguuauuccuagccuucucuuaagugcuuucagaaauaaauuuuuuuaagugugauuuaacuacagucucacccgaugacuucugucuucuuucagccugagaguagcugagccucguguccugcuaaacagcagccaggcggacagugcgcucucuccuaccuucuggauuccgccuuccuguggaugggcuaggcaggguaaggggccuuaccuagagcccucagccuccugcucuuccuccugcuccagcucccuggcuuucaucugcauauaguccugcaccagugcagccagcaggcgaacuucuucuucacugagaguggccaugccugggcugcuuuccaagauugaccuguggagaggaagcaagucuagcaccgucucugauucccugccugccgcuuacacuagaggcuugagucagcguccucauaaguuuaggaauuuugcaaguuaaaugauaagugcaggcaaauugaaugacaaaauaauuacuguugaaucugaauugggggcucauuuuaauaaauacaguuuguaaaguagaugagaaauagauuaacagauuauaaauuagagucaguaauauuuauuggcaaguuagcagauuagaguaaaauucaugucucauaaggaaugaauugaacaaaaagguuuaacucuugauacuaaauaugggggggaaguggugaaagcauuuuguuaguuaaagggcuacuugaaauuuaagcuuauagugaacuuacaugugugucuauguacauguauauauuuuuccaccagauaguuggguuuuaaacauucgguacucugugguuaacaggaaguuggccagucccaggacacuaggacuccugucuuuacacguaccucaaaggcacugccuggaggcugcaugccugguacaggagcaagaugcugacaaccaggaaaggggagaacuucaggaagcccaugaugccuuccugcaagagaagaaugucuauuuauucauuuguuuauuuauaucaguucaagguucuauaagcccauggaccuggcuuucugugugcuuaugccugugacuccccgacauuuuggcuucauacugauaaccacauuucucaucaucuuuguucccucauuguccagugugcauguagccuauacgguuuggaaagaaucuuagcccuaaagauggaggagggggagggugcggggggucgggggugguggugguggugguggugguggugguaaaggaguggugguggugagaucagucucaaggauucuacgaaucccaggugucuccugucucuacaucugucuccacagggaaguguagaguugucuucucuuugugaguuuuuuuacagacaccuaagaaugugagaaagaaagucuauggagagggaaucuuucugccuugaaaucugagaaacugacggcugcacugcucagcugcuccacccucuggcaacucaguugccuacaagaaccaaucuaaaguugagguggaaaacacuucucuguuaaucccagggucccaaaucgggguuugcaauugcggcaacugacucuuguucgcuacauauuggcccuaggcucggacucaggaccaauuucucaggaaacgagaauacugaaagcaccaucuaagaagagcuacgcccgacugcgcgcgugaagccuaggagcucagcgucccaagauugguggaucagguguacagagagagagaaacgugagacuggagccugcgcuccagcgaaacugaaggaaggcucugcggaccaguucuguagggaccuaucuggaucgggaucuaacacgaaccacgcuaggacuaaugacuaacggggacugggauugucaggaaagacaaaccaaggacuaacagcgagagcgggagagaagagggagaggaagagaaaaguagaacuacacaccugaacaggaauuuuagggcucaccuggugagcggugccuuggagcugagccugcggggauccugauggagccaggcagugcuugcgaagcggugacucuugauccuggcaguggcuccugugccucccagcgccugcagcugcucuuauucccgccguggugagucggga

SEQ ID NO: 4049 - RNA, 4880 nt, Mus musculus
ucccgacucaccacggcgggaauaagagcagcugcaggcgcugggaggcacaggagccacugccaggaucaagagucaccgcuucgcaagcacugccuggcuccaucaggauccccgcaggcucagcuccaaggcaccgcucaccaggugagcccuaaaauuccuguucagguguguaguucuacuuuucucuuccucucccucuucucucccgcucucgcuguuaguccuugguuugucuuuccugacaaucccaguccccguuagucauuaguccuagcgugguucguguuagaucccgauccagauaggucccuacagaacugguccgcagagccuuccuucaguuucgcuggagcgcaggcuccagucucacguuucucucucucuguacaccugauccaccaaucuugggacgcugagcuccuaggcuucacgcgcgcagucgggcguagcucuucuuagauggugcuuucaguauucucguuuccugagaaauugguccugaguccgagccuagggccaauauguagcgaacaagagucaguugccgcaauugcaaaccccgauuugggacccugggauuaacagagaaguguuuuccaccucaacuuuagauugguucuuguaggcaacugaguugccagaggguggagcagcugagcagugcagccgucaguuucucagauuucaaggcagaaagauucccucuccauagacuuucuuucucacauucuuaggugucuguaaaaaaacucacaaagagaagacaacucuacacuucccuguggagacagauguagagacaggagacaccugggauucguagaauccuugagacugaucucaccaccaccacuccuuuaccaccaccaccaccaccaccaccaccacccccgaccccccgcacccucccccuccuccaucuuuagggcuaagauucuuuccaaaccguauaggcuacaugcacacuggacaaugagggaacaaagaugaugagaaaugugguuaucaguaugaagccaaaaugucggggagucacaggcauaagcacacagaaagccagguccaugggcuuauagaaccuugaacugauauaaauaaacaaaugaauaaauagacauucuucucuugcaggaaggcaucaugggcuuccugaaguucuccccuuuccugguugucagcaucuugcuccuguaccaggcaugcagccuccaggcagugccuuugagguacguguaaagacaggaguccuaguguccugggacuggccaacuuccuguuaaccacagaguaccgaauguuuaaaacccaacuaucugguggaaaaauauauacauguacauagacacacauguaaguucacuauaagcuuaaauuucaaguagcccuuuaacuaacaaaaugcuuucaccacuucccccccauauuuaguaucaagaguuaaaccuuuuuguucaauucauuccuuaugagacaugaauuuuacucuaaucugcuaacuugccaauaaauauuacugacucuaauuuauaaucuguuaaucuauuucucaucuacuuuacaaacuguauuuauuaaaaugagcccccaauucagauucaacaguaauuauuuugucauucaauuugccugcacuuaucauuuaacuugcaaaauuccuaaacuuaugaggacgcugacucaagccucuaguguaagcggcaggcagggaaucagagacggugcuagacuugcuuccucuccacaggucaaucuuggaaagcagcccaggcauggccacucucagugaagaagaaguucgccugcuggcugcacuggugcaggacuauaugcagaugaaagccagggagcuggagcaggaggaagagcaggaggcugagggcucuagguaaggccccuuacccugccuagcccauccacaggaaggcggaauccagaagguaggagagagcgcacuguccgccuggcugcuguuuagcaggacacgaggcucagcuacucucaggcugaaagaagacagaagucaucgggugagacuguaguuaaaucacacuuaaaaaaauuuauuucugaaagcacuuaagagaaggcuaggaauaacuguagaaaucagucugcuaacauuggggagacuuccugcaauaguaugagcgaagacugguaaagccuaaagucugcagagauggcauuguggccacagggccaaggagagcaccccucccuauccuugccugccugugugcccccagcuuagaaacagaccaacccuggucuggcuccugcauuacccaaggaaaagcauguguuacccuacaaccaucccgagaaacacccugccaagcaugaaagauuaaagagcacauggaaugucagaaaagucacccuucuccucugcccuuccccacauucuucuggccuaccacaccccaagccuucccgauaguguaugugugaaccaaccuccuaccagccccgucccagcuucuaauccugugacugauuuaaccugcagacugcccacagggucagcccuggugcauggcacugccucgcaugucuuuucccugcagcuuggacagccccagaucuaagcggugugggaaucugaguaccugcaugcugggcacguacacacaagaccucaacaaguuucacaccuucccccaaacuucaauugggguugaagcaccuggcaagaaaagggauguggccaaggacuuggagacaaaccaccaaucccauuuuggcaacuaagcuccuucucuccuuucuaguuuccuucuugcuuucuuccuauaacuugaugcauguaguuccucucugguugcucuccaggcuauuacugguugcuuuccugaggcaaagaaugguaucugaaauccccagugggugaggagaaagucccacaggcuaaaagagaaucacccaggaagauggcagagagcaagggcacacucaggaagauggcagagagcaagggcagucaucuggcuuccuaguagagcuucuagucuugcuucuggaaguguugguuguuugggaaauaaaacuauuuuuuaaaaagauuugaaccaugguggucauugaucuagcccacaucucagacuucauggaguucaggaccugugguuagaaguaguuuuuagcccuaagguuaaucagucguaguuuggugagcgauggccaugacucagcucaagcaguaagaagagcggcgacaaggaacagguaaacacugcugggacuggaugcuccaaacucugucuuccuucagguaagacuggggugcuuucacuuuacuaagaagggccacuugugucugacugggacaagaguccuugugaaugggcucggagguggcaucaaaguuuacucuagacuuauaaagccuugcuuauuuguauuuauaugggcaugguuggcaguuacagcccuguguuccguggccaguaaacccaaacccauuuggguuuuugaauaccgcugggaaugucuaaggaaagugaucacagcauuuccccuaauggccuugugauugucuguucugauaaccauguuugggagaaacacuuaaagcuaauuggugcuucugagagcagcaauauucccaucauagucccaugaggcagacaccuccccagccucaaugacagccucucucucucucucucucucucucucucucucucucucucucucucucucucucucucucucucccccaucccccucccacugccccauccugaauaucagugucacugcucagaagagauccugcaacacugccaccugugugacccaucggcuggcaggucugcugagcagaucaggagguguggugaaggacaacuuuguucccaccaaugugggcucugaagccuucggccgccgccgcagggaccuucaggccugaacagauaacagccccagaaugaaggugacuuccuuguacaacugguaggaaaaugaauguccacauaucucagggauagaagacauacucugaaggucacuuggccuaugaaucagaucccaucuuacaguuuuuuuuuaaaccuuccccuagccuuuccuucucccugccugccuacccugccuuucugcucucuucugugaugcugugcucuagggccaagagauacagaacccauauauucaucacucuaauugugaccauucuaccauauggguuugaaagccaaugacauuauccuaguaguauacacuacaauguaagagaagccauaaguuuaaggacugaauugguucacuacuggauauauaaccauuggauggucauuuaacucucacugagucucaauuuuuccacuuuauaaacuagggacaucaacagaaccuaucucuuaauauuaacagaaaacuaaauggaauaaugucaagagcuugacaauuaauaccuaaacuuuguucuuuuuuuuucuccuagguuacacaauaaagauaaacucuaauucuauucauguauaauuaaaguuauguauaagaaaggcugaugaaagacacauauauuugcauccuucuuaguauugaaaaacccuucucccuuugacaggagcuaaagcuaagugcagaauaaguugccuauugugcaucguguuguaugugacucuguauccaauaaacaugacagcaugguucuggcuuaucugguagcaaauaugguccccauaaaccauccuguugauguugaugacucugcuaaaccucaaggggauaugaaacacugccucuugcucuucuggggacacaugguaauguugugacucaauggaaccauaugcuuaaagaacucuuaauauugucacuugugaauguaaucaaaauuaaaaacaaauguauuuucaauauccuca

SEQ ID NO: 4050 - RNA, 885 nt, Mus musculus
cauggcucguggucccaagaaacaccugaagcguguggcggccccacgccacuggaugcuggacaaacugacuggcauauucgcgcaccaccugcaggagugccugccgcucgccaucuuccugaggaacaggcccaaguacgccaugaccggcgacgaggugaagaagaucugcaugcagcggcucauuaaggucgaaggcaaggucagaacugauguggccuacccagugggcuucauggaugucaucagcauguacaagagcggcgagaacuuccuccucaucuacgacaccaagggccgcuucgcgguacaccgcaucacgcccgaggaggccaaguacaagcugugcaaggugaggaaagucuucguggguaccaagggcaucccgcaccucaucacacacgacgcgcguaccauccacuacccugacccgcucaucaaggucaacgacaacgugcagaucucacuagacaguggaaaaaucaccgaugccaucaaguuugauaccggcaaccugggcaugguaaccggaggcgccaaccugggucgcaccagcgucaucaccaaccgcgagcgccaccccgacuccuuugacaugguccacaugaaagaugccaacggcaauggcuuugcuacccgccucuccaacaucuucaugaucuggaagggcaaaaagccguggaucucccuuccccggggaaaaggaauccgccucaccauugccgaagagagagacaagaggcuggcggccaagcagagcgggugaaauggacucggagggacauugcggggaagaggcguuuacauuuguuuauacuuaaaguuuuuuaagcagcauguugaauuaaaaaaggaagcaagcuuaaaaaaaaaaaaaggaac

SEQ ID NO: 4051 - RNA, 184873 nt, Mus musculus
cggggcucaggcgcugggcgaacauggcggcugcggucgggcgggacacccuaccugagcacugguccuauggcgucugucgggacggccgcgucuucuucaucaagugcgugaggggcggcgacacccggacggggucgugcgcuggggcuggggccgcgggcgggcguggagggcggcggcgcuaacaggugcaccucucccguagugaccagcuccgcugcacgaccuggcugcacccgcggaccggcgaaccggucaacucgggucacaugauccgcucaggugggcgcugggucggugcgggaugcagggugcggagcggggucgccacggcugcgcuaguuugaccaacuuuucucgccuucccgcagacuugccgcgcggcugggaggagggcuucacggaggagggcgccagcuucuucaucgaguaagugaauccgcaccgcggccgcaccugccuugcucucccgcagccuuggcgggcucggcgcucgggguuuguuugcuugacgguggcgggcucggggggacggcugcguacggggguucgcagcgccgcagggggccuggccaggucccgcccgccgguggccgagccugcaaacuccaaggcucccccgggacacgccuaccccgggggccugcgcugggcacaguggcggguggcggggaguagggcucgcgugggucgggaguguggccugagggcuugggcgugggggagggggaagaggggccccgacgcuacucuagccgcgcuggcugggcucgccguggagaguuggagcgcgacccgggccgccgcauccuugcuucucagggaugggauggggguggggcucccaggcagccaaugauauuccuggaacucuacccgcgcgucuucggcgggcgccgaacgccgaggaacgcggacgaucugcucugcccgggcuaguagaacgggagcuuugccgccugagccucugggcgcugucccaaguuauucuuggucuguugguccgcguggaucugaucucgaaguuguaaggggacacgaguguacagucuucacuuuucccagucgggcaaggugccuguguugcagcguuccucccucugcuuccuguggguccugggagucagaacuugccuuugaucguuugccccagucagucggugccuggcauagaguaggagcucuguaaauguuuguuuauggaaugaaugaacuagccaaaggucuggcgcuccaugguuugacuggcacucgguguacugugcgcgaccgugacucagaauucauuucuucaccaacuuggaaacaauguuuagaucuggaucagaauaugugaagaaaguccccgagccuccuuugucacaugggacucuuguauaguggcugcugauggaugugcucuaugcaagggaggugcucacuauuucuguucgucaauuuguaacccacgggaggaaagggaacaaagagugaacaaauaauaauagcagguaacggugacugcugugcggaaaauuaacaugaggggaugugacuugaagugauuggauggcugaugggacugguagguccugaugacuuuuuuucugagcaggugacauuuggaauuugaaugacaagaaggacccuugcuguggugaccaguaggggcaaaacauuucagaaaaauguuuaaggaacaaaacccuucgaguucaaugagggguuggggauuuugcucagugguagagcucugggggaaaaaaaaguucagugagcaaaaagucuuguguggcuuggaggaagugaccaagggcgaggauggcauuaaaggaaggcacaggaagggagguaaaggaugaaacuggagcaggguaaagagcugcugagcucuauccugagaccagggagaaugcagacguuuuaagguggcuugguauguuuggcaguuuuugggaguauggcguuuggguggagagcugugccagggagguaggagagcagcaggaagcuguggcugugguccagagcagacguuagugggggggggggugaagcacggagauggagagcaggagucagauagaggcugugcucuggaugcagagagagagagagagagagagagagagagagagagagagagagagagagagagagagagaaagaacgagaacacuccugggggccuggggagaugaugcuccguucauaaagugcuugccaugccagcaugaggacucacauuccaucucauaaaaacccagguguaguaacaaugugcacguguaauacuagcgcugggaagguagagaccggagaauccagggcuugccacccugucauccuagccuaagcugcaagccccaggucccagcaagagacugcuucagaaaauaaguggguauuuaagaaaaaaacaugugagguugggcuggcuucuggcuuuuacauucacaggaacacauauacgugugcacuuguacacacaggaauacacacaaguacacauacugcacaugcgcgcgcgcgcgcgcacacacacacacacacacacacacacacacacacacagaugauuccuagaggugagagguccugaguggguagguagugcucauaucuuugagauggaaaggcugggagaaaaacaggcuugaauagguguuaagaaacucuauauuuuguucuguuauauauaagaugugaauauaucauauagaucagccauucucaacaugucauuaacaaauuauccuuuuucaggggucgacuaggaucaucagaaaacacguauucacauuaugauucauaacagccaagugacaguuaugaaguagcagcauuaggaagguugagaaccacugauacagauuuaugaaucugaaacuuggguuugagagggagagaggcuugcagagacccaucugaggauaccugugugugaugucauagggaguaggugacgucaucaaggacaagugugggccaagaaagucugucccgguuugcuugcuguugucauaagcaccaugagcaaaugcauaguuagggaaacuagggaaaacaaagguuuguuucagcuuauacuucucaucccaguucaucagugaaggaagucagagcaggaaguugagcaggagcugaagcagaagucauggaggaaggcugcuuauuggcucacucuagccugccagcccacuuuccuuaggcuuacauguguaggauacaaugguccacagugggcugggcccucccacaucaaucgucagucaagacaauuccccgcagacauguccacugcaggacagucuucaguugaggcucccucuucccaggcuacagaaacuaagcagaacaaugcucuaagccugggggcggguaguggcugagaucaggaaaggcaaacuuaagaggacagacugagaaggugagaagauguguagucacagggaccuccagaacaggagacugccacccaugguaagauggguaagaaacaccuguccaggaagggcaguacaucuuccuggaaguuuuuuuuuuuaauucuucucuuuuuuuuuuuuaauauuuauuuauuuauuauauguaaguacacuguagcuguccucagacacuccagaagagggagucagaucucguuauggaugguugugagccaccaugugguugcugggauuugaacuccugaccuuccgaagagcagucgggugcucuuacccacugagccaucucaccagccccuuccuggaaguuuugcugcaaagaaggguccaggcauuggcugauagcuggagauuguguggguagagggagggugucuuaggcuuuuauugcugugaagagaccccaugaccaaggcggcucauauaaaggacauuuaauuggggguggcuuacaguuucaaagguuuaguccaucgucgucauggcaggaaacaggcaacauaaagaccagcaugguacuggagauguugcugagaguucuacaucgugauccaaaggcagccaggaggagaguggaauuccacgcuggguagagcuugagcagaggaguccuccaagccuuccucccacaaggccacaccuccuaauagugccacucccccugggccaagcaaucaaacacaggagucugugggguccauaccuauucaaaccaccacagaggggcuuguucuuuccagggaaagauggugcagcaucuuauuuucuggaccuggggggugggugugggggagauagauguaggaaaaaaacuggcaguuauuggagcagaguuucuguggaggugagagggaaggaugccaguguguaucucaaggucacuuacugggacaccgaggagagguggugaguguuuugcaguaguggcacagccuugaguugaguuggaucuuccugugauccugcagucuguaaacucuaggcugcagccucagcacugggauuuuaucccuguugcaacucuucuucgaucacucugucccugcugccaccacucccucaucugaauccucccacacuuuuuggaaaugacuacccauagcaacauugacuguggccccuccucucaaaggcugcuggugccaguaggucggaauccauuguguuuucuacaugauaauuucucaagaggccucuuugucccaccccccccccccaugaaguuuuacaccuaucugcuuacuaaagaguuuuuuuuuuuuuuuuuaguuacuacauuugauugugugucaccuccaaaccuugucccuagccuuuuagacaugugugucaccccucagcccuuguccccagccuuugguuuucugagacaggaucuuccugugauccucagacuggucuuggauuuaagauccucuugucucuaucuccugaggguuggggucacagguaacugcaucuuacuaaacagauuaauaccaucuggacucuguuucuuuuucuuuucuuucuuuuucuuuuucuuuuuugauuuuucaagacaggguuucucuguauagcccuggcuguccuggaacucacucaggcuggccucgaacucagaaauccgccugccucugccucccaagugcugggauuaaaggcgugcgccaccacucccggcuuggagucuguuucuuuauuuuaguuuauuucugcgcuuuuggcuacacuuugccuucaugguucucacaaguacaggugagguggugcagacuuccccuuuaauaaaaagauacugggcucugagauguuuucauuuuuccaugagucuccugacuggauagcaaauaucacaguaguuaugauaguguuaucuacaccaacaaugagaauaguggcaauuauaugucuuuuuuguuuuuuuguuuguuuguuuguuguuguuguuuuuugagacagucuugugucccugugucccuggcugaccuucaggucacagagauccaccugcuucugccuccugagugccgggauuaaaggugugcacgccaagccugggccuaauuuguuuguuuguuuaggacagggucuugcaguuuagcccgagagcuggucucacagguaagcaccuccaccacauggugcuaacuuaguugaggucuuggagaaaauaucaggaccugcuauugcuauucauagcuguugucugauuuauuuacuuaaagacagggucucacucugcaguccagcuggccuggaacacuuaacauccuccugccucagcucuccugagaaugucucaggauuauaggcauguaucacuguaccuagcuuuugguuuuguuuugagauagagccucauguacugaaccuagguccuucaucaggaagucauggcucuagucuagucuuugggguuuuuuuuuguuuuuguuuuuuuuuuuguuuuuucgagacaggguuucucuguauagcccuggcuguccuggaacucacuuuguagaccaggcuggccucgaacucagaaauccgccugccucugccacccgagugcugggauuaaagggguacaccaccacgaguggcucuuuguuuaauuuuuauuucgagacagaaccucacugggcugcccagggcagccuugaacuuggaacuuggacacugccuuagugucccagcaguugggaguuacagaucugcgccauaguucagcucuaggcaaaugcucguccugccucagccacuugugugcuuggugguguguauguguguggagugggguguuggcacaccacacccugcuugaaggcugcuccuugagggcagaccuguucacuguuucugaggcauuggcacacagcccaggccuggaccugcuuccgcccuccguauuuauggaagaggauguguccccaugaaaccuugggcagucauuaaguaguccagucuuuauuuaucaauuccuggcugaagaggagacuuguguguggagcagaagcggggaagccaggagugggccuguuggggcugguguuuacacccaggcaucuuggagucagucacucauuggcaacagcaacacucaaagcaggaaccuggccaggagaggcucaggcagccuucuuuggcuccuuggucucaugagcucagcacucugcaucuggguauuuucucaucuauuggcaauugaacuagauccccccuuuucccuggcuucagggccuuggcaucuucugacuuugcuccaagguccugacagggaucaaucuaucacacaaagugccacuuagcuucagguccuccagccuuagcuuuguggacuugggucauccuguguagguaccauucccuaggcaguaggacuugggaaagauucacugaaggcuuggagugaaguuguuuuucugcuguuccccugugcuguggccugcaaacauuuuaggggcggagucuauagcauaacuuucaggucuccagugcaaaaugaaaauggaaggagccuacugaaaggggagggugccauuggaaguacuguaguaaaaugggugugguggcacaucgauuuuagcaugugggaggaggaggaggcaaggccagcaagaguucaaggucauucuggccguucagucugggcuacuugagacucuagauauuggagucucugucuccaaaacccaacaacaaaacaaagcugcuguguacgccaguguguucagccagcaguuagcauucuagaaguggaggcaggaggauccaagaguucagggccaucuucaaaaauggauugaauuguaagaagccagccuagguugcaugagccccuuugucaagcuaaaggagacaaauccacaaaucuacaauauaaaauguguuccgggcuggugagauggcuuaguggguaagagcacccgacugcucuuccgaaggucuggaguucaaaucccagcaaccacaugguggcucacaaccauccguaaugagaucugauucccucuucuggagugucugaagacagcuacagcguacuuacauaaaauaaauaaauaaaucuaaaaaaaaaaaaaaaaaaaagugucccuuuugcaguccccccccccacccccgccccagacuugucaugguuuuaaaaauuugcuauuucaugucuuuuuuuuuuuuucccucugagacagagucucacuguguaguccugaauauccuggaauuugcuauguagaucaggcuggccucaaacucacagaggucuggcugucuuugccuccccagugcugggauuaaaggugugcaucacuguuuucugguuuguucaauaucauuuuaaauaaagaaaaaaauuaaauauauuauauauguuuuauagcucaucucuauaucaaauauaaucauuuauuuaaaugucaauaucaggucauucaccucuaaugccgaaugauucaucagcaccauaucccacuguaaaauacaguauaagagugggcaggcucagggcacuguggacagggugaggcacaugcuggccaagugggacauaggaggcugggagaagcagggagagcugggguggugagagccacagcuucuagccuccuucaaagacacccugcuguggaccauacccaguucuuagggcaugccuucaacuuuucaaucaguuuaaacacagagugaaucagaugugaaagucaucaagggggaagucccuauuaaauggaaggcccuuuagaaaaacuauuggaggccgggcaugguggcgcacgccuguaaucccagcacuugggaggcagaggcaggcgauuucugaguuugaggccagccuggucuacaaagugaguuccaggacagccagggcuauacagagaaacccugucucaaaaaaccaaaaaagaaaaagaaaagaaaaacuauuggagcuuuggacaccacacuuccagaacuuuuauuucaaaccagaaauugacagucuuacauugaauucugggugcuaauggcuuacauguauuuaaaguggaaauccugaagccucauuguugaagggcaagcagguucucuugcuuggcuggcuuggguauaaucucacacuuuaccuuguacuuccugguggcuuuaucaagggggaaagccggaucacggauuuaguacuggguccgugggaaaacacuaacagugaguguuuuguggaaagcuggagcacggacggacuuagggcugugauuuguaucacacucucaaagcaccuggaaaaaccucugagaaaaaggauugaagcugcuuaaggcucuugacccgugggggagccaguugcuccuguggcaggucggucugugugaagaggggaggugugagucuccucugcacugguaaccaacugcugggggaccugggcgcugggagaagguggcucaugggagaggaagagugcuugcuuggcacgccaaggaagccuggguuccauucccaacacagcaaaaggagaaacaguaagaacugggugcuuuucugccccgcugguacucuuuccauccucuucgcacgcuaagaggguguucggcacgugcuaguggaggaagauccugagcaggaagcaggaggacagccaaucccaggucuuccagggcuacagagugagugaguucaaagccagucuguacaauuuagugagacugugauucaaacguaaaaguaaaaauaaagagauuaggggcuccggcccaugaguggggccuuugcauugcaugugcaaggcucugggugcaagucagguuuuuuuuuuuuuuuuuggggggggggugggcagcuggcaagucaggccaggauguggaauacugggugacagacuguggugcccacuccagcucagcauaaggagccagcaucucagacuggcacggguuugugaguaaacacuggcagagggaagaaccuggaggaauauggugguguuuuccucuugucacugggcugucaaaacauuugcuuuuugauuucugggaaggggaagcacuuugaaugaauguuuuuauugucugcagaguguuucaggaacacuaucugguucaacucuuaccauuauuuauuuauuuauuuauuuauuugccuguagaacuuuggcucgaaggguaaagugauuuuuccuacaguuaccuguuaccuacuagcucagccauuucagggcucgggagagaggccuggagguauuguuacccuagcuugugcuucucacacauggggaccacagauuuaaugacagaaggaaggggaaggucugcuucccugggagacgugggugcagaaaacaucgugugugcugacuucaguucugcugugccggggugaaacccagggcuuugggccugcugggcaaagucuaccacugaaugacacccccagcccuuggcuguagaaauagugucuuacugugaggcccagccuggccccaguccucauccuccuggcucugugccccaagugccgggauuacaggccugcaccaccacgccuggcuucuguggccuuuacagucgauucauccucucugccuaccucgggaucgccacguugguaagcugcaucagaucuacugugugccuuuugccguuucccaaauagaagcaucugccccaggaggugccagcuucucuuaacugccccuggacuuaugucggucuuggcggaccugugcgagucucccacucucugccaugcauaugcucaguucgauguguguggggaagacagagaggguguguaguggggagucugugucuccaggaaguguggggacacagacccaucauuggcuuuauggucuuucugggucuuagugccuggaggaaagccacaccagcagcugcuguggccccaggcuaucuuccuuucuuaccuucacccccuuugacagagccuuccuauguagcugugguuggcuccaaaaucucuauauaaaccgggcuggucuuuaacucacagaguucccugccucugccucuugagagcuaggguuaaaagcauguaccacugggucaggcuugggcugucaucuuuugcuggacugagauugcuuggccucucucauccaguuuccucacaaccacccucuaccuuggaagcaggguugguuuuucuggaagcccugcacccuguagacaguguguagguguguggaugggguugacaccuguggggagagacaguuuuagcaccuggaugcuaaucccagccgggcccuggcugcuuucugaccuugguccguugcuggauucucucuaagcuuacuucuccaaagguccacuguuguuaguuugaggauuaaaugaaucaugagguggaaaaaaggcccaggacauguuuagugcagaguaaaugccaaugaacgugagcugcuauacaucuauucccacagcucagagcuggggcgagaaugugagucugcauccugauugcauuugacugcuggcggggguggggugggggguuguggggguaggguggggguggggggaguggaggaugggggagcuugaugucucugauacugguuugccuggaguuagcagcauguuaacuguagaacucaacucagaaauuaauuugaaccaacgaaaauggaaaaccauuuaguacuaacaagauguccuuaguucuggaaaaugcacacuaaaauguuugcucuggugguugugggacugggggagugcauauuuguguggggggggguaggggccugggaguauauauuugugugugagggguagggggcuggggaguauauauuuguggggggugggaguggggggaaaauaacaccacgggacaccauguuaacaguggccgagacuggauaacggauacuuggggacacuuuucacuguucuuuugcaauuuaaaaauaacuuuuuuagagccgggcggugguggcgcacgccuuuaaucccagcacucgggaggcagaggcagguggauuuccgaguucgaggccagccuggucuacaaagugaguuccaggacagccaggacuacacagagaaacccugucucaaaaaaaaaaaaaaaaaaaaaaaaaaaaaaaaaaccaaaaaacuuuuuuagcugggcgugguggcacauacuuuuaaucucagcacucaggaggcagaggcagacagaggcaggcaggucucaguucaaggccagccuggucuauagagcaaguuccaggacagccaggacuacacagagaaacccugucuugaaaaaacaaaaacaaacaaauaaaaaguuuuauauaguuauuuauuuuauguguaugaguauuuuucucauauauaccacauguaugccugguaccugagaggucagaagaacggguguuggauccccuggaacuggaguuacaggugguuggggugcuagaaccuagguccucuagaauaagagggcucuuaaccucugaagcaucuuucuagccccuuuacucuugcagcuuucacauacguuugcagagaugucaaguacaguuguggugaaugccuggaacacacaggaggcugagguaagaacaucugaugcugugaguuuuagcuaggccuagccuacauauugaguucaaggccagccugggcaaccccgucucaaaacaaacaaacaaacaaauaacaaacaggcaaagaacccaggugcaaaacccuucagcaguuuaucuuaacagucuggcgcugacgugggcaccaaacuuaacagaaauggcuccuuuauuaucagcugcugacucuguuuacacguguggaugggggcugaggaauucaugcguguguguuagguagcccagugaggacugcccagcaguccucugugucaucacagcccccuuucccugcuuggcugccucccucaagaucccugaugguccuguacugcaugggcuggggcgauguguuuuaggaaaacaaaugguccauuaagggccaggcuggggcuggagagauggcucagcgguuaagagcguugacugcucuuccagagguccugaguucaagucccagcaaccacgugguggcucacaaccauccauaaugagaucugacucacucuucuguagugucugaagacagcuacaguguacucacauauaauaaguaaauaaaucuuuaaaaaaaaaaaaaaaaaaaaagggccaggcugccugauguccgucacaggugccugcccaggcuucaggggucuaggcuaugagagcccagcgugcuguggaaaggcucuaucuccuuccuggacucuuagaggcuguauaaugcugcucuguaaccaggcaucaccugguaucaucuguggacacuggaaaauagacaaguugucuguccugaucagcagcugacacuggaguuaaacaccauuccuucuagagcaggccuuuugauugucauuuguacagcuugggcauuugagacagggguggggagcuaaaggucuuucugaaaccagaagaauugcaguuggaacucacaccugaguuauuuggugcuguuucuacccuggcuccacccuccacuccucugcaccaucccuaaggaccccaaagcagcagcaucuugggccucccucaccaacaucccacugaggaacaagugagccgagcuguggcccucggcagguggggguggugagaggggcccugguguccuggaaggguggaucuccucauuuggaguaucacccccucuuuaaucuuuucuacuucuccuuuuuccuccuccccagaugucaacugacccagcuuaggaaccgaugagccucuuaagucugcuuaaagagccagacugucuuucagggccugccugagaucauguugacaacccagccagccccagccagcugcagccagccuucucaggggcucuacugcauuuccugucugggccuggcagcuuggaguuagcaugcacucuccugugccucccuggaacccacucagccaaugggaauguaguaagaggcccauucuguccugugcccagggcauugcugccuuccuguggagucuuccuguggggccaggaccagaaaagggcgcaauaaguggcauauuugugucaucuccauuuguaaacugaauugaccauaguucauagauggagccagugggcuguguaggggugagugccucuuuagagaacuaaccagagguuugggugaaggaguuuaccaagugugaagcugaagggccuucacauugggcccuguggacagagacagaggccacuaucccuacuuccaguguccagugcaaaagcagagaggauccugaucaguuucagucuggguguuggggguggggcucugauggaucuggggaccuccaggggaagauugaggaaggcaggcagcuguggagaagggcagugcugagcugcaggggagagggaagcaggggagcagguggugugggucauagcaucugugugaggagaggagguauugggugggcccuggcucaaagccugaauuggcaacuugguuucaggaaagagggcugagggggacauugcccaagggguucccagugcugagucugagucucacaaugguuguagaacaagauaugaggcugggauggagaaugacuuugauuaucagcgggcuugcacaguuuucaugaaguuuugggugcgaucccaaacacugcauaaaccugguauggguggugcacaucuguaauccucgcacuguguaggugaaggcaggaaggucagaguuucaagguuaugcuuagcuaccaaggccacccugggcuacaugaaauucuguuucaaaaagaaaacaaaacaaaacgaugcuauagacuggugccugagaccccagugcuaccucuugcuugggccggucacuuccaucucugucucuagguguuucuuccgcuaggguagcuaugguggcggcuacuuugaccaccagcuagggcagcuagagcaggcaggcacugagaaaguaaccguuaugauugccgcucugccggcucugugaaggaagugcuuugcuaggcuaggugcugugcuuugcuaggcuaggugcugugcuuugcuaggcuaggugcugugcuuugcuaggcuaggugcugugcuuugcuaggcuaggugcugugcuuugcuuugcuaggcuaggugcugugcuuugcuaggcuaggugcugugcuuugcuaggcuaggugcugugcugcuggccaggggcuggugugcuguucccggggaagucuccugaauccgagcuagagauggaaguuugugcccuuuugcuuuuucuuuccauucuuuguuuuuguuuaaacagguucucauuucauagccuaggcuagccuugaacucaugucucccaaauaccgggacuccaggcuugccagugugccucacggagaacucugcuuguauugagacuugucuguaauuggaagcugggcccugguuggugcuaaauaccaaagagcaguuacugaucuuggaagcuguguagcugugucccuccagagagaacaggaacacguuuccugggcucggaauugcuaugggcuuuccacccccugcccucugcacuacccugguggaggaccuuccuugggguucccacuugggcuaucuggcaggacgucuugcuccuuucgggguaggcagcaacuuuggugucuguauuagacacccuuaugaagugagugaaaugaaguccuagucuagaauguggguccaagccucuggggccuugggacuugggaaccuacacaggugcacaggugauucgcugugcggagagugaagccuucuguagcuucagcuccagcgucugcgcaguggcggcgcuccuuuccuccgagugucauuugagauggaaaacugauagccuggcugcagguccacgccucugcucugcacauggugggccugugggcauugugucuuucaugacaggagcucaucuguccaaaacagucagacagagcugggugcaagguaguagagggggagcagggggcaccgaugucagucacugcccgcacuuuugcucagagggaguucugggagcaggagucuggucuugcuuccuccacgggguggugagcucacaccucagaagccacaaguacuuagagauacucugaggacagaggacgccaggcuggaggguccuucuggguugcuggaggaggcaggcaggcugcagcucagaaccagggauggcugcgugugugccagugaaugguggugaugggauagagauaccuuaccacucccgacaucccugcgcugguccugagggauccuggcaggacuaggggcuccaaacaacucaccagcuccccguggacugugucaggcacagggucaauguucagccaaagagguauguagguuugcugauuuaaccuuugaccugucucuccagaaaugggcugguuuacaaggagaguguuuagagcugggaguuaguacggcucugagcaggggugggaagaaggacuggagcccagggucaggguucaagggaggagaaaggcuuaccuagccugccaggggagggcuuggaaaagucuuuuucauagcacauuuugaacuggggauuuggaaaauaauagacagacggcugcugugaagcuaaauaucuauaaucacuguacccagggaugcauuuuuaaauggaacuggugguaccuaaaauuacauccauuuauguaggcuuugaauaaugccuuuuuuuccugugugaggugugagcgggagcugaagagagcucagcuggccucugccuuugguuuucccagcccuccuuaccugagaauguguagguguguuucuguguuugucaucagaugggugcugaaacucagaggacaugaauccuucagggggagagaaaaguuucaugcucggcgaguagacagauauuuaaguuagaacucagaaagugcucugauugugggagaugugggagaggcaugggugauugguacuggaugcuucauagaacaagcuggaaguuuuuuuuuuuuuuuaagauuuauuuauauuuuuauuuacauaagcacacuguagcugucuucagacacaccagaagagugcaucggaugccguuacagaugguugugagccaccauguggcugcugggaauggaagagcagucagugcucuuaaucgcugagccaucuuuccaguccaagccugggaaguucuuaaagugagcuguaggaugggcugguaccccaagaagccaacugguuuucuuaaaccuucauucauucauucauucauucauucauucauucauucuguguuugugugguuuugguuuuuuuguuuguuuguuuguuuuuuuuguuuuuuuguuuuuguuuuuuuuugagacaggguuucucuguguagcucuggcuguccuggaacucgcuuuguagaccaggcuggccucgaacucaggaauccacuugccucugccucccaaguacugggauuaaaggcgugcgccacuaccgcccggccuuguguggguuuuuuaaaaaaaaauuuauuuugagacaaugucuuacuacuuaguuuuagcuggcucggagcucccuauguagacugaucuggcuugggacuugugggcuauccuccugccuuugccuccuugguguugggauuacagguguggaauaccacauuuacuuuauuuauuuauuuauuuauuuauuuauuuauuuaauguauuuugucuggugcugacgugcacaccaaacuuaacagaaacggcuccuuuaacuauaugcugacucuguuuacagaggaggacagggggcuguguuagguagcccagugagggcugccuagcaguccucugugucaucacagcccccuuccccugcuuggcugccucccucaagaucccugauggucgugcacaggcuggggugguuuguuuuagggaaacacucaauuuguacagguucacuuaaaaggaugaaugagaggugugaccugaccuuuuguaacacuaaggaaaaguaaacuuuggggaccuucuguugaguaaccugggcagagccccacugguggcaggcauugccaccucucccuggaacaggcaaggagacaguagaugaguuccugggcucugggggagaguggggagguggcuggcuuuguagagggcauagacugugcugcccugggggcuggaaccuggccaggaaggucuagggucuuggccauguuguccucugccugucacaugccaaguaccaggugccacggguacagaaaagcaugggcuguggagcuugggugaguuauuaagcuuuuguaaaauggggugaauguugguaucuuccccaagaauuuuuuuuuuuuuuuugccuugauuaaacaaaaauaacauggcugagcucaggugcuaguguucaccuguaaucucuccuuuggagggcugaaugagaggacugugggcuuaaggccacgcuggaaaacauaguaagaccuugucccaagaaaucaaaccaaaccaaaccaaaccaaaccaaaccaaaccaaaccaaaccaaaccaaaccaaaccaaaaaacccuaaaaagaaaagucaaaagucaacaacaaaagaauguggaguauugauucccagaaugcagcaguaaguauuguuuaauacuuuuggcacuuauauguauucccaggggguuauuuauccucuggaguggcugugcugucccagguaugugggagauugcucaguuccuuggcuucaaucccacaggccuccugucuacugauauagacagagaccaccugcugucuuguucggccaucucagcaucuuagugauggguauuuucuagacgacagcaucgguuguccugucaggguuaaccaagguugaaaauguccaguguccagagcugcauccuaauugugaccuuggcaguuagcauuuguggaggcaguuugaguacaguuuguagcacaacucgugucucaccugagcccugccuuccuuuuccuggcggggaagaaaaggcugcaguaauaguggagaagcuagaggggagguuugaacucaguucagcaucucuuuauccaccuuugcugugccucuggagagcauuggguagcuggugcaucaagguauucauucaguuucaggugauggucaggaguguguggcaaggacccaggguaagaggugugggugcuucguggaaagaggugcccaggagggaguaguguggggucuggguuagucagggaagcuuugggucuccagcugggauggugcagagggcuuagugacauagccuuugucacuaagggacucuuugaaagguggacuuucacugagcccuugauauguguuaggcucaggccccgggcacucugagcauccacaugagaagaguuauuuggacggagguuaggaacacagguucugaugugugguugucuguguuugaggcccagcacuggcacuucucggcuuguggugugaucccuauauaaucuggggccucaacuuccugauguguaacacaggaauaaugguaauugugauaggguuuacaugagcuaacgugggguacucagaagggucuuggggauagaagcuauaugcgugugcuggcucuuuauuagcaccaggauaucgucaauccaagggauauguuuugucugcauugguugcugcuaucugggugcucccagaaacuucugguacauacauagcaagcaagcaucagguuaaugauucacagcaccacuggugugcccaaggagccaugagccugggcuagaagggucacagcugugucacaaacuagaagacaccaugcaaguaauuugauaagggggaccuggauaauuuggcagaggggcaggucaggggaaacuugggauucugggcaagccuccagcuuggucuugaaaaacaugaaggggcuuauuggagucuugagugauagaggaagaggauggagcuugggcagagucacaggaagcaugucacacuggcggcagcgggagagcgcgggcugcagagugagucccuuagagaaccuuaguccugugggucuugcacgcgagacuccaccuggcaggugagggcuggccuccgaagcugguaacagguaacacauaccuugguuggcagcacguuugucuuaaaaauagaagggacagagauagagggauggugugcuuguccuagguauggccuaguuagaaccugaccccuggcaacaucagcuguccucaccuucauucacaggccagcaacuuccucucacuacugaggacuaccuccugcccgucccuccucccaggacucagcagagggguggacugaguccccagguagucaucccucaucuguguguguguguguguguguguguguguguguguguguguguaggggggugcugucugcuacacucagugaguuguagggccuuauauauauuccuaugguggucacagacagcccuaucugugcuuuuguguguuuagugucuaggugauucaaacaucuaggguguaagagacagaaagugcacccagaguucauaaguaacaacaacacuuuauucagugaaucauacagggcaggaaggaaugugccaucaaagagacagcuggccauggagugaggcucaaggcuccagcauguagccucauuuauggggucuagaggaagaaagugguuacuagggacguaguuugauucugucugucugucucugucucucaagauguugaauccuaggccuuccgggaccguguaugaguucgcugucagcagagcuuaucaaacacagggaggaggcugcagauaguaaacacccucugaugcucuucuggucagagucccugagugucaguaucccucuccugugugggcuguggcuucuacaggguccucacgaaaggguuuagagcaucucuagcauuccuagaguagccagauuuuuuuagcagggaacauguuaggcuagagccagagucagaaguuuuggcuuugagucauugccucuuguggcuguauaacaucuugaaaagccagagugaccaggaaagaucuugcggacccaggccccagauaaaccaaccagucacagguccacagccuguaagagggccggccggguuuagcuccguccauucccucagagcuagguuagaaauguguuggaguaacuuuuuuauuguuguucuuugguuuuguuguucguagaccuggucucgcacagcucagacuggucucacacucacuacugacccgggucugcgcuugugcuccuuccucaguggccccucuguguuuacuccugacuuuucaguaggugaagggccaaggccaguggagggaaggagggaggcuggagucacuggugcuaggguuggggagggagacaccagaaagccuuuacuaaggaauugugucucaaaaccuugucaugcagggaagaggacaaaggcuaucacagaaucaaaggucuaggaagugcaggggucacgggguagaauaaucuggggagagaaggcccuggaauacagaacuuucugaagacuggagagcccccuccguuucccaucuagugcugugucucagcagcuaaaggagguccguccaaguuacuagaguguuccugucagacuugagucauaaacaggccgagaaguuccuggaggcuguuuugcauucucuucauucuucagacuaaucugaaagccagaaaggggcagguggcuuuucagcagggcuggauccagcccaguuagaaccuagccauggccuuagccugggcuguuuguaccacacccauuuauaaggaaaccccuguccaggccuggucugccccuggucagcuccgccccaucauucagucuuaggcggaaaagguagaggaagcuacaguuuuguuuaccaaaggggcugguuggguaggucugcuuugcaagguuaaaggccauuggggaaaccaagguuucucugcgggcuccugaugguggguagguggagguggguggagguagguggagguggguggagguggguggagguagguggagguggguggaggcaggccugagccagccaccagcugggaacuuuugccugagaugacugacugucugguguggugcccgagguuuuuccaaggcaugguucuugagcaccgagggcugagcaguuuccggcucucacauucuuuuucuggggaguagggccaggagagauuagggcagacacaggaggccuguaaguuuuccauuuggggcaauuaauuugauggauugcaaaucagcucccgacuuccucgugcuccucccugggacugagcagcgggacugagagugccuuccuguccccuggcaccugugucaccugcugguggccucaacuugguucaaauuugagcacacaguaggugcuuucugaaagccuugaguaucugaugagagccuuucuagaaagcuguuagcugaggaacucccaguggccacaccauucauagguacaacugaaccucugccacgagcuaaucugcucaaggucacucaugucacuggugacagcugggacugcagccagguuuucuacacugcacuugccuagugugcucaaaggaaaggcgaugcacgaggcacacggcgaaggacuccuguggguuguccugaucaccccgugccuugggucggagguuccugucagcgucguccccuggugguuucgaagccuccuacaaggguguuaagggucacuuugcugugcucccgugccgugcuccccugggcacugcaauggugcucagaacugacuugcuuuguaggacaccuuuguaguugugcuucuccuucuccuggcuuaaucuuguguguuaagguuuuggccuucccacacaucuguaaguacgaaggguuuuacagaaagccguguguaaagcaaucucaguguaaggacauaccaggugucuagggguggcuagcuuauucagugcuccugcuguguggcagcuuugggcggguuuuuuaugauagacuaggcuucuacccuaggaacccauucuucuuagaaucaauuucucucccccccuacccccuacuagagucucauuauguaacuaacccuggcuggcuaggaacuugucuauauagaccauguuaguuucaaacucacagaaaucugccugucucuccucuccuuuuuuaaguacuaggauuaaagguguacaccacucauccaacuagaauuaauuuuggcuaacauauaaauaaguagguucgguuguugcuuuggugcggggggaggggggaaauuuuuuguguaucucagccuuaaccuucagcuucuuucuaccuccucaauguaggguuacaagugcauaccaacacagcaguuuauguggugcuaggacucaaacccaggguauaugacugggcaagccaccauaacacuuucauguaaauagguccuuauacuuugugucccugccccucccugaguuucaguuuccauuuguaaucagcugauugagcauuauugauuuccugaggcugccaggcauuguugcagaggccaggcuggacuguguacauaagccacaaacucucugcuccuugaacauacuuugcaguggacagaaagauguaccuuuggaggacugcaaaugugugaggucugggcuggggagucaggaggguggggugucgggggaggcaucugaguugagaucucaucaagguaugugacaucuaggcagaagguccccugaggcgagaacagcaaguucagaagccaggggucuggagugggccuggcuuguccggaggagcagaaggaggucaggcugggcugagagugcaggaggugugggggugagggauuuggccuucgcccaggguugggguuugggggagcuauccuaggcuuuuggacagaggaaugucauuugcuuuagaaggcugauuugcugguugugugugggauaaacagaccgccccaagcccauguagguaguguguuuaauacaguacccagcauggaaugcaccuccaucuuggacucggguucuucacaagaacucuaucaucaaaauuggccugggugacugcugcugucagcccguugucuucugccuccugugacgacagcauugggauguccuuucccugaggaggaaccagugggaccuaggcuugggagugacaagagaacugacaacucauucuuuggcuauucuuugcccaguuggcccuguaguuguggugguguucgaauggagucauggaaagggugcuugcuucuacagaccuggcagauccgacucugaccauguagcgcagaccacccaaguaaugccaaguuggcugcccauggagcuucuguaucuaaagcucuucuccccauucugguugcccaugauuuugagagaggcuagaacugggccucugcaccuucuucccccucuuugccuuucucucuacaaccucaggccuuuauggaaagaccucagguguccuuugacuccugguugucgcuuaucagguggagacaccuuuggcagcagaacugguauucaccuccgcugggucucuuuggauggcaggaagcauucucuauuuguuagugucccaguaucauuggcaggaaauuccacuuuggcucugagaucaucauugccuuuaguuauuuuuugaagguguguuucaccacauccaggcacuuuuuggguuuuaauuaauuaguuaacuaauuaauuuuauguaucuugucugcauguaugucuauauaccauguacaugcacaacuugcagaggucagaagagggcguggacugggauugccauuauaacuguuagcaguggggaauagguccuuuggaagagcagucagagcucuuaaccacugagcaaucccaccgcauccccugcuuuuagaucugaaacagccgcucaucaucuucuccuacccauuuauuuaaccccgccuccuuuagggaagaguuucccaagagccuuuguuuaguucuugcuguuacuuggaguaauccccuaggugggaggcaucuucucgggguacagaaggcuccaaagaggucuuagaaccaggaggcgauaacacaucuuucaaugaugcagaauccugcaguucaaggugguugcccaucacuggacaguugagcuuagacuugugccuaugugugguguagggacagaaagggugaggcugugaacuaacagguggcccagagcacacaggcucccucuucagcccugugugucugaggucagcaggcugccugggcugcagguuuuagagcucguuuguuugggcccagcuaccaugaguuucccccauaaagagcuccguuuggguuugcacaucccacccuccaccccaucuuuccugccuacucuggaugggguuacugauuaaguuuguccugggagccugugcacauagagcgguguguuggauguggacacucuauuucugggcccagugagguguaagcagagcuccgggcccuugcaucuggagcucccucuuccuggguucugugguccuggcuggcuggucuucugcuggucagucgcuuggacacacaagccugucucugcccugcagguuguuugauuuaggcagagagucugcaaugauaggaaccuggacuugagcccuugaccaaacauuccaaauucuuuggacauaaagauuuucugaaggggcuuggggcccuuccaaggcuucccaguuucuguuuauaccccaugcagauuuggguuuggaacggauuuucccguauucccuagagcccuuucccagucucccgagggaccugguuaggucguugggacucuuuuuuaacccagccucacccacuggcucauggagcauccuccuggcagccccugcccuuccccagugccaugauggugaaaggcugaggguggaguggggccuuuuguuuuguuuuuaaauaagggcaacguggguaaacagagcagcguuucuggugccgucagagagggccaggaccccacauuccggcuccaugacaacaggcugugggcagcggccguugagauggacaaugguggcucuguugaaaggcugaggcugggcucugaacgagugcauuuuaauugagcacuuuccacccugagaucuguggggaucugguggcccacgccucgcccagucauuuugucuuugcagcuucagaaccaaguuauugcagccccuuguucccuuuucagccugggcugguuuguuccacaaugguaggagaaagguuggaauaagggccaaaagggucuggugacauccuuauaaccugggugguuugaaagauaaacugacuagguuaggauccugguggugguguuucucagcuaaacccugugccucaguuuccucguuagcaacuuuuguggaaugcuaugucucacuugggcuagggacauagcucagcuauuaaagugcaugucacgaaggcacaagggcccaaguuugauccccuggaauuuaaaugaaaaaagcagggugcucugggguauaugcuuguagucccaacaccgagcuggcagagguaguuaaaucucucggguuugcuuuucuaccuagcagaacugaugaaccuuggguucagugagagaccuuguaucaaaaaaugagauagagccgggcgugguggugcacgccuuuaaucccagcacccgggaggcagaggcagacagguuucugaguucgaggccagucuggucuacaaagugaguuccaggacagccagggcuauacagagaaacccugucucaaaaaacccaaaaaaaaaaaaaaaaaaaaaaaaagguagagaauccgaagaagaugugugacauugaggcucagccuuuaugugcacacaaaugugugccugugccguuaucccccucgggauuauuaugagggugaaagaguuuaacggaaaggccugaggauggcuccauggcuaccuuucuuuuugccuuaugcaguuuuagcaucugucgagaucaccauggauguuucauuaaccuccagagcuccuaggaccagcacaacauuccuaccagaaugcaaaucuaauuucauucuuuccuuggcucaggugguuucaguggaucucauugaccccucugcagaaggagaacuccuuuuuguuaaaggcccacugcgugccgagcacaugaaacuuucgucugaugaaggccugcguauucaguucucucauuuagagacuuguugauuuuucuuccucauuguccuaggcggcucaaaccaacuaagaacacgcgugucucgaagaacagccuuucccacggucaagcucagcaugccuucugccagacauguccccuuaccaccaucuccaugggauucaucuguacaaaagcacacuugccacuagucugugaaauuaaaccuuugcauccugucugcacugugcucuguggcccuuagacgugcuuaaggguagugggccccaagucagucgagcuccugugcaugacgacccgugucuggcuucugggaaagccccacagacacaagcugcucuugacacccugggucuuccuaaagaccaagaacguuucuguuuggauucucucuugaagcuuaacuggaccaaguuucuuuagaggauccagugcuuaggauguucagggugugagggaggucuggcauagguccuugguccugcccuuucuguggugacuggugcugcuauguuucaucaccacguuuggcuccucccacuguuuauauccaccucugggggcaucccuuauagggacagacccagggcaggagauguggggauauggucugugugcacauaccugcuugcugcugaaggucuugccugucugugagcgggcugcuaaguauccaaaugaggggaaucacuuccauaccaaacagagccucugcucaggaaauagguucuuuguauuacugcuuucacggggccaaauucucaaagauuaucuugaaagugucucucauuggaaaugacagccacggugaggagccuuagaaagguaaaggggagugugggagaauggcccgggagccgugagaaugcgugguuccugccaccucggcucugaucccaagagagcugggcauccaucacccgugcuguuaacagcuaacugagaaaucuacuaccucugccucccaagugcuaggauuaaaggcaugugcuaccccugccuggcugggucucacuugugacguggaggacucgucuagcuguagcuaccucucaugggugaugucaggugggaaggagcagacauccuggaagucuugucuuuauuucgucagucaaccuuugcuacauacacuggauuccauggcuguguaucuaaaggugacuagaacauggucucuuguccuggagcccagggauggcagugggagaggguggagugagugggcagaagcucccaccgcacgcugguaaguguugaagcggaugcaugaagaaggguugugguacuuagcucugagaggucagugcagcaucccagaggaggugacccucaaguaaauaagaauggggguggggagcucuggcaagcagucucagcacuguggaaagcuaaugagggccugggguugugggccacgugggaaagaggcugcccugggaccaugugaugaguggaacaguaacuaaggcccugaagcacaugguggcgcacugaaaauguuauucugauggcugcaaggagggagaaccagacaauggcagggagaccugcuagacagcuguuaaugaggcugugugugugugugugucuuuuaaagauguauuuauuuuauuuuauguguauuaguguuuugccuauguguauguguguauguauaucaugcauauuccugguacccagagaggucagaagaggucucaguuauagacacuauacuagaacuguagugacaagcaguugugagucccuuaugugugugcuggaaauugaacccagaugcccuauaagagcagccugugcuuuuuaccaccaacauaucucucucucucuuucucucucucucuucuuuccuuccuuccuuccuuccuuccuuccuuccuuccuuccucccucccucccucccucccuccccuccccuccccuccccuccccuccccuucucucucucucucccuccccuucucccuguucccccucuccccccuuccuccucuucucccucuccuucucuuucccccgcccccgccccccucccucuccucuuucuuuuuguuuuuuugagacaguuucucuguguuguccugucugccguggaacucacucuguagaccaggcugaccuugaacucacaaagauccaucugcuucugaaugcugguaucaaagguguucaccaucacaccuggcuccaauucaucuuucuaaucucauagguuuuaguuuuguuuugagacagauuuugcuaaccaagacuuguccagaauuugcaguaucucuaccuuaguuucccaaaugcugggauuucagguauuugccaccacacuugaauaucuaaaugaaacaccacacuggccuggcgugaggucagggcauguguagaagagagggugguguagguguacauauguguguaaguaugugcacguguauguggaggcuagagaacagucucaggugucguuccucuuccaaacaaggugcagcucacuuaauuuuuaaauuuuuucuuaauuauuuguuuugagacagggucucuuacugccuuggaacuuacaaaauaggcuagacugguuggccaguaaacuucaggcaucugccugucuuugccucuuuaaugcuggguacacgccaccugccuauuuuaauuuuaaugugaguuuugugggucaaacucaggcccuaugcuuucuuuuucuuucuuucuuuuuuuugggggggggggguucaagacaggauuucucuguguagcccuggcuguccuggaacgcacucuguagaccaggcuggccucgaacucagaaauccgccugccucuuccucccaagugcugggauuaaaggcgugcgccaccacgucuggcugcccuaugcuuucaagacgaagacuuuaccaaguauuuccccagccugauguaacuuucugccucugauugugguagcaacugcuuuaugucugaccucugugaauaguguuggggccucuuucauuccgccuucccugguuuucuuuaagcaacagggauagguggccguuaguuaguuaaugcccgauuuaauugggagcugugaagggauggccugucccagcauucgaugauacugagcuuuagguugacuuugcuuccccucuugcaaacagucaaugugccuggcccauaaagaggccuuuaagcggcagcagcgauaacaaagacuucuucuaaagaccugcuugaguggggcaggagugaagucgggcuuuguuuucuucugccuuagggagccaacuggcagccaggggaugaggugugccugcuguccaaccgguuuuccauuuuuuggugugcaacgaucaagccugggggcuuugguggguggcagagggagaggaaggcuuuccuucgugcgugcuggaggcugggccccuugccuuaucuccauucaucuuugggagaugaagaaauaugcugcugcaaaugguggagccaagaucucuccucagaucugugugcuuucugacagcggccagccauccuagagcaggggcugcuccacccccgcagugagggcuugaucugggcacagagggcaucagauauuccuucauaucugcugugugcacugugugauagcaggucccgaggggacacagagacgaggccgggaugacaccuuguuugugugcucaaccaucuuguugaagucacuuguuuuuucuggagagcuagggcagggcguggggacacagagaauaggagguggaggccaucaguggagcagcuggugggaccuagguguguugggaaggcuucaucaaggugggggauaaacagugguauggagacgcgaaguguagaugaacgugggguucuuggaggugaagcuuggacacauggaggccuuguauacugacugaagaggucuaccaaguucucugggagacagggagcuguugggugcuuuuguagaguugacacaguagccagcagucuccaggugacaugucuggaagcugaacagaggaagugggcuaggaugguuacucuccugugauaguggggaugggaagacaagcuggcugagcugggcuggagaagcucaagucuugucuuggguaagcaaugguccugaccauaguaaaaggaacaaauggccaugugcauguuccgucauggguguaaugguccacugcuguguccuuguuuuaaaggauguugguggauguguauauaugcuuugguguaacuauccacucacuacccagauaaugaccaucgacugugacauuggagccaagugcaugccaggcacaaagcucuuccuugguguuugcuuugaaaacaguguccucuaagacacuggacaggaaaagcacgugagcugcucugagagagcaguuugcuaccuccaaguguaacggaagugcugcuuccuccuaagaugggaucuuagagagagaaggcucuggacuaaugagcuggacagaggcauggcgguuagacgacaucuacuccaacccacuuagcuuagaggcaugaagaaugggugcuggaugaacuggggcguuccucgcagcuguuccucauguuuucugaggucuccaugcuucuagccuguuccaugccuuguuggccuugcuguguggcugaaccagccuguccugacugcuugccaucuuggcuaggagaaaggugggagagagagggcucagugggcagaagugggguuugguugguagaguucuugcccagcacauacaaagcccuggaugauccauccuggcgcacagaagaugguggaagcauggccguucagggcuacacaaugaaugugaggucagucgggguuacauaagaccuugucccaaagcagggguggggugaggcugggguugugggauagaaaaggguagauggcuaacaagcaauauggaggaaccuggcaaagaccccauaguagggguucaaugcagucuuugucagccccucaaugguaguagcugucuuauagggcuuauguuaugagcccuauaaggcuuagguuaugagggguaagguauugcuacuuucagagguuuuccuuuggguccucugcucuggcuaagcauccaugguauggcugcaguuucagguccuuggugagugccuggguuuucaggaguggcagugaggcaggcaguaggaggugccugcuggacugaacugugaaugaaauggguccuaguguggagaccuaacagggcuugccagcuggaggaaggccauggcucuggcuggaagcugggaagauagagaaauuggaucuuuacucaaaacauuuuuuuuuuaaacaagaguguguuauaagguuauucauguuucuuguaaauuaggcaguguagauaagcaauaaggagagaaaaaaaaacccuuguaauucuguuaacucagaaucacuguggauucagauuuuguuuuguguguguguguguguguguguguguguuugggcuuuuggcuuuuuagguagcauucuacucuauagcccaggcuugccuacagcucacuauguagcuuaggcuggccucaaacuugugauacuuccaucuuaaccuaucaaaugccagcaugauagaugugagccaccaugccugguuugcuguugacauuuuguugugucuagauguguguauaagugggcgugugucaagaagaguaggacagcacaacguauugucauguauuccucacuuaaguauaagacacauuuugucauuuaauacugugccaucaguuuuaauagcagcacauuuguucacuguguaguuguaccauggcuuaccuggcuguguuggagaugaccugaggaaggagcuggaaagcacacuucauugcaguagcaauguguaucaugcaguaacauguauaucacacugugauacaugcuuaugcugagugaaacaaccccaaagcuuauauauugcuccuuuucuuuugagacaguguugcucuauguaguccuggcuugccuggagcccacuagguagaccagucuggcuuccagcucacagagauucuccugccucugccuccccagugcugagguuaaagguguuuuccaccauguccagcucagaaacuaggcucacuguguagcccuagcucgucuuggacucacuuuguagauuaggcuggucugaacuuguggugauccuccugccucuauuuucccagugcugggacuauaggugugcaugagucaucacacccagccacugagcuaguuuuuaacuucagucuaaaaugucaucuacaaacagguguaaauaaaugcuuacuuaagucagauguggaaccucaugccugcuaucccaacacaugggagacugccgcaggggaauugucaauaguucaaagcaaaucuaggugacauaaugaguuccaggcuagccugcucuauagagaaagacacugucccagaagccccuccccucccuccauguucaccagcuuuucucaccaucagaaggaugucaugguaaggagggaacuguaggcagcccugguggaaagcggucccugaaauaagcaggagugucccaggacaucagauagugaccgagaaggcuugggaugggcccuaaggagugggagaaauaggggacuuuacuaaggcugagcagggccuugcuuuuuaauacaguggaugggaagacugguguccuguaaugaggcaagguggacacugggccugauugugacugggaggcuccagcagaaagccugggcuucacuggggaagcaggugccugggcucaguuucugucccuaacaggcaugauuagaaccgucugguauuucugaugcauggaacgccuaggcuuugcucugugacugagugggggucucugauguuggguccuuggcuguaguuucuguugauaugaauguucagccaugguugagagcucugugcuuaguuccuacacauguccauuguccccuuuauuuuggggcuuggcguagccuauuccuucagaagggacaccaagggaagcugcugucuucaccuguaacugcugcuaucgggagugugagacagcagcggugcugggaaggagcacagcaaccugguggcuuccuugguggcuccuucauuggcuucuguguccugugucuugucauuuaaaacacuuaagccaguggcuuccuuguggcugagugcagccccauuugggaggagcaagggcggacgggccugucugagagagaguugguggguuggagggcgacuuggacauucccccaagccuccaugguucuguagaccaggggcugcuuucagaccuggguguaccccagccccaauagcaagccuauaaggcaggccagccggagcggaggaaaaggaaaucuaaguuggcuggagcccucaggguuucccucuccguaggaaacccuuugucacggcaagaugugugccacuggcuggauguuucucauucucaggguuuucugaagagccaguucgugagucccagcaccucagugcccacuccacagagugguuggaaaacaagacagagacgagauucacaaauaccccuucuuuaucuuuuucuuuugagauagacucucacuauauagcccuggugguacuggaacucacuuuguagacccggcuguuugaaggcaugcaccaccacaccccgcucugcauucuuaucuugaugcuucaaagacuuaccucugucuccaacucuuugcuagguucuagggaaacaucuucaaaagccuaaacuagucagccgaaccuugggugccccgcuguaacuggguguuaaugcagucagcuucagauaugacaaccacagaaguuuguuuaccaagcccauacuauaggcaacaccaggaacucccccacauucagaguuugcccacuaugcacuguuucccuucagaaauaaaaguggggggggggggaacaagcaacaacaauaaaaaagcaaaacaaaacaaaaacaacucuccauccauugcucacauccaucgugguaccuguguccaguaggcuacuguauaucuguuauauugacuugauggcauggguaaugguccccuguacguugggagaaaagagacacacauaagaugacugccuaacucuagacgcagacaaggugacaggguuagucuccggcucuguuagaggaaacccacauggcugggagucacguggaaugugaaucuugaccucauauucagacucauuugucuuuguuuauuaagaaguaacaguucugagggcaguggguagagagcuugucuuggaugcagcaagcccugaguucuagccccugcauugcuggccugauauaguucucagcugcauagugaggcugacuggggucuguguuugaaucggaaaggcugugugacagggaggccacuugaccccaugccgcuguguuugcacuccgcucuacaauuggcaaagaguaaauucuuaaauaauuaacagaaagaaacgcccugggggaacaccuauuucuaauucugcaggagugaucaccgacguauccuuccugucuuuuucucagggagaaaugugacuuucauaaacuuggacagugucacacauaggcuuuacuuauuuaccugcuuaucuuuuuccuuuugagugacuaucucacuuuguaacccagguuggggcugaccuugaacucaaggcaggacugccucagccucuccggugcugggguuguagcaugucaaguuguacguguaguuuuguuuuguguuuucucucuguguguuaaugcacugugugcaaugccugguacccauagaggccagauccccuggaacucacgguugugagcugucacgugggugcugggaacugaaccuggguccucgaaagagcagugagugcuccuaaucaauuguauuuucuccguauguccugaaucucucauaugcaaccugacuuccugggcuauggaguggggcauuuuucuaaauaaucuucaguccuugaacaugcaaauauguuuguaguuucaugggugccgguguugcugacaugcuugucuuugugaguaucuuugaauugcuuagacguugcuuucucuggaccgggauaucagcauucgauaaaacguucucuauugaguuuuucauccuuaaugugauggaauugggaggcggagguuauuauccucauggcaaggcuuggaagcugaaguguauaggaauggcauuuguguaagacaggguagaauugcuuuaaucccaaggaggaggagcagcagggcauuuagauucauguuuuuguugugcccuucagacuugcuugggauucuccauggccacagccccaacagaugucuuaugugccccucuaaauccccagcccucccgugcccucccauccgcauccuugcccgggguucaguacugaguccccuguucagguuuacacucccuuccccuuucaaacauggcuuauucacugccucugacaccacucuggccgcauuccacuucaccugaaaauucccuuaaaguauguguuaguuagcucuagcucagaaguaauaaccagguuuguuguuguuguuuaaacaggccagguucucuauucuuuguguagcccuagaucccaagauuuguagagcaggccuaagacggccagagguucaccugcuccugccugcaggugcugugaugagaggccagaaugacuugguuuuuguuuuuuauuuuuuuaauaaaacucauccuguagaccaggcuauccucgaacucagagauccaccugccucugccucccuagcgcugggauugaagguguccgccgccuuugccuggcuuucuaguaacugucauuucauuuuucuguuguauuauacaaguuuucugucuucuuuuuuguuguauuauaaagcugaggauggccuugaguuccugauccucccuccaccucccagugcaggggcuacagauccgugcuaccgaguguggcugugugucucuucuuuucauuuguuuuguguuuuuuugguguuuugagacagggucucuccauguaguccuggcuguccuuaaacucacuauguagaucagguugaccaaguucugguuuccaacucacagagauccuccugccucugccuccugauuguugagauuaaaaguaugugccaucacaccugacuguacaucacaucauuuuuuuucuuaaugauuauuuaaaauuucugugcauugguguuuuugccugcauguaugucuguuugcaggugucggaucccuuggaacuggaguuacagacaauuuuaagcuaccauaugggugcugagaagagaauugaaucuugguccucuggaagagcagccaguguucuuaacugcugagccaucucuccagccccuuuauaucacuuccuaaagaugauuugauuggcucuuggguuuacccugggguggagcaugguggcugauuaguauuaauaaauauauuuucuucuucguauugcugugagaugaggucuaauucuguugccuaggguggcuuuuaauuccugugcuuaagugauccuucggccuuagcuccuacagcacuacagauacaugcucugugccuggcaguauuguaaucuuaguaauucaacuucacaucgagcccgguccccauuacuaucuagucauaccuugcucaugugacauucuccacuugcugcgucugcugggaggccguuggcuuggacuuggacuucauguggcuguuuugaguccugagaaucagccuguugagauucuuuccucucuuuaugauuuuauucaaucuagcucauugugucgucccagaguggccuccagcuaucacugaguaugaccucaaacuccugauguccccccccccccccgccgccuucagcucccaaguguuggcaguacaggcagguggccaugacacaccuugauugaccccaaguccugugcuugugccagugaccucgaggggguggagaugggagaugcagaauagacuauuucagguggucagcugcaucaaaagagccagagucuccucucagcaccugccaccccacacccacaccaccacuaccaaaccccuacaguuuucuucccuuggcccaugagcucaguaugcuggguuucugauauaucauaggucaccaagaaggacauccuugggucuacugcucaggaaggauagcauugaagaugaggagucaauaccugucucaccaccgccaagccggccuuggggcauacaggaaagaggaaaaaagaagaggagaggaagggauggagaaggggaggaaagagagcagucaucuuucuucuuuucuuaaauuccuuccugccucucuuucccuuucccucucucuccuucgcuuuguucuucuuucgacagggucuugcuucaaaguuacuaucuuccugccucagcauuuagaguugauuacagauaugugccacugugucuggucacagucaacuuuucuauuggggccccaaaugagcaaguaggaaagauccacuagucguuaaaggcccccaggcauaggugguccgggaggccugaagagcgagcagcagcaaugcacugguggauguugucaggcuacgcacaugcuucugagacccaggaugaguugugugcaguguccagcaagggauuggaagucugagccuugaguucgcagguuggcccugcugugcaugcaggcauucaugguagaggggcaagggugugccgggugacuuugggcuuugugucucuuuuaaagacugggcacaguguccuucagcugcuuaaacaguuuucuuucuugguaagcaggaaacacaaagcagcccuucagagagggugggcaggaaccucuggcccugugucgaauuaauccgaugcaacccuggggcagccgcccagauggccuggcagaaucagaguuggacagcuguauccagaggucuccugggggacagagagcagugguaggugcccuuccuuggagacugugaguccacugauggccaggaggaaggcgggcugguccaguccuggcuugcugggcagaggcuggagcagccuuucaccuagagcccuuggguccgcuggagcaucuuggagugcuguggggcugucuggaucuaggccuccagcauuugcucuucuugugccugggaggagggggaggcaaaucucugucuagcaaguguuucaggaaugagguaccucccucaaggcaggcccgugauagucuaagccuccauuccuuuagcacccaggcaaugucaugaguagagccuaguagcucuuuucugccuacaccaagucauaguuguaguuugaguuuggcugagacuaaggagcauccgucugcucucuucccuccccuucuucaucccuuccucuccucuccuuuuugccucuuuccuguaugcccccaaggcccuuaagagagucggggugguuguuagacagguagguguugucuccuuuccagugccaccuuucccgagcaguuagacccaagaagauguagaguuugacgcuaagguuguuauguguggaggguaaggcagggagugggaugucugaguaucagaugacaguguucaaaccauccugguacaaguguuuauuugucuaggucagagcugagcuguggacuugucucuucagcgaccugacuuggagagugccuuuauguugaggaacagauguaaguggcgggaagcacacagaaaguacucccugggacuugggugcuguggacgcaguucuccaugguucucggggugcuguggcauaguacucccuggaaagacugaugcauaccaugcugcagcugugagggccaggggcccuguggcccuagcagagcugagucauuccuucucuucccaccuggccaagguucaggauaaccagcuccugccagaucuuggacaccccgcuuaggauccuggaaucacccggguuguuguuguuuguugucuuugcuggaggaaaaacagaagugugcuugggaaaaccugaugguagcuuggcuggacuguggggcuggcugaggcuugccccaguagacugcuguucagaggcucacuggagaaauuaggcuuuaaugagaaugcucuuuccuaaacuuuaacuggccaagccacuggagccugugcaguuaauaauguacucagaguguugcugagcugaaauuuaacagccgguuuaaaaacacaagguaggggauuuaacaaauagggcauagagaacacguguguccuggagugauuuccaccccugugacuuugugcugacugggaguauuggugccuccucucuggaaggucguuauccugucuccuugucucugaggaguaacagcguacagcccaugugcagauaagccggggggcugugucacaacucagugaagccgagauugaggcagcuccucccagagugagacaguccagggaaggaggcuuugguggagaagggagugagcauucaccaugucccugcugcggcagacacaggcagcaguacagucuugggaccagagcggaggaugccccgagcaggguguggcuggccgcgugaguaagcagggagagaaguuacugcucagauaucugagaugacaaaguccuucugaggaguuugcuuuagaaaacagaaaagauuuuuaaaaaacugaguggaaaauuuaggggaccugaaacaaaggcucccugcguucugagcuauguguguuggugcaggaggugcgccagugggaaagccuggaguucagucaggucggcuucagcuuagucccuaggucucacuucauacauggucacugacuccagaugucuuuacgccuugcucaaacuuccuggaacccugauugccuugcgguuuauagugugagguuccgaggcuggacucugucucacuuaugucuauaucccuugaaaugccugacauuaauagugacuuaguggugacuuagaacugugcagcaugagcgcacacacaugcauacacgcacuuaugcauguacacaaauauaugcacacgcacacacucauacacacaugcauauacccucccucaugcaucuccacauauguguacauacauacuacauauacauggaacacacauguauacaaguuucuacauauacauagucauacacauguauacacauacacacaugcauacacacgcaugcuucuuucuauacauacccaugcagacaugccuuugucccugcucugaguugguccucacuaucuuuagauacuuccagaguuuuucuucuuuauacaccuuuauucuuauauguuuauugaaagaugcagcauucgacaagcaggcaaugcacccauugcuguuguguggacuuucucauaacugcucugugaaguaaaugcugugcuaaugucauuguuuuucugaugaaaaaaaaagagguagacaaagaacuacauguguugugguuugugcuuggagucccagcacccuggagcugaggcaagaagauugcuguaaaguuaaggccagccugggcuacauaguggaguucaaggcuacaacaguuuguagauaugcugggguacaagagaaaggcuauuuccugggaucgaguauagcuuagggguuaucaggguauggagaaauugguucucauggaauugcuguaggagugaucagacaucuaaacugaaccaucaugugacccagcaauucuaccucuagguauagacucaaagaauugagagcugggccccaguaguuguacacugugcucuugugacaguugugguagccaagggauggaaagggucccaguguacaccaacggaugacauggauagacaaaaugugaccucuacauacaacugaauaguaucugucccuccaaaggaggaaauaugaacuucaaagacauuaugcuaaguggaauaagccagucaccaaacaacaaacaccagaugacuccaguauacaagucaccuaaacuguguagagguuuccagggcugggugaggcagaaauggagaguugaugcuaacuaaugguaucagugucucucuugucuaauggaaacuuuuagaaauagcccugggcugggacuggagagauggcucugugguugagaauguuugcuacucucagacgggcccacguuugcuucccugcacacacauggugcacuaaacucacaugggcacacacacagacauaugaauaaauaaauauuuuuaaaaagaaagaaagagugcuggguuggggagauggcucagugggucaaaugcuggcuuguacucacaauggcuugggcucaguccaggacuucauaaacuggguaugguauuguaggccuauacuugggaggaucagaugauggucagauguuagcuacauagcaaguucagggccaggcuagucuacguaagagccugucuaagaaacccaacaaaaaccccaacaaaaaccaaaaccaccaccaacaaaacaaccacagcaguguuuagagcgccguguaacugaugaagcugagcacagaggggucugagcuggagcggaaggcccugucauucauucuuuuguucaagugugguacagcugccaaucagaugccacaaugucccuguucuguggacauuuucuaccagacaccagggcugcuagaaucggacaccuguggccacacccuggacauucugguugacuguaccaauagcucuccugccuccccagggggaaacggucaggauuuaggccacuaagugcaaccauuuguccccuuuuuuguccucuuuccucugucagcugaugacagcuguaacucagugcccuguggucagugacauuucugcgauguuccaguguuggcgucguguucagaagcaggggcugcugucucugguauccugaaguagggcauaugggugguuucagaguuaagcuugcuguuuagcauauauggcgaguuagaaaaaccccaacuuuuaccuccaccauuaaaaaugaaagaaaaaguccuaaguuaagcaaggucugagguaucuacagguuccucaccaaccuggaacacaaaccucuaaaaauaaaaggugcugagcucuaggauacaaacuguggugcuuggucaggugcuuggcccucagcucugugcccaccaccccuguuacagucugagcugcacaagaggaagcugauggcccagcgccuccugggagaaggaaaaaggccuuggcuccugggugcaggaggggauggggaugcugacucuggugacuucgcaggccaccgugguuccccugcuccuccuccccuucgcagacuguacguucacucugguuguccuggaggagcaagcacugccguuugcugguggcuggcccacaguuugggucuugugguuugguuuuuauugcuccuggguccccggcagguuagaaugcuagaaacauccucacaaacacaaccguuaggccugagcaaggcggcccauacucaguggcugaagcugauuuucgcaaggagagaggcuugccggguguuuugggagaugaaugcuguguggaggugauaaccauagcugaaagaucucaggcgcuuccugcucucccuguccgucuccaagggccuuucggcaaacagccucaaaacagcccuuuugcuggacccugugguagcguccauccacguaagcguaagaaagcagaggcucacuccuguccagagucacacccugcaaaagggugcaggcccaguauuguuuccaggccugugccucuuagguggagaaagacuguguguguguguguguguguguguguguguguguguguguguguguguggauguggguguuucagugccaacgcucuuguuugggaaaggagacaaguugauguauuugccccuuuacucccugugcaguggggauggggccaggcuggugguacaugcuuucagccuggugacuuuggccaaccaaggacauacucaugagcaccuacccacagcagucccucugugcugguccccuccugugacaccacggcagugagguggacgguacuguucccaacacuugggaggugagggagggcuggggaggggauggggggcggacugagacuuugagaggugacuuaaacugccggaguuaaguagcuaguuaauggcagaaucuuauuuggaugucagagcugacugaggucuugccacccuggcccaggagggugcagcagggaguccuuggucuuuuuaacuccuggcugugcuuccucuccuugugugcagaugccacagagggucugaggaccaaggcugaaauggcucugacaccuagaguaaaugcugcaccagggagaauaacagcugcagaugucccuuucggguguggccaaaggugggugcggggcuggggggggguguuccuuuucugggccacuucucuguucuccguucuccgguugccugcagccguaacuguaaacucucuggagcucuggcugccuggggcaagcugaggcucacucacugccuuugcccugcaaggcgccaggagacucugaugagccccucucagugcccggaccaccuugagaagcugcggugccuuucacaaccuuuccagccaagcuucggggauccuguccuuuuaucuggaacuucgguaguccuagugagugguggagaaaugauuugggaauuggggugguuuggggaccuccgugaggaagguuuucugaaugacuccauuuucuuauaaccugagugcuuuguguuuggggaagggggaagcuguacccagaaaaugagaagggacagcucugacaaugaagacccagggccccgaggguucagggacaguggccugucuggaggguuggaggggcagcuacuggcugggucuguccucuggaggucuggucagggccacaagggcuggaguagugaaaggaaguugaaguuuaaaaacaaguuuggguucagggaacuggcaaguuacuuacugccuguccaggcccugcaggccucaguguccccagcugggugcuggggauuaaguugccuccaggcuuggggaagccucugcucuggguguagcugcuacacagccuauugauguugacauuauuuaagugccucuccuguggcugagcagcccccugcggguggagaauccccucaggcuguguguucucuuuccuuugcacccugcucuccugaauuuguggguagcagcugccucugcugaugauagauacgaccucacaccaguuagcuuucaugugacugagcggcuuucccagaaucccccuggauauucuucccucaccuucugaccguguguaacacccauuucuuuuccuuuggcgugcaugccucccgcacucuagccccucacucaccuugagggccuagcuggccuucaccuucacgcccauggugccaggcacucagagcucaggaaguaaggacuacggcacuuguaucuagcgccuugguuuccuuguguuuccugggugccuaugcuucuugcauugguaccugaugcguggaaacaguagcagguuucuuuagggcugguggaacucgaggcugugagcuggcuacaggugagcaagggcuguguguucuggucagaagggaacaaguuucagaucucgaguggaggggccaaaauguguuucaguguggaggaagccaagaggacaggagggcaggagaguggauauggacucuacucugaggaacagugauggggccuggucaguauuaguacucugagcucccagaguccuggggagugcagaucggagcuccaagaacccaccagaaucagccugcuccuucccuguguuuggccagagugucaggcuccaccccacugcaccuggccauccccaccuuccaaaaaaggagagagcuugagccaggaacugcaggcugauaaaggaguuuuucauucugggggcguuaauugacacagauuagauuucaguugagugggccuuuuguugcaggagccuuucuaaucaagauggucucaguacuucuguaguuucucagagucaauucagguucauuaccuuggucuguuacuggccugggcauucagaccugaugugauuacuuuuggccuugauggguuguuucaguuuuucaaauuugguuuacuccugggcugacaucucccucagaacucacccagggaggaugcuaggcccagaagaaggcaauucaggcaugcaggcacauugcuuggcugugagauuucauuaaacauuuacaaacauguuuucugcaaauuccugagauaaucuggcacaaacacgaugggauucggauucucuuccacuagucauguuuauuuauaauuccaucagcucccacuguguggagagagaguggaaaguaaucagaaguggcauugcggaagucagcucacugcugccuguaguccuagcuccuggggaucugacaccuucuucuggccuuuguggguacuacacuaaccugagccccccauccuccccaacagccacaugauuaacauauuuucaaagucaucaggcgugauggugccuuuaaucccaguauagacagguggaucuuugugaguucaagaccagccuggucuacuuaucaaguuccaggacauggagagacauugugguccccacccccaucccuacccccugccaauuuuuugaaauucauguaauauagucuuuuuuuuuaauuaaaaaguuaaaagccaucuauuuuauguuuauguguguuuugcuuggguaugugucauuguaccacuuaaaugccugguacccugggaugccagagaggguauugaaauccuguaacuggaguuacaagacggguaugagccaccaugugggugcugggaauaaaagcuggcuccucuucaagaauagauagugcauuuauaacggcuuugguuuucagcucuguuuuaauugugugugugugcauggaugcuuguaagguauauugugcuuaacauguugugcugaaauauauucuuguaucucaguuuauauacccccuaugcaguuugguuugaaaaugaugguugcaggcucuugugcauuugcgugcaaucucucucucucucucucugucucucucucugucucucccuccaucucucugucucucauucuuggugcacccccccccuucucucccugcucuacgcugcuccccccacugcagcucuaaccuuuggcuccuuacuguaauauggaaacucuuaucucuuuugucaaagcuuucccuuaccuuagcaaguaugacuaauacugccuggaagcaggaaggugauaaugccugcuuugcacaaaggaagcccuauagcucacuucuggucuuuugggagcaucuggacugucuauugaaucuuuguguuaagugcagcauaacuuuugccuagacagaugacccucucuauauguucuggagacugggugauuggagcagcuuccugucucuugccuucuugaagucaaggcuguaugugauguccuguagauaggggaugagggccacagccaagaggagaucucccacaaaagccaagaaggaaaagccuuucucuuucccacgucacagagcuggcuuauguguaauuaaaagagagccaucucugaaccucacugugacauuguccuguggggcagcagagggagccacugagguggcugauguuuguuguguaacuugaucaaggcauucauuuccucugggcauccauauuaucagugggcgcuaacuugccuggggggauuacagcccucugcagaacugcauguuggaccaucauugauauuuuuucccucuaagccuagcacagugccugguguagggugagcauucaggguguguguauguuuaauacauuucuaugacaaacagcaaccguauuuuugcgaaggaaaccauuucuaagaauccgcucagugcccuuugaauggcugugcgguucucuggacuuuccguguauccaggugcugggucugugugaggucuguugcuguugcugugguaaaccaccauaaccuuauuuggacguaaggaguuuagauggauaagauggaaaccauggcagcaagcugcaggcauggccauacgagcagaaagcugagagcucacaucuugaagcacagguagaaaacagagcaaacuguaagccugcuguagccuauaacucaugggucccuaugcauuuagaguucccuuuuuguagaaauccuuuuagauuuucuaguguccuguccugcaugcagcaguugugagauauauuugaguaauuaaaaaaaaaucuauccaugaagucagggagguagacgugguagaggagguuuuaaugcaucguuguuugcucugcuuuauaugcuacguucucuuauuccuuuccaaagaguguucugggucauuucugguccugugacuuuucaaauacucucagaauuucaugaauucuuuuuucuuucuuuugagacagggcugcuauaaccuaggcuagccucaaaugcucagagcagccagagaugaccuugaacuucuggcccuucuaccuccugagagcugggaucaccgugccuguucaugguuuauguggcgcuggggcuggaacgcggggcuuccuucacugugcuagauagacacucuccaguugagcucugcccccaccuucauguuauuaauucuuuauucuuagccgggcggugguggcgcacgccuuuaaucccagcacuugggaggcagaggcaggcagauuucugaguucgaggccagccuggacuacagagugaguuccaggacagccagggcuacacagagaaacaaaaccgaaaaacuuuauucuuccagcagugucagguaagaagacaguuauaguuguguuuuuauguaauaacuucuuguuauuguuuaauaaacuauguaagaccaggcauucugcaagugcgacuuagccugugguguacucucuguguuuaugcuuuuuagcuggcaccgcccagaaccuagccugacucugacccugugcagaucccucugcguaugaggggucaguuucuaaaccuugucaaagauucccucauugagucaguuuuguaaacuauuuuacuaucugacuauagcccuuaccucggcgugcuggagcuggaagggaagaacacagacucuagugggcuuugcauuuuccuacagaguacgcaguuuuguauacuugaacaggaaaacagaaacacaagcugcaacaauauguuucuuuacaggcagccagguaaguuuaauccuguuagcaaagaguuuguguugagcgguaaaugcaguacuaauuagccacauguuagcccuuaaucagcccagcuugcucaguguaagcuuugucagugugaguucuguuaaugcaaaauacaugaaaugucacguggcagcuucaugucagggguguguguguguguguguaugaucucagggcuaaguuugauugcuuuucagccuuuaaauuauuauuauuauuauuauuauuauuauuugugcguaauaugcauaugugggcaccgcacacguggaggucagaggacagcuuguggaguuacuucucucacuuguaugcaggaucugggaagcuaacucaggcugucaggcuuuccuugagggcgugucugguggaggcuguuccuguucacucaacagaggugaccugggcaccucaccucucucucccgugcuggcagggagguugaccugaucagugagcaugccugcggucuuuccucccucuagcugagugaccuuggguguaugaucuugcuucuagaagauggcuccucaaagccaucgucaccuccgugaggugggaaggguuaaagaagccauacagaauucccagcacugcaccugacaaauugcaaggacucaggggaugugauuuaaaauagugagcgggguacuagcgcagagacagaaugcucuccagcucuuccggagcuggcaguugugugugggaggcagacauggaaggggugauuucuccgugugugccaagaaggauucaccgaguguugugagagugaagaggcaggggguaagcagcugggaaggagugaacguggggcggguggggaagagaguuuuaccauuauuuuuagguuuguuuccgaguaugagcguuuuugccugcauguguguaugugcacuguuguaugggcacaccugccuucccaggguccagggaggucagaagaggcacggauccccuggagcuggaacuauggguaguugugaaccgugggagcugggaaccagaucuucuggaagagcagaaaauguucuuaaucauggaggcauuucuccaucccuggggaagagguauuugauuugggguuuaaggaccaugggguucagcaaggauggcagaggagagggugaagagauuuggagaaggacauugucagaggucccuuggccuggggaugggaggccgaggaguccaaagguaagguuaggcauguggaucuaagggcagaugugugggcgagcacaggcgugugccuacggugcuugagaggcugugguggcaaggccagucgcuccugagcagcugauugaagggcucuauggagcaugcugagggauuggacuauucuacaccagcagguauuucccuuguucgcccggcuuccuuucuuuguguauguguucgugggggugugcaugccggugcacgcauguauauggagccagaauuugacaugggugucuucuucucuacuuugcauucaaucuuguucuuuuuuuuuaauuuauuuuuaucuuguaugcauuuauauuuugccuacauguguaucugugugagggucucagaucccauggagcuggaguuacagacaggugugagcugccauguaggugcugggaauugaacccgaguccuccggaagagcagcaaguacuguuaaucacugagccaacucuccagcccuguccccuuuaaagauuuguuuauuuuauuauuuuauguguaugggugguuugccugcauguguaucuaugcaacacguggaaaccugaugccuucagaggacagaagagggugcuguauccucuggauguggaguuacaggugguuguuagucuccauggggaugcugggagucgacucuggguccucugcaagagcagcaagugcucugaacugcagagccagcucuccaggcccuucucucuugcuuuuucgaagcagugucuuacugaaccuuacugagcagugucauggauuguagaugcaugcuggccacuuccuggaugagugccaguggacacacccagguccucauucuuacaacugcgcuaucuucucaguucccaaggugccaucuucgaguauccauccauccauccauccauccauccauccauccauccauccaucucuuguauguaugugugagcaccacacaacuaucuggggagauggaauguguauguggagggauacauauguaccauguacuguguggaagucagaggauagcuuucaggauucaguucucuccuuccauuguguguagguucuagggaucaaacucagguuguuaagcuuggugacaagugccuuuacuggcagagcuauuuuaguagcccucauuuuuuugauguuuguuuguuuuuuguuuauuuguuuguuuuuuaaucaaccacuuguugaaaacacaguggcuuugucaguuuaccagagaugcuucaaaaugcucuguuccccaggcccugacauuguucuuccgugcucccagggauacugggauagcuaccucuuggcuaagauaaccuaguccucuuacuucccacacagaguucagggaugugcaguucucucagcugggguagggcuuuaacccuuaggaagcagaaugguagccgaggaagugcaugugccuccucugucuccuggguucaguguguauucugcagccugcauguaacagaaggcucauuaagaccacggcaaguuggaaccugucagcagugaguucucuaaugcuguucucuacagaaaccucacuucuaagccuggagacuucacacuccgacuuagcauuuccagauagcagugagagaagcuuugggcagguuuauggcaucccuaagcauccagauucugggagccucugcugaggucccagaguaaaguccuucaacacaucagaacaggugacacaaacaauucauaccccauaguccccagacccuaaauguagcccaaguccagggcagaaguucuuuuacccuacacuugaagcccuguauuauccuucucuaugcuacaagcucaggaaagagaagaacugggauugggggucuuuggcaggagacacauccaauuccuaugaacugggucugcacgacugcauugucuggaagaaggaacuggaaggaagugcagaggcucagcuuugggcugguacaacaugcauggcuguugucagugcagauucccagacugguguggcccaucuuuuaaccucuagcaggacagggccagggaagccagcugcccucauggggaagagcuguggccaccacugcaggauccugcugcccucuugagaagggagugacuuuuccacuaagaggacaaacagcaaucgaagguuuguaccaugguucuugucugucucugcugugaucaagcuguggucccaagaggccaguugugcucccccaaaacaaagccagcaucgccagguuccugaacgcaugggcaaagcaguagcaucccacaaggccagauugacaaggaaccggcuuuggcaggacuccugauccugcucagguaccuuuggagccauaguccaaccuucugcagaguccauucaaacugcccuucaguacagcuggggcagcucuugggggccgagucucuuccacccaaauuuguugucucaacugccccccccccccaucuccuugcugucauucaugaucagugaguuccagacacccauagaugaggguuuuuagccuauucccuucucagaaauggaucuucaauuuguaaaucugguaaugucugucugucuagccucuuucccugagcaggcauccauuguauugucccucgguaacugaagcaauaucagaaucaccugggaaauuccuuaaaauuuccacgcaccugccaucugucucgucucucucuccuucccucuccuacuagaggccaaggucuuggguguggggggacaugugaugaaaggaguugccauuucuuaagagacuguuggggaagauggacaguagucaguuaugugugcugugacaccggaaaggaggugucuauguaaaggcaggaggaucugcuauggaugccagaaagaacccuagcgauucucaguauuaggaggaguaaugaugauuuuauacuauagagacuuauucauguuuagcuugguggcucgaucagaaaacauuaacuauuuugagccccagaguucucauuuuuggggugggggcaggaucucacucuguagcccaggcugaccuugaacuuguagagauuggccugccucugccuccucuagcguguacagcuagagcccuuugaaaacgccagccucuagcaugacagaggaaauguagucucuaagaauguuugugggagcgaaucagugcucaguuaauacuggcugcugguuguggcaguuaguaucugaggagaucuucccuccaggauccuuggaggcggugacugcacaguaaaaugucuccucauguuugcacagcaugcgcucagaguuuuacaguccuaucugucguaucaugccugaauaugagcagaguguuauuucacuuuagucccaggugggaggacuccugggagauaaggcacauugcuuuuuaaguguuuuuuuuauuaucuuuuauuggcacauauucuuuguacauggugauaaguuucauacagugcaccagguacucggcccaucccacaccccacagugcuguccccuucuucuagagcagugguccucaaccuucccgauacugugaccuucuaauacauuuccucauguuauggugacccccagccguaaaauuauuuuuguugcuacuacauaauuauaauuuugcuacuauuaugaacuguaguguaaauacuuuuggagauaggaguuuggcaaagggguugugauuuacagguugagaacagcuguguauauauauauauauauauauauauauaauuauuuuugucuauauaaaucuagaguccacaaauuagagggaauaugauaucugucccucugaaucugacuuauuucaccuuuuuuuguuguuacuaguuuuugagacacagucucaaaacuauauauaucuauaugccuuccugguuagucuaaaacucaugauuuuccugcaugaaccuaccaggugaugggaagucccucccccccccccaaaaaaaaaaaaaaaagaagagagaaaagguauuuugggcuaaagaaguugcuuuaccuguuaagagcacuggccguucuuccagaggaccuguguucaauucucagcacucacuugguggcucccaacuguguaacuccagcuccaggugcuccaacaccuucuucuggccuccgaaagcacggggcacaaauguggugcacagacgcauguagacaaaacacccacacaccuacaacaaaagaaagagauauuuuuaucauuugcaagaucguuuagugcagucucuuuccaaacagagacuguauuggaaucagcagggaaaugucuuuaaaaaaccagcuuucugccgggcggugguggcgcacgccuuuaaucccagcacuugggaggcagaggaaggcggaucucugaguucgaggccagccuggucuacaaagugaguuccaggacagccagggcuauacagagaaacccugucucgaaggaaaacaaacaaacaaacaaaccccagcuuucuuauauucuggaguguguacuuguucagagacagggucuccuguccucguuagccuagaacuugcagugcagggaaggaugaccuugaaccuucagauccccccccccccucucguguucugaggagacaggccugugccaccuucugcagcuuaucagugcauaguuuaaauguccucagguuugcuuuuguggcuguuugggauaccuggacucuaaggcuacuggguuucuccccugcuggugcucuugggugaucuccuggucacugguccuugcuguuuaugacacuggucaugagugugggcgucugaugagaacaagggugcaagcagcuuccccaugcagccucugaaaacggacacagucagaaccaccacaccguagcuuuuaucuuuuaagccugcaguugauuugacaggauuuauguuguaaaauagggagcgaaagucagagcuuuggcucagcagcaaauucuugauguucaaaauccucugauuugggaguuuggggauguggcucaguugcuuagcaugcgugagaacaacccuacaucuauaauccuaguacucaaaagagauggaaggaggagaaucagaaguucagggcaucuugggcuacaagagacucugccuuuacaaaaaguagugacacaagcuuuuaaccccagcacucaggaaacaaaggcaggcggaucccugugaguuccaggacagcuaggacuacauaggagaaacccugucucaaaaaaaccaaaccaaccaaccaaccaaauaaauaagugaaggaaggaaggaaggaaggaaggaaggaaggaaggaaggaaggaaggaaggagagagggagggcucuggagaaaugggucaaugauuagaguacuuacugcuccguagaggacgaggguugguucccagcacccucauuggguggcucacagggagagcagaccuuuccccaaguguuacugcugaaaccuuauuugcaugugggagggcuuggugcucuuccuugaugaccaauggccacauaccucucggcaggagagcugugggaggcuguagcugcuauuggagcuaggagcccaggagggguggccaaacuccuacagucccaugaagguggaaguuaugacccaccaggucuccaggguuccaggcgugugcuugacugggaccaggcuaucuuugcacaguucaccaccccacaacuagccucagaguggccaugaucacuaggguucaacuggucuggauuaagauguguuaugaaugugaacuagcacccuagacuccggagacuccacaucuaaaacaaacaaccagguaaauaaguaacuaacuaaauaaaguaucucaguuguguccugaucauguugaaaaugauagugcuuuuaauauguuggcucaaguaaaauacacuaaauuaauuacauuuuuguaaugaaaauguggcuccuuacagaucuaugacauucuguuuugucacauagccagguugguuucuuaaaucaguuagaggaaccagauuaaaaagucaacaguagggcuggagagagauggcucagcucagcucuuaagagcacuugcuauucuuaaugaauauccaucuuggaguucuagcacccagaaugggaggcugucaacugucuguaauuccaguuccaggggauccaacaucuccgucuuuuguggguacaugccuucacaugcccauacauauucagacucacacacacacacacacaaagcuaaaaaguaaaucuuuuuuguuuugagacagucucucuguguagcucuaucuguccuggaacuuacuauguagaccagacaaaccuugaauucauagaaauccuccugccucugucccuggaaugcugggauuaaaggugugcaccuccacaauuggcagcuguaauguuugccauuccccuggugcugcugagugauguucggguccccaggcucuugaucucgaggacugcguuggagaggcagguucugaauuugaggcaggcauccagagcacuauucugagucauuuaacuugaccuugaacauccacagggccauuaucacuggcauuuucuuugaagugggaauuuuaugaagucugauuuaaggguauuuaguaguuucuccuauuuuaaaggacuuuaagucucuucaaugucucugggagggacaggaagaaaauugccuaaguggagaaauugcuuugcuuggauggaagcuuuaucgcagcacuguagagccuuuuuagaauucacuuugauuuuauguuugugggcguuuugucugcauauuuaugguugugcaccaugcacuguuccucucggaaacuagaagagggugugagauaccuggggacuguaguuccagccaguugugagccacccuauggacgcuucuagucauuguucuuaucugaggagaccucucuccacgccccagagucauuuuaaaaacuguggcuugggguaaaacugcugugaauuucugaugacacccucugucccugugccccaguguccugugucccauccagucgucugccccugcccuuuccccuuuggcugucucucugguauucugcugcucucucauucccugucuugggauuacaaugggaaugccaacugcccccugcucccuuccaacaggacaagaagagcccauucaguacuuaagggcuggcugugcagugggugccaccauccugucuugucaggugcccagccuucaagcauucuucaaaguggccaccuguuaugugcuugaggcagguugggaagaauaagagaaauaaaagggauggugggccgggcgguguuggugcaugccuuuaaucccagcacuugggaggcagagacaggcagauuucugaguuugaggccagccuggugaguuccaggacagccaggacuauacagagaaacccugucucgaagaaagaaaaaaaaaaaaaaaaaagggaugauggcaucaaggugggaacauggcagcauccaggcaggcauagugcagaaggagcuuagaguuagaggucuacaucuucaucugaaggcugcuagcagaauacuggcuuccagacagcuaggaugaggaucuuaaagcccacacccauagugacacaguuacuccaacagggccauaccuucuaauagugccacucccugggucaagcauauacaugccaucacacaugaguccugcagccucuggucuuccuccugagaucugccuaagaaacggaucgggucugagugaucagugagguagagucuaaacccuggaguuugaauuugaacucagucauguaacuuugggaaagccacuuaagcacugggccucaauuuucucaucuuuagaauaagaaagguuaauugaaauacauaauuuuguuguuccuuguuuuuuuuuuuuuuguuuuuguuuuuguuuuuuuuuuuuuuugugacagggucucuacauagccuaggcuguccugcaauucaccauguagacuagguuggcuuugaacucauggagaucuaccugcaucugccucucaagugcugguucuaaaggcauacuccaucauaccuggccuguuuuuguuuuuaagacagaaucucauguaguccaggcuggccucuaccugucucuauagccaaaaaugaccuugaacuucuuagccaucugccucuacauccuaagagcugagauuauaggcauggaccaccaugccugguuugugugguaucagggcuuugagcauggcaggcaagcacuccaccagcugagccacauccaugugagauccuaggauguagaacaccucuguaaacacuggcuuccuucagggagcacaguuuaucgaguguccucugugcaagcugcugucacucagcacagcggugaacaaagcugcagagcccuuagcagugguucucagccuguugcucaagaccccuugggggcuccaaugacucuuucacagggggucucauaucagauauccugcauaucagauauuuauauuaugauucauagcaguagcaaaauuacaguuaaugaaguagcaacaaaaauaguuuuaugguugggggucaccccaacacuaggaacuguauuaaagggucguagcauuggaaagguugagaaacauugccuuagagagggagagaggcccauccauccucagaggaauuguagacucugcuuuuggcuuuucagcacugugggcugcuuuuuauauauuaggcuuugauagaguuguuguuguuguuguuguuguuguuguaagauuguacugcuaaauagaccaaaaauagaaguguuauuuuguguguuugugugcauguguuugugugcauguauaucuuccucaguugcucucuguguuaucuccccgccccaccccaggacaggauuucucuguccugucuuggaacuuacucuguaguccaggcucaccuguggcuucugagugcagggauuaaaggaguggaccaccacaguaacucggaagaaguuauccuuccccuuuucucuuuuuagagauuuauguaugugaguauacuguagcuauacagaugguugugagccuucaugugguuguugggaauugaauauuuaggaucucugcucgcuucggucaacccugaucgcccagucccugcuugcuuuggcccaaagauuuauuuauuauuauuauuuauuuauuaccuaaguacacuguagcugacuucagacgcaccagaagagggcaucagaucccauuacagguaguugugagccaccaugugguugcuaggauuugaacucaggaccuucggaagagcagucagugcucuuacccgcugagccaacucgccagucccgaaauuauucuucugaguuaggaucucucagugaucucggcauggcuuguggauuggcuaggcagcuuggcaggcaaacucuuggcccuucugucucugucucccugcaccaggauuaaauccuaaauccuagugcucuuaaauccuagccgcuugcaucacuucccgguccagagacucugagucaguggcuccaagcuggaagggucacaggcugcuggaaggaggaccuuagcgacuccgucucucuguggaaacagucaccuucuucagaggaagacaguagagacccacaucaggauacgugggcuuucccgaggaugcaagacucucaucagugagagcauccgagcuggaccucagugugggggccuacagaggaugagccuguucuguaggcugcaucccacucucacgguggaugcacguuggcauuuaacccggcugugcaaaggccuccuguggggugcccaucucugaugagaccacauguguucaggaugcacagguguagacagggugcccguucugaagggcaccugcaaucucauauuugucacuuuggccuugcuccuaaggcaagaccccccccccccgucuuuuuuuguuuuguuucuuguuuuguuuaguugguaucauuaugccauguucauacgggugucucaugaacgguggacuuugcccacaucccugccacacuuaugggcuccuucuuccauuuuguuuuugaguuuccugaugcagccugggcugaccuugaacucuggauccuccgguuucagcuuccugaguguuagaguuacaggcgcucaccacucuguccagccuuaguggaacugggcaguagagauggcuacuucuuugugcgaugcuuucuuuacccagaagauaacuggcugcuggcgccucugaggcgugaacuccccuucuugaagggagcgcagguucaugaaggagccagcaagggucuagagcuuugcaagccgcagagggcuuuuaauucuucuucagucaagcugagcaccuuggacucaacucuaagaagugaagaauacuggauuccuuuauucauucuccucuccccuccucccucccucccucccucccucccucccucccucccucccucccuuuggcuucuucggugcuagggaucaaacuuagggccuguguguccuagguaagcacgcuacuacuaaacuagaucccugaccccagcuaucuaaaagaugguaaugauuuuauuuuuaaacauguaauuaugucaggcagauuauuugcuuuugagaguggcugcagauaccaugccucugauagccagcagagggcgggagagaggagauucuucuguccaaagcaguggcgcccccccccccccacgcccccguggcccccaucacaccuccaugugccuccugugugccagacacucugcugaagccaaagacacagacuacucguccccacagaggaaagcaacggagguugaugaaggagacagacccacccagaugauuuuccuggugguccuguccucaguucucccugcccagccuguguuuggcuaugcgcacuggagccugucuguaaucucucccuuuccaauucacuuccucggccuuaucugggcgacagcagcucugggugcuaguguaguguagcuggucuuuacugcuccccacagucauguuaccaccguccucuuagggaugaagaccucccuuuuuagacucccuuugcuuugugugacccgaucccaugugacuguaagaccucagugacugauucuuguccugucuucucagagaggcaagggcuauucaagggcgcacacuaccacuugccagaggacuuuauccggcuuccagcgcacuuuaccacccccccccccccccgugcccuuccuggcguguucauagcaaugacaacuucagggggaggcggugcauuugcagauggcccuguccugggguggggcgugcugugccacagguggggagacugagccugagccccugcucauccccuggcuaucaggggcucagcagggcuuuucuaguaaauucauggcugcuucugacagcugcugaguuccagccucucuccagugucgggagaagaaagcccacacccggggcuggcagaguccucagaacauguucucccuggucucugcacucggaggauguguuuauuguacuagaugcggugucuccucaagugcaggcacauuaaagauggguauuacuuucauagaagccacuggggaaaagggagaggagaggcagaguuugggcauccgaaggcauaauuggauuuauccaguaauuguggcaagcgacaaggagccaggaagugcacuggaugggcuuguggguauggauuugucaggcauguguuuuuaauuacucugucucuguugccauuauuuuaauagagaccuaauuuugagaaugggguucauuauuuaauuaaacuucaguaggauuggcaaaugagcggauccguggcucagugcugcccucuaguguauacuucauggauugucaaucuucaaaaaauacuuggcaauaaaauauauuucacaacugcaccaagcgucaauagaugcuucuguaagguuggcaauacuggggacagacauaagcaucuaucaucaucgugugcucaaggauucacagaugacaggcaaaaaucaucucuguucuuugcucccuggagaaugcgccucaucacaaaacacauguggccagcacaugggauugggaguaauugcugccuucggguuuguuggagaggaagguccccgaggaagggcccuggugguguuuguaaacaagacgaggcguuugguucuaucuuuggcuugcuaggcucaggaaggguuuuggcuggagacaguauugagaaaaugucauaauuuuuaugucugcaaaguugugcuucugggcugcugucugccucacgucugccagcuugugucugcgcucagaaagacucuugggaagagcagcagacuccagaagaggaugggcagagcccggauuuacccaugaaggauucacacugagucugugcuugcuccccugaguggcuuugacaggucucccgggaaaaugaaguagcugguguggaaccggugaccuuuugugaaaggcaacaaccacagagacaccaugcacauacagugucuuaguguuugccucuucccucuagauuacugucgcauuaauuaaggagagggaagaaauaagaauacgggugcuaaguauaaacugauuuguuguuuuuauuuugagaccuggcauuacuguguagaccaggcuggccuccagcucucagaucugacugccucuguuucccaagugcugggauugaaggugccugccuccauacccgguaccagaccuguauuuucuucucaaacaaaaagagaucaaaguauuggagcauuuuacuugauaauuaggguauucccucuucuagucuuuaauuacucucugcauaagcaucuuuauugaugaagugguucugacagccugacacccaggucugugacagccgggucugugacagcugagcacucuguucauuuauuucuucaucccguuucacaguggauucuaagcagcuugugggaagggacaaaaaugaugacacacagacacacacacacacagacacacacacacacacacauacacgaaugcacauccaguuaggagaggaagccccagcagacaggggaggacggagcagaaccuuugguuggagcacacacaguuccugaaggcugagugaaaacauggcugccugaugugucccacagucaagcugccucucagaaaugcgccccucacaaccucuucccaaccucuagcacacucucucuuccugagagcccaggaggugucaagaugaaauuguuuuaucaugcugugacccuguggcagcuggggauuuggaaggggccacuguugggagcuuauuuuaggaaaccuuuuauugucuugacuuguggaccuuccaaguggcuccaggcccucccacucuggugggcugcagugacaagaggacagauaaagggaguguugacgugggagggaugcugggugauugauaaccuugugcucgggccagggugccuucuggagaucaucaggaugauugcuggugcccaggcuccugggaagcugcucagagcauggagccgagauguagaugggccuuaaaggcuaggcugggggcugcagagauggcucagagguuaagagcauuggcugcucuucuagagguucugagcucaauuuccagcaaccacauggugacucacaaccauuucaaugugaucuggugcccucuucuggucugcaggcauacaugcaggcagaacauuauauacauaauaaacaaacaaacaaauaaauaaacauuaaaaaaaaaaaagauaguccaggcaugugcugggagucucagagucauugcgagcuugugacagcaaaccagauguccauagccaggagagcugucuccucaucuucucacuguuacccagcaacuacugcugccacucacugccuugugacuucuacccccacaucugcuggacucguccaauccauauggauuugaacucuccccaccuccuaucuucucaggauguaaaacuggccucuguuucucaguucaaagccuggaagcagcuuuggcuuuccuuugcuuugucccugugaaugccacccaugagccuugguucuagcuucaggcuguugagccagcucccacccugacccccuacacugcugcggagggccucuucaccucuacucccuuuccccuauuuguauguugucauuggcgcugcccucacagaccagcggggauggguucauugccucuuucacugggucuugguuucgcugucugcaaaaucagggcagcaacggggcucauaccaaaaagcuuuuagggggauuaaaguccuucacagauacacacgcgcgcgcgcgcgcacacacacacacacacacacacacacacacacacacacacacacacacuucuuagcacagcacacagcuaagaagugaauaaacacugcagcuuuacucgcugccucugacuuccaggccauccucuggacggaagcuacagaaaccuuugcaaggaacaaaauugaucuucccacaggccgucagguuccccacacaugguaucuuguuuccagggagacccucgguuucuucccaccugucuucaugccuggacccaucuuuagagcucagcuggagcuccgcagcuuaggccucugcugcugccucccugaccucaccugucacagcuucacagccuucaccugcgccccucuauucugucauuauccccugugcucgcugugccuucugcagagaaacccuaauuggcacuuaccaauggucgaauaacaacagcacuucuuucuuucccuugauuuuauuuuauuauuuuaugaguaugaguguuuucccuggauauaugucuauauaccacaugcacgccuggugccugaggagguggugagccuacauguggguucugggaauugaacucagguccuuugcaaaaacaagugcucuuaacugagucugcucuuaacugagucagcucuccagccccagugacacugucacuucucguuugcaguguugcauauacuuaccugguucuguuagccaagucuuauaaccccacaguggggguauguguuuaagcccuguuuuagaguugaagacaugagacuccaagaaggacaaacaacugauaccaggucacccagcugugaagagaaugaguguagacuuugcucagguccaagucugugggcuuuuuagauacuagcuauagucaggugagagaguucuuuccuggcuacgggugcuggccaagacugccaguguuaggggcauacuagcuccguuugaaagccaguagucuuccauaccuguguuuuuguuuuuuuuuugggggggggggcauccaucaugcuguagucuuguauggggugagaguucauaagagguacucauuagauucuguuuagcuuugauuaugaauuggaaccagacuaccugggugaucgcugguguucuauguguuauacuaaacuuuuuuaagcuuagaaagucucauaguugggcucuaaacuacaaguagccagaucacuggagagcuagcuuccgugccugcugaggacagcucuaagcuguugaccacagccuauacaagguccuggauuugacccucugcaccaccauacacauguacaaagaagcaacuuaacaacauaugaacagaacaaguguugggcucuggacagacucuagaccuuuuauuugauuuuaucuggggguggugggugguaagucccuggaccuacauuuuaacccaacguuauucccguccaaguagaagguggugcuuaguggcagugugugcuguagcuaacuaaugucuugugucuuuuuaucuucagcuuaaaauauuuauguauauauuuaucuccacuguguguauguccugugaguacaggugccuauagagucuagaagagggugucagauccccuggagcuagaguuacaggcgguuuugaacccacuaacauggguccugggaaccaaaucgaaucuucugcaagaaagagcaguuaagugcucuugagcacugaaacaucucuccagcccccuuaauuauuaauuuuugucagaacucuuuaucugugaggcguuugaucucugaccauggggcaggaagcccuuucccgccaggacccacaccacaugcauaacugcuuccuugguuacuguguccaauggaucuucucaccugcccuggaguuggcuuucugacccgacugaagcuacauucaaaauucaguguuggcuuguguuuugacaggcucucuuuguauuacagcccaggcugguccagagcagcuccugaucgcccugccucuccucccagagugcccggaucacaggcuucagccaacacagccugaugguuuguuuuuguuaacuuccuucccagaaacaguucugagcuaaucagagcccugagccuuaauggcugugccuuccuccgcuccgcgcucucucucuaaacaaaggcuucguguuuuaauaggcacaauaacaguaaaauuagcuugauuaggcuccagguggauuuaaaguguauccuaauggcaucucugacuggcuuggaagccaugcauuuuguuuugugcacaggaugugagugucacagugacucggggcaugaaaggacgauugaauuaaaguggccaucuguagaucccgccucaugguuucuaacuuacuacaaucugagaaacuggaccugcagcguggagccagguccaccugccuucuguccuugauauguuaaguuauaccacaguguuagcacagcaccuuccacuuuuacuugccccucugggaaccuucugggagcuuggagagcucagaccgggagguaggaccugugagauggcucagcaggccaagauaccugcugccacggcccacagcuggaguucaaucccuaggauccacagggcggcaggagagaaccggcuccugcagguuuccucuagcuucuucaugcacaccaugucacgcaugcccuucucucagauaaaugugauuuaaaaaaaaaaauauaacuuggacaccuucugcugaaaaccacagcuagcggcucccuacuuuaccggaaaguggauaugucugauuucauuauguagcaaagccccaugccgggugcuagcuacucugcccaagugcuuuugcgucucccccuaaaagggaacccugaccacuaguaggcuuccuaguaagaggaagcagaggugcagagcacccgccuacucaucaacugagccuaguuuaaugugugacuugcuaacuagucuuuaucugugugcuugguggcccacgaaggccuuaaaaaagugagauuuuuguuuucuucuuuguaucaaggcauaggcuauaauucccugagcucacuaagaacccagaauaucaaaccugguauuugaauaauauaauaauuagcauauaaugguaacauuuggaagcaggggacagaaccucuggucauggcugcuucauuuuggaaccuuugcuaaguuucugggcauuguuauaagcacagcccaggagauaaauauaaaaauaauuuucuugccaguuuuuucugugugguauccuagcgacgauggagugucuguccuuggguuaggggcaccagcugggacagugucagcguucaccaaaaggaggaaugugaagggcacaggcaaaguggccuuuuaaaagucaaugcaggggcuggaaaaaaaucacuccgugguuaagaacacuugcugggucucacucuguaacccaggcugaucuugaacuaacucauagugauccuccugccucagccucccaagcauuacaggaacacacuagauuuugaacaguuuccuaaacucaguuauuuuuagcagcauuuuaagaucugaucaucagagucauauauacuuauugucagacaaguuagcuaaaccagaaaaucucaaggaaggcgauaaaaacccagcagaguccugccauuguucauauuggcagguagugcauugucugccuuacugaacuguacacuaauuagcguccagaguccuuguaagguuaaaaaagucauaaaaccagacagaccccauaccaccuuggacaggaauucguguguaaugaagucuaaguaccugugagccagaagaauaacugacaaaucucuacaccaaggcccgaggcaaagugauuuccccuuuaagacaaagauccaauugcaguggcggguguguuugggugaagaacugagugcgcuccuguuugccugggagguuugcuccauuugauguuaauauuaggaccugauaccucuaguaugggcuaauagaguuccuugugccaucgcaggacaugucugcagcaggacauggguaaggucagcucugaacaaaaaggaacaccaggcagcuccaugggaagugcuuuccacccaccccacccacacaaugcacacagucaggaucacuacacauacacacagucaggaucgcuggucuuagaaccuuuugcuugcucuacaguaaauauuauauauguauaucuuuuuuuuuuuuaaagacaaggucucacuacauagaccaggcugacccugaacucacagagcucugccugccucugccuccugaguucuaggguuaaagguguguucuacuacacccugccccaagucuaucauuuaaagcuuggacauguucacuguaaggauguuuguuccauaguguauuagccagccucuuguguguuuaggucauuauaguuaugugcuguugcgcaaauggugacaccagugagcccuggguggaucucuauguuuuguggauaaacacuuauuuaacuggcucacaggagcugaguguuuuagaaggcuuuuuaucucauacugacaaauuauccccaggaacauuuuauacuuccuacaaugggucuauuuccccuauuaaacuggaaauuauucaaaagaaucuuccacagcauuccuguccuuuauugccuggccaauucgcucuccaccuuauauauacagguagcaucucucacugaacugggagguuacucuagcuagccagcuugccucuagaaccucuucaccucuagcccugggauuguaugcagaccacaacacccacccagcauuacauaggugcuggggauuggaacuuagcucccacugagcuggcccuucaguaugauuugugauuuggaaaauaaucgauugcugucuuguaucagagaggcuacagaaugagaauggcauuuguauauuuuuccaaagaagccgaguuaaacaaaucuuuggagagguauuguccucacccaucccuaccccguagauagaacacagagaccagagaccagaggcauauccacgggccucgcagaaugauggcagugacacuggauccaugagugacggucccaacucugcauuugcugaggugagacagccgugagucaggccgacaggagagagcauuugagggccucuggacacauggguaaacuguuuugcugggccugugggcugccccacacccauucuggacaaaagcugauucucaggcauggaggcccucaucugcccagucaucuccaccuguugaugggaacuuaaguaaacccuaguuaccaggguacacccucagcaagccucugcaguuguguggcuuccucagggaaggaagucaguuacugagucaguuuggggucccuggcauagcugcauccgcacuucugcgaccacuguaauaguuuguucugugguuaagcgcucauccugacuagacucccggggcugugagugcaggcacuuuauccucuauguguagcugcaggcacauucugagccuuauuuuuauuugaauauuuagaugcuaaugaaugaauuagcaguguguguggguuguugggcgguucuguuuccaacugcuugcaggaacagaagcaaagucccuuuuuaccaaggacacugaaagaagaaaaacacaguuggcgcugccaaagccagagggguauggucuguuuugcuggggccugucauacucuuaggguaugggggucagcagccauaucuaaccaagcauucuuuccugacuuaacagaaucagcugggcaguucccuagggacuguuaaaggggagcuuccagaaacauuggguggaagagaauucaaggucagggcucucaagguuuuuggcggugcauggauaucacaccucgucaccuacagccuggucuucacuguugaugggugcucgcugcaagggcuuggcagagcucuuuauugguggcuggcugagcgccagagcgccgcaguggugaggccgcagguccugcccuccccgcgcgccugccucccuccccuccuccaucucagccuccuccaguuugcagcauccucugcgaggaaaggaaugugccaguccgggacgcgccguccuggccgcgcggcagcaccuagggcgcccucuggacugccaggggccagcgucuggcgcugcgcggcgcgcuugggucggcgcugaugucaagugggugugggcucuucguaaaggccccggcgaggacgagaagggcgcacgaugcuccgcgggcgcguggaggcccgggcacguuccguggcccaaagcuguugaccgguggcccacuggggccggagcgggcgcauggaaccuuggcgcugcccgccccgggaugcgcgccccgccgcccugggguucuggggagagccgcuggcagucugcaggugugugcacgcacgaacuuugucgggcaggacucugugaucgugggcugcggucuggugcuuugugucugggugcggcggguugggagaggauucagccggccacugguuaaucuccccuugggaagggcgcgccgguagcugcccaguaggguuaagaaucgcgucuccaaguccugccuguguucaugguaacaggauucucucucugcagacagcauggcuuuccaaaaucgccaguggugcgugggaacugagaggccccagaggcgugggagcugcgggucggaggcugguuccaaaggaggcgggagguggccagcgguucugcacggagucggccaaucccacccccaccccacccccaccuccgacccuuuccuugcacacuuucggagagcugaaagcccgaagcuggcuauggaaaggucaggggucagccccucuugaaugacaucucagguguccuggaggaaggcagggcuuuguuccaggcucccuuugcgcccaaaacuaugaaaccugggggcgggggggcguucuagggcuggggcuccagugcugucacuagucuuucuuagcaacagcagcucuugguggcagguuaauuauuaauauuguaucggcugguggcagagacucgaaaugagauugguggcucucagguucucucucucucucucucuccuugacacucuucaguccaucauacugcaguguauuuccagggagaaugugggcauucucccagggaacugggacuugggagggaccccuuuuuccugucugcgagacagacagacucucuggggaagaccgcaagacaauguccuuucguuuuuugucuuuuucacaguauguaccuguuuucuuugccuuuggaaaccaacugcucucacucucacaccagacugagcucuuuuagucuggagucugagcugcaaaugcuaccugcaauucuacauucuacaaguaucucugacgccgcuuugagaaccugggucuguagaaauucuggcaggaaccugacaggugauacccagccugugucuccugcagaguggaagacaggccuagguguggaacuaugggggcagaguggagugaagcccacccccuaggagguuuccguucccuuucuugucuugacagagcauggcgucuaucaccaagcacuaggugugcuguacuuacaguugggguaucucuaccugggccccaagaagcagaacaggaggggagauuccagacugcugggggcauggaugagaacaggcuuuggggauaaguggaagcaagccugagggaugagaacaggcuuuggggauaaguggaagcaagccugaggagaguugacaccguuacccuucuuccuagcaguagucagucuugagacucggcaaucuguuugcccagccuagcacccagugcucagucugguaauugaagggcccucugauugguguagaaguguguuaagaaggggccuuacagaaggcgugggagcagagagcaaggaagcugaugcuaacucugccuguggcuggcuguuaggugacagaggcccugaaacaggccugguguccuuuagguccuagcuuucugaaaacuucugcgggcacuuggcuccauagguuccucuuccucuccacuccugcucugugggcuggccacuccaauggcugcauuccccuaaggaaguaguuggcagaacaguaccauggguuucuacagcagggccugcugaucuguacgcucugggugccacucccagcaccuagcugcguugucuucuccagugguggcccaagcuaucagugcuguauggagggcuuggagacagcucugauugugagccaguuuuccucugcuguaggaagauagcccaaagcugacaucuaauaaugucugcucaucuuuuggcuugcugucaugucccaguauucacugacaguggcccuaucccugccuggugaagccacccagggggauuccauaaagagccagugacugauagugucucuuaagcacugugaguugaauaggaagggguuggaggauuucaggggaaagcaaagcaguuuucacggagccuuuggaauuaugggauggguuauggggucacagggugggguguggcuguuuggaauugugucauguccugugucccaucccgugguuacgcagucacgguguaucuuugccuacuccgaggccucugcuaggcacugacuccagggagccuugucucagggcaagagaggaauacucugaggguuugucugaaucaggaggucaggaggagacagacaagacccagcagccuuguuugcaaaaccacaaagauccuccugggggaguugggcugucucuugugagggucaaaagggaccacucuuguaggccagcaugcugugggaaugcagaaacugagggagagagcgugagggguugauuaaggcagggugugugugugugugugugugugugugugugugugugugagagagagagagagagagagagagagagagagagagagagagagagagagagagauuuucucuguggacuuggcuuugaacucagucucugcuuuguguccuugaggcagagucaguuucuucacuugugaaauagggauaaggaaaccccacccuagccccauacuugggaggauuauaggagguguuuggaaaggauuuagcacagugcugacuaauuggcagauagaagaucuuugggaugugggcugggggagcugcuuuucucacgaggaaauaaguauguuagaaaccaugucugggcuccuagggauggaucagaugggacagcucuccuggagggguuuaaucacgcuugaacaucacacuuggcuuccagccuccaguacugaaagaggucuuuggagccuuagaugcuggggccacugaaagguguccuaacaggauccugcgugggggcguggcauggcauucuggucgaacaggcugugugccaggggcuguuggacaccguucuuguguguguuauugaauucuggacaauuuuagaggcagauacuaucguuuacauuuuauugaugaagcaguugagcuguuaggaauuauuuugauuuuguuugccucuuggagaggcaaacaauuaucaaaaauuauuuugauuuuguuugccucuuggaaaccaccauuugagagccucuaaauucaaguuuccucaaauauguuuguguacccuucuucauuggccuguucugcuguuguaggggaaauaagguauaaagcuguaggauguucuuuuuuuuugguuuuucgagacaggguuucucuguguagcccuggcuguccuggaacucacucuguagacuaggcuggccuugaacucagaaauccaccugccucugccucccaagugcugggauuaaaggugugcgccaccacgcccagcuuggcuguaggauguucuuacuagucccuuguucagauccaccauggggcucagcguucacaaagguuggucccagcucucugacuccuuaggugagaucuucugucucauugccguugcuucccacaacccagugugcacugaggucugaaguuccccaaauguuagagagggaaaaaaaaugucagcaagaagaaaggaacagaacaccuggggaagacaacggcuuguggcugguagugguuucaacuuggaguugcucacuaacauugaguuauguucauagccuccaauucauuuuuguuaguuuggaaguaugcuccuaagaaaaggcugccgccuugugggcuauucucucuuaacgauccgagcaacauuauaaaggugugacucgaagccaugcauucugaguuggaaggaaaaguaacagcaacugcugggccucccuccaggcacaggaaguuaggagcucuagaaggauggagauuccacagccugcuguuggguccucaccucacagcagccugaugaugucaucagaucaggugcccguccuucaucuuacagcagggugcagugacuugccugacgccagguguccagaucugugcuggugacacaugggcagugucaggucuggccuggcucagcagcaggcagucuuguuuaauuauuuuuuuucaauuauauguuguaaaacuuaaauauuacagaaggagauaaagagggagaacuguggauacgaguggagauaagcacuuugcauuucgguggaguguuuuaaacuuuuuuuucucuugaggaagaugggagcauuuguuuuuguugggggagauuggguuguuauccgucucugggcagcuauaguuuuguaagccuuucuuccuuacgaagucagaucacccuugacucagcacugugggcagagaggaaggugaucaagagauucagagcugaggcugugugugcucugccagugacugcagacgcacagugugcauuggcugguuuuaugugucaacuugacacaagcuagagaggaaggagccucaguugaaaugccuccgugagauccagcuguaaggcgguuucucaauuagugaucaauggggagggcccagcccauuguggguagggucacccuugggcuaguggccauaagaaagcaggcugagcaagccacggggagcaguucaguaaacagcauaucuccacggccucugcaucagcuccugccuccagguuccagcccugcuugaauuccuguccugauucccucaaaugaaacccaauaaacccuuucuuccccaauuugcuuuuuugaucaugguauuuuguugaaccaauagaaacccacacuaaggcacagugacagccauuauccacugcucaccucugcuucaggugcuccauggauggcccacaugcugucccuaguuggccuugagaacuggcuacuguccguuuuauaauuguaggaacccagagauugaaugccuugccuaaggugauaaagucuaagguauaaacccaagcugacauucaagucuagauugucucauuacagacucaacuagauaccuuccccagcgacuccaacuguagcaaagcccagagcucucaaaucgcauggucuuugagacugaaggagcuggcauucauccuuccauauuuuuccucuuugguguuaauucuaguugucuacacgucugaggggucuucauauaaccugcucaacugcacauagaaaauauuuggaaaguauuauuuauccaaaacauguguagacacccccccauacuuguuauccccugaaaaguacaguauagcaaguuuacacaacauuuccauugcagagcuauuuaaagcaaucuauagguagauuaaagcauaugggaggaauggggaggggcugauauugugccguuucauguagguggcugccucaggagguccuggaaccaauccccugagacacugagggguaacuaaacuaugucgggugacauucgggccuuuuuuccuugguuuucaagacaggguuucccuguguagcucuggcugucuggaacccgcucuguaaaccaggcuggccucaaacucacaagagguccaccuggaauuaaagacgugagccaccacacuccacugacauuugucuuuuuaaagacauucucagcuuggcuuauucugcuuguuuggguuacucaaugauauaucagacucugagaacuggaagggauugacaagucuauuaguggggaaacugaguuucagaacugaccgagcauacagaaccauuucuaguugauccaggaccagaacuuaggcuccccuccuauccgugacccaggggugucugucauacagggcacauacuuuuauuuuagggguauuucucacauagguuugaagaacaacacagcuaaaacguuaaacuccucauuugucguuuaucaucacuuuggaugugguuagagucuauacugucuauuuagagaaaaaaaguggaaguacggguugggcagggccuuggcugagauuucagaggcggugugugggugagcugugugugguaagugcucucccagugagggacuugcccagcugccuuuaguauuucagggaccggaagaaggaaguggcucuggugaacauauucuguuuccugggugccuuacccaugagucaaugagugagagugggcucauuguguguguucagaaagcccaaggucagagagcaaggggaaauggagcugggguucaggucucagcuugcucucauuucccacagguuguaugcuggggagcccgccauccucgaggcucugaagucuguuaggaccugacugcuccaguacccggcucagguggcaauggaggaggcuggguugcuaggcugccaucauagccuguuaguuuaaagcuuccuuuugauagucuuucaaagacuggaauuuaucaaaucugacucaugcaguuaagugauagagaacacuuauccugcugccaugugccuggcguucacauuguguggugacgccacaaggcuccaggaaaacguggucugugccugucaguuucuuuaaagggcaguugucacaugccuuuugagacccagucauaugccugcauuuucagcauucagauaaucaaccagagccuaugcacuuagagcagccaggggaggaagaagaggaggaagaggaagaggaagagugagcugcugccuccuuagcugaagagacccagagcuguagacuguagagggaaagaaccaucggggucugcuuuggggaugcaggccagaacaaugggucuaagguuuguccccuuccuagcccugccaagaaagugcugccacuuccggguguaguggcacugaccagagugugccucauccuugucgggguagugucuugcugaccagaguguaccucauuacaaugauuagcucacaucaccagcacagaauaaaugguuucacugugacguuuccauagugccugccaccuugcucucauugucuuaaacaugaagcaucacuguccgugugcuacacauaggugcugugacagcuggacccaauggcccuaagacgcccagguucuagucccagaacccaugggcgugcugacugucuagguaauguggaagggaagggcuuuggauuaccuggugcccagagagccagagccucaggagaggaggugugucacgugguuggagggaugugggcucugacucugggaacaugggcagccucugcggagugacagagguagggaugauuuuugcccucacccuuccggucaauggagcagacuucauauuugugaucucuggagcuuuacacgcacgagcguggguaugcgggguaugucuguguggacgaguuuuaguuacucuucuacuggugggccuuuaucuauacuauauacauuuauuaauccauagaggaagucaggcuuguuuaugagaaaaguaaggugugcaguaaacugucuuuuuguaagaauaaaaaauuaaauuuaguaaaauuuagaccuuuuaaaauuuauuauugauacuauuauuuugagauagagucuuaguauuuggcccagguuggccucaaacucacacuucuagcccagugguucucaaccuguggguggagaacccuuugggaagguuguugaacaacccuuucacaaggguagcacaucagauauccugcacuauuguuuuuuuuuuuuuuuuagauuuauuuauuuauuauauguaaguacacuguagcugucuucagacacagcagaagagggcaucagaucuuguuacagaugguugugagccaccaugugguugcugggauuugaacuccagaccuucagaagagcagucgggugcucuuacacacugagccaucucaccagccccugcacuauuguuuauaacaguagcaagaaauguaaaugaagaaaauaccuaauuaaaaaaaauauauaaaagauucugugugugugugugugugugugugagagagagagagagagagcgagagagaauauauaugucugugguggccagaggcauuggauacugguggagcuaggguuauaggugccugugagcagccacccagaguggguugaugacggaaaccaaccacacucacguucucuguaagagcaggguggcuguuaaccucacagccaucuccagccuugcaaaugcuuuuugucacauugauuucuauauucuaguaaguagaccucccaaccgaaaaagugaauuguuuugugugagggugguggugguggugguggugguggugguggugguguugguguguguguguguguguguguguccuccacaugacaugguuauauguagaucagaggacaucuugugugaguugggucugucauuccaucauguaggcccuggucuagaacucagguugggguugguggcgaaugccuuugccuacugaacuaucaucuccccagccuagcccucuguuuauauauugcagaccccuauccucaugugacauuuaacacaauuuauaagaaacuauauuauugacuuaguauguuuguggguuuuuucacuuauguguuuuuuagacaugguuguacuacacaguccuggcuggcuuggagguagcuauauagcuggccuugcauuuucugcagucugcuugcuucaguuacagcgugcugggaugaugggugugugucgccgugcuggucuggguuaguuuugugaggcuuccuucuucacuagauagugccauuugugcugucuucagucaguuuguaguagccugacaugaagcaauauagacagauacuaagcauuacaacagucagacacacagccagccucuguggucaagggaggcagacaagcgagcagccagguuacauacuguggugaggccgcagcuggacugaauagccaggguuuuaggagcccugaaggaugguuggaaaggaggugggaagauccuuacuacuucaugaagagccuauucaagauccccuaaguaagauaugaaggcaggguggagcuaccagccacuucacacagacagagacacuuccuccuaggcuaauauggcccaccucucaccuucuggcugaagucccauuuucagaccaaaaccuguggccuuuuguugguaggaaacacugggccugagauuugaaccgaggcccagagcccaaauucugaacaugccucugugggaagaugauggcacccaaauguaagagaguagagugugacccuuggucacccagcuuugucaagagcagcuggggcuauuuauagggcucuccgagaggucagaccuguugauauuggcccucccucuuagaagaagggggagagaugcaucaauggccccucaccugagaucccagacagucccuccuggaccuucuggcuauuuguauguaauucuacucaauuuguagccccauggucucaguccgugcuuagaguaagacuggagaguagcuggagggagacuucacagcugugggcagguggucauccaugccgggguggcacuuuacacggggugcagcugcuucucugucacuugugcucccgucaguaaaccccucugccacaccugugagccagcccaggaaacucauugccccucuaaguuggacuuugguagacuugaauuugguuugcaguuggggccuuaucaggaggggaaagacacuugucauaacuuuucagggaaagaguuccaaagauaucucaauucuagucuuugguuugcuucuuuguacauucagagacagccaaccucuucagucucaguuuccccaucuguaggaagacuuggggucugucugcuucacaugugcagugaguggaaagggaauccuguaaacuuauucugugaaccacaggacacauguaccagcagagaggaugcucacaggaacccucaccucuccauggcucagcguccuucgguguccuugaagagggccgggaaacuuggccacagugagccauugaggcauucagagacagugguagcaggcagugggguguaaguuuaggauuaugccaugcugucuccauggaugccagucagugcuagagguggcugaggagaacaccuuuccugccauggggggcgugagcaggauguugucccagcccugccacuuaauuuccuuuggugugacuugaggcaguugcccugaauuuuggacucaccguuuauuuuauggaacgaagccaacaguuucuacuuugcagaccaugugaaugaagcuugcccagacccuggcuacacuggacaagcaguuggcagggcuggcucugacuuuggaacauuuucaggguugcuccaggaaggcccuguuugacagaccccuccucccucuccugcuguucacccucacucugggugaaauguauaggaaggucuggacaagaauugggaaccccggacccucuggaggaggaguccugugccuccuaguagagcagcucugugugguuuccaggugcuucagcgggcaugccaggcuguuuuggaaggcacgcugugucugccuugccaagugugggaucgagugucagcguuuugcuuucugggaauaauggcugugcagaugagguggacucaucucggagcuucgucagacgccaggcucucugcuuucucucaaccuugugaaugcuuuugguuauucuuauuuacaacauuuggaaaacagcccccaaaagaagaaaauaagaauguauacccucacacucaaaaauaguucuuacuaauuaaggugaauauuucucccugccccucccuuccagggguguggugccuugggggucacucacacgcuuacaaguaaucucccauccaugcucaguaagucaacacaguaaacucuucggugccuccagcuggaguuuaguggacacgcccgugucaugucauccaggcuguccuugaacuccucucuggucuugcugucuggcugagugcugggcuaacagugcuggcauugacagugggcacugacaaggccaucgcuuugacccuacugcuggagauggagcucugggccucuugaacgcuggguggguggguacucuggcacaggccugcacugcagcaccucuggguuuuguuguuuguuuguuuguuuguuuguuuguuuguuucuggauuguauggguaugucauuggcagagcacagcuuugaugugucucacacacguggucacacucacagccaggcccuugaagccuuguaacauuuucauccgcuuuauaaacgguuacugguguucucuguucaguagacccuuccucccaaaaugcauagaauauuugacuuuuuccuucuauuuucuucaauuccuugaacuugucuuucuaguucagagaugagcguauucugguauuuuuggcagucggggugaguccccugccucugaccauugugcgcugaugcugccuccucauuacuuacccccagucccggcggacaguacaaucagccucuuguggcucgacagugaaauuuaaguaaugggucagccuuuccagugcuucccucuuagucaggaaguucacucuugaaucuaaccuaaaucucaucggcugcauuuuaaauccucaccugcugcugcuuccucucagugggguugagcggagcagaacugcacaccaucuucgaaccucacagcucagccccggccaccagccuuauguuacccuggaggaaacuugaggggcucuggcuaaugcugucacggcugggagggcgaucuccgcaucaaguugccacugauaacgccagguaggguuucugcauccuagagaggccauucuguggaggccagcaucuagaccuccccugcccucuacagagcuuguggggcaauuaucaugcagagcggugcuugacaaccgugggucuaucagauucguucucugggaaaagaugugcuugggccagccgaaagauuugccucccaagcuaguuggcugagcuauuggugugcguugaggaaguguacuggcuaguuuugugucagcuugacacagcuggaguuaucacagagaaaggagcuucaguugaagaaaugccuccaugagauccaacuguuaaggcauuuucucaauuagugaucaagggggaaaggucccuugugggugggaccaucucugggcugguagucuugguuaagagagcaggcugagcaagccaggggaagcaagccaguaaaggacaucccuccauggccucugcaucaguuccugcuucuugaccugcuugaguuccaguccugacuuccuuggugaugaacagcaguauggaaguguaagccgaauaaacccuuuccuccccaacuugcuucuuggucaugauguuugugcaggaauagaaaccuugacuaagacaggaaggaugcuccccgaagguagggugucauuauucuggucucaaagcagcucuugaaaaugcaggaggccaggguccuaaucugggccacccacccuugcuaaacagcagcugggaauagccugggccaccuuucuuagccaguguccuucaucaggagacccuagcuguauauccagagaggaacaugcuaauuuggaagggagaugaaauucagagagcugcaacuuugaggacagcaagagggcccuuugucgcuuacuccguuggguuauuuuagagucuggcaacagccccaucaggguggagccagccuccuaggauagaacucagcccugggggccucuuuacuguaggagaugaaaccaguguccucagggaccuagcccaggcuggcuggccuccccuggcuacaugcugcucuucccuuccucaacaccagcagaucccaccuccugugaaugcauggaggcuguguuugggcagauauuacuaaaaggaagugcccaguccuuacagagugcgguucucuccuucagugccuggcaguguaauucugggcagaaauagaaugagcgccucagaggcaagccagugucuugugcacagggugaaguaacucucuguuagcugggcacacuuuuaaucccagccuuggggaggcagaggcaggcguauuucugaguucaaggccagccuggucuacagagugaguuccaggacagccagggcuacagagagaaacccugucuagaaaaaauaaaacaaaacaacaaaagaagcucucugguggucaccucccucucuaaguaccuuucuguccaccuucauugccagccuggauucacuuugauguugaaugucccugguacuuagcucaccaaguuggagcccaagaucccccugcaaggugugccucucauaagugcugucccugucuauacuuagacccugggcuggaugcugggauuggugcagaggcucugauuucuguucuggauuggggcauuguuuuuacaaaauauugcacaggugguccuuacgcuuggcaauucucagaaagcaucaguuuucuaccuguaggucaugaccccuuuaggucaaauguccauuucacaaggguugaauaucagauauccuacguaucaaauauuuacauuacaauucauaacaguagcaaaauuauaguugugaacuaacaacaaaaauaauuuuguggucgggggucaccacaaugugaggaacuguauuaaagggucacagcauuaggaaaguucagaaccacuguccuaaaguaaggaggaaggcgugcuugccacaucccaucagcacuguccuucaugcgagggcgagcaucggaagcccgggaacagaagugcgcuccauauuguccugagaaccaaaagggagaaugacagaugagagcauaugucgacuuuccugagcugggucagcuugccgggacgccuuuguggagaucugugcuuuagcugugucucaccgccugcugauugagcagguggugugggcaggaugaagaugcuugcuucaggucaaaggauaaagcggagaagagacagcucguucauuugccuaagcgggguucuucagccagggccugggaacuccucccucccucccucccuucucuucuuucuuuuuaacuguggagggcagggguaaggcugugaauagcagaccuuaaguuuuccaauuugugccuuagggaaagacaagucagaggaucaggugugggcuggagagauggcucaguucaaaucccagcaaccacaugguggcucacaaccauccuuaaugagaucugaugcccucuucuggagugucugaagacagcuacaguguacuuacauauauauuaaaaaaaaaaaaaaaggaucaggugccuacacagugucgcacaaucccugaggcccagggcagccagcuuccuggaaaauguuggggguaccuuuucucaaagaauuaaugagggcaagucauugccugaguggaauaaaagccccuuuguuauuuuguuuguccaaggugucuuucugugacaagcguggcugcucuccauggcuggggcauccaugcccaccuuccucagggugcugguggguggggcuuugcucugugagccucacuuucaucugccugcuuagcauugcagaagccagcacucccuggaaaaagcccuugucguucucucuagcaccucuaggcuagcagugggguugugguguucccuagauugcaaaguuugcuuaguaugauuaggagucaguaucgccccacccccaccccagcccgugcccuucagacugcagucugucagucaccugcaacagacacucagggcggugguaacaacugcagaauuucuaggaauagauuuuauauuuuagugagacaccaaggccgcugucuagguacuagaaauuuugagaauuacuaugucacaaugcccccaucuuguuuuauaguagagacaugcacugugguuaacuugcccaaggaccuggaaggcuaacaccaucacaucaaauuugcagaguucauaccuuuguggaccuuggcccagcuuucugcugcuccagugugcugcaaucauugucuggaaguagauuauuccuuguugugggaaguuguccucuguaccaagaagcgguguuuauuuguguguguguguguguguguguguguguguguguguguguguguguguguagcuccuccuacuuguaaguaugaaaaaaacguuuccaguguugccaaacaucuuguggaugcaaaaucaucccaguuaagaacugcugguuuccggggagaagcuguggccagagcuguuccccgauagcuuuaugucuggggauuuuacuuuuauaauuugcauaauuggcgucuccccagcuuggcuaaugugcaggguugcacucauaaauagaagucacagugcauauaaguucuccucuccucugcaucuuggcccguggaggaaggcauaaaucaauuugaaaagaccacuugcuuuggauucuauucuguggcuucucugccagcccugugcuucccagcugugcgaucucgagcguaaccuucuccagugccuugcccuagcugauuaugauggaaagaaauguuuguugucagugagaaugaagugacaccuugcauguggaaauguuuauaaaacauuacucaucuauuaagugucaaugauaagauucaggucuaauuaccagcacuugagauuccucagauuggaaagugcagaucucagcgcggugguucuaguuguguguuuggucaagaacauuacccuucauuucugcccauggaguuuuaagcuuccuucuucucgguaaguuuuccuguugccuggcagaagccaguuuuuugugugcucuguuuguuuguuuguuuguuuuacagugaguuucugaagggcugucaaaucuuuuaugaaaaccaaguugcagacaccuuuuuucccccauguugcuggcuuucacagagaauuaggugagaagccaguacuagccugcagagaagcuccuaggugcgcuuggagcagacucagcuaguguguagucuucccagaggcgcaggauaucugaggcgucacagggcagagugagaagggccaggcacucuagguucuaaggcucuggcgugacaucuccaccuuccagcugcugugccugagggugggguaggucaggaaggacaugggggcugcugcagcugcucuguaggucuugggaaccagucuugcucucaguaacuuauggguggaguuuuaccagaguacacacaacacacacaugauugucuuugaucccuagaacaucucaaggggggaaaggcaaagacauaaaagggccccaguucuuguguggaggccugguaaaggaguggacagagaagcuggaaucuccuuuugcuuuuuaccgugaccucaaacucugucccuguugcuucgaugaagcaccaugaccacaaacaacguguagagaauagguuuaucuggcuuacauauccugaauacacagucuauugagggaagccaaagcuuaggaauucaaaccuggcuggaaccuggaggcaggagcuggagagaggagugcugcuuccuggcuuacucacccugauuucuaaucaaacccagaacuuccagcccagggauggcaccagccacaacaggcuagauaccccacagcaaucauuaauuuaaaaaaugcccugcagucuugccauaugcccagucuucuggaggcguuuucucaacugagguucccuccucucagaugacucuggcugggucaaguugacauaaaaacuagccaggacauuuggccaguuucuacuagugagaauugcucugauaauguggcuaugcauauuaaugagcaguauaacugcugcuuacuguugaguguuuacgccaaugcacaccgcauuuaauucacccagacaccucacagagaaggcaccaugcuuucuccauuuuggaagggagcaaucagguuggagaaaagagaaucagauuguucacauuccgguucacaaagccuaaauggucccuuuccugcccugcaaucaaggugcgcccaccugcggcucugcccgacuccagccaguagaugcuuacagcucccuauguuaauguucuuggucugccgacagaaaauguuggcuggcuuaagcaacauaaauguauguucucggccuggaggcuaguagucaagaugucaguauguuuggcuuucuuagagacuugugucuggcuuguagccugucuuuuaauugucagcacuuuaucuuauaagagcgcugucauccccauucagacuuguuugcucugagacaccgucucuccaugcugucccugcugaucugaacgcaagcauucucccgugcuccagucuugugagcagcugggccuuaaggugucauggcuaugcauaauccaggguucgaauucaagcuugaccaccuuuugaaugaucuaaccuccaaauaugacuguauucuuaaguucuguuggggaggauaucaaacaugaauuuuguugagggaugugggucagcccacaggaguccuguuugucagguauccauuuugauggguggcacccagcuugcuaagcuguucuuugaccccuggcagugcuaagggagggcugcugcugauuccaggagccucaaggcugccugcugaugggaaucacaccuucauccuugaggucuacaucugccuggaagcugucaccuucuagaacuuucccuuuccuggcguggacuggaagucaggccugccucagauagaugagaugcuucauauggaaagggcuggggcuggagaccaggcaugguagagccugccuauaauccucagaaggcagaggcaaguugaucucuguauguucaaggccaaccuggucuacauagugaguuccacgacagccagagccacauauuaacacccugcagggggagggagggacuguaagcucugagcucauaugggacuaacguauacucaugcuuagucuauaccucccaguguucuggggagauagagcuggagccuggggaaaaacguugacuuggguaaagcccgccacuucagccaguuuggggggcggugguauuucugcuucucuguuugccuggggacauacucaaaggagcuagcagcuguuuccugcagauccagagggcuguguucugccgucccuccaggcugcccuagggcugcaggugaggauggaggcugagauugcuuacaaggaagcauccaagcggaugcuuuggguuauggugaccuugagaaaaguguuuaaagauuucccuaggauagaaauaauacuucagugagcaugauguuagagaaugaagaaauggggggcuggagcagugucucagugcucaagaauacuugcucuucuugcagaggauccagguucaguucccagcaccacacggcagcucacugcuaccuguaacuccagucgcagggggucugacacccccuuguggucucuguagguaucagauaugcaggcaaaauauucauacauauagacaaaguaaagcugagagggagggagagagggagggguggggcacuggaucgguugguugcucggugauuagcagugaacacuguucuuucuuuugaaggauuguuucuuuuuuuuuuuuuuuuuuuuuuuuuuuuuuuuuuuuuuuaagauuuauuuauuauuuuauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagccccugaaggauuguuucuuaaauuuuauuuuuaugugaguugguguuuugccuacaggugugcaugcguguggguuucugauccuggagauggaaaagcagacacaugugaggugccuugaaggugguggagguuaaacccagauccuuuagcagagcagccagugcccuuaacugcucagcuaacucuccagcccugcauacugcucuuuuugacagagcacccauaucagguggcuugcagcuauugugaacuacagcuccaagggacagcaugcuuucuucuagaguccauguguaccugcacucacccaugcacguauauacacaggauaaagagaaucuugaguuguuuguuuguuuuaaagaaggaaaucagacuugguggcauacaacauacucuuagcacccaaguggcugagacaggagaauugcuaugaauaccaggucagucagggcuacauaguaaggcccuggaucaaaauaaugaaauaauuaaguaaauaaacaggugaaccuuucuuccugugugucuucugaagcuccuggcaaggcucagaaggugaccuguugugagcagguacacccgcuaugguguguuagcgcggggugcacugcaugaagagcgagcgaguuacagucagccuucccagacacacugucuguaugcuuucccuugcugcacgcacacacucauccaaacauuucacaucuucccccauuuuaaaggccaaaaaaccuuugcaagcagaacgugcaaaauguacuuaugaauuuuaauucuuacauaaauaacagguggcaguacaccaaauuaguaucagugguugugguuauggguaauuuacauuuuuauccuuccccucccuccuuauuccauccuuccccuucuuuuccucucuccuuccccagaaccccgagugucccaggcugaccucaagcuccuguguagcugaggaugaccuugaaccucuauucgucugccuccacucuccugaugcugguauuccggugugcacaccugccaugcauggugcugggggucaagcccagggccucagacuuacuaggaauuuuaacauuaacauccuuggucugguuuaauucauucauuucucauauugagguuguauguguguuugugugugugcauguggauacacaugcauguguauuuuuaauuauugacaauuuuacauguacaugaugcaucuugauuauauuuaacccccuuucccuuuuuuuaucuguucucccauguucucugaaccccuucuuuccaacaagcuuugccacuauuucgaugucuuuuauuguuuacucagagcugcuugcgugagcaucccucuggccauugugguuuacagagccaggcauaggacaacucacuaguggcuauacuucuaauaaagaugacccccccucccaaaagccauuaacugccaaucgcuccucauuugggggcagggucuuaggucuuagagcgucucucuccucuccaggcuggaauguaggcuugauccugagcugugaguucucgaggguaacuccauguucauucaguccaggcaguauugcacagcauuccuccccagccuccagcucuuaccaucuuuuuuuuuuuuuuuuuuaauuaaggggaugaccuauguuaagaugaggaguuuguuuguuuguuuauuaaagauuuauuuauuuauuauauguaagcacacuguagcugucuucagacacuccagaagagggagucagaucucguuacggaugguugcgagccaccaugugguugcugggauuugaacuccggaccuuuggaagagcagucgggugcucuuacccacugagccaucucaccagcccagcucuuaccaucuuuuauuuccucuuccaagguguccauguguaugugcaagagggagagaggaagagggggaggcguccuguuucaggcucagcacucagcagucaguucuucucaguaccuuggcuuguuaugagucaugacccacuccaaagagaagccucucugaccaaaggucaaagccugaauaaucucuacaaacaaguauuuagaaggcaguugaauaauauugccauaguagucggcuccccucuggccguugugguuuacagagccaggcaugaauucuccccugagagcagaccucaaaucuacucugaaaguaguugguuauccccauagcaaccaugccauuaaugcaccaguggauacaucuugccuggcugguugguaucauaguucacagauccacugcugcauaaugccuucuggcaaaggcauuauucuagggagaaguagagcuacagauguuuguuagcaacuaugugggugcugggaacugaacccagguucucugcaagaacaaguauucucaauugcugagcuaucccucgagcucccaaaacaagggggauuauuuuaagucaaugaaggcccgucuagaaggaccucagaagaaauugaaaaugcaagccugacccacacugaucucuucaaggccuuggggaagggucuccgguuucaucggugaaggacaccaggggcgaauugugaucugcacagaugggcagcaggcauguagaguuugcucugaguuuggaccuugcagaaacggccaaguggcagcaauagauuuugggugucugacacaggggacauggcaggaagaacagaagccggaaggaccgauugcucucagaccaugcucugcccaaauaaaugcuucugcaacuaugucaaugugugggaggccaggagacuuuguuuuuucuucccauuuuggcucaacucuucuuuugguguugaguggcacacagaauuucuuuuugaagugacucuucuuauucugaccugugcuaugacuuagacuuucucagacagccugccuucacucuguuuuuguuuuuguuuuuguuuuuuuugguuuuuuuuuuuuuuuuuuuuuuaaguuuuuuuucaagacaggguuucuuuguauagcccuggcuguccuggaacucacuuuguagaccaggcuggcuucaaacucagaaauccaccugccucugccuccucagugcuggugcugggauuaaaggcauaugccaccacugcccagcccugccuucacucugaauuggagccacuacugucuccccucuucccccccuucugcucugagcuuauguaaaggagguuuugcuccucccacuaggacccauaauucuugaguguugguugaaagaaaaggggagggagagagacagagacagagagagacuagccaaagagacaucuauacugugcaguggaguuggaggguugugggaagcucagccccuuggccacucucagccuuccccaggagccucuaagggaaggucuccuccuucccaacaugagacaugucuaaacaagcucugguuguuuacuccuccugacucguucuuuaauacauuaucagucacuugaugcuuaugugcccugugcacuauacagcuauccugauacccagugacuaacacccaacuccaguucacaguagaguaacagguuuaacacaaaugacucuaaaacaauuuguauuacauuuauuuauuacacauggggguugcugcacagcauguauguggaggucaguggugcuugcagaagucacuucucuuauugugugggcucuagggauugagcucagaucaucauguuugguggcaaguguccuuacccagugagccaucuugccagccacuuaggcuauucuaagcagaauuuagagcuuaagucagugagugcuugaguggcagaggagcaaguucaaaacugccuuuggcuuugauagcuaaaagaagacugaaaacagucucuucuaacuacagacuuauuccucugcucgucccccuaccucucagcucccucugcccugugcucucaaccucucuucugccagucuuagcaucuuccugaguguugaacucuuucaaauugauagauuagaaaguguuaccauaagguuagauguuaguaacuuuuguuagcuguguguuaagcacacuguauccuaguccccuacucucugggaguuagauuacuauauacauguaaaucagaaaugucaaacucaucaaaggugacuuccuaggacaauucaacuauaagggacauuugaauccagauauuggcccuguucagaggacuugcaauaaauuaaaaaagaaaaaaaagauuuauuuauuuuuguuuuauguuuggguagcacgugugugccauuaaugcccuuagaggccugaaggggauguuggucccccugggauuagaguuaauuuacagcugguugugagccaccaugcaguugcaaggaagccauguccucuggaagagcagccagugcucuuaacugcugugcaaucucuccagcccuuaggacucgcuuuuuuucuuuuuucuuuuuuaagcuuaguugagcuaaauaagauauauaacuguuuacugagcacaugggaagauacucaacgaaugccacuagccauugaggaaagcacgggaugacuucacacacgaugucucugcagcagucucccccuuucugcugggcugugucugcaggcuccagugcuaccuuaaaucacagaugguauucccccuccccccccucccccacacaccuagggauggugaacccggcagcccagugcuucuccccuagugcucugcagugccaccacacagcaccaaagccugccucuccucccagacuugcugcccccuuccugucacuaccucugugggucucucuguagccuaggcugaccuggagauugugaggcucccccucagccucccagggagcuagggaucauggguauuuguaauucuguguccaacuuggcagcacauuuccugcuauuggugacuguuauuaaguagaaugcagguuaguugaguauauauuaccuugugaugcugagauaguuugauaaccaagaugaugccaggugguuaaugagcagguccuacuagcagccugauaugauggacaaaggaugguucacgucuggggcgggaugaagcagacuugcaagauuuuuauuauaugacucagaacagcacacggcuucaaacucaggaaucauuuauuuucccauuuaacguuuuggggucuugguugagaguuagugcuggaaccauggauggcgagaacucagauuggaggccuucugcauuuuagugaugaguggcuaacuaggguuggugcauguuggggagccacugagggagccagucugaugcuucucggaaguuuaaauguagaauuuccguaaaacugaugaauucuacucccaggagaaaugagaacauaaguucccauacguuguccacagcagcauuaucugugauauccuaaaggugaauauagucugacccagauguccaccagcugagugaaagaaaaacugugauauaugucuacaauggaauauuaccuggcaaugaaaaggaacgaaauguugauaaugucacaaggaugaaccuuaaaagauuuauuuuaagugaaggaagcuagucacaaaaggugacccaauauauuacccugcuauuauucagaggaggagacguucgugaagauagaaaauagauuaauuguugcccagagauggagugggcaugguggugauggcggcuagaagauuggauagaggagcaaguggugacugauuugugaacugucuccauaaagcugucuguccuucauguucuuuccaccccagcagacaugcugggaagacccacacucacccuaacaaaugaguuccugaugguagaguugcgaagagaguggcagacuuccacacaauuauuuuuuuuggaaacguuggcuuuuauuaguucaucuucaauagaaucuacaaggggaaacaggcuugcuuuagcacaaaauuaauuauuuagcucucagacgagagugccaguggaccuagaagugauuuccccccucagcauuucuccuuuucuagguuuacuuauuuauuuuuuuauuuuugcuaagggcugcauauuauuacuuuuuguaaauaacaagcgaaaaauaaacuuucaugccguacauauuccucuggguuauauauggcuuccaugugcugagcaacuuaaaaauuaaauuuagaguuucuauucuaggaaaauaggguuuuguuuguuuguuuuuuguuuguuuguuuuggguuuuuuugggggguuggggggggcaaaagagacuggucucauaggugacgaccugacgaacccagugaggagccuuugcuuggagccuccugcuuuuuaucuucuuucuuccuggccugccagaucacuaaggacgugaccaauucucaucauuuugaccuguauaaacaugcaugaacuucgugacaaggaggagauuauccugauggugguggggccaagccaucaggccaguggaaguagagcuguaacaagacacccaggaguccagggaaggcaggucagagugucuguguuccuaagaccgccguuucacugugucaucccggcaugcgagccggccagcauugcaugugcugcaugcuugagagaagagugugcagccacacagucagauccagcgagggcucucagcugugagagcugaacuaugcguaguuccucccuaccacacagacacuggcagcaggcagggugaccugcauuccuagggcuggcagauccaucucugggccuucaaagccuuucuguucagagcgugcaggggcaucugucugcaugugaggucucucugccacgguggaagcaaaugaaaggcaguuccacagagugccugcuccaggcaccccaucuacugaacuaccugcuuccccgccugcccacagcccuguggcuccuuguuccacccagguccgcagagcaagauuccagucuugcuguuagacuuaggaagggucuuugcccuugacaaaucacccuucaugagauuucccuucucauuaaaaaccauguguaucugagugcaugcacacguguguauuuguguaugcauuauuacugugcacauguggagguaagagaacaaccuuccaaaguuaauaaacucccuucacgugaguucuucggugucgggcuugccagcaaggccuuuaucagcuaaaccaccucacuggucaacauuauuuucuagccccccccccccauuuauuucagaggccuuuagaguaagaauguuuuccaguaaaacccagugucuccucccaccccccauacccugaaaaucguauuggaaguucacauagagaagagugagcaguugauuggucaugaggacugugcaaaagggucuagaagcaaagagcuuaggcaggagauguuaggauaaugcaagugagugauacagagccuggguuuaggauagaggcgggagagaagccagugcauuccagauguauuucauaggaaggcaggaccagggcuccuuuguuacuuggggcaaaauaauaaugacuuuguuucauuauucuaauugacagcucacugugcauauguauaaaaugaucacuacugcuucuuacugacauguuucacagugccguuccuacucugucuuccagguaggaucuagagaagguaaaaagcuagcccaggaucacacagagugcaccacagagauccaggucugucaguccagaggccauugagcaccgaagccuaaugaaaguguaucagaccuuuugaauuuaugacugagauaaaaauaguuagaacccuguucucagucauagccagaaaauuaaauuggaauuuacacagcuuuaugauguuagaucaaauauccagacaaaucuaaaugugugaacccuauaaacucugagacauugaggcagacggagacuaggcuuuggggaugcggggagagggucaugugauuugugcaaagcagugaaaauauugccgaauuccuaaacuguuucuggucguauuuuucuggauaacauuucguggauguuuucuuccaacugauuaaaaaaaaaaaaaaaaggaauggccuuaauuaaaauuucuauugucuuugccacagaggaaggaagacuuugggugguugucauggugaugacugaaugcucugggaguagggagugauugccacccagagcccugaaaugagcauuugccauuuuccucacccccugagaggccuucaauaccaaacugcauauuuccuuaaucgccuuuuaaauucacaucugagccacaugugugccugcaagggcagacccucccacgacagccgcaguugcaggcaugaagucugagucccuuucuaauugcucuguguucccaaagcaaaagcaacacgugcaaggugcucgugagaacucccagaaggugauagcagccagcagccuuuuggacagaggugccauccccacagcccuucccuugaaugcacucaggagccuugccccggagauaaugcugccaccagaccucugccaucgccgcacaguggggacucugcagccaccacacaggaugcuggcagagccauaguuguagacaguaaagacaggcuagcugugggguuucuggcugacuggcugugguggaaggaggggaaaugcagagcuuggugugugccucugagucgggaguugacuuucccaguguaagggaaacugaggaagaacaaaugaguuuucugcguuucucuuuugucuuacuucucucuaaccuccccccagaccauacaaguguuauguguacaguacaugcgcguggugugugugugaggcuagaggauaaccucaggcguccuuccucagacacugcccacuuuguguuugaggcuggcuuucacacuggaaccugaggcucacugauuucguccagacuggccggguggucagugagcuccaaggauccccucccugccuucccuggcacugagguuaccagagcgccaccacaccugacuuuuuacauggauucuaagaacggagcucugaaccucuugccugugcaaauacuuuacugacauagcaacuuucagcucuauuuauuuuugaaauaaaaucuuauaauauuauucagacugaccucaaacuccuagacccaagcguccucccaccccaggcucccccagccggagggacuagagcugugugcuuuugcacugguucacaugucuccuuuagacaguugaguaaguucucuuuuuggcucaaccagugcccagguaaaccugggaagggguagacuuuuguuccugucuguagaugguguuucuguuaucuuaccuugugacuggugggcccaacucccucagaguaccguacugaccacagcccucugccccuaugcauuagccaggauccugcccacaauucgguuucuucugcaguggcagguucucccuuggagcccucuguucuugguugacugauuaauagacacuuggggacuugcagggaggcauuuaacaugcaucagauaccaucacgcagccgagaaagccauucacugagcaagcucucugcugucugcgucccuuccugcccacauaguuugacacuggggaacagagccuguauugggaaaggcuucguuucaagaugugauucagaggcagugaugugcagcugucuguagagugggaggcgcgaggaaggaugcugugugcacucauuucuuuacacgguccucuucaaagguaagaggccuugcuagugaaagaccaccagcaaguuccagacuaucuucaugcaguccaaacugcugggacuuccauggggaaguagaggccugggguuguuuccagaggguggagagucuaguaagagcaucuucuccuuccuucuugccuuggcaauauaaagaauugauuuuugccuuguugucuuuuuccuuucgggggugggggcaggagcucauguagcucaggcuagccucaaacuugauaugucaccaagugucacuuugacuuuuugaugcuucugccuucaccuccugagugcuuggauuaugggguaagugcugauguugcaagaugugccagggauggaggccaagggcccugugcacaauggccaggcacucugcaaacugagccacauccucagcccuugccuuaaugucugacggagaauaguccaacauuugcgcccccccccccccaagcuguucgguuagagggccuggguugaacucuggccccagcccucucuagcugugugaucuucuacaaaucucuuagugguucugauccucaguuucuuccuucaugaaacgaagagaacgguacccgccuccuaggucauauccaugugggagaggccuggaguagagugugauagagagagugaugugcgggcugggagauggcccaaugguuaggagcacuuagugguccuccagaggaccuggguaugguuuucagcaccuacaucugcuuguaauuccagggagaccuaacacccucuuuggcuuccauggauaccuguacucaagugaauauauccacaugcagauacauauaaauauacauagugaaaaauaagaaaauaauguuuuaaaagauuauauauauaugaguacacuguagcugucuucagacacaccagaaaagagcauuggaucccauuacagauagugugguugcugggaauugaacucagagccacuggaagagcaguaagugcucuuaacagcugagccaucucccuagccccaagaaaauaaaauuuuaaaauaaaagaaugggcuaugcucacuagaguuacuguucuggauacccaucuuucauugguaucuaugucuaccaccagucuccaguuuugacucucugugggagaagucugagacaccgacauggugggcucccugcuggggcuguggagcaucuucaggauucccucgggugggguggggugggguggaccccaauaagaaaccuuguggccgccuugcugccagauaucacaucauggagaagcuuucuauaaaguguccacacugcuggguggaaccaaaguuugagcccaguucuggcuucaggcucacuuucuuccacuaacugaugcgucccucuuacccauuccucucuccugccccaauuaaugcuugaaaaucaaaaggaaaaaagaaaagaaagaaaucccagaaucaagcuagaagauucugucaggguguugccaguguggucaugguguguacaguggaaacucuggguucuugggguugcuguggucaggccccgucuuccugcuguguuccucaaacaggacucccuuccugaauggacacaauugggaaauaaaacaggaaacuguuuagguggggguuuccgaagccaucccauuccacccucuucugagagucugaguccuuaguucugagguagaguggggcccuccuucccugaguccugcauagauagcggaccaaggaaaaguacuguucugcagguccccuccggggucuccagaacuguuaauucuauggcuagaagucccuuggaguggaugcauaguaaacgguaggcuuagccaggcaggagguccugacuggggagguugaaaggugcuggguaaccugaucauggggaccagauaggguacaacacaggaguuacuacaggagacuccucccauuggaauguggcuggguugccucugacaaccugguaaacaaaggccccaugcuuuaauuccuggagauguccccugggcucugggcacagugagccuucagaucagugauucuuuuuuuuuuuuuuuuuuuuuuaaauuuggcuuuucgagacaggauuucucuguguagcccuggcuguccuggaacucacuuuguagaccaggcuggucuugaacucagaaauccgccugccucugccccccccacccccccaagugcugggauuaaaggcgugcgccaccaugccuggcucagaucagugauucuguaaguuccuguaaguuccaaccccuugguagguggggcucaaaugacccuuucacaggggccaccuaggaccaucggaaaacacaggcauucuuaggauuguaagcaucuugcaauucaaaacagcagcaagauaacaguuaugaaguagcaauaaaaaguuauuuugggcuggcgagauggcuuagcggguaagcgcacugacugcucuuccgaagguccugaguucaaaucccaggaaccacaugguggcucacaaccaccuguaaugagaucugaugcccucuucuggugugucugaagacugcuacaguguacuuauauauaauaauuaauaaaucuuuuuaaaaaguuauuuuaugguuuggguuacaaugacaugaggaauuguauuaagggguugcagcacuaggaagguugacaaucauugccucagaucuguguguugauuuuccccagcccagccugcccuugacagagugaagggccaaagucaggauguaguagguuacugaguacgguaauguggauacuccugccucuuguugcuuuccucauuacgaugcuguuccuaccugcaaggcuuugggcuguuuccuggguucuagagagacaccacuucccugccagcaauuucucugguccaauaauguggaggaaauucuagaggggaaaaggaauaaauacauuucuagauuuauuucucuuauguuuuauguguaugaauauuuugccugaguauaugugugcgcaccacaugaaugucugaugaccaaagagcccagaagagggcaucagcuuccuagcaccaaaguuacagacaauugugagcugccccauggcuagcuuacacacaugcaggcauguacucacacgugugcacuuucuuaggaacacauagaaguagauaagaacauuugguguaagaaugguaugaaacccagcucccugggagcaggccaggaguuaucacuguagcucugcacugggucuugauucugcuucccaacaaguacuagugugugcucagaaagucacacguugcagagauggcucaacuuagauaaucauuaaacucaaaggcucccagagcuagagaguagaaagugggcuccuuagcucauggcaggacugggcucuccauucuuuuauuucuaagguacuugguaagugauuuguuuugugguuuguuuuuuuugggggaggggguugaaaaugcacaauagaggcaucuagccagugauggucagaggccauucugauauuauugucacucaguuccuugaagagucuaucucccuggaucucaguccacauauccuauuucaacagucuuggaccccagggaacaaagcagauuaucucuacuuucuuuuauuuuuauuuuauuuuauuuuuagcccucuagaguugaggauuggaauccagggucuuaugguuguuaggaaaguacucaaccacugagcuacccaaacccccaaaccacacagaacauuuuuaaaaaguuuauuuaguuguaccauaacaagaaugccaccugucaucccuacuucuugauaguccguccagcugucuuaguuacuauugcugugaucagauaccauuacuaaaagcaaccugggaggaaaggguuaaauugguuuauacuucaugucacuguucaucaucaaaggaaaucaggacaggaacucacccauggcaggaaccuggaggcaggagcugauguagaggccauggagggguacugcuuacugcccugcuccccauggcuugcuuaguuugcuuucuuacagaaccaggaccaccagcccaggggugaccccacccacaaugggcugggcccucccacagcagucacuuagaaaaugcccuacaggauugccccucauuugagguuuccucccuuacagacgacucuggcuuguaucaaguugucagccauuuguccagagucuucccaggccacaaaaguuccagcuccuucagugauaggagccuguuugaguccuucacaguccuggucccgaucuucugugcucgcuucagcuuucccacuuggcugauagguguggauccugagaugggcaugauauugaugggcuuugaccaguuaaaaauguaagaauaacuggugggggugggggagcagggcggggcacucgccuuuaauccccgcacuugagaggcagaagcaggaggaucuuugaguuugaacccagcuuggucuacagaucaaguucagggacagccaaggcuacacagagaaauccucccuguuucuaaaaacaaaaaauaaaacuaagaauauuuaaucuuauuuguuuuggacucuguucuaguguuaagugaguccaaauaucuagugauccuccuguaguuuuuccacacuggacuaauuagaucuacaguuuucuagaaccuuaggacuaaggcagauuguguucucuaggcuaucagaacaaaggcccauaaauccaaugccuucaaacaacagaguuuuauuccuuuaucgucuuaagauucuggaggucagaagucaguaugucagcaggcuugguucugucccauacuucugcuucuugcuguaucugauggcagaaguugaccucucucugcauuccuuggcucuggauguguaaccucuguccucaugugacuucucuccugugugcacguaugugcacucacaggccccucaaauccagaucuaccuuucucugguucuuaugacguccagagacuagacauagggauuccuacuucucaaaugucuuuuucauguuugggaguggaaaugagucacuggaagauggauuuugucuaaggcaggaaauuacuuaaaaacgaaguaggaugggcuucccaccaauccuguuuucaggaacugcuguuggcgugcgugguuccauaauuccugugaccuccagccauucucuucaccuuccuaggccuguuuccuuaucacagagcagagacuggaugaggucaguuggaguagauuucagcucuaaaaucuuuugucuuuuaaaaaauuaaauuaaaguuuuaaaguuuauuuuguguguguguguaggcuugucauaccaggccuguggauggaugccagagaacugcuugcagcaguugguucuuccucuacccgugcggauuugaggaguguguaaaccuacuaaccaucucucuggcccucuaaacuuugaauacugugauuucuggaaaacaagggcuacccuacuaagaaaacaagucacuccaauaugacuucaucaauggggaauuugcugcucuugacuaagacagguuaucauuuguggagaucuaaacagcuuuccuguuaaucgucuuugguaggauauaaggucugagcuuauacuccugacuccauuauaaacuguugagauggggggaaacacaggguuggaaaguagguggcucucagauauuuauguauugagugagugaauggcgcguauaagcugguuccagucauugugaacagcaucuuucaggucuugucaccuaguaagagccuuuuaagauucuuccugaaugcacauuaguaguggcagcuuuuucuguggcuuucuggacccaggaccaagcugucaaggacuauauucugaccugaggucuaaaugccauauucaguguuaggggaagugagcggucuuauccagggagcacccggccucagagaugcuuuucuguucccagaguccauguuggcggucuguggggacuuuuggugucugucaucagaguggcauccacuacaaccucuagggaugaugcugguggcaauuugccguguaaucuuugguggagacgggcaugguggucuggauuuagcugugcugucgccuaggcauggaagauuaagggcaaguucccaguagccacuaagauucuuccaaauaugacagaugguauaaguuaguagauuuguuugcuugauaagaaagaaaauuucuagccaauuuuugccgucuuccuuugguuccuacucucaugcaagauucuucuaaacauacuugcuaaaggaaagccuccaguugucaguacugugugccccagccccagcaggugcacccagccugagguccagggcguauggccaaggacagcuaugaaguuggccucgcacagaguuguaaacuuaaguaaaacuugauuagguuauuuuucaaagacuccauugugaacuuuguaggugacagcacagccuugugucgcaaguucagaggguagggcucgcugagcagcucuagcucggguguuugugcacucgcucguuucuuaacgacucauaccaaggcuuugucuuuuguuuuccccauucuggcugagccauggauauaaagagguuagugugagaaaacugggagugugcaagugaugacagaugggcucccaggucaacccugggagcagagggugugguggcgaccacagcgaccacaguaagcugaaggugggucugcuuggcagccuugcaauagugcuugcuuuuccaaggugaccuggauuugagacauauaugugaaugagaauggcauuuuuggcuuuuaaaauucuacuggauuuuuaaccuccuuggaacucaaauaaaacuuguccuggggucauaguaguucauagucaucagugugcaaugccugcuaugugucuggguagguuagcauaugggaugguuccagggucaucucuguauaaagggugcugagggcccugggagguauauggaggcggugcuaugucuguuuuuugcuguggacauggaggaguccguguuauuauauaaaguauaaaaaacaacuugaggaacauacauaguauuguauguauauguauauacauauacauuuauguguauacauauacauuuauguguauguguguguguguguguguguguguguguguauguguagguagauauguagguagguagguagguaggucugggaacaacuaaugugagucaguucucuucuucuaugggguccuaaggacuggauuuagguagucaggcucagggggaggaccuuuaccuguugagguauuucacugaccagcuaaaaauuuaagugccuaaggauuccauaaaugcaaacagcaauaauggcauaaggauuucucuggcacaaguauuugccagauugaacaguggguuggaggcaggaaagggguuuugguuccuacccuucuggaauaugcagcucuugagucuguuuugaaaagcaaaucagaauuugggaacuaugucauucuagucuaagccuucaggugucgcuuaggccugaggugaccagaaagggccacucagaagaaaacagaccuuggaggcuucccagaauucagcagggaagaugacagcuacagucaugcucaggggcuggaaagacuaagugacuggagcugguggacaguuaaucuggcaggagcuggggccuauggaguugugagauagagaggcaaggugggugaggggaggcagugccaagaaaucugguuuucagcaccgcugaucuggcagcaaggacagccaggccagggucaugggagcagggccacugggcagaguggagacagucugugugucccuucuagcucucacaugccugucacugaucucugguugggugcugcuggugauggaggguuaaacccaggcaccugaugacuaagcccaggccacuuccuguuccugcccuggcuccuuggcaucugacccacuggggccagagguggccuuugccugaaguguaagcuggaaaacuaagcccccacuugcacuaacuugaauuuuggucaugugauuacagaagggcucugggcuacuuucagcucugauuucuuuauuuguuaaauggaaauagcucagucuaccuucaaagguuguugcccuuacaacgugguuucuaaauauagccauguuucaagcuugcauuggacaccugcuccaaccuggguguguggcacagaugaccacaucugccuguccuauuggaugugagugccaguauuacggggcagauuaugcaguaauuguuuauccccaaaguacacauaaugcuaaacuaaacacacaguaggaccaaauaaguauuaaccauaugggguuugggcuuguaagccucauucagucuucauagcaauugauuuguaguuaauuaugaucuuuuguaguuaaaacauucugucaaggaagacaauugugaggcuggcuccuggccgcucaugauuuuuuuaaaaaauauuuuucuugcugggcgugguggugcacgccuuuaaucccagcucuugggaggcagaggcaggcggaucucugaguucgaggccagccuggucuacagagugaguuccaggacagccaaggcuacacagagaaacccugucucggaaaaaaaaaauuuuuuuuucuuuauuugggggaauaaagaaaaaauguauacauguauacaauagaaacuuccuguuucugccugccaacuccucuuguauauuccccagugugcccccucccaccucaugucuuuuauuguugucuggauggcccacauaguccaguuagugaugccuguauguggauggcucuggcccauucaauggagcgcccucaaaaugaauguucuuccuccaccugcugucugucaguaguggcuccccguauaaacuacaugacuacuuuauggugugguuaugggggcgaauuauauuggagacaugaaagacagagaacagccagaggcaucuggaauaguccagagcagagaaagagaguucagagcagagcacauggcuagggcugugugucggagaguagagaagagcaagggggagagagaauagagaaggagggagagggagggagggagggaaggaaggagggagaaaaagagaaagaaaacacacacacacacacacacacacacacacacacacacacacacacacacacaagaaauaacagggcuauaaggagacuaaguagcugguggaaggguaucccacaagcuggagggaguuuaguguagaggaggugagaaggucuagaugugauacugagggagcccgaaggccagcaagcuuuggugugcugacagacaccacggacagccauuugucccuucugcaguaugaagagaaaugacuccuuuuugguagaggguaacuuuuuguagaaggcuuuggcuucccuaguuccuggggaaugcuggcucuuaucuaaccugcagaaauccuccaguagugcaggcugagccccucucuggauaucugggcugccuuuuagagucgggggaucagaguuuccuuuggaccugacuugccuuaguaaggguugaucucuuucauuuugcagugccaggcucccauucuguuuuacaacuuguuuuacuccuuuaaaacuauuuaaaaaaaaaaaaaaagacaacaaccuggauuucaggacccaaagcuuuuaagaugguaacagauacaaauuuuagaaaaauugucacucuaaacagacugagaacaaaauccccuuuauuuuuucucaguaauuauuucuugaucuccuacugugugccagcauguggcaaacucuagagggcagccuuguaacagucugcaacccccucuccccuuuaaccuggugcagcuaucucaccuaccccgugaucucuguagguuacaacgaaaaagccacuauuggucugugaccuaccucagugucaguuucccuuucugucuccuccuacuucuuuugggagcaaaagcuuccugcuuaagauuuguccugaaggagccguagccauucccaggaaguucugaaagaaccuuggagcuuuuccaggcagguagguggaugugguagcaguguucuccaccaagaaugggcuugguuuuagggcugacuuuagccccaugcugaauggagaaaacucacuggauggcucuuccugacguuaugguuagagacguuaggcuaugucuagaugcuagagggagccagccucacaggcuccaagaacacuuugggucccauugccuacagugcuugccuggcugugcacagccaggcauccucauucccuuuggccacaggggguggagccucagagcugaagcuguguuccugccugguaucugguuuugcuggggcguggagaggaaggagaaugaaugagccggggccagagugacugcuggauuguaacgccugguagcagcccuggagaggugaagcugagaaggagagagagagaguaggcagcugggagccuuccucucggucggcccugagcagagagggcaguuucaugagacuaccaccaggaaagacacaguucugaacauggggcucaaagcgagugcgggccugucugcaagaagagaacaggugagucccguacgggucuguaaggauucagugggcgauauauuuugguuccugaaguuuuagaugacccaggagugccucugcucagcaagaaugccauuuaauuaggaaaaguaggacaaagguguccugaacucuuaucucccucauguucuuccgaacaguauccuguuggcagcugaggaggggacagcccuuuguguuuuaaguuaccuguacuguuguugaacuucagucuggguuugggcggauggcaggaguuugagaagaaccucggucaccuaaaauguccucauugccugggagagucuuauaacaccuggccugccuucucaaguggcugccaagucacuggccuagggaagcauugaauggaauuauaaauggguguccugagguagaaaaugucuuccuuguaauuucaguacucugugucucuggccgguggucggggagguggguuuucuuggccuguaguuucugcaccauggggacagacccucugagggacaagggugugccugcugaucugaaaccauuuugucuggcaggcgaguucuuuaaauagauguuaacagugaucuggggguuguguguucuuuaacucaaaggaggaaagcaugugcuugggucuaagucuuugcaggcuucuccugcuggaguugccgcacagagcaaggcaggucgacaccucaagagcaguucauagcaaaggaaaagcucagcaggccccaaaugcggaaguguuuccugacggccuccucauaaccuugcagaguugguuuaucuccaccgucuacagauaagcccagcccucauccacucaucccaggucaugcaugcauggagcagggcuaagguuugaacucugggcuguguccaaucugaucugccuggguggccucugcugauggggagcccagggugaggaaaccggagcccugagcgguugugaggaguuacugcuaacaaggcugauaccagcuucuauuaccuuguuucucugaaaacuuccuuccagaaggggaugggcugucugccuuugauuuccucauucuaguaggaguuugccuuuaaucuuuucauucaugagcacaggaagccaaaaugaaaacucccuauucagcagguggaauucuagguaugcagcccuuugugggaugugggguacaggcaagcuucagccagucagguggcuugcuuggcuugggagagguauuuuacaaauggaguggccacugaguggaucugaaaaccuagagagagagagagagagagagagagagagagagagagagagagagagagagaacacgcaagcuuuccagaucauacuaaaagccaucacucugcucugagcaggagaugaggaguacagaaauaccucuuuccaagguuggcagucaccaugugacucucuuagacucucucagugccuuuugacacugaaaaggcaguaguaccagagcaccccucagcauucaaguuccgccuagucugggguggguaugaaugagauggggacaguguggguacuaggagcccagcacugcugcauuucugguccccagggcugguggguauuaccagcacuggcagaggauucuuugccagggaacccuggcccacuggcccaucccugggacuuuaugagauauugauagacucuacacagccucuugcugaagguggcuggugcucauucccaggcuguugagguaauaguucaggugccuuccccaugagcaucccuccucccaugcaggaagugaagugcagaggauauacugguggagggagcagagaacaaagcaagagccuucauagcugucucugagcugagcuuagccccacauucugucucguucaugaaaaggagacagaggccaugugcucccacccugaguguccuuagcugcucagcaguuuccuuucaggcgcuggauucaugccuuucugcacugagggcauuaaccuucaccuugggccugaggggcuucugguguguaagugucucuuuauucugcccauagaaggcaccuacauccugauggccaauaucuguuagguucuugucucuugagucugaauuuuugcaggcucagacagcucauuuauuucacuugaagaucacaauccagucccccaccccuuuuccucauccauggagucgagaaauacuugugugaguaccuccugggugccagacaccccuacuggcugauacauaagugagaaacauuacagcuguuaauagcugaaauuggcuggugcgugugaagugacagugagaagggcccaggaggugauagcccugcccaggucuaaaggacaaggugcuagcuccauggacacagacaggcaaggagcaugcugacugcgaggacacagggugccaaguaagaaaggccugaguguugaggaaaugaggugggcagggacagaagaguauuugaagaggcugcugcuaggcagggucagaucaucuaaaguuugguuugguuugagacagauucucaucauugaggaucuugaacuucugauuuucuguuccaccuacugugugccagagagccaguuuauguguccaccuacugugugccacagagccaguuuaugugguauuaaagauggaacucagggcucaguggguguugggcaagcacugugccaacugagcuauagcccuagccugccuucuaggaucuuauaagccaaggcaaggagugcauuuucacugugcaugguguagugaggcugucacgaucucucuuaccuuacaagacccgagagcuuccggugaagucacagaggcugagacagaagaagcaaaagacgugccuaggagcuguuaccaagacuacuaaccaggagacaaaagaugagccugcuuguuacaaggcaggaaucacaguguacuugagaggcugaggcaggaggaucucaggugcaaggucugccuggagaacagagugaauucaagggcaaccuuggcaacuuagugagacccugucucaaaguagaaaguaaaaagcaggcuggcgacaccguugguuuuuuaugacagagcacuugcuuccugugcccagggcccuaggugcgaucccuugugggggaugggcuggggcugcugcguguaugugggucaaaggcaagcagauggagaaggugaggggaugcagagcaucuuugagaagaagccaguagugcucacaugugcaccacagguggaaguuaagauacagaaaggaacagagaacgacuccgguguuugaggccauugcuacgggaauacuugcuuuggggugaaaaggguuuauucuccuuuuguuaaaacuuagaugucuguuuauuguuaccauagucaagucucagucagguuaaacauugagcaccuucuguaugcuaaguguauaugccccuuuauuuuaacccuucuuuaaaugucuuaggaacauuugagaaucgcacuuguaaugccagaaccaaggcuuggaagaggugaggaagcuugcuuuaaucugaacccagcuucagcuccagcugucuggacugagugguucccaguguugaaagagauggguuagugcugaguggauagcuuccccuugggggacaggauggggccauauacuggcucauucaggauccccuggcuacgggaagaggggcugucagaggaguggcugucuguagcgagcuguugucaacuguggcauauuuaaaauucugcaaacuugaaagaccauucugccacauuaugguggcacuuucuguuaagugaauaaauuaguaaaagugcuaagcaaaauaaaccaaaggagcuuaggaaaugcaaaggaggcaccgcucaucuagcccaggcuggccuagaacucacaaguggcugaggaucgcuuggaacugcucuaccuccugagugcugggacuauggaugugggccacuagcuuguuuauggggcuugggauugaacucacagccuagugcuugcuaggcaagcacucucccaacugagcuguauccucagcucuugaagauaguuucuccuguugauuaccaccaccucuccauugaguagcccagaugagagccccuguagugaaggcaauuucuucucaugcuuggaguuucgguuuuucagcacuauuaggugacccacaguccauaguucuguugagacacugaggacaaagauaaaaugugccuuaagaagccuggaggcaaugcugaagucagccuuagccugaggguaacuguucuacaguguccugggaggcacauggaaggguuagaagguuggggacaggggacugacaggcucugcucagcaugcuugaugaggccccuuuugacuuuggccagauacuuuccuuacauuuuaagcgguuucuucuuuuuauagcugggaacagagcuagugcugacagcacaucugucacacuccacauaccaaagccacaaccaucagaaagccacacuuaacagugugcgcuuccuucuucuuaagcaucuuucacagcuuuccagagcuccuugaguuaaaaaaaaaaaaucaauaaaaaauaaaugugcuagguaaauaauuggaacuuuuagcuaauugaaauauuuaacuaaucaaagccacugcucauucuuuugggggcaggggauaccuguuguugagacaggcuuucuauguguuguccugacuaccucagaacuuacuuugcaggccaggcuggccucgaacucagggaccccccugucucagccuccugaguucugggauuaaagaucguggcccucuggauucuguuaucaaggcucuuguguuugcugucgcacucuguggagccaaucucaguccuuuccugccuaggacuuuugugaugugugcuuuuuuaccuggguacucacucuccccucggugcucucugguacucuccgggucacauggcugccaggcccuucugaaaggcugguuccaggaggaagaugggauuuuaagaaagaggacuagauuauguuuuaauucauuuggcagauugcuuucuugguagccuaaagcaaagcagcaacuccugugugaagaguuucuauuccuaugaaaucagcucccggcagggccaugccugcaaagugggaaggugggaagucggguuucagaacagguauuucagggaugugucaggacaggccugcagauuguuucuugaguuagggugaugggacaugcgcgacuuugugggcuuuagaaucaggaaacagacuggaguuuuagguccaaagcgggacaacgagugcagcgugagaggacuccaagcugauuuaacaggcagccuucuuugggcaguggugggccuggagcuguguagggagcagaguaguugacugagucuguagacaaguuaucuaccucuugugggguuugcuuuucucccuaaaggccagaugacagcacauaaccugcccuacugguaucagguugaauggcauagucuagggaccuuaccuguccuuuuguucagagugcugagccagaagcucugccagaagcaagcuggguacauucagucaaaacucaggacccauuuaucccugcaggccugucuccuuucucaauggauaucucucucucucucucucucucucucucucucucucucucucucucucucucucucaagguuuauuuauuuuauguaugcuagcacacuguagcucucuucagacacaccagaagaaggcaucagaucccauuacaggugguuucgagucacaaugugauugcugggaauugaacucaggaccucuggaagagcagccagugcucuuaaccucugagccaucucucuagccccagucucauuucucuuauuuguauuauggaaauaacaugacccguggcccugaccuccucgguuaucugagaguauuggacaggaauugaugaaugugagcaguuggaagcuggaaggacugaugcugaggcuggcuaugcuggcauugagggcagcaugcauauuacagaagggagugugugaucgggcaacagcuguuugugugugugugugugugugugugugugugugugugucaaccuaacucauguuccuucuaauguuagggugcuugcacuuuugauuucagcaccagcaucuuguagcucaggauucaggagcugggacucugaauuacaagugaugacaugaguuagggcauggggagcagagugguugcccuuaggguugauguuauauugagaaaagguggccacuggcugcuggaucuguuccaggcacauaaaagauuugcccugugcuccugucuaccagagaguccauuggcugaucuuaugguaggaccaggggcugcuuggguuauacugaucgccauacaaguauccuucagaacuuugguccugggcacaagggagaugggggguggggaguaaagguaagcucuauguucugaugcccugcccacagggcuuucugaccauagucaggaaggaagcagccagucucugguuccuaagggaagggggcaacagguagaaggcaugggauuuccaaucagagccuagguccaugcccugucuuaacacucuucccugaaguugucuuguacacagcucucaccuccacccagcuuucucacuuagaaaauaaggagcugauguguugacggcugagaugugugagcaaauguuuuguggacucugaagugcuucugagcuucagaugugagggaugcugcugcuugcuuguccccccgugagcaagacaucuuccccccacuaggcugaaaaugggacugacccagaguuuguguucuccaggcuccugguuaaaaacaaaaaaagcugugugcacauaaggcccagcucuuggacgugaugcaaggcugucugaagcagguguugcaggggcuacauccuaaaguggaaagcugcuuuuucgggaagcccagacugcugccugccugaugaggucauaggauucuguggguuggguagcaacaggaauugagaagccagcugugccuggaugagugaaggcuugguagggguggggcuggggcuggaucaaggaacaagcagccuggccugcuggccuguuaguuaguaccauggcugcuccggcuaccacugcuaagguuacuucaggcaccaggacagagcaagggaaaucucaugcuuuuagacauugucuuucuaaccuuugugcugugccgauuuacauacacuggccuccagagaagccagugcucaauuagggggugaagcuaccaucuuaaccucacuaaaaugagaugaucuacuggcugugacggcaaaaacggcucuccauugccuguguuaagagcuuuuaaaagggacuaugcccuuugauuuuguaauuuuacuucgacgacuuuaacucaaggaaauaauuggaauuggggcaagggggcaucuaugcucaaagguguugauuauaaugggagggaaccccucuaaaauauucagcaucagaagagcacgagucuaaagagaagcaccauggggccgggggauagggaugcuuuugugccccugugccccugccccucagcaaugccucgcacacaggcaaguuguaugaaaaagauuauguccauaugucaggcucuguuacucaguaaauuaaaugaaggcguuggauggaaguguuucucuagcaucaguuagaugugauauuaaaaccccaguggaaaccuuugcuuuguauguugacuugaggauuuaaaaaaaagaaagaaagaaagaaagauaacaucaaauaucaaaacugaaaaaggaacauauuuuuauauguagaaaaaucacugccaacuugggcucagcaaguaagggcacuugacacucauccugaugaccucgguucaaucucuaggaccuauccacaugguaggaaagaaacgacuccugaaaguugcccucugacuucacaugugugcucuaguacaugugccccccaacccccaaaucccaaacuaccuuggaaggagauuuccagauauauaaugaugcuacuggugauuuuugguauuuuuuuuaauauaaaaacuugaaagcaacucugauuuaguucuugggaaauccuuuuucaguccaucacauucucuuuugagaaaggagauucaauuauuugugaaacaagccagcagccuccagagccagcucugcaucuucugaagugccaggcaguuuuugucagaacacaaggcaccuucacacuggccgagucugucagccuagcauggaagcagccacuccugacuucaaaagggugauagaagugccuguguguuggaaccaugcgggucgcgcuguagagacaugcccauacguuuauuaucccuucagugaacugaagacaucugguagcacugagaggaauuuuaagaagauaggacuugcagggugggugguuaauucuuggcauucucucccuggcguccaguucagggaagcuguugaaagcgucgccuguuuuccuucauucuuguaucagcuuguacuaucguaagggcuuuuccccuccccuccccuucauguuucaguguauuggaacuuagugaaauaugccuuuaagauauuguauuuuccuggguguggugacacacaacuauaaucccacuacguacaaggcagaaauagaaggacuguccgaagguugaggccagccuagucuacacugaaguuccagggcaggcaaggacauguagccagacccuguuucagaaaagaaaaccaguuggacacuuaggugucagaggcaggggaaucaguaugaguuugaggucaaccugggcuacaguguggugaguucuagccagcuauguuccuccuuuucugaggaauauuugauggccagggcccugggcaugcugacuuugguguccuuguuguccccucauugacuugacuucuucuucucucucuagccacaaucagcagacaacaacauucaggcauccugugacuggacaguuuucuucagaaaacagugaauacguucugcgggaggaguaaguauuuauuauuauuauuauuauuuuauuauuauuauuuuuaauguucuccuuagucaggcagaguuugaaagcuugaagaugugagcccaacaccucgcuugcuaggcuguuugugcuguuuugguuuguuguuuguuuugugucagguagagggggcuuggaguggcuggguugauuccaagugagaagaguuuuauuucucaguguucacacgucuggggagaggaugugggcggagagggaggcugcaggacguucuguggugguaugaucagagccuccuaaaacacccuuucuccugaaacaucaccuuguacacugugcucugacgacacuccccaccuggugggaagauuguagagcugagauggggcagaggaucccugcgggaauuccuagguucuugcccugaacaaggaucuggacagagauaguggauaauaacagaauuguuuacgaagggagaaaagcuuuuccacggguagaaauagaccagagcuggaaaaagauccaaggcgcaauggcagagauucuaaacagaggaucgggacuguauagucuaguauggugggcuuuggaucuuuguacaguccacaguuuucuuugcucuuuuacaagucaaccuuccauucuuucacaugcuaauuuugacuuaauuuccauccuacucucuugcuacaauuguacacauacacauaaccucuaggggcaucaaguaggagcccaaagcuggggucucgaggagaggaaacagaacccugcuuaucucaguggucuucagagagaaaacccuagucacaggcugugcucaguguguugaguggaccacgguugcuauugcauagagguucuaacuggcugaucugcaguaaccuuaggcuugcuucaaagacaccaggccuccgcuccugucucuucuguaggacccuucuccagcacuguuacagggccgcccugcucaugacugggucacugugcugcucuucugaagcuucuuccugguuuucugcaguuauccgcaugggucuggccuuugguggcuguccuaguuuuauuucuggagcuguggucaagcaucgugacaaaaaagcaacuggugagggaaaggguuuguuucagccuacaguuccagguuaccgucuguuaccacgggcgagucacagcuccguuucuccagucuuaacagaguucaggaccuucucugccuagaggauggugcugcccacagugggcuggguuuuccugaaucaguugacuuaauuaagagaguccccaguagauaugcccacaggcuaacccaauguaaacaacuccucaccuagacucuccuugugagucugggcugugucaaguggacagaacuaauuaucacaguagcuaacagggcuaccugcauacaaggggcuugggcuuggaagguucaggaaugugauuuccauaucagauccucaagcacaggcacaugcugucuucuccucagugcuagggugucucuauagcuuuagggaagaggacagaaacauuccugagcaaugacggcagcuggcuguguacaccgauccccagauucuguaaagcguuucauguggagguggagccugaguugagugagagugcaccugcuuuggaaguccagaagcccacuguugugcugagcaacugcaaggcacauaggcucccuuggaggcuccucaccaaggggacccucacugagccuucccuucccugcaugcagugauuucaucugcucucccauuuugucauuuguguauuuggagaaagaaaacacugguuggaauugcugauaauauugugagugugguguuugaagacagcucuaaaagagaucugagcuuccugaagguaggcggucucuuacugaacguuggccccuuugcagaagaggcuuuauauuacagguuucagggcuagcucuucugagacuggugcagauuguuggcuuaugugggaaucuccugcugcuaggugaugcugucuccugcugcuccuccuguagcuacauguugguaaaagcuggcagccagagguaagagcaaggagagggcacuccagcuccagagggaagccaccccgugcucauccuuuugggcugugagagucuuguauguuaccaucaguggcugguagaaccagcaccuucucuccagacacugauagucuugggcuagcuuugccuguugcauuugguugccauggcagcagaaaagaugaggagaaaugcaaacaccuggcaagcagaugcagaaacuugacuggcuuuccucucuggguuuucagacaacauuugugacagucacagguaaggggacauggggaugggggcccuuaguucacucagggccuaguggcaguuuuugguguggauguuuugaagggcuuaacauuaggaaugcagucauugccacaugacacccacaucguuggcucuuuucugcuggccaaauauguagcugugguggcuuugcuaugugaaaggggagcuguugcucaaaaacagaagucugguuucuuccugugacuucucuuguccauugcuuuugccucccccgagucuggggggaggcaaauuugcucuauuuaacaaaugcuguaguuuggugagagcaguggccacucgguagaucaggcaggaggaacagacaggccggaaggaggcggauuugaaggggagcgucccagagguccaugucucgcucucacccugcacagacagucauggagucuggagaggguaagagacuagcccagggcaguccagcuugaggacucuaaggccaaauucaggacaaugcucugacaaagguugggggcacagcucucugggcugucuucaugccaggugagggggugcugcugggcucuuuuccagcuugucuuuaaggaauugagggggacggggaaagcucauagugagcugugaaagaaugaggcugcauugaaaucccaugucagucagccucccccgggguguugggagcugaugggaagcgucggcagccugucugugccucuucugggaagaggguuauguaggugucccugccucuauggcucuuugggacaagaacuaauucauucauucauuuauuuauucauucauucucucucucucucuccucuuucucucucucucucucucucacuguagauugugcuccuuaaaugugugcuugugucucagcccuccauucacaucugccacccagccgaguucucuugucuuuggaauccuugaggacacagccugaaauugggggcccguugaucuagaaauucaugagauaauaguaaaugagguuuuuuauuuuucaaugcuggaauucaaacugagggucuuauccauacuaagcaaggucgcuaucacccacccagcuguauccccagcccaauaagguuugguuuuuguuuuuguuuguuuguuuuaauauucagaaauggaguucuguuucccauucucuuccgacuuccugccguugccuugaccacuuaagggaaaagccugccauaguuuuuauacuuugacuaaaaaaagucgcagguaaggcguugcuaagaaaccacuguggucugagcuuucugguaauaaaaauaaacugugaaugggauuuagguucuggggucuccaguggagacacaggguggugcugucucacagugcuuccugguucucagaaagacauuuucacguacacgcugcccugcgaagagagaggugguuuucagccuguuuuacaaaauagaaacugaggcacagagagcugacuuguggaagagucauaacgucagagcucaacugaaaugcagucaucucuuucugcucuuucaggccuccuuggcuuggaguuggccuuguggcugaucuauccaaggucgauaucuuacagaccuggggacuucucacuuggaaccugggaucucuuguggcagacccacccaguucauuguuuuucaccuguuuuuaaucuuugcagcacuaggaacuucaccuauaucuucguaggcaagcacucuauuacugagccauagcccaacucgccuuuacauugggagauggaaucucacuaaguugcuaugaguuuacuuuaaauguuugaacuucaauuucccugccucagaccccugaguaagcccagguuucccagcauugcagcuaucuuaggcaaggcauuaaucugucaggggcacaucuacaaagcaaggaugauaacccugacaagcuaaccauguagcugagaggauacagggaaagcacccggcacuuagcuguucaggaggcccugcagcaucagcccaccgcuuggcuugcuguaacuguaugcgcccgucccucacagcuugugacuugcagaagggagagguccugcugggaugacaugccagugcucagagcaaacagcuuccagaacguagagguuuuuugcucugccuguaggacuaugcacacuuugucuugaggcgcagagaaagccacuguauggcuaaggccaggguagaggccagccauuuuccagugggcuucuucccggcugauuuuugucuagucuucauuucuuuuguuagguacagacaggaggcaguugagcucaaagucuugcucacuguuuugaacuuuagcccacaccccugcagccaaagaaucugcauucaugcagccugagugaaggaaagggagggcuuuguuccagccgucccacugcacugggaauucaggcaucacagaaacccagcaagcaggcuuacagcgaauggauuuuauguaaggacgcuaauagucugagcaugcagguucgguggucuccucugugggaugcaguaugccugagggcaggcugaugggagagcuguaugucuucuggggacauuucuugggugcaauuuauuaguggaguacauucaggcuaaggauuugaggaaagaucagagucuggcccgccaaccucuucagugaggaagaugacuguccagugagcagagcugaagcaaauggacccaaauuccuuuuguugaaugaagcucucucuguucagucauuucuggguuuccuggcuuaucuauucaggagguuucguggaugguccuguugcucaaauccaugggguuaaaccucuccgcaaguuuucaugagugccaguguugcauccagcugagaaaauugcuuugaugcuuucuccuaucuauuuuuugaugugaaaugaguuacugguuguaauucuaguaaauagcuugcggucauuuccaaagucaucauucaaugucacccacggugagagaaucuagccaauauccuuugaaggcuggccccguuucuuggacaggugggcuguguguguguaucuuguccuuucagagcuggguuggggggcuguuguuugaacggggauuuguuucugcaguguuaguagaaacagcacagucaccucucuagggcagauuuggguuuuccuuucuuacccugccucccaccuccucccuucgaucucaguacuguggcuauaaccagucuuuuuccagacaaagucucuauaacuggcuccuucagcaggaacucuguccucuugcuucauccaaaccugugguugaguugucuuucuccucaugcuguuggcugagagaacgcccagccagcuagcaccuagggcaagguauaacguucagauuucaaaaaaauggcaaagugcacacuccuuccgguuucccgauagaaauccagagaguuuuuuucauuguccuguagaggaggcauggaagagcucgacauaaaaaggguuguguuuauuuaagaugauuuagauaaucuaaaagugaugagugaaauguuuauguuaaaaugugccccaaaucaaagcaggcguaucgaaaaggacaggcauaaacaaaaguuaaaauguuuuugcuuuggguagcaggacuacgggacauucccacucauucaucuuuuucauguagcuuguuaaauauccuguaauaacaugucaaaggagagccaauugaacuugauaaaaauuucagcaaaaccucugugagauuggcucuuaugucuugaauuuauuuauauguuuauauguguuugugggcacauauguguguguguguguaugugugugugaguguguauaugugaguguauauguguauagguguuuguauguuucucagugugugucugacucucugugugugugugugugugucugucugucugucugucugucugucugaguaucuguguaggucagaggacaacuaguggaaaucgguucucauuucuaccauguaggucccagggauugaccuaagguccucagacuugggggaaagcaccuuuauucugucucccucacugguugugucuuagguuuagucuccuuccuugucccuccuucuggaaagcugggcaggccaggguccugggaggaugguugguuguacugcuuagaggcagagggaggacaaggcagcuucacagagccucuucccacucccaugccaugaucuugcugccacagccucugccaagggagaggcugagccuggugacauuugcuauccaagcagggagcaguaacaacauuuuggcugggauggaagccaggggcagggauugaggaugccuggcugauaaggagucagccagcuuucugccuugugugaagcacaucugcugcagcugagcaucucacagggcuggcccauugggaagcugaugccugcucugcugggaagucuaguggccacacaacuucuacagagaaguccccuccuggggcaguguuggugcugugauucagggcgcuacaaaguucccuguccuuugagccguggcaguaccuggagggagcauggaaucuuuaggugaagacuagaauuuuucuguaacaccauacucaaguaagugauacaggacauucugaccaguuucgucuggccuggaucuuccagcuuugucuuucaugguccuggcuaagucuucugaagugauuucucugcaguauagucugccugcuaaucaccugccuggauccugaugcucacuggagcagcagacaaaaugcagucaaggaacgacgugguuucugcucucugcucagggacagccuacagauugcggagcuagcagggucuugccguaaugaaucacgcuguucaaagauagguacugagcuugagugaaggcacugacccucccgugugggaaggacuggugcagauaugggcucggcggaaggcaggugagaagcuguucuuccgaaucucuuuagaguagugcuccaagccaugggccuccauguggcucggcugcugguggggaagcuuaccguggcuccacauacacuccauggcuuccugcucuccaggcauggcacaggggguuaauagcuccaauggcucuauuuuggggcaaauggaguguucccagaauaggacucuuuguugaauagucuauuuugggaggcaagccccacuggcguuuauuauguaagcaucuucuguguaugucuggggguguggaugugugcacaagugauuucuuguuacuaauuauaagcagcuucuucugggagucagggaaguggagguguauguguauagagguaugaugugucucuccuucugugaggaguauugugugccuugagcagucaccaggcgcauccuacuaggagaaugagcgugguaccuuaggaccacagacagauagugcggugugcacccuuuucuggaauaccuggcuguggugauauguccaucugucaucuuuuggguguccugaagcacagggacagguggauauuauggccuucagucuacaaucugggaucagacggccuccaaaaacugggaccugaguuguucuaaggccaagcaacuagcuccaaccuggaacagaucguagacuuagccucccacucugcagcuuggcgcgcacucacuggacccccccuacaccucccugcaggccacacccacauaugucgaagccagagagaaaccaaagaccguccagcauggucagugagacauccacagcugggaccacguccacccuggaggccaagccuggacccaaggugagcuccuggucauggguucuucuuuuucuuucuauauuuuuccaaaccccuuuauaaucagaaguccauuugauuaucauuagaucugugguauggacccauaagaaauccucccccaguuacagaccaaguaaugaaggcggagagaggugguggccucuuuccagggaaacaggugguugcugauagaccggaacuaguucuugaaugcauuugucacuguucuggggugugcucagaaagcagcaccccuguucacaugugcaugguguuagauccugacgacuuucaguggcagacaggccugcggaaaggaaaugcccacaaguuucuaugcucaaaguauaggaucacugaccuagacagguaaaccagguugggagccaaguauuagaaacugacaaagccaaggacugaaagguggguucauuccaggacaccauagcagcagcucuuaacuuaauggaacauccuuuaaugucucugugugaaccaguugggaaguucacugugucuggggcuugcugucugaccggcgugaugcuauggccaacaacaugcacugacaggagggugcugccucuuagagaccaccaacggcccuccuaagauacaagcauguuugugccccuucaagucccugcugcuagaacuaaggucugcuuuuccuagauugucaaguccagcaguaaagugcacagcuucgggaagagggaccaggccauucggaggaaccuuaauguuccggugguggugaggggcuggcuacacaagcaggugagguugcugacgugggcgugaggugaaagugugagugggucuugcuugcuucucccucagccuggggaggcugugaacaguuagagacguuucccguuccagaauuucuuugcggcaggcggguucugcccucugugcucaguaaccuguucgguuuuuuuuucaugagugagcagaugguucaaggguugcagugucucuccucagacccauuucaccacuucugucccuguugcucuggguagccaggggcuggucaguggggguguggggugaugauggagaugaaggagaggcaccugcagauuggcacccaggauacaguguaaguggaugagucagccagaauccagcuuccaguuagcccucugccccaccugucugucuuuguuguccuuuggcuacaaaugcuaccuuuuccuugccugggaugcauggcuggcucccaagcauguugaaguccagauuugccaaauucauuauccccacccccagacccuccagccacuuuccccaggucuuaguaauaaggaacuaucacuccucucucggaugcacagggaagagacccaggacgccauagcagcagcucuuaacguuaauagaaugugcuccagcaccagcaccugccccuucuuuccccacauccauuuagccgggagccccugcauccgucaucuccuuaccgcucccgcccucacuccgugcuuugucuuuggucuucagccagcucugagcucccaagucuagaacuagucucuuggccccuccuuuuucuccuguuauuuccuuacucguuugcuucccauguuuuaagggcucacacagcaggugugaggagguaaauaagaaggugccuguccugaggaacuccucaucugcagagggaaacaucacacugucacccgucccuaaucugucaccuaccagcaucuacaaaaaacaaucaaacgcccagagcaauggcaccuauuugacggaagcaguugugagaaagucuugcguugugugauauguaggagggguuccugagcauuguacacugugugggaggggauccaaagacccuucccauagaaggggagccccagaggcuccuucaucugccccuggucuuaugucuccucucacacucccaucuugucucuuuucuuacauuucugucuucaucugagucauuauccuaccugacuugcccuguuaaguaaagggcaccgguuggcaauguggcaggagagaggccugucagguaaaucauucuccuaccuccugacccuuuugcugcucccagccauacgggucagagccuugcagaccuacagcagaggguagacugugcucacacagcugaggaagccuuccugggaagcagcauuugaaccauggacggaggauggaucaaggccucccaguaagaaagaggcaaaugcuauggagacugcagaaaucaucuggccagucugcaggccuugaccaucagaugacaacauuaacuuaauuugguuuggguacuuuaguguguguugguggaagggauaugugggggguggcaaacaagccucauguuguauucaggguuagaaacuguucuuuuguuuuaacugucaaaacuucugaauagggaaagacuauauuuuauguguaugaguauuuugcuugcauguauggauguguucacugcucaugccuggugaacauggaagccagaagagggcauuucauccccugaaacugaaguuaacaaacaguugugagcugccaugugguucugagaacugaacucagguccccugcaagagcagcaaaugcucuuaaccacuaaagccauuucuccagccccaaggaaagaugguuuaacagcuaaacccaacucugagauucuccugggccuuggagaaaacugguguguaaaauuacuauuuuccuugugaccaagucuuuuuguuugguuugguuuugaugaacuuuuguuuugaggaaauuugauugcaaagagaauucagaucuuuacuuugaauggaaagaaaacaacaaaucaguccuuugguagaaaacagaguugguuagcugagagcguugucucaauuacccaacauaagacuauucaauacuaugugaauucauuuucuaaucaacaugaaugaagauauuuuauagccuacauucuaaaacaaaaacaaaacacauuuuaguaagaacuuauuauucauagguaacuucuauuuuugaauuuuccuuucuagaagaaaaugaguuauaauaacuuguuucuaggagaccagaaaaccuuacuuccugugauaaaccaucagugagucuaagauuaaugucuauuuaaagaguaacuauucaauaacacauucauagaaagagggagggacuauaaaccaucaguuaauuuaaguuuaacguccuguuccaagaggagcuauucaauaaggucucagugguuuauugagcgacagagggccagagauguaguucaguugguagagagcacagacugaaucacgugaccacauaaaccaggcaagguguggcacaccuguaaucccagcacucuggagguagaagcuaaagaucggaaagugggcaaggccauccugggcuacauagugaguuuaaagccagccuggacuucaucgucacuauccacaggagaccaccucauuaaagauagauagauagauagauagauagauagauagauagauagauagaugagagaaaaauaaaaggggcaugguagcacaugccuuuaaccccagcacuagggaguagaggcaggcagauauccaaguuuggggccaucguggucuagagagagaguucuaggacagccaggguuacauagagaaacccugucucaaaaacaacagcaaaaugaaaaaauaaauaagagagaaagucugagaaauugguucauugaguaagagcaugcacugcucuugcagaguucuuagcacccauaucagugacucucaauggccuguaacucuagcuccaggggaucuaacacucugugaccccuguggauagacacacacacacacacacacacacacacacacacacacuuacaucuuuagauuuauuuugaauguauggggaucuuuccugcguguaucauuguguaccaugcgcaugccugguuccuguguuggcuagagagagugucagauuccccaggacuccaacuacaggagguugugaguuuccauguggguucuagaaauugagcuucaguccucuggaagaacaauuagugcucuuaacugccgagccaucucucuagccccaaaaauaaauauuaaagauaaaaaaauguaaagaaagaguggcugugggcaggucuuagcucugggauuggcuucaggugaguggagggcuggaguguauaggcugcucugacugauucucugugcuuugcaggacagcuccgggaugaggcuguggaaaagacgcugguuugugcuggcugauuacugcuuguuuuauuauaaaggugagcggcagccucugaucaccaagggcuccuuguaauagaagagaggauguugacagaacauggaugggcgcuuucucaaaucuagucguuacaacaguggccugaguuucuuagccccuuacccugcaagaguggucacugacauguauggcugguggcuucaguuuuaccaguccaguccauagaaguucaaauuguugaauucaaguacguaagauucaguuacagucucaagacccacagucacaugggcucuugucccucuuagauguagguuaccuuggaggcccccagagagcuggggagcaggggacucucccugcuuucugggugccucuccugugccacuggacaggacacuugaguguaauugcccauuugagcauacauaaagucugggauuggauaagguggaaucuccuacagaaggggaagacaaguguaggcuuugcugagugcaaugaagacauugaagucuguagguucuucaagggaaaugauagaggguugucauuugggaauucugagaaggccuaggauuugcauuuggcuucuaaggauggguaguacuuggccagugugggaagagacagacauuacaaggagaaaaguuacacuugaggaagguacuagaugcagaagugggggaaggacugacccugaucuaggagacgaggcucacaagguggguagggaccaaaugcaagggcugucacagaaggguggggacacuggguuuaggguugugucugguggcgaagaaccgugugaauugaguguaugaguucaagggccaacucugucacucugcagugaggggauuagugagggaagauguuccacagcacaucacauacugcccguucacuggcaugaugagcuaagaguguccacaugccugugucugcccuugggaaaauugcccuuucagccucucuucugugguaccgccccuuagcaccgaggugcugguaagcauuuggugcggggggaaggugccagugcagucucgguagacggccuggauaggauuccuagaacguuguugugaugugcuuuucuauccaaagacagccgagaggaagcuguucucgggagcaucccucugcccagcuaugucaucuccccaguggccccagaggaucgaauaagccgcaaguauuccuuuaagguauuguucucccgucucaaacaauguucucagaaacaccuuuaugaugcagcugcuuuuguggacaggaaaaggaaguuaggaagcaagagggacucagacacagacuaacaagguguaaaugacuuaaacagaacaaacucauugcuggguuugaugggcccacaccuuuaauccuuguauccaggagccagaggcaggcagaacucuguaagucaagccagcuuggucugauuuaaauaguaagcucuagccuagcuaguacuacuagcuucauuuaaaaaaauuuuuuuuuaaagcucaucaccccagccacucuucuauucuguagcucaggagcugcucugaaacaauuguuuguucgguggcuucuagaauuaucuuuaguggccgagucuuuuucaagaagucuccccuuuguggguagagugauuuuucuguugcuguggcaaacaccgugaccaaaagcaauguauggaauaaagggauuauuuuggguuguguuccagaaggauggauucaucauggcagagacgugcgacaggcagggcagcaggaacaggaagcccagaguucacauuguaaacuauaagcguaaaccagagugggcacuggaaguagcuugagcguuuagucucagagcccaccuccaauagcauacuuccuccaacaaggggcuaccaucuuagccucaucagacagggccgcuuuggagcuaaguguuccaauggggauguuuuucauucaaacugucacacugggguuagguaucauugcagaaaaaugacuaggaaccaggagagacagccucuggaguggcaucgugggaguuuaucauggcugugugcaguucaucuucacacucuguugcgggguaugagagagagaggcugagaaagcaucuuuuuguggucucucuccuccuuucuguacuucagccaguggucuuuccaaggucugaucuugcuuggcccaguuuggcucccucuuuaacuaaacauaaacccguaauguggccugcaaggcccugaggacccugcccuggcagccucauagccucaccaugugcagcccuccccuuugcucucucgugccagccaugcuggcugcauccgugaaccuguacaccaagugcuugugcuucucggaggcugagugccuugucuuccuauccaggaguugugugaauguccaucucagaugagucugggucacacucuuucacaaccucccagacugugugugugugugugugaguguaugucugagugugcuguauaguguuuuguguguguguaauguaguaugguguguauguguguaguguguauguaguauaguguaguguuuuguguguguaaugugcugugguguguguguguuguguauaguguaauguguagcauguguuuauguaguguguuuugugugguaugguguauguguuguguguguaauguuuuguguguauguagugugguauggugugugcguaguauaauguauguuuggaguguguguguguguuguguauaguguaauguguagcauguguuuauguaguguaaguguuuugugugguaugguguauguguuguguguguaguguuuuguguguauguagugugauauggugugugcguaguauaauguauguuuggaguguguguguguuguguauaguguaauguguagcauguguuuauguaguguaaguguuuugugugguaugguguauguguuguguguguaguguuuuguguguauguagugugguauggugugugcguaguauaauguauguuuggaguguguguguguguguguguguguaguggcugcaguauguauguacaauucagaaccgugggugucuuccuuucuccaugugucccuuauuaccuugacauagagucucucacugaaccaggagcucaccauuuugguuaggguacuguuuagcaagcucuggggauccaccugucucugugucccagugccuaacacugggguuauagaugcgcacaggcacaccuggcuuucuguagguccuggggauucagacucagccccugaugcuccuagagcaagugucauuacccacggagcugcagccgcuaaccucucagcagcaauugucacaucgcggugcccauccaccgguguuuucuuagaagugguuuugaguggucucagcccuguaaaaggcuguccucuaccuucuaguguggugcuuuuccccaugugguagcacuccguagauggugaauuauugggcagggcacacaucugagaaagugucagucaguucguggccuuugguugugccuuuguuacccacaaagguucuugcuguccugaaauuugaucuugggauuugagggggggguggagcugggcuuccuucuuagugucuuauuagcacagccgucuucuagggcagcuaggucaaugccuucuuacucucaucccgguuuucuuugggugcagucauauaaaguaggguuguguuagcugaggagcagagagcagagaggaagggaucagcucccaggcuucucacugggccagguaccuuuguacaaaguacaaagcauucuggguuuaggucacuggaccaggugacagaggaacuugugucuuucuuaccuucacagucagagcacccgagugccucagcacaggcagagugaagcuggacaccugguccucgggugagcagcugggcacaagccugcugucacgugacgagagaacaaggcccugugcuugugugugacuccuguggcggccgcacuugucguggcccaucugccggcaggcugcaaaacuguacuugcaugccggaagugugcccaaggcugccucugagggugcuuguagcucagugacuugcucuuucaaaagacugcccugguggaccccccucccccgcccccuugccgcauuugugacuggugggcaagagauuuccccagaaugcucuguggugaggaagggaagacaugcggagaucuugggccucaugguccagggaaaccugacuaaagauuucugcugguguguggugaagucugcaugagucucuuguugguuuuacugccauagcuccugcuugcugaagcagaggggaccaaaagggcacccaagacauucaaaauggggauaggagauuucucugccacuguggggaccuuaacugcgggcaaaauuuguguagugucucugggcacugggcuggguagacucagauguauuaaugggauaaacaggcccguaguuaguaugcauugugggcugggauguccaguguggggaggaguaagugccaaaggcucaccugcgaggcuuuguucauccguacugaaggcacgccacucaacaguucauaacuguuuucucuggcuggucauugcucuggccugccguuuauucucgguccacauuauugaggugaaucucaguuuuccaugggaccaugagcuuuacacagagaaccuugggcugggagucagaccaggguuaaaacucuccacucacauucaaguauucaacaaauaguaagcacaugucuaugcugggcacugugccugcucuuccugggugcagaguggggaacaaaaucggaaaggcuccuuucucaugaaguuuguaaaaugaacaguguccagggacgguaaucacucaguguccagggacgguaaucgcccucagaaccuauucccagauggggugugugggagaguuacugaaccucucagauccauuugccucaucugcaaaccaggucugugccuaccucuccaggcugcugggauuacaaagagacuaaaacuguggccacacccaggggccacagaguggguacucugacagucuucccuuuucuauaccugugcagacugggugagguuuucacugcgagguaagaggcagacucuugccuccucaggcagaggauucuuuuuuuuuuuuuuuuuuuuuuuaagauuuauuuauuuauuuucuguacaugaguacacuguagcuguacauaugguugugagccuucaugugguuguugggaauggaauuuaggacuuccgcucucuccagucaaccccacucaacugcggucaacucugcucgaucagccccugcucacucuggcccaaagauuuacuuauuauuauaaauaaguuuuuuuguuguuuuuugguuuuuuuguuuuuguuuuuguuuguuuuuuguuuuuguuuguuguuuuuuuguuuuguuucuugagacaggguuucucuguacagcccuggcuguccuagcuagaacucacuuuguagaccaggccggccuagaacucagaaauccgccugccucugcugcuaggauuaaaggugugcaccacuguagcugucuucagaugcaucagaagagaacgucagaucucauuacagaugguugugagccaccaugugguugcugggauuugaacucaggaccuuaggaaaagcagucagugcuuuacccgcugagccaucucuccagcccccgggcagaggacucugaugggaaugauccaaggugcuaaccaagggucauccccugugccuuuuucuaggcuucccagaauucccagucagaugucgaucagcucugcccaguuccaugguguuuucugaaaagacaauagcugauucuuuagauagcugaagcacccauaucggucucugggucuggcaguagugagaaaguagcaucuagguugugacauuuuucagauguggagacaaacuggccgacacucuagaagcaucuagaagcgggaagacagccaggguauuccuuauucuuguucccguagagaaugugugcuaaucugucuguccucgugcucacaggcugugcauacggggaugagggcacucaucuacagcaccaccacagcgggcucucagauggagcacucgggcaugaggaccuacuacuucagugccgacacccuggaggacaugaacgccugggucagggccaugaaccaggcugcgcaggugcugucucgcucaucgcugaggaggucaguccuggugggggcccugggcgguaggcagggaaaugcccuagggcugcaguuccaaccuucaugcuggguguaggaugcucagcucucucaagucuguacuggaccaagugcucuaggaggagaaggugcaaaugcuaacacaagucacuagacagcaucuaagggccauggcugccgugggaccacacacacacacacacacacacacacacacacacacacacacacacguucucagcuuuucuuauuugugguagaagggauagagauauuccaaaucacgugucagguaaauugauauccuuuaaaauaacuuucuauucauggaauagauguauaagguauauguagguuucuuucuuacuuuuagauuuuuauuauauuuuacuuauguagugugugugugugugugugugugugaauacuuaugccauggcaccacuguggagaucagaggucaacuuucagaaguuguucucuccuugcaugaagugggucccaggaauugaacucagguugucaagacugguagcaaacuggaccaucucacuggcuuucuugcuguuuuaaaacaugaacaagaagaucuacauuauuuaauaccaguagacauagaucacuauaucagucuguauucugcuauaacaaaauaccaaaguguggguaauauauaaagaaaaaagguuuaaucaccucacaguuugggaggcggaagacuaaguagcaugguuuggaaucuaccacaggcacacacacacaaacacacacacacacuacuuggacuguaucaaaggcaagugacaccauaaugggagcuccuguaagagagacacugguaucagucacuuuuguugcagcaucugcauugaccuaauugccucgaccuggcacacuaaggcccaucuuacucccaucacacuugaaccagacuucuaacucguugacuuuugggaugaaaaccucauucaaacccuggugacuguuuaauuggccaccgguguggcauccacaggguggugucuaccaugugguugugcugggcauucagacaggugcagagccuuggccagcucagaaauguucucuaaugcuguugcuauaaauagcccuauaucaaaaccccucuacagcuccucacacgugaaaucuucagauugaccccauuuauuuuauguagccccaccaaauugucccuuaagcagcauggugugacacacaugugaguguuggcucauaggucuucacuguuagucuuaccaaucuuuuggcguuuuuugaucuacuguguaaacagucaaguuaucuuuuuuuuuuuuuuuuaacauagcaucuuacuuuguaacccaggcugcuuugaacucacaguaguccuccugccucagcccuuuuaaguacagagaucauaggcaagagccacuggacucaacaguaucacuuggguccccagaagugaauaaagaccagcagagaaagcuauaggcaggagagugugugacugcugugccuugugcucagagcgugugaggauucccucacuagccaagauuuggaccucucuaguccuacccgaagaaguccagcugacuaucaguuuuagaagagauccuuaccuuuuaagaucuuaaacuuuuucuuggaaaauuauaccuguuuugcuucuaacucuuaaaauuccaucaucuuugcuuaagguuccuucccuuucaacuggaaaaucucuugccuucuaauugggagugagugaacaccaguagccaucacccaggcuggcugaugcacccuucacauucuacuguagcauuaucuuuuuuguguguaugucauguugccuguguguaugccugugagugucuggugagagaugggccuugucaaguuccuggcacacagugggaccuugcauguguggcaaugguagcaucagccuuaaaaacauauaugacccugaccgagacccuguggaguuuucaauccauaaaacuucccaggggaguuuguccuuugcugcuccuaugcaagcggcaagggcauuguugaguguauuuugugacucauggggagagcagcugaagguagaguguccuuaacccaggcagguccucuguugcuaauucugguaaagcgagccaguugaagggccguggggugagagauuuuccccugggacaaggagugggggguugccccauuuaacucagcacuggaaagaaggaagugacuaccauccccgcugcuuucagcagcuccuuccucaauacugagcccuaaccagagugaaagaagcuacaugccuugcagguacugcgaggccucagcucuucagucuuucauacagaguucuauauagauggugaccaggaugggcucgccgugagcuugccuaccucugagacuggggaucagugcucaguacuccagcagcaccccguuugggaaggguuugugccauuuuagcucuagacaccuaugcuccuuggccagcccucugaaugacagucauccaaaugaaggcauacuuaacccauugugcuaaauugauccgugaagauuucuuuugugacaguucuugugauuugagaagucauaugguaaauugcugggaauauagggagacaggagaaaaugguuuuguuugguugguuuuguuugguuuuaaggccccuaauuuaguaaauuguuaaauguugaagucauguagggcuauggaguaggaagcgcugcuuuuccuaccugcagccaccgacugaacauuuugggcauaaaauugucccuuuaaguccuggaugaggagcuucauaaccccaaagucuuagggguaagacgaguggcaggcagcgagcagacaccgagcagacaccgcucugccugccacucccuagauguuuacucugcagggucuuuugguaucaaucugaauagaagucaucaucucccuucaaagugauuuccaggaaguauuugcauacgugggagggugcaucuuucuuuauacacacgcuaaaacccagaguuuacucuuacaaaauuagcucuaaaagaagagcagaccaacaaacuccaugguuuuaggguuaacaguucugaugccuccaugauagugguauguuugucugacugcuuauauuuauagugugcauaauaagaagauguauccaucuggagacuggagacaaagcccagguuauagaaugcuugcuugucuggaggcauaaaccguggguucaagcgcuaccauagcguaagacagaucugucuuccaguaccugggagguagaggcaggccccccucggggacagaaaaguuagaggauagccugggauucaugagacuccuguuucuccacccccacgagagagaggggggggagagggagggagggaggaaggaaggaaggaaggaaggaaggaaggaaggaaggaaggaaggaaggaaggaagaagagcuacaggucuuuggguuucccagcuggaaugagcacuugguaguggaagcacaugaaaacacagaacaacugugacccuaccaggggugacccagaaggcagcuggacuuucaccagcucaaagguagcugugaagcacagccuauaaggaugggagaccauagucuggucuauagagugaguucuaggacagccagggcuauacagagaaacccugucgggggggggggggggggagauuggagaccaugaugaggauaaaggccaaggaacucaaaggcuucuggugggguugacaaagaggagaggaggaggagaggggucgaacugcucaaguguccagagcagaauuucuuaccuuugagcuuacaguaacacuguaguauuuauuucgugugugucucaguguauguguguacaguaugcaugugacagucauaagacagcuuccuggagucgauucuuucccucuacaaucuggguucuggggauggaacuccaguuguggcaaguauguaucugcacagcccucuuaccagcccaggaauugcuuuuuuauuuuuauuuuuuuuaauuuauuuauuuauuuauuuauuuauuuauuuuaguuuuucgagacaggguuucucuguguagcucuugacuguccugguacucacuuuguagaccaggcuguccuugaacucagaaaucugccugccucugccucccaagugcugggauuaaaggcauucgccaccacgcccggccuugcuuuuuuaaaguauaagucccugaguguuuccugucaccaggacguaaagacccauugggcuggaguggcaggccccucgagucacuaucucaauccuucauucuaaugagauguaacaaccucuguagcgugaguaacauaaaccagcguccaugcacacgggaaagggaauuuauugauccacacccgggaggaccagugaugcaucugguuuggguguggguacaugugagaacuuaggcugaguccucagggcucuguuucgcucccucuacuugccauccguuucuugcucuuggcuuccguuucaaacaaccccucacacagggagggcagcaggagcucaagccagaguccgaggacugacggucuggcccuuugucucccccugaaccaggcccugagacuuuggagccauagcagagcaagaaauaguaaagucagcaccuaaaccggguugacccaaaguggggaagggugagcccaaaugaaggcagaaaugcugucagacaugcaguggauagaaguauagguuugggaggugagaugucccucagauaugagauacaaaccggguguagugguguaauccuguaaaggcaagaucaagagagcgauccaauccucaguaacauagcaaguucaaggccagccuggacuccuugagaccuugguuuaaaaggagaccuagagcuggcaagauggcucagcaggugaagcacuccccacuaaggagugcuaaauucuauccccaggagcuaugugguaaaaggcucgccauucuuacugcaaguugugcucucaccugcacacaugcgccaugauaccuucauauacucaaacacacucaaacacacauacaaaauaaguagguaaauuaaaaaaaaauuguagagaagucgggggcacauaccuuuaaucccagcacuuaagaggcagaggcagguggaucucugaguucgaggacagccuggccuacagagugaguuccaggacugccagggcuacacagagaagauagacagacagacagacagacagacagacagacaguagagaaguacagagaaacuuuauuucugcauaacuugggguuucuguggagaaggcauucgaacauugacaguggcaagugugacugccuuguuugggucugcgugcccacaguuagauccgcauacaacaagaaguagccacuguguaggguauuaaauguuucuuguucccuagacuagcuuuaaucuguacucaccccggagagccgagguucugggugguccuggggcucugaucaucaugguuuaaauacaggaguguucugcugugugcucccagaucaaagcccaaacaguccuggcuaaaccaucauacaagcccuguauuggaagggcaggaccuuuuuacccuggaacauagcuagacuaaugccccaucugaauuccugcucauuuucccaucuguguuggagugucuucuucugacuccagugagccauuguucuguccugagugauggggccgcaugcagaacuaggguaggaccuguccuuaggaggcuuucaguguggcaggccuugacagaagaaccauguccagugucacagagucccuccucuauccucagcucacaguuuuaguugucaccaguaccucuccccaagcuggccgggcuugugggugggggugagggccaugaguggaaagacaguagguggcagaaacuagaguauggcucuggagcagccguuucaguguggugauggugucaggccguagucccauuuacacugaggagugugucaggagcggccuucuggaagaaguggcacuuaagccagguuccgacaguaggagaaaggacugagcuuggguuagggguggagggaugcucugagauaaaguagauaauguuuccuggaagucucggcugugcugugggcugaaugugcugcugccauuacagggacguggacaagguggagcggcaggccaugccacaggccaaccacacugacgccugccaagaauguggccacgugggaccugggcacucgagagacuguccucgucgaggcuaugaggacuccuauggcuucaacaggagggagcaggaggaggaacgcuuccgugcucaaagagacccacuggagggcaggagggacaggagcaaggccagguccccauacuugccagcugaggaggaugccuuguuugucgaucuaccuggugggccccgaggccagcaagcacagccacagcgagccgagaagaacggggugccaccuuauggccugggagaacagaaugggaccaauggguaccagcggacugcuccucccagggccaacccagaaaaacacagccagaggaagaccggccuggcccaggcagagcacuggacaaaagcucagaagggggacggcaggagguuagucuaaugugauaacaaggguggggccggucgggugcugucauuucuccaguaccugcucagcuaauuaaccgcucuaccucuaugugaauaaccuuaacaguccuccacaggaaggugguagcucuaauuuacagaccagagaaaugggcuuggagaagggagguagccuaccuaggacacacagcuuaguggcaaggcuguguuuagaguguggucuguggacacagauggccaacagugucaguagcugaucagcuuugcacugcugucccucugcuuccaaggagucucuguagacucuugagagcacugagacccaggugucaccucccagaugccuggaggagccccgggaagaacccagguauuguggaaacucauccugucauugguaggggcucauuugaagaaaaacauuuuauguuuauggguguuucccugcaugcaugucugaguaccagauaugggcuagugcccauagagaccaaaagagggcauuaguuccccuagaacuggaguuagaaacaguaccauguggauggaugcugggaacuaagccugaagccuccgcaggagcagcaagugcucuuuaacagccaagccaucucucuagacccuuucuuucuuuuuucuuuuuagacaaggucucauuauguagccuguuuggccuggaacucacuguguagaccaagcuggccuugaacucauagagcuccaccugccucuaccucccaaguaccaugaggaaagacgugcacaccccacccagccagagcuaguuucagaguuuaaaucugaaggcaguggacaguaggaaugaaggagccaccagaaugccuggcucucgagaccuuuucaugggagaaaguccuugcaaaaaaaaaaaaaaaauuagaccauugagcuucuaacucguuguugaugaaaugggacuccacaaggcucucaccacccacagaccucguuauuccucgccacaauggccugcccuguggaaggcacaaagguggugugugucagggagcugaagggagggggaucagcaaggggaggagaggcaguggcacugaggcugaaagcagagugcagagaagaugcacauuggcccugggguuguaccguccuaaaggggcugcaccccguguucccagauauuuguccuuaaagauuauguagcuggguuucauggcacaugucuguaaucacuagaggguggcuguaaguuccaggccagucuguucuacacacacacacauacaugcacauacacacauacacgcauacacacacauacaugcacacacacucacgaaaauauauauaaguauaugguaauuuccuaugguaagugaccaaugggucuggcuccuuagugaaggaacuuccuccauuuuccauuugaaaacacagauaaagaagccagcuaucucaccuuaguguguuguaagacugugcugaccuccuugucacuggacagagcacacagaggcauuggaaggaaguccacauagggaacuauuucucacuuauccccauauuugagauauaucuagauugcaucuccuguaauuuaacgcuguugggaugggguuagcaagagucuuacauaccgguacuuagaguccucgccuucuacuuucaccggcacccaguguuuaaaguaaaguguacuuauaaaauaaaaagguggguggggccagggauuaaaagccgaucagagggaacacaauaggaaaugaaaggcuugcaugauugacguggaagcgagggugagggauuucuucagcaaacaggagcagucacaaaaguugaccuuacauuuggcgugacugucuugcagccacuuucucaggauauccuguuuaauuuuucugguuuuggaaccacagggcaggugguuccuaauacaggacuauguaaggccagguuggacacaugucuguugucaagacagaggcugccccaggagcacccaccugcuccugggaccuauccugccccucccuccacuagccaguuaaucauuauaguuuggcugcaggagccaguggccaccauccuacuaaugucugaggucuccccaaaugguagacagugcauaagugggaagcagggacugaggacagccuccggauuugggauacuuaauagugggaaugggggacugugaccaucuaaacaugguaggcagguacucugcauaggcuguagagacagauggacggagcagucccacaucugcugacugcuucggccaccacccaccucugaggauuugggagcugcuaccacauuagacgugggcuuugggaaaaugaauggaaaaccucugccaccuaguggcaagcaggcacaccugcaugcuagacagguuuggguugaagugaucuuaaaauuaccucaacugaaugaaaagaaacugagaaagggaagcugccauauuugauggcaccuauuucugucccucacgauggugagucagaggggcuuauuauccacguugugcagagaggcgagugaggguagagcagaagagauggacgugaggucagacgauaugagugauguacuaggauuggaauagcauccuucaaccucuggggcuguuuaacagggugaaaguacccugcccagagguuauuauucauagaucuccugggcugaaagaccuacauuuugaaauuauauuuuauauagggucuugaucccagacuggcuucuggucuguuuaugccacacugggaguugaacccagggcuuuguggauauuagacaaagacuguuaaaacugaauuauaucucuauccuguauuucuaagauuuuuaaaaaagauuuauuuuauuuuauuuuauguguaccauguguguguguuccugcugucugcagaggucagaaaagagagucagagccccuggaacuggaguuacagaugguugugagccaccaugucggugcugagaauugaacccagguccuuuguaagagcagccagugcuaaggcaucucuccagcuuuuacuuuuaaccaaaaguaauaacuaugggaguagagaaaugacacuuggcacgagugauucuugugcaguuccacccaugucaggcaaucccaguguuagggggcagacagauggaucugggagcucacuggccagcugccuuagucagacaagaaguucuaggcuagggagagacacugucucaagggaagggggcagagaauguuagagcaggacccuugauguccucuucuggccuccagacacaaacauacaugggugugcccacuccaacacaugugcauacacacacaaacauaaucauacauuugaaaaaguaauaguuauauauugauggaacagaugggagauuuugguauaugcauacauugugaagcuguugaaacauuaauauucaucaccucacccacauauccuuauguaaugugguagcaauaaucacucuguucuuugagaauucugaaguuauuauuauuagcugugguccccauguuguguacaguggggcucugauacaugcucacgugaaagucugcacagcugaccaacaucuccugcuucaucucugccaucgccagccuuacucuuugcuucucugcaucccauguacaagcgagaacaugcagugacuggcuuaauucaggagccugcccuuugaauaaagccucagguauugcugcugcugcugccgccuccacugaccauauacucagaguuagcaucaucccagagcaaugacugacacacagugauguuuuuguuauaaguuugccaugugaaguugaugagacagaguuaggauuugaacccaggcuucuguaaucccagagccuauucucuuuacaaggucacacuaccuugcagauuagacugaaaaaagcaaacgacaacaaaaaagaacuuagagagagagagagagagagagagagcagacagacagacagacagacagagguggggggagcgcacacacacuugagcaggcacauggaugcugcaaugcacauacagcauuuagaagaacacuuuugggaguccauucucuccugccaccguugguucuggggauuuaguucagauuaucaagccugcuuggcaagcacucuauguacuaagccaucucacuggccguaaacuguaaaaaaaaguuugaauuuauguucugaauguuuugccugaguguaugucugugcauugcugugcaugccugaugcccauggaauucagaagagggagauagaucuccuggaacuggaguuacagguuguuaugaaccuuuuguggcugcuggggauugaaccugggcccucuggaaaagcagcaaaucucugacugcugagccaucucuucaaccccuagucuuugacaauguuuccuguauccuagaauggcccagaacuuauugcacggcugaggacgccccugaacuuccuuuauuuaaagauugauuuacuuauuuaaugcauaugaguccacugucacugacuucagacacaccagaagagggcaucagauccuguuacagaugguugugagccaccaugugguugcugggauuugaacucaggaccucuggaagagcaguuggugcucuuaaccgcugagccaucucuccagccugauccugaacuucuuacccuccaacuucuaccuccuuauugcuuuuauaggugguguguaccaccacgccuguccauggagggaggggaagccgugucaggaaggugcauaacaugcuaaggcucucaggauguauuuucccuuacucagaacccuagaugaagcacuaauacuaccucacauacagguagggaaacugaggcucagagcagucaguaagccuccugcagucauguccaguguauguagaauucagauucaaaaccuacuuuuugcuuuuugcacagugagaaguuacugagguagggggcuccgugguggacaaccaaugcgggaugcucauggugugugagggggaggcggugagggugcuccuccaucccuggcagucuaggcugcuggucucaguccuggagggagcagugagaaaacagcgggaccucaggguagguuguaaucagauguuagagagcccugaguaccaggcaaggauuucgagggcacugaggagguucagagcacacuggagugaugagaucaggugaccauguacaagaaacacaucaggaggcucucagaguucucuguaggagggaagguaccagugucuggguuagaaggguagcaaagagaagacaucccuccccacccgccuccagccauuuucuuugugaguuuugaggguuggugcuagguucccaggcagaaggagagccucucaccccagaaaacucuugagaccuuccagaccaacacaccuugcuugucauugacaacugguaagagaggagagacgguuuaaccacaccgcuccaggagugaugggcacaggaacccugccguggucccagcucucagagaaaacugguucuggguucagugagaagccccaggugucugcgucagucgcuguuugggguccugaugucucccccacaagaugacccuguggauuuccuuagcuguguugccuugugugauggccugacauguucuuugucuuucucagcuugcccuuagaccaaacacuuccucgccagggucccagccagccccuguccuucccggaaaacuaccagagucuucccaagagcacuagacaucuuucugggagcucgucacccccuccccggaaccugcccagcgacuacaaguacgcacaggaccgagccagccaccugaagauguccagugaagagcgccgggcacacagagacggcacuguguggcagcucuaugaguggcagcagaggcagcaguuccgucacggcagccccaccgcacccauaggagcuggcuccccagaguucaccgagcagggucgcagccggagccugcuggaggugccccgcuccaucuccgugccuccgucuccuucugacaucccuccuccugggccuccaaggcccuuuccgccccggcggccacauacaccagcagaaagggucacagugaagccacccgagcagaggaggaguguggacaucucucugggggguucucccaggaaggcacggggucaugcugccaaggugaggccugggaacuucuaccaggugacugggaucuuguaucgagagacagagucacucgguggcugccuggcagccuguaagucaggaaacaauauaacaacccagcugaggucgaacucucagggccuuucaguuugcugugcugugcccagugagaaagguguccauuucagacaccaggcuccuagggcucagagagauggaaggacgcauggugggcaguccugguagugaguggcugaggucuccuugccuggccucagucuggcuucuuuccugucacagaacuccucucacguggaccggcguuccaugcccuccaugggcuacaugacccauacagugagcgcucccagcuuacauggaaaaucgguaagcugccccucacuucccucuccaggugacugacauacuguagaauccaggacccuaggcccauagcacucucucccuuggagccaagcuuccaaucccuucugggugaugaggagacaggcccagugagcacucaggcccugcagcaagcccuccaaagacugaggaaaguggaggggacugcugggcuggcccucucuucggauuuuguaagaaguauauuccagcuacuugcucucuccuucggcaccucuccuuucuucccuggcuuucacuaugauugguuaacucucccuucaaagcacucauccuucugggugaagcggagcugguggcuuccagugcccuaugcuggcggugccucuauuugcccuaacagaggccaaugcgaccauugccuggcggugucacgucagagugguccuggcacuggugaagaguagaauugcagcggugugcccugcgguggcugacucccuccccaugugucugcacgcccacagcuggaggagcucucgcugcugcucacccgguugcagcggcaccaguccaaguuggccagcgugcgaaauuucgccgugggccaguuacuacaccacuacuugaccuuucccgccugccaggucagcgccggugggcccuccugggccccggcagggauggccugccucccaugucuccccgugccgugcucuggucuguccugcuggcuggcucucugccucuccccuugccuguuugcuucugggugcuacagcuagugacugugggcgcgguggagcgccccccucuggugcaggggaggggcugcauggggugggacagaccugaaucucgcuucuugagcuguggagaguagcaggcugcuucguggucgucuugucuaagagcugugcccugucagcauuauugcucauugaagacauaugugggucagccuggagggaaauguagggcaccuccguuugcugaacaguccucaucucuuguccugucuagcccugugggcaccuuaaaggggugggauggaacuaucaugggacaagaggauccuaaaggagcaguaacuuaccaagagcuggcaggcuggagccagaaucccaguccuacugggguuaguuuuaaauagcaucagggccuugggcuugguacccaggcuuccugugauugcccugggauuggcugucuuguguuccuggagcagcuaagggaaguggacucuugccugaaacguuguccuuggguagcagugguucguccaaguaagccuggucccuccgugcagcacaaagccaggaagaggacacacgggauugcugggauggucacauuccuucccugaccccuuuuagcaagaccugaaggacucaggaacuguaauuagaaagaugaguguaagaaaggacauguuaaaaaaaaaaaacaagcaagcaagcaaacaaaguuaaguugugagacuuagugggcucaguggcuaaagagcuugccaugcaaguguaacccuguaaaggcuggguggauguggccauccuccugugauuccaacucuagagcaagcuggcuaguuagacuaguuaagcacaucugugagcucugggugauagagcccaccuuauaaauaagguggaagacuaauggagugcuuauacacuuguucccccacaugcaaaaacaugcauauaugcauguauaucacauacagagacacacagcaaaagggaaaagaaaaaagucauaaguccugaauuugacuuauagcauucuccagcugucuuuucuuguccuguucaaagugugcagggacagugacuugggggagugggaugaggaaggaggcaauccagggaaagaaauaagcuuaugccagcucuagcaucccuuaaagacagggcuuccaugccuaaggcacgauaugaaugucucaugugugugucggugaccgucucacaccagagcuaugcaccuuccccauccuuggcuugcacagcuggacaccucaguucauuaagaacaugguaucuggaccacucuucagcucuugccacuccucugccucaguuagcuucugugaucugcuugcugaacaggaguguggcuuguggggagccuuuuucucaauaauuacaccgaagagcuugauagaccauugaagacaccacaagcaagucuuacucaacaacucccacacuagcuccuaauauggcugcuguggcuucuuacugaacaaaaagagcagggaaacuuccagcagcgguuacuuaucccucuggagucuaaagucauaccgggucuuccuggaucacccaagucauuucucucugccuuuuccagucauccauccacaucacuuggggucuuguuacuucaugcaugugacaacacaaggcaaagauuugaugccaacaauuggaauagcugugucaaugggauccuggcuucgaguguggcgagugcuguuccgggcagaucuucugguucugccucaggagccuagcaucugccucaucugcucuucugcccuagcccucuuguuggguccuucccaucauaccgcaaugggugcagggauaagcuggcuauccccacugugacccauaaacucugccaugcugaaagagggcucugaguugcaacaagacaucugugcuuccucuguagccugguguguugaucugcuguggucccgugucuccaguguaaugugaaugaucugcuuucgaagaccuggguuauuuaaaccaugguguuuguaacuguccuguuuugcuuuuuucucucugcuuccugggaaggcugaugacaccuaccuccagcugaagaaggaccuggaguaucuggaucugaaggugggugguagccacuggagagauugcuuaaggguuaggaguacuugcugcucuugcagaagaccccgguucaguucccagcacccaccucagguaguucacuuacuaaucaguucuagagcauuugauucccuuagaccucuccaggcaguccaaaggcacauaaguucacacaggcacgcacacuaccuuuaaauaaagguaauaagucucuaaagauaaguggcaucuggauuccaccuaccauggacacucaucuuucugcaaguauuacuuacuggagcccaacucaaguuccagacccuaagugaaaacccuugucugaaucaggaaaaagucauugcuuauggucugacucuuguggaauggcuuugugagcccuguuauaggaucucuggcuuagacaauaugaaggucaugguuuugaucuguugcuucccuugguguagagccagagguuccugggaaauagccaguggcuuugccagagccucugcugcuggcagggguguguuuggcuuauagggaguugguuggugugugugaggugccuguggguacuugaagcucaagcccuggcuuagccuuuaccaccgagcugaaagggcccaaagaaagcugcugcugaguugccacaacccacaagcuuccucuggugacagcccuccucaugccugagcucugggacagacuggaggagggaguguaaccuuagucaacccagggaaggaagaagguuguggaccacguuuaucuuuacugcacuguaucccuggcucaagacauuucugaugcagggauugucucccagccuuguagggcucagcuguaaacccuuguggggguuucccaugccuuaggugacuuagaccuuugguuagauaucuccuaguucaugcaucuguuaagcacuugcuguaugcccagcuuuacaaaagacaagggcagaugcaaaagaaaaacugaaggcccuagucuuaaggaauuuccgaauaguauggguuagggaaggaaaauaucccaaaugauaguguauacagugaccauacaaacaucugucuugaucaguucugagcuggggucaugagaaguccaugggccgugagcgaaaggcuucuaaggcaguggggagcaugugagcagagcuuugaagaaucauggagaugagcagccgugaugaaguugguagggaccgaguaagccaaagagagucgcugccaugcaguggugauauuagagccauggagugagguggaauaaauccuauugacucccgacucugucauaggccuuauagggaggaagagaauggaggaagagagacagaggcacgaggcuucggugcgcgagucagacagaagccgaguagcgacagcccauguucugagucucacuguaccacauuagcuuacaacguagucccauaaggggguaaauuaccuucucaaagccgcaccggagacagagauacauuugcguccagcacccucucacccuaaagcucauaucuaccucgcuaccugccuuaaagcacaugccauuuaugcugccauggucccuaaggcaguaaacuuuuuggagagccgagcuuggguuaggauggcagggaauggguuugauggacuggagaggcaaguugcuuccugggggagcuuccuuagcuaugucaccugaggagguauucuggaugcuggcauuaucaugagaacagcugggcuuguagccagaguuuccugguuguguaucugcuacuguaauuacuaagcucuucucagggaaguaguccagggaugaaccucuccugcagcuggaagaggcuuggcucugucuacccaagagagagaagagcaguuguguaugaaguaaugaucagaaaagccagugugcuugcauggcuuccaucagagggcagggaccuggcugccaugcacagauccaggagagugguccaugaugcagaccacuacaggaugcagagcccagggucaagggccuacaaaggacuaugcuuacagauguucaaagucugcuaaguguaaaugugccauuccaguuuccugugucggggucgcaguccaggagguuaggcacaucucuacucugccucccgugaugugcugaugucaccuuugaacucagguuccccucuucccccauguguuuucuguggcucugaagaggauuaagccaagcagauggcagcuauaggcagacggacgguucaguugguagaaauggucuucugaaagggcuuucucugugguggugaauguccucucacagggccacacagauuggaaccuauggauccuauaacaugcucggcaggauguccuugaaaugaggggggauauggaugcagguacuguagguagagacagcacgagaagagguucacacacccaggaaaguggaugcacuugaaugagcccagaggaccacccugggcaugagagacaagcugugccccucuaggaccauccucuaugggauugaaccuccagccucaugcaagcaagcacccuaccucugaggcauauucaacuaugucaccaaaucucuuuuuacuuuaugauuauuaauaaauucucaggcuagcauugaauucacuuuguagcccagguuggcuuugaccuugcaccagccccucagguaguuggacuguggucgccgccaagguguggugagugugugagcgugugcgcgcgcacgugcauauacacaaaugguuugcuagggguacaacguagggccugugcuugcugggcaggugcugugacacugcuuucuccccaucccuaagaugaauuucucuagagaauacuucccuugcccacaucugaucuauggauucccucacucugauaugucaaccuagguucuucuauguuauuguucuaagagcuaaagauucagggcccaucaccccucuggguguccugaguucacugguggugacuucucccuagcaccuuccacaggcuccucucccucgggugaauaucccugcuguggggccaggcgaucaaaugcaggcaccgcgcagaagacgcagcucuuagcuaguguguuuuggagagugcuugcucucuuggugaugccaggguagaaaggacugagcaguggugaagcuucuauucugccuggcagugucugucugguugauuuguguuuuaauuuuaauucucacaguaacugaaugguaggaguuacucucucuauccuguuaaccaagaacccuugucucagagcggguaagggaguucugcaaaguuccauggcuggaacugaccgcagcccugaguuagucaucugggggcuguguuuccaucauggaaauucuggaucccagaaccugaacuccauuaacuggcuuuaaagagugggcuguggucgagucgcugucguccauagcauuuaaaauaaaauuauccuuuuagauagcgucucagaguguuacccaggcugcucucaacuaucugggcucaagugaugcuucugggcuguggaugugugccuguacucccaacuuugaguuauuuuuauaucgcccugacaugcauccaggugaggcugagcaggguaucuuuggcugcucaagugaauaccuuuguaaaugcagaagguugccuucaaccccagggaguaccguuguuggcuccacaucuguagcaccgugaguucucucugacaguuugagccuaagaucagggcuuguccguuuccaaagucagcuucuggggcagaguuuuuagguugcuaucuggggcaucagcuauuucuagagcaucuaggaacgugauuuuuaaaauauagaucugagucaauuaugacgauacacaccuggggucccagcuucuugacucagacaggaggaucauuugagcccauaaauuagaggccagcccacagaacauaaugacuuuuucccuuuaaaaaauuauuuuuaaagccgggcaugauggcuugugccuugggucccagcacugagaggcagaggagggugaaucuuugugagcuugaggccagccucgucuccauggugaguuucacagcaaccagcaaagcuucccguagagacuucucugucacaaagaacaaacacacuuuagagccuggcgugaugcaugccuuuugaccagcacucaauaaggcagagacaaaaggauugccucaaguucaaagccaacuaggcuacauaguuccaggccagccaaggacacagaaaccuggacucaaaaauaaauaaauaaauaaauaaauagauagauagauagauagauagauagauagauagauagauaaauaaauaaauaaaaauaaacuuaaaagcagagguuagagguaaagcagguauagguacuugcuaccaagccucauggccugaaaccaggacccauaugguggaagggaagaacaaguccacaguugcccucugaccaacacaggcacuauaggauguacacacagaugaauacauaaauacguuuccuucugaucucuacugaguuagcacucuuguguccaggauccucugcucaagccacgcucaggugugauucuuguacacacuaaaacuugaggucagccauccaggaacagagauuacuaagcccagccaugaacuaaaccacuagggaauuuggaaaaugcaugucuuuguuaggguuucuauugcugugaaaagacaccaugaccauggcgacucuuauaagggaaaacagcucacugauacuggauuacaguucagagguuuaguccauuaucgucacagugagaagcaggcaggccuggugcuggagaaggagcugagaguuuuacaucuugagcugcaggcagcaggaagugguugccacacuggauguagcuuggacgucuggguucucaaagccugccccagugaccacuuccuccaagaaggccacaccuccuaauaggcauugggagccaauuuaauugaaaccacuacaaugcuuagagauucugacuugacuuaaacaauuccuuagauguuuuuaaaauacaguuauggucgagaaagaaaagauuaccucagagugguuguuuuuguguuuuuuguuuguuuguuuguuuguuugucuguuuuugaaacaagggcucaucuaucccagguuguccuuggaugcccaaugaccuuggacuuguaucuuuuugccucuuucuccugaguacuaggguuuuguagguacauccauguccauuugauaugguaggagauggagcccagggcuuugugaaugccagacaagcacagaaccaacugagcuacaucuuggaagugguggcucucaaguacgguuccugaccagucacagcagcaguaccugggaaucuguuaggaaugccaaaucuugaguccuagcccagaccugcucaacaaggaccuccaggguggagcccgagccuuccaggugauucggcacaccaaaguuggagggcuugaguaggaauucugaugccaaccugggggcguaacuugggguaaaguacuugucuaguacacaugaggcccuggguuccacuuccaacacuguaauaaaaauaaaacuugguuggcuugggaucuacacaccuggugggggagaccguguuuucuuucuucacauuucuuuaacgugucugugugcauguguguguggaggugugugugcauauguuaaggccugcauuuggaggucugcagggcugguucucuccuuccacccuacggcucccagggacuuaagcucaggucgucaggcucagugacagcacugcacacugagccaucucaaggccugacaggcuguagacagcacugcuugugagcaucuggauccucuggguaagcggagacauuuaccuaccugcacccaaguauggagcugaagucugaggaaauucuguuggaaauaaugguuagaacugagaggaaugcauaaaccgagcuuacagguguuacagaacguggugauggaggcaggaagaagcagaucucuuccgucaggcuuccccuccccuuccucuacagaaccgggaaggaagggaaccaggaaguagcccuugggcauggucagcccacacaggggcccccaagcaagcaaaacuggucaguucuuccuuuagaggcgucccuagcugggagcucacucuaccaaggcucgaggcacgucuuaauugucugcacaccucaucucugagguuccccuucuccagccccccagacuguggcugcuuccagugucgucugaugucucaccuguuacguuuuguuguauuugccuuucuguuuggaacagauuaaaaauaaugaaccuuugaucaacgugcuuuacaaagugcugaagaagucagcacggggcugucggcccgggagaagcguaagaugaucggauccgugucuccaggcggggccauuccauugcuucuggcucagggccggcaccaucacuugcuuaagcaguugcucuccugaccgccccacgcuuccugcaagucauuucgguugauuuucuuuaacccaaagcucucuucagcauuguggcugagcccgcucaucugugguguccuguggcuccaucuuuuguguugcacagggguggggagcuugccaccagcuugcauugugucuccaucuucacuugucugccuccacauugguauggccgagcaugaguuuaugggaguugagagaagccuuagauuccacugucucugccuuuucuaggggcaggauacugacaugcaggacccaguuuggaacuggauggccacaccaucuccuuugcaauguaacuagcucuuggagcuuucugagggaggcuacagacugaggggcagguguccuguucugaugugguagaggggagguaggguggccgaggggcugagucucuucccauguagagauucuuuaagaugaauggggaccugagaccuuugauauuucuggggacggauacuggggacauuuguugauguuuuagguggauagaaauacuguuaccacugagcaccauuuaaaaagggaaacuuaacugccauguacuacccguggcuggaacuguucaucagagcauccuuucucuggaucagagcuaagcugaaggaccucugaggaguauaagccuuucaaggagccggugcccugucacuuguaaccuuuacuccaucggaagccaaacuagccagucugauuuuguuauguucauaaacucacucagcuaacauccuccagaucuccuccauaugccagguccugcuugggcuucaaggauagagagaaaaugcauucuagucuccacagugcccccuaaugugcuuaauaggucuggagaggagaaaugagcagacauuauggugauuugauacucuaagccccacagcagugacaggcacccugugugagagggacaugcugaaggacaccagacccacucaaaaggaagaaagaaaggcaaggacuuugaauuccuagcucccaacauccuauaaacagcacaucagagagaacaagagacgccuauuucuuagaaaaaagggaauguggguaucccuggagggagagagaaacagaagguuggcuccagagucacagaggacagcaguaaagggcacacuuccagaggggacgccuccagaaggccuaauucggauuucuccuucucagaaugccuuuguguauagauacuucauuucuuuccugauggugcuggauaaaugaggcguugcucaguuagauccucugccuuauuuaagcaucagagacauccucaauaaaaagcuucaggggaaaggggggaagaguuugcugggggaaauccccagagugcaccucaauuugaaagugauuucuagcugguuaacgagccaaggccagcuuugaagaagagaccaacucauagcccuccccucaggccucuauauucuaacuauguauaugcauguuuguaacauacucugcauagaccccacagaacuugaugaugcuugcuggacucuuccucauaugccaggccugauacucagucucuaccacaaaaaaaacaaggccagggucccugucgucugcugugugaccaaauggaagcaguccucagcucaaagcgaggagucauuugacuucuucuguagugagcugacucagugguuaagagcacuggcuucucuuccagaagacucagguuccauucccagcaccccauagcaacucacaugucuguaaccccaauuacaguagauccagcaucgucuucugucuguauaaacccacgcguaugauaugauacgcagacggacaugcaggcaaaacaucguacacagaaaauacauauucuuuuaaagaagucauuugauaguggcuuggacuugcugagggaggguguauggcaguugggcacaugacugugguuagucugaagagaaugauggacagcccuuuuugacuccuggcucacacuggcaaacuucuugggccuuccagguggagcggggagaaaacaaaggcuaucacuccagcaacugucucuccauccuaggguccucugccuagcacacacuaccugccucugccaugguuacccugcucuccaugucugcugggcagggcugcaaaacagaacagagaaaggcugucuggcucgaggugcuuuaacugaccuugucaucgugcccacagaagcccacaucuucauagccuaugaaaggaaggugcccggggaaagcggcgcaugggauagagucgggaguuaguaagaacaggacagcagcaagcugccugcuuacaguugacgggggcuguaaaaugggcuguucuacuggccuggaagugugagagacuuguucguugcuuuguugaggugguaagauagguuguaacucacuugaguacagccaagccuuguugucugggugugaaucuuaaaccacuggcuggaucugcccuggguaccuucccacucuggcuggaucuuuuaguaguguaggauaaggaaggcuggcccuugucuauggggaaguggcuucucagagaccuggacaaacuguguuugucucuagguguaucagcacgccucucuuaccaauggcaaaccuccaaagacucauaggaacgugucaugcuuguuuggggcaaacugaugaccccuguaacuugagcaccugcauuuucauuaauuugauaaacuuaauacuccuauuagcaucaccaacaguuuuuccauaaaaugaagcaggcauuaauacagugcagauagugcucaaguucuugcccauuuugugccaugagccucccgccucugcugagacuuccacauccaucuaccauaggacuaaccuuccuuccugcuacuuggcuccacacaccuuguuaaucauuaaauuguucaccucccagaugacaggccgagaccuucuuaaagaucgaagucugaagcccaugaagaucgccgagagugacauugaugugaguugccagugacaggccggcuccuuggccaccuccugaccuggaccugggcagcuuccagaaggguuuccauauucacugucuggagguuuucugcucuuauucccaaugccauuggccauguucucacccccuccccccagcccucuccaacucguucuuacucacaggucaagcugagcaucuucugugagcaagacaggauacuccaggacuuggaagacaagauccgagcucucaaggagaauaaaguaugcaucauuucuucauaguagugggauggaauggggggacuguacccaucuuggcuuugcugacauaguauuugcacuccuguguuagcauuaaucaacaggaggcgcuagaguuguaacaggcuauagaguguuugccuaaugugugaagcccuggcuuauauccucagguuacauaaaacagguacaguuaucauauaccuauaacccuagcacuuggaagguaggcucuaaaucagaauuuucauccucagcuauacaaugcuuaguccuguuucaaaaaaccacacaaaacauaaacaaggguuacuuuauucagucuuucuugucuaaaagugcuccucaaaggcuccuaucugagccucccugugugguuaaaauuaauuggggguuucuaccccacuauugacauucaguucccaaauagaaccuuuauguuuauaauaagccuuaaagcacuagagcugggcagauaucagcccucugagcuauucugucuacuucucugucaauaacuguaauauaacuugccacguucugccugggccccucuuacuucaacuggccagcccucauggccauguucucacaauucacuuaccccguggcgacuucuucucucuucaccucucugcucuccucacggucucugcuucagaccccaagccuagcaaucgcagccccaccuaccucucuuuugccuagcuacaggcuggaggcaucuuuaguuaaccaucaguuuuaaauuaagagacaagguuacauagcaucacucuguguagauauagauauccuuaucccggaggcagcuagaucuugggguccaguauuuggcauuacaauagacagcaacagaccaagccucaacacuccccuccuuuuaggaagaacagccugcugguucauacucccuuuucugugcuggcccaggucuaagccugggaaaggucuuuauugguagcucugauggccucacacaagaaacccagaggucugccuuggagaaaguggcccucaucacacugggcaaagccuuuugcuuccucagguugcuuaccccagggaucugagcuggaaaggcaguaagucaagaugggaagacaggagagaacuggggccacaguuauggccucagguugacuuuucucuuuuuauauuuuaauaagauauauucauuguguugaagaucugugacaugcuuuuuuuuuuuuuuucuucacaagaucuugggaagguucucugucaauuuguccauuuguuuccugauaaccuauaagcaaucagaagguucugcaccuaucuuguagauaagaaagcuguggcagagcuuuaucgagacugccucaagggccaaugagcugcucuccggagcccuguaucuguuccagcucagcucaccacuuuggccucaguugguugguuccuugggggacagcucgcccauccucuugcucuuggcccuuuccggcacaggaucagcuagaauccgugcuggaggugcugcacaggcagacagaacaguaccgagaccagccacagcaccuggagaagaucacuugccagcagaggcuccugcaggaggaccucguccacauccgugcggagcucugcagagaguccacgguauguagaggggaaagagguaacgggcacuuccccuggggcugccgcugagaugaggccaggggugagagcgugucgcugccuccuggagguuacuuauccagggcaucaugucugacucuaucugcacccuagugcaccuuagguugcuuuccuucaggauaguugagggagccucaguuucuuggagaagucuucaggcuguauucuagucuguauagugcauucugagaugucagaauuucuacuguuguggcugucagucuagugugguauugaccuucccaccaggguagggagggaaaccaucuuggggggaggaauggacagugcagguggccaggaacaccuguucccaucuccuuuccaccuaagccuuccccuuccuucuuugccuaggggguaguagguuagggguggguauccuugagccugggagggaacaaggugagggcccaucgagggaccagaaguguuuucuugccaauaggagauggaaaaugcauggaacgaguaccugaagcuggagaaggauguggagcagcuaaagcagacccugcaggagcaacacaggagagccuuuuuuuuccaggugaccaagaaagaggguugucaccucccucguccucaucacuagcuuguuagggcugugagcucuaccaaacagcugucucaagcucuaccuuagcagggaacucuuugcucucaaugccuaacucucaguguuuggggaaagagcugauccuuuaagagaguagagcugggggcuggagagauggcucagugguuaagagcacuuacugcucuuccagagguccugaguucaauucccagcaaccacaugguggcccgcaaccaucucuaauggaaucugaugcccucuucuggugugugugaagauagcuacacuguacucauauaaauaaguaauaaauaaaacuuuuaaaaaaaagagguccaggaugaguuucuccuggauucccuagacaacagcaggaaguccagccucugucuuguuucugguagucacucgauggccugaggaaaaagucccuggagccuccucuucucucauuuaugcuuauuuguuuguuucuggagccaggcuggcugauccccaccucuguggccccuggccaaauuggaagaaguagcuuuaacuuaaagucagaauauucagaaagccuagcgguugaacacuuuuaaucccaagaguugggaagcagaggagaucagaucucugaguucaaggucagccugguccacagaccagccaggacuacacagagaaacaaaaagucaggacauucuagcuggccugugcucucuccuauuguaguaagccucgggcuucuacuccacccucaaaauuuuaaaauagaacauggccuguuuuccaacucuauuucagaucuguuucuucuuggggcucugacuacauagauucagcguauuugaguucagcaaauguuccuggaggcuucuugugcucagggccccacgcuaugccucuuugagagccggacuugcuaaccgaugaugggauucugagcuagguuccucuuucagguuucuucaugaauaugugaacucuggauguuccccuaacccuaggaaaccaaggaacuucucuggggaauuuuguuuuuucuuuucccauggaccuacugucccccacucacucauaggugguucugggagaugcugaggacaauguggagacucuuaccucugguucagggauggccucagagaaucccuagaagaugccucucucccacuguuaccccucccauccccccauaacucccuucauuagaaacaacaucccauaauacuuacuguaauggcuugaacauauugaguaacugcuguugguaaaauauucccaaaaguuguuucuaguuguugcugagguauaucuguagcccauggcuuuuugagaaaggucgcacugcauaaccaaggcugaccuugaacuugaaaugcuaaucuuaaaucuuuuuuuuuucuucuuaagcuagaguuucauuauguagcccuggcuggccuccaacuauuuagaccagaacugccucuuccucugccuccugagugcugcaguaagggugugugccgccacaccagacaucccaacuguguuuaagaguacagcugagcagucuaaguccauccacauguugugcagccguaguccagaauuuuccgucuugugaaacugaaaacccguucucuuccccccuccucuccucugguccaguucuuucccaucucugugagacggacuagguguugcaugcaucauuuaaguucauccuaugcaguucgagaccaucuauuuuuaaguuagguaaaguaggccaguugagcuggugaacacugcucacuccagcauuccucacuggucuguuucucaagcagacuuagauugggcccuggcaggucccaaagguugugccaccccuaugguaaagggcucuaacuaaagacguauagcaaauccucagaagaaacauuuagugaggagccaagaagauccugaacggggcccccuguguuccccaggagaagucucagauacagaaggaucuguggaggaucgaagaugucauggcaggccugagugcgaauaaagagaacuacagaguccuggugggaucugucaaaaauccagguaagacagcuagccaucuuccuggcguagaacacagaggggcaggcagaauggcccgugcacugagacagucucgguuccacccuugugucguuucugcccguacccucagaaagaaaaacggugccuuuguucccucacccaucugugccuucacucucuccaacugagagcaagccggcccugcagcccagcccucccaccagccccgugcggacgccucuggagguccgacucuuuccgcagcugcagaccuaugugccauaccgaccucacccgccccagcugaggaaagugaugucuccucugcagucaccaaccaaggcaaagccucaggcgguaagcuguggcagcuaggagcugagggcaugcugggugacucccugaagagauaugaacacaagucagguucaccucccauuaggcacugauaccauaccaaagaaaugacuccaccccagugcagcuugaucaccagugaguuuauugggcuuccuuacagcagggugaagugugacuuacagcuacaugagugaccccuaacuccugcaucguugcagcgucugccucaccacgggcaauaacucauaaaagcugcacuggcugaaucgcugguuuuguuccauuuugagaucuccugcccaaagcucgaugcgaggugcagaccagagccuugauggagaggaggcugcugaugugcagcaaggugccuagcaaccagggcuggcacagagggagacgugacagccugggagccagggcacugagaugccaguccucagguuuucgccggguccuuggcaagucucucauuuuucugagcuaucucaguuuucucuggagcagaugauggaaucugggagcucuggaaaagcaguuaguguugacggccucagguuuauucuuuuguaugguuguuugcuuguuuuagacauucacauguguguaacagaaauaacuccccuggggcuagagagauggcuuugcaguggagaacacugacugcucuggcagagggccuagguucaguccccagcacccagauagcagccagcacugacuauaacuccaauuccaggggaucugaugccuucuucuguucacagacauacaugcaggcaaaaugcccaagguaaagauaaauaucaaauuuguuuuuguuuuucaagacaggauuucucuguauagcuuuggcuacacugguauuuauuuuguggaccaggcuggccuugaacuuacagagauuugccugccucugucuucugagugcugggauuaaaggugugugccacuaccaccaccuaccuucaauuuuuuuuguuuuguuuauuuauuuuauuuguauaaguacaguguagcugucuucagacacaccagaagaggguaucagaucccauuacaaaugguugugagcuaccaugugguugcugggaauugaacucaugaccucuagaagaguagucagugcucuuaaccgcugagccaucucucuagccccauucauuuuuauuuuuauuuuuuuaaaugaaaugucuggggcuugagagauagauagcucagugauugagaaccguugcugcguuuugagaggauggagguuugguucccagcaccaacagcagguggcuugcaaucaccuauaacuccagcuccaggagauccgaggccucuggcuugcaggauguuuguccuuauauucacauacccacaugcggauacaugcaccuacauguaaugcaaggguuuuauuaaaauaucuauucugaaaaaugacauuuaaaugucagugaaucacaaucaggccaccauccuuuauaggccaaccuucagacugaaaagcagaguguggccaucacaagaaggccccacaucuccucccuuguucccaguggucuuggcgucuguugacucuccauguuugcaccccuaagcacuugaauuaugcauggacagaacacagcuaaucugugucuucuacaccgugacuucaccagucccguugagugcagggaccccgcauuguagcuugacuuguuucuuuaauuuaccauuuuaaaaacugggaaaggucucaggguggugguacacgccuuuaauccuggcagaggcaaguagaucucuucuugaguuccaggccagccaggacuuaagagagaaacucugucucaacaaaaccuaaauaaauacauaaaacuaaaaaccagacauagguaauuucaaagaacauaggaacaagagccacagggaaagugucuaagaaaaugucccucagccacccugucucgccauuuucuucagucaaagacaaugaguauuuuggguuucucuuuguggagagcuuucuggacgcuggugauucuguuggcuugucaggacuggaaacuguugauucuagggagccugugccugucuuaggcagaugguuuaucuuuugccacagauauacacgugcaaacacacuaaaaugugaaacuucuccccacccccacccccaaauauacugggguuuguuuguagaaucagcuuggacuuuccuaaauucugugaaauccugaaauagaaggucagauuaggggaaggagggaagaguuaaugacgagggguacagcugucaucagugagugaauuuucaggcuuggucuccuggcauggaagauccacagcccccaagaagccagcaagcacacugaguacccaggagacuggccuuguccccuuccucccuggaagugagccagugccucuccugccugccugucagcccacuagagagccuuuguaagaagguucauuuccaagagaaagaacaggaugccaacugaugagcggcuccucacacagaaggacucagcucuggagucuguucaggcugaacaccacagggccgguagaugucugucccugggcugugugcugucacuaucucagaaguaguggucagcaucucaccuccccuaacaaacgggcugaggaggccggugucauuugacacugccaagaauguagauccaggacaccaagugcuggagcugggucacugucaccgguagguagcacuuugaaacuagaaaguaugucaaucaaagagaagaguuggaauggagguagcuccucgaagcuuccuggggguggggggcgaugagcaucugaaguggcugacccuguggcagugccucguaagagcaccccuucaauuccaucccucugcacacuggaucugguucucucucugcacaggaagacgaggcaccucccaggccaccacuuccugaacucuacagcccagaggaccagcccccagcugugccaccacugccgagagaagccaccaucauucggcacacaucugugcguggacucaaacgacagucggaugagaggaagagggaccgggagcagggccagugugugaauggggacuugaaggugagcuguaaagaccggguguguccaccgaguggaaggggcagugugacgauagugaccuaacagucuaagacucuauccacagguggagcuccgguccuacgugagugagccagagcuggccagccucaguggggacgugccucagcccuccuugagccucgugggcucugagagcagguaccagacgcugccaggcagagguaaggcaagacugugaauccuucaggcaccucacucuucuuuagcacucgcagccucuacucagaccucagauccuggccugcagcuugagucuaacugugauuguugcuaagagggaggacaggucugaccucaggagucguuugguuuuucucccuuucugccuccaagagcagcaacagugauugcccuaaagucugacaguguugaccuguucuuuaugagccucauacgcaacuguguugggaggcggggcuauuaugauucccauuuuaaagaucaggaaacggaggcagguacuggaaagauugcuuaguggcuaagaggcugacugcucuccaggaggacccagguucaauugccagcacccacaugaugguucacaucuguccacauaacucuugcaugauacacacacacacacacacacacacacacacacauacauguacucaauauccauaaauaaaauuaagaaaaagaaacagaguggguaccagucucagagcucuggcuccagaucauggcagccugcaggcuggggugcuggaaaccgccagcacuaaggccacaucagaccugugucagccugcgacucagggacuucuucagcccauggucucuucucuaggcuccccguuuaucccuagcuggauucuccaugaagcagaggggcgaagguucuuguaucacgcuuucccaccugcgguagcccagcacuucuuguauggaagcauaguuaggguugugcacagcucuguagggacagaggccacccaggccaacccucuucucucuguguguccugccucaccuaggcccaaggagaaaagaccagggcaagugugguguuugcagggcuccuuggucccucaggagaggggagugugugagaagggugauuagggagggcugggggugucuccaaccacagcacacauacaccugagucuuccuugcuuagggcucucaggcuccacguccaggcuccagcagucguccaccauugcucccuaugucacacuccggagggggcugaaugccgaaaacagcagugcgaccuucucuguaaguggccaugggauguggagggacucacacuccauagaaggaagggccccugggauggcagugaccucgagcgagucauggggaacuuaggaucuccucucucccucuccuucucccucuccccccuccccucucaacacacacacacacacacacacaccacaccacaccaaaaaggccauuacacugccaucucuguuuucugaugacugccaagccugucagggcggugagaagcccaggagaccuguacccuagguucacccuggguugccagccucggggucagccucugcccagaaaccucauuaggacgaggggcauuggauaauuagaggaagugauuuucuguggcuaggaugagcccaaagaguguaugagaaagagaccaagcaggaagaggacagggguguguguggcuuaauugguagaguauuugccuagcauguacaagccccuggguuugaucaguccccaacacugcauacauuaggcuugauugucaacaccuguaaucccagcauuugggaggaauagcugggagggccaggaguuuaaggguuauccuuggcuaaguagugaacuuaaggccagccuaggcugcgacccugcacuagaagcaggaagaagcagggccucucgcuccaucuccucugugucucgccuccuccucagagacccaagagugccuuggagcgucuguacucgggggaccaccagcggggcaagaugagugcggaggaacagcuggagcggaugaagcggcaccagaaggcucugguccgagagcgcaagaggacccugagccaaggagaaaagacgggucugcucucagcccgauaccucagccagccacugccaggagaucucggcucaguauguuaggcggggcugggacagaggccagaacuuccccgagucccccaagcagacgcaaguccccugccagggugacuuacuugguugaccgucccaaggggcugcuuguccacaacuccagccgcacgugugagcuggccagaggaugaccgggaaacaaagcaguagggaggucuagcagcagaggccucauccuuucuccacgcugagugggaggaggcucugggcucaacgaaggacuugagaauguaggauuccaguagagcagaugggaaggaacgguaugauaugcaacucaaccacacagccucccaagcagaucccgcagccaggggaggcaacucaauaaggugcugguggucucccacagcccgcggggcugaggccucagguacucaggagggcuggggaaauuggugcugccccugguggcuggcgcugcaccugcccacgguugccuuaggcucauuguggggacauugcauuuggcuuugggguuuggagcccccaguuccccagcccucuagccugacugcucccucccuaauucauugcacaagcuccuacgcuucuagugucugcgcucauugccucuaauccugccugauugucucuacagacgcucugaauugguacuggccccucucuaaccagccagugcugucucugaccaggcuuguacuagcagcucuuggcucccuagacuagcaggcaucccuagguguugcuuaccuucccacugcccugcuuuguguaggccagcugacugauaauucacccauccaaaaagcugcucugugaggaccacggucauuagcaguggucugggcauuggggauuuaccgauuccauccaugccuuacccuggacaguaaauaucagcuuuagagagugcguagucugaagccauuuggugguaacuccuccuaucccaucaugcaauuccuuauugcuuuuguaauucuuaucuaguaacuugaauagauagcaaaauaaacuguauucagagggccucucugcagcuguuagucaccaaaugacuagaauagugucuuuaaaagcuauaaacccauuaacuuuuaaguauuauaaguaaacaucagaacccugacuuucuacaaccugcugucugggauacagagaguauuuccgauccacaacuccaauccuuugugcuuuuucuuugggggaaaaaaaggcuuguguaagucucgucagcgccaauaaacauauugcuucccauuacggauuggcgugguucuuccgcaggguaguuugcagagugcggugaacuuuugcuguuuguggaagcaaucaggcuggguuuaaaugaggacuugucucuuuuugagcacuugugagcguguaaggaauuguguguuuucuuugugaaccauuaaauuuaucccuggacuucaguugccuaagucauccaaacuguaauuggaaaaccaucagcacacacaauucuguugguuugcuacggaggacccgagcuugugcaugaauguguggagcgugcugacauggcgacaggaucgggucggggugguugugagguaucuuuggcugcugggguacugugagaugaauggagugagagagaggaggugaccugaggcauuaaguaucgucucauccucacaagagaguccuuuguucuuuuaaggucagaggucugaagugaacaggaagccaucuuggaacugcgcacacgugccuggguagauuuuucccuccugggaagagacauugauacaaaguugccacugugaaacagccuuggagcaauucccucugaucucacuuuuaguuuguuuucuauuuuaaggaaacugucuuaucucaaaugguuaucauuuuccacggcaguuugcaacacugguggucaaccaacuccuugguacugauuggaacucucuaccaauugcugggucccuguggaccacuguaggcuuaaagucaugggucuuccuccaggacccuacggaugcacauuugaauacucagagguccuagaucagagcacagccagcaguguggaagaggccacaggacgaaggcagaggccaguuuucaguuacacacacacacacacacgcacacacacacacacacacacacacacacacacacaacacagcuaugacacuugccuaaugucucaaaaguccgucuucccagguccuuaggccucagggcccugugugguucuugaaugggucggaaagugagguuaacccucuccucuguugccaguggaagcgagaacaagaguuugaccugcagcugcuggaacgggcugcucagggggacagaaaagacaaagaggagggcuggcugaaagugcaagccacaccugucauggaguuggaccuggagccacaagacuaugacuuggacaucagcagagaggugaggauaggggcuuccuucaugcuuucuagaagucaccaggcaggguucagcuucacuguugcccaggaagguccggacgcuugagaucguaaaggcguccauguucuaaaucacacuuaagccuauuucugaugauguggggagaauuaagugacucagcauguucccaagaggauuagaaaauguucccuggaucauuagugguggcccucgaaaaugaccucuuaggcagacuaucauacguggugggaaaauacagggcaggucugaaaagucacaggagacauuuccagccgggacuggagccaauuucgaucugaacucuucugcugcccucuaguggcccacuugccucaugacaggucaggccuaggaaaacaaggcaggagaaaggaagggagggagggagugccaggcagucuucuagacaucucuggucaccuguggucugugggcagugucugcagcuguuucaguccuuugugucccuagcacuaggauggcacgcaguaggcaugcuauaaaugucugcugguggaagacauuguuauaugaauuuccagugccccaaaacauuuguguaggaacuuggccugcugcauuuuucccagguguaggcugaguuugggugagauucuaagucuuccacaggugcccuacuuagguagagggggaacuuugccacugugguuguguguguguguguguuaaaaucugggucucacacaugccaaguacauagaacuacauaccuagcccucccauuucaagagacagggcagauccauuugcagguuuuuguuuuguuuuguuuuucccuuugaaugguuagggauucaugggggaaaggagcucugagaacaaagagaacacuguagguaacucgguacuugaguuucuagguucuugguucuugcagucaguaaauucagccuccugccccaggucuuuuucucugacagccuaaacaguagcugccaacagucuggcggcuuucuuauucacaaagagccuccaugugcucuuggcaaugcgaggcugcccucugcuguccuuccuuaucucuaaccuaaauccuccugcuacaaugcagucuacuuccuacucuagaucuguccuggucggaugacagauuuuuuucuugccaccuuucaacaaacugaagggccacauggguucaguucugcuacugagaccaaaauccaccuagucaagggggaagaaaacuaucuugaggcaaauuaagaugacauuuugaaaaucgcaagcuuaaauauuccuaaaagcguggacagagguuuucagaacuuuagcuagcagguuaaaaacagggauucccacuggugcugggggaaaacaaaauuaacuuuuuuuuuuuuaauuuaaaauguacugagacaaccaguagaguugguucuuuccuaccauguggguccccaagaucaaacuugagucauuagccuuggcagcaagcagcuuaccuacugagccaucucucaaaugcacaaauuuaacauucuugcaggaauggggugcuaugaagacugaaucuguauauagcaugggggaggggccuugucaccagagcacugucccagaggaaagaaugagagagcuuuuaggaaagguaacuuagauaaaccugcagagucaggcugggggcagguggagaacugaagagaggaccaucagucuucauccguuaggugaagguaaaaaucuacgcucugcccagaaguacgaaaagcaccuugguuauuaaccgguugcaugcugucacugcugguucaagcuuuucagucagucaggucugaccuguacgccccccaaagucagaaguguguuugagaugggagagguuuuacuacgguuaugucagcucacccauccguuuuggguggucucuaagcugccuggcucugguucgaccuuuuuuuguuuguuuauuugguugguuaguugguugguugguugggcuuuguuauuuucuguuuugagacaggaccuuucuagguagcccuggcuggccuggaacucacuguguagacuagagauccacuugucucugccucuccagugcugggauuaaauacacguacuaucucacagcccugaaauaagacuucacuuacugaaguccuauuucagugccagaucccuaaauuagagcagaagaaagcuccuuaggugggaaggacaccagagcucccacugagcccguguggcuggagggucggcucacuggggcuuugaguguagcacuaaggaucaagugcuuccugugagagucucagcguguugccugccuucuguuucccuuuccccuggccucuagaaagccgucuaguguagcaggaagagcaugugcuucgguaugagacucagguucgaguccuuaguuccacaacugauucuuuugaugaucuuagcaaguuucuucugggugagccgugggggacaggccuggagcaagagugggguugaggcauguccaaucccuagaaaucuuguccugauauuggcaggaucaugcucccuccacacccccaagacagacagacagacagagagacagacagacacacacacacacacacacacacacguacacugacugggccugcauaucccagugcacguagacauuugccacaccagaggaggucacauagcccagcagccagguuaaaccucuuuuccuuucauaagauccuggccagcagcaccuggaauucuuccuuaugcaaaugaggcauccccggcaccuuuggcccagccagugaugcacacucaaccgcaaagccuuuacccacuccucagaggguuaaauagccucuguuucuccccaauuaaacaagcacucagugaagccugucucccuuccccugaggucuccaucaccccgucaccaucaugcucucaggccaccagucugauggugggcgacuaugcuguuaagggagggggaacagggugggaaugacaucuguagacuuugaugcuuccucacaggguaggaagggugggaaaacaugucucagaccagagcaucugcgcuuacccuccacccugccaccugauccucuccccagcugucuaaaccagagaaggucuccauccccgagcgauauguggaacuagaccccgaggaaccacccagccuggaggagcugcaggcacgguaccaaaaggcggagaagauacggaauauccuugcccggucaaggucagccccuacuugcucaaaucuagaagucucacagacuccaucucaggugauagcucagccaugagaagacccaggccaggcugacugguaauaauuugcuaggcuuuguuucaaaugaauucuucugaaggggucagccggugcuccaacaggaaagcuugccucaguuaccaaaaaggugcugaagaacuuaugaaggguucccaucccagguccauguccccagaucuguccccaaugacuggcaagugugggccauuucgcuagacaguacugaggcggacuuaguggaugucacuucacugaugguccucuuaacaccugugcccacacuccauuauggauucauagaugggcccggccuuuacccacuuccugaaccugagcuuggacaacaggaagugguuuuucugaccucugagcucuccuuucagaguuacauuaaccauuucauaucuggauuuaucaggaauccccagccggaacccuuagcuugaggccuacaggaggaacugaguuguguucuuuguggguuuagggagaaguaggcguucuugucuuggaagaaaaggggcaaugcauaucugaugccccuuaaaguguugaagagucaccucccugcagccagggagauacauguggggcugaugguggggggugucgagacucacagccuucucucugauccccaacagcaugugcaaccugcagccacugggccaggaccgcaacagccuggccgaccuggacucgcagcugcaggagcaggaacggauaaucaacauuuccuaugcccuggccucugaggccucgaagcgcagcaaacagguagcagguaaggcugugggugccacccuccagggcccaguccccugccugcugcucucagugacauguccuagaaccaggaaguuagcagauguuggcaggccugccugacccaagugacagaagagcuguccauaucugccagcucugagacaaggugacagggacauuucuuuccuuaggaagaaggggcagacgugacacuggagcagggcuuucgugguggggcaaagcaaagagcuccucugaccucugccuagaaacccuuccuugguccccaagccaaagccacucacucaccuugucagugaccuauggcagaaaguaggagaauaagaauugaggcuuggccagccuagccaaaagaaugucaccacagaagcagcacacggcugcuguguuacauaugaaggaugcuuuaagcaugugucuguaaacccgguggucaggaagcugaggcaggaggauugcuggaaugagacccugucauaaagaaaacggucagaaaaggggcuguggacuccucccucuguucacaucucccuuucugugguagccuuacaguuucccugguauaguuugccccuuauauggaggccauugugucuuuauguggugucccuggccagcuauacgucugagacggacagucagaggacucagagugguaccauucuaucucccgguccucuaacacaccuggccaagugugaggccagcgggcccuguggcugccaacccuggggagucuggagcagccugggcaucgcuuuuggaggccugugagugacaaaugaugacacagaugccagacucucgggagcagccuguucccuguccugaugcagcgcagcugcuagaauacagccuuguguggugccugauucccaccuagggagguguagacagggugauugggauuucaaagucauucuugauucuauagcaaguuuaggcccagcauagaccacaccauggcccugucucaaaaccaaacuagacuaaagcagagucucuggccccguucuguccaaggcauauagagggcuuguguugcucuguggcugggacuuaggcaauccuaucucaacggccuuugcgccccucccugggaggcugccccugcccuccaagcaccaccucgugcugugcuugugcccacucugccuccacaucuuaggugguacccagggccucugguaugcugggcugacccaccagucacugagcuacagucccagcuugcucucacucugaccaaucccuucugcuuccucccucacagcugaugaccccagcccugaccucuuguuccacaccuuucuuugcucuugcucucuucccugaaucagaaacuacaggcaagcuaggccucauggaucugcccccaggaccaggcuauuaguuguggggcagucggaccaggccacacagucuugccaggcagggcaaaugguggugugggugggcagaucacucuaacacacugcuugauuccugugugcucugucuagugcagcagcuggcccuccucccgccuaaagccccccuguccuccaggacggugccaccuuacccccccuuaagcaacggacugcacuacaccuuugucuaacaccuuccaaguaagagcccccgccuagcuggccugcugcugugcgcccuguagucucagcaugccccuccugccuucccacugccacugaguugacugcaaugccgccugcuguugcuuccuuccauuggcacugcggccgcuggagggugggguggagaaccugccagagaugguagacagaaguucaccuuuaaggaacucaggucucagggcucaaaagaggucgacaucaaaggugcuacugugcugaaauaccuugggggaguuuccagcccuuuaucucuauuagaugaugucggcuuuuggaggguucaugcugcagaacuguacaguugagguacaagaaaagaacugaagaaaaaaaaaaacccacaacuucucauauuuuaagcccauuuaggauuuugugcugggcugcccucacagcuagcugcccugggccgugggcauaucuucuaggguacuagcugcacuuaccgaaggcagcuugaugccccccaaaacagcacaggccacguugucaguguccagggaaagaagaguuagaucucauucuuucaggguuuuaucauagagaccggcuuacagcccagaguuacagagacaggcagacccugagggacugggcucagcccuccacacagcaaggcugccuuagggaagagacagaggcagguccaggagcacaacccaucaggaugcuugguacgaccccaugaagugaauggcugacaaggacaggcaaguauggcggauuucugaguuugagaccagccuggucuacagagugaguuccaagacagccagggcuauauagagaaacccugucuugaaaaacaaaaccaaaaacaaacacaaaaacaaaaaaaccaaaccaaaccaaacaaaaaccaagcaaacaaaaaaccaaaaaaggacaggcaguagguauaggaagaugcuccacccucccuacccaaacccccaccccccaucccaacccccuccaggagccagcaggcccagcuccugaccaguugugcgugaauucauagcuuccauccgcuggcccgucuguauccucaccuggaccacagccaucacgccagagcucccugcagccagucucucccuaacagucugccuugccgucaguuugcacaguucccuucuccuuccuuuccuggauuaugguuaacugugcugagggacugcuguguguuaggcaucgugcugagugucuccugauccucacaaccacccuauaaagcuguucgcuccaguuuguauccaaggagaugcagcucagacaccugagggacuugcacaaggagaugaagcuugugucagggugcuaagcccuuuggcaugaacuuuuuugcuggcuuguaggcuuaucugggccacccccagaagcuccaagggucugcagaacaggcugaugggggguaucauuuuacacgggggcccuccaacuuaggcacacucuagccagccugagggcaggaggagguaagcuagcuugggccuagucuggccaucaggagggguuagaguagaccuccauggaaagcugcagccauggccuuuguaaaggccucugggacuuaccaggaccauagauagacagacagacagauagauaauagaaaucuaagcagacagaggugccagugagaggcucuguucacucuagcuuuuuaagccccacacucugucuugugcuaggccuuaaaugcucucuccagagcucagcuaugcuucuuccuguaauggcaccacaggcagguuagagccacucuguccuuagauuagaaagcaaggucagagaagcaggcucucugguccuccagagaauacagggcagagcuaugcaccccacaaggcuugcccaggccucugcuuacugcagggguaaguuuaugagcuagugugggugcagcauguuuccuaagaaggaaaaugaagcccaaugcuuugggucauagaagaaaaggucccuugacagcggccgccuugcccacacacccugcucucuugcuccaucuaccagucccuuucaugcgugugcacaaacaugcucacucuuaggacaagaacaaagauccgccagccucucauugucuccuguacuuuuugccagcccaggcaauaacagacccaugauccagugugcagaggagaagccuggagccggggacccagcgaaaccagcgucuucuuggaguaugguucucucugccccaguggaaacccuuccagcugagcgggggcucuggcuggaggagagcaacccacccaccauggugggugcagccuggaaccagggcuccauccuaacacacgcccaugcuuuucaguccagauaccuuuugacagaugacagaagcacuuuugauacaugaugugaaauauacuguauuuuagaaucagaauauauuuuauaaugcucaccuggaggacugaauggcugguaaggugagccugcagggguuuguagccacacauagggauucagguacuaugggggugggguggcagagugaguggggagaggggcaaggcaagcagggccauuucuacccucccgugaacccagacagugcaggguucaaggcuaugcuuccuguggauuccaguauggagcucauuacgcuguccaggaaauuaacugcagagguccgcaucccugaaccgaugcccaacccuggaaacugcaccuggauggccgcacggagcccgucugugccucggcccuugauucugacugaggagcagccgugugcucgaaagccuuggcuucuucagcugucggugaagugaaguucucucagcagacacuucucagaagaaagaaaaaagccacugugagguggaaagcgagauguguuaaagcaauaacugggcauuggguggcaucugcuuacaaaugccuagccuugagccaucccuccagccaggcuguacuaaaggaccucugcugccugcuguggggaaacccaggacaguuuccucugacuaggucuggugaggugggcaggcagggccaggacacaggauugugacuugacuccagcccagcugaggaagagguggccaugccagacucaguguuuugucccuuuauuuaacuugucucaagauauucuacaugcaggaagcagugaaaaccauaaacaccuucacuggguggagccgcauuuuaaacgaaaauuugucuuugacuaugcuuacaagaagaaaaagaauccuugaauauauuuagaaguuacugucuauuuuuaacuaacuccauaugcugccaguaucaacuucaugacauuugccaaaauaagauuuuauuuuuugccuuuauaagauuuuguuggaaaaaugaaaugaauauuuugcaagaaaaaguuaauuuaaauaaaaguguaaugguuugcaaaaaaaaaaaaaagugauguauagauuaaaauauuaaccucauccgugucc

SEQ ID NO: 4052 - RNA, 861 nt, Mus musculus
cgcgucccagaaggcauggcggcgaggcgguaaguguauggcuggguugcuacgccuugaacucuugucucuagucuugcucuuagccagagcagcaagucugucucuaacaucucuucggaagucgcaucugaggggaccuagggcgugcucgaguccugggcugaaggauuuggauaagcugcggguuucucagggcucccucugcagccccgaacucgugcggugugggaugaucgcaaagccuaggugcagccggcgcuucucucuagaucguuaauucuaggcuuccgagccccgcccgggucuguccuccugucugcgcgccuuuucuacacaggucggagcgcagaaccgcucacccccgucggagaagaguugggaacgaggaaagaagcuucgagaagaugagggggaaagggacuaccccgggaguuggucuuuuaaggauguccuaguccgguucaccacagagcguucgaagaaugggugaauauaacaauuuauuguaaaugcaacaaaaaacaacaaagacauggacccaagaaacucagaucuacaagacccuguugacaagugaagcgugagagguuugaaacaguacugaaauacugauccaguuuucuuuuuuguuguguuugagaccgggucccucaauguaguuuugguuguucaggaacucgccuuguagaccaggcuugcuucaaacacacguuaagucuuucugccucugucucuuaaaaaaaugcugaaaugaugaugaaagguuugagccaucaugcccagcugcguucuuuuaacccauuacuaguugaauuacguuuuccaaaacauugggaacuugaaccaaauuuguauuua

SEQ ID NO: 4053 - RNA, 36320 nt, Mus musculus
gggcacgcauuaggcuguggaucagagcaaggcggagggccgugggcagggaaaacuggugugcucgcggcgggcaucagucggcuuagccucgcgcgccgggacccugcagagaaggucaguggcgcggagcaggguguagaucccagccucgaggaggcuggacgggucacagaagagagggcgcaggucuguucuugcccugcccaugguugugggcauggagggccgaguucugggcgggcaagguuggggagggucucccagcugaagccggaggcgucggguccacuccaccacucuucuagcuacagagcgcuugagcuuuucuuccggguggguagcacgagcaggcagaguaggugcuggacccagacuggggcgggguacgugggcgaggggcucgcccacuggugaggucucuggaccuaucgauucccggcugaugcuccgcgcccccccgccccccuccaguuguggagcaaagcuaggcccaggaacacagcucuuccccgggguaugugaaaccagcaucugccacuaaggagaaaguuccugccagcuguaguaucguuugccccaaagugacaaauuaggugaaagaggauacauuuugauuuagggggaagagaaagauguuacuuucuuguugcaccugcugaauguuaccuccgugggcuggugugguuauugugguugauacagacagcagucuuaccagacaguuauuuugcaaaaucagaaagggguggaggggaagagaaugaaaaugaacaggaacccuuguucugauaauuuauaccuuuuacacggguuaauguaccuuuuacacaauugaaugccgagugcuaucaucuaaguuucuuauuuaagaaacuguggauaaauaauauacauuuuaucccccuccccaaucauccugauuuugacaaaaggcaggaaaguggugacucacacaauaucagcuguuaggggagccugaggcaggaggauacggggcuuaaaugaaaauauuuguuauagugaguuacaguuaauuuugggauuucccuacaggaaagcuuaaaauguugagaugauugucccaaagaauugucaagaggugauaguauucuaccaggcauuuggaccagggagccuuuggcuauuuaaauugcuucuuaaggucuucccuggcugguuuuguuaagaaacuggacuugaguaaugcucagauuauuuuaucuuagaaauuguaucaggaguuuucccucacauaagcuguguuaugguucuauaaaacucaaauucaacaaauaaugguccauguuccaacacauguuccuugguuaacacaauuaacaggguugcacauuaaaauaauggaaauuuaggauuacaaaugaaaucucagauaguaucacucuaguuauuaggugagcacaggacucuccaucauuagguuugucugaugugggucaaaaauucauuuccaagagccaucuagaugacucgguggauaaaggcgcccgcagccaagccugaucucccucugaguuuggucccagugacccauaggguagaagggggcaccagcuucugcaagguguccuuuaaaacauccauaaauacauuguaacaauuccucucugccuccuuguggguuuacagaugcuguucuuaggcuauuuucauuuacccacugcucugugguggagccccugucgcauuuacucuccucuguucccuaagguacuuacuguucauuucauacuguguguguguguguguguguguguguguguguguguguguauaggcuagaggcccauuucagaugucuucaauuacuucccaccuuauguuuugagaccuggaacucaccuauuuggcagaguaucuggccaaggaucucuauggauccucugucuccaccuuucaguuuaagccuucugagugcuggcauuacagauguugacaugacuuuugccagguucguuuguguucacuaaauacaaagugaaauguaaucauaagaaggcaauugggacacuuuucaaaucaguaguuauugauuaugggcguuaguucuggugucuuuguuuuaggauauguugugugugucacugcagacagcaguacaauaauguauguuaaacuuguggccuacuuccuaaggacacuuuuagugacuggugucugcaaaauauuucuugaguauuugggaguuggaagggucaagugcugguuuuuaaaacacauugaagggcuggcaagaugccucugagggaaaaggugcuugcugcuaagccugaugucccacguucaaucccguaacccaugucaagguggaaaaagaaccaacucccccaaguguuccucugacuuuuacuuaagugucauggagcucgugugcacaugcauaaaauaaauacauaaaaaguaaaacacaaaacauguguugaaaauaauuuauaccuauuuaauuuuuuugaggcagaguuucauugucgcccaggcuguccugaacucacuauguagccaaguuugaccucaaacuuaaggcaauucuccuaauucuccugaauucaaggauuauaggcaguagacaccacaucccauuuuaauccaguuuuauaguuaggaaaaucaagacucagaaaaucaaguuucagacuaagaauggagcucuaucuuagcauacauucaauucccagcacggggcggggggcgggggggaggaagagaagugcaaguaacucucaagugaaggaaagaggcucaagguucaaugugccguuucuuucuuuguuuuuaccauguuguauugaagucauguacaaaauguaaccugcaaauucuccuccccuccccucuccccucuccuccccucccuccucccccccucagagauuuuauuuguuguauauaucugaguacacuggugcaucagacacaccagaagagagcaucagaccccauuauagauggcugugagccacuauguaguuacuaggaauugaacucaggaccucuggaagaacagucagugcucuuaaccacugagccaucucuccaacccccccccccccgacagucuuauauuaaauacacugcccaaagacacccguuacuaaaauuugaagagguuugauuugcuuauuuucuuugcagacugcauagaaauacuuucagcauugaauuuaaucauguacauccugucuuauguaaggggguuucagagaaggcguugaaaugaacugaguuuuauaucuguggcaaggagagauggcucagugcuuaagagcacuugcugcucuugcagaggaucaggguucaguuccuagaacccauaucagguuggucacaacugccuauaacuuccauuucaguggcucugacacccuucucuggcuuccguagguaccuacaugcauuuggugcacauacaaauaaguaggcacauacacauauaauuaauaauaauaauaauaauaauaauaauaauaaauagcaguauaucugugacaaacaggucaaguuaguuaaagauaauuauaauauuuauuuuuguauguguguaccauggcauucauguggaaggucagaggacaacuuucaaaaguuaguucauuucuaccaugugguuucugggucucagguuugccaagcuugguggcuagcgccuuuacccauuaauccacccuaucaucuccaaguuaacuguuuucaaguagugguaaguaauuauaaagaaauauuuaaguuaagaauuuguuaauuguuuaguuuucuuucuuccuuccuucuuuccuuccuuccuuccuuccuuucuuucuuucucucucucucucucucucucucucucucucuuucuuucuuucuuucuuucuuucucucuuucucucuuucucuuucucuuuucuuuuggaaauaaucucauuuugcccagguuggccccagacuuacuauauagcuaaagauagccuugauccuucuguuuucuacaucaugcuggaucaacaggucgguaguaccauaccuggcuuuccagcuaaggauuuaacagaacaaguuauccuuggagcuggauagcccccuugagguuaagaguauuuauugcucuuguaggggaccugguuugguccccaguacccucaugguggcuauaacuccaauuuuggucuccaggaccacagggaugcaaauguugcacauggguacuuacaugcaggcacccacauguacacauaaaauaaaaacaaauacuuuuuuuuuuaaaagaagacguuaccuaugucuaagccaauggucuguugcuaugaagagacaccaugaccguggcaacucuuauaaaggaaaacauuuaacugggccuugcuuacaguuccagagguuuaguccaguauucugguggggagcaugguaucaggcaggcagaugcuagaaaaggaacugagaguucuacaucuggauccacaugcagcagcaagagagaaccacugggccuggcuugggcuuuugaaaacucaaagccuaccccuagugacacacuucuuccuguaaggccauaccuccugguccuuuuaaauagugcuauuccauaagcauuuaaauguuugaaccuaagggagccauucucauucaaaccccuaacuguauaucuuaaaguuuaucuguuugcugagaaagccuuaugcucuuaucuugaguucuuuccagggcagaacagcuuagccauuguacacaagaucuguuuguucuguccuuugucuauuuuaucaguacuuugagaggucauaaaaauuggauacucuuuuuuuuuuuuuuuaaaagauuuucgagaccugauccucuucauagccccggcuaucuuggaacucauuauguaaaccaggcuggccuugaacucaccagagauccuccugccucugccucuagugcuagaauucaaggcaugggccaccaaauccugcuaauuugauacuuuucuuuuauacuauuuucauacuauguauuuaauagcacacauucuuguguguuuuucccacuaaauaagaaugcauuuauaauucauuguuauauuuaaucucucuuucuccauuuagaacacaccagucaguuuuucaagggaaaauccugggccaggagccaaguccugaucucuacaaacuuaauauuguguagauuauuuuaccaccugagaucucaguggccucaucugugcaagaaagagaaaauuaaauaauaaaaaagauaaaaccuuggccugucugaagguaaguguucagugaaaaaucgucuucuguaacaaacagaaaccaacuauggcagccagcagcaaauaaacacugggaagagaccagggggaaaggaaggaaagauagagucucacuauguagcccaggcuggucuagaacucacuauguggccccggcuggccuugagcugacagcaauccuucugccucagccaccugugugaugggauggaggcauucauuaccauacccugauuaaaguaauuuuucuuuuaaaaaauauuuuacccauuuauuuauuagugugugugugugugugugcgcgcgcacguguguuuguguguguuuguguguguguccucagaggccaaaggaaucugaugcccuuggagcuggaauugcaagugauugugaaucgcuuaacacggguguugagaauggaacuuggguuaagaacagugugugcucuuaagcacugagccaucccuucagucccuaaaauaauucugccuuauaaauuuaaauuuuauuuuacuuuauguguauugguguguuuugccugcauucaugucugugcaccguguguaugucuggugcccucagaguccagaagagggugucagaugcccuggaauaguuacaggcaguugugaacagcuucauggaugcugggcauugaauugggguuuugugaaagagcagccaguguucuuagggcugaaucaucucuccagccccuaaaagaguuuuugaagucauagcuuauaauaggcaacaggacuucauaaaguugacugcagccucaccuucuaguucuugaucuguugccccuaagguuccucuggucuucaauggcaaugauggcuucuagaccucuacuguuacaguggaguuccaggcagccaggcaaagacaaagaagaaugcauucugucucucuggagacucccugaaccaagacuucaaggaaacauagcugaauggaugggcuuuaugcuacugagaaggaaggaaugguuuggauaucaauggagaagcagaacucucugccgcagauagagcuucccuccucuccuuucugagcuuaaggcccuuggcauugucuuacacagccuuggugaugggagcagaccuucuggucugaaugcugccaggagaaagagguagucuguuugcugaauugcauuucugcuauuuucucaggucguuucuuucuccuaauuugucuuuuuuuugagacgggaucuugcuggucuggaacucaaaaucuagccaggcuguugaacuagucugccucuggaguugugauuacaggcaugugcccuccuuuucuuuuguucuaugauucauuauaaaggcacuuuccucuuguuuggagauuuguucugguuguuuaaaaacaaccacccaugaauguucaguggauguuuguuguucagaggcaagcugacacguaugaaacugcgggccugucuggaagcaagacacuagaacgauagagaccuuuccccaagauugccgcuuaaccugccaucagaagugacuguugaugagugugaccccucuugguguagucuuuguauucaggauaaucacacaggacauauguuugccuggcuugcuaguugaaaggaauugauugucuaaagucacuuagcacuuaccuggcaugaaaguuuuucuacugccccuugcauaacuuauuuaaguauaccaguucaggggccaguguuaggaguugaagccagggccuuacucaugcucuucaaacccucuauauggagcuaccuauauacuccuagcccuggggcaugacaguauuucuuuucagauuuuucccuguaaauaauuuacagacauaccaugcuuuaucacuuaaaauaguucggacgaccagcucugauaggacacaguuguaauccuagaacuucggaggcugguagaggcuggaggaucaggaguggaggcuggccugggauagaaagcucaacuggcauuauuuuaguguaaaaaaaaaagugaauugaaaugaacaaccuugagaaaaugaaacagcaauccagggaauggaauuuuaaucgagaaagaauguaaagauucaaucaguuguucaguguuuauaggauggagauaaagagagauuaagguuuuauuucuaugaaguguguuugcauuuucacaagcucuucugcucuuccucuuaaauacgugggcauggccaggcauggugcuacacagauuccuauuggucuuagacucacuguggaaccgaagaugacuuugaauuucugauccuucaucuucuaccuuuuuagugcuggcauuacaggcaggaaccaccaugccuaguuuucuucaguccugaauggcuagcaggcuaagcagacucuuuuccaacuacacuaccuucugagcaucuuacaggguuuucaaaugcauuugacauuugagucauccaauuaaauaugucuguuccugaauaccucuugaauaguccuuaucuuuuguuuugcuuuugugguuuaauacagucuuacuuuguagcccaggcuagccucaaacuugcugccauccucauguuuuagccucccaugugcugggcucagcucaguuaaaaacauuuuuuuuuuucaggguuggagagaaggcuccacaguuaagagcacuggccacucuuccugggaccuggauuccagucccaccacccacaugucagccuuaaaauaaaaaagaagagcaaauggggguggggauuaauuaacaggggaaaauuaaaaaggaaaaauaaaggaaacagauucacaaaggcagggguggggcuaggaagaugacucaaugacuaagaaggcuugguaugcaagcaagaggaucugaguucaaauccccagaacucagguaaaaagugagacaugaucccuuauguaccuguagucccagcuccucugccuugcaugugaacauaccaccauaugguauuauuuaucuaucuauccauccaucuauccauccuuccauccaucaaucugaucuauguaccuaccaaccuacuuaccuaucuaucucucauacacacauuuacacaguuuauacucuuaauuggauaaccucuucacuacuugagugauuucacagcuaagaaaucugucucugugugagucacagcuuugaguuguuuuucuggacuugggaggcuuguuuuggauuuacuggauacauaggagaaggcucugauuccuucugcaucuguacuuuucauguugucauaucauagggcuagggauguagcuuauuugucaagugcuugcuuggcaugcaccaagcccuggguucaauugcuggcaccuuauaaacuggguguggaggugcacaccuguaauccuaacacccaggagauggagacagaaagaucaggagucuaacuucauccuuggcuauauaguaaguucagggcaaucuggguuauaugucucaacauguaacaacaaccaccaccaccaccacaacaaaauucacaucauacuacaccauacuagacuugggggccuccugccuguaaucucagcacugggaaggcugagaggcaggaaugcugugaauuugaggccaaccugggcuauccagugaguugaauggguuucauguuauccuguuguuagagucaacucucagcuuguaguguuuagcuuugucugcuguucagcaguuggugcacugucuccuuucaagcucugugucguccuuagggaagaagagggugauaaaggaaaccuggucagggaaggaaacuagcucacaccccuucuuccugucggcuguccuuccucugcaaucaugugcaacauucccacaucuucuagucgauggaaguccguaacuggaucugucacuuucaacauuuuuaaagcgauuuuuuuuuccugucauuacucuucuaccuaauguacucgaacacuuuccauuuccucuguuagggcgacaguugacauuucugagucuuuauuaaggaacuaagccauguuuaaguuaauuguucugguuacaucuagaaugagcacuaaaagauuagaaucuaguagagggggaaaauacguuuagaaugguuuccauugaucagaaagaagugaacaagaugaccgucucuguagcucagcagggaaaggcgcucauugagaagccugaugaugugaaggggguggagggcgagcacugacuucugcgggucaccucggagcucugcaauaaggagaggcaguagcuauuaaaaggcaaggcaagcagaacguccugaagaggaugguagcguucacacguaggauuccuguguuucacugguaggacacaugaccauuauggcauauagaaacaaaaugcugccauugaaaaccgagccagccgcggcaugauuuaucaugcacaguccauuucguucccgaaagugcuucuacagauuaauuuagauacacagguuuugcacagcauuuauaaaaagacuuauggggcuggggagauggcucagagguuaagagugcuggcugcucuuccagagauucugaguucaauuccccagcaaccacaugauggcuuacaaacaucuguaauaggaucuggugcccuccgcuggcaagcagauauacaugcaggcagaacacuacauaauaaauacaucuuuagaagagauuuauuugauuuuuaaauuuuauuuuaugaaugaguguuuagccuguauuucuggguaucacgugcaugcaguaacccaaggaggacagagagggugucugauccccugggguggagguacagacagacaguugugauuuucggugcuaagaacugaacucuggccuucuggaagagcaaucagggcuuuuaacugcugcauagucucuccagccuaucuuuguuuccugucagacuccauugccugggaguuucuucuaauccuguaacuugaacuucacaagcguugguauuggggcucucuugguguuagcauaagcuggcagagggcuuucagauuuccuuuaauuguuugugaaccagaagcccugacagcugucagcuguggaggaacagcaccaacguguucuuucccagguguccuguuccuuagcugcucagacacaucauaucagaacgccccaggagcuaagugaacaugcccggcagguuggaccagguucuucaagccggauuuagcaacucuuccuuucgcccacccccacaagagcucccuggaacaucuuugggaagcugccuuguaguuuugaauguaacgugucagcaaaccuuggccagcuauuucuccgagaguccuuccguggagugcuaugaaaacccauucauagacuggagaugcaguuuaguugcuagagugccugcuuugaugcaggaagccccuggauucaauccuagcgugugcagucacuagauuugguguucucgaagagagucuugaaccguggacauguuccuaguaguuacugaacuaucuugcaugggcugaugaauggacacuccagaaaacaagucuguggaaaccaaaggaagugggcccgggaaguagcucagucugcagagugcuugccuagcacacacaaagccaaguucaacguccaacugcgcaugacgguguacacuuauaauuucagcacuccagcggguugaggcaggagaaucagaaauucaaagccauccuugguuaccuaggccagcuuaucucuaaaugucacugugaguuugaugccagccuggguuacauaagaccuuguuucaaaagagcacaagcucuugugccugugucuuuccccuuuaggguuaguuaguguauuauuuggaggcaugcgagagaacauuaggagcaguuugucagccuuucccauugacugaaaucagcuuugccucuccacuucacccugugguacugaggucaaaccuuccccagcacauggcacaugcuggauaaauacucugccgccgaguuauguccucuguccuuuucuuaugucgcacgccgcuggaaguuaugaaacaucugcucagcguuaggaagacguuauugacaguuugacauuugcguaucugccuuggagaugaccacauccacccugucagcccaguacuugggaccugcagucgguuucugcuguccucaacagugcaccauggcugcucguagggaaugugugugugugugugugugugugucucagaacauagaguaacacagcuuuguguaguagcuuccugucuaaagucugguaaagcaauuagugcccauaaaugaaaaggucaggcuguuccucugccagcacuguugcucaccucugucagcugccucauuuucucugcuuacagaagagcacuugaaugccacacuacagcccuccucuccaacccccacuucccggcccagcaggucuggagauugaguuagggcuccaugcaugcuaggcaagcgcucaccguugagcuauggcugcaacccuuucuuguuuguagcccaggguggccucaagcucugugucagccuucugaguccuauggucacacuugugcaacucugggucugacuuaguuuaauccuuuugaaaauagugaccaguaagacauaaugauaaugcaaaaaguuugaugauaugacauuaagaaaaacugacauaacgucaaaacugcaaugacuuuuaugacauucagguaguauagccagauugcuguuaccuccuagucaaucaguauuuuucaguuaauugaaagacaaucccugacuuuuaagauauuaagcuaaauaauccuguaucaaguugcuuaaguauagacucagugaucugaguaaauuuaaacaggaaauauuugcauuagaaggcagauguggcugggaagauggcucagugguuaggagcacuugcugcucuugcagaagacccagguuugguucccagaacccacaaggcagcucacagcucucuguaacuccaguuccaggggauccaacccccucuucugagcuccccaggcagugcacacguguggugcauagacacacacgaaggcaaaacaugugaggaaaaaaaaaucuaaaagaaauugaaaaaggaaagaagguugaaaggggacuuguauagugguaggagaaaacggacuccuaaaaguccugugaucuucacacauucagugugacacaugugaacacacaugcacacauacacauaguaaauaaauaaacaaauaaaaacaagaagaaagcagagguugucagauauacaaaacuguguacauguauauacuuguacaugcuuauauauuaacacacuaauaggagcacaacuaauuucaaauaagauugggcucagacacaaagucacucaaauaguaaagucuggcagagggcuagaaaaauguaaauuuguguaaccuuguaaaaauugacagaauuaucaaagaaauuacaaagaaagaagaucauguuuuuucucugauagagauagaauaaaaaaugaauguguuaagaauauagaauuuagauuauggaaaauuauaaaucauggcuaguauagugccauuuauauuuucuuccuucacauuaaaaacauuuagcucgacauuuugcuguguuucuuuuuuguaaaauugaaagaugauucuauaucauguaauuuacacacacagacacacagacacacacacacacacacacagacacacacacacacacccucacuaugcaguccagucacguagucuaggccucaggcucagucuuucugcuucagccuccagaagcuggaauuacagcaugggucaccacacgagcugucguccaucuucauguaaaguguccacuuggcuggugucuggggcacucuaaugcugcaccacgucagcucuuucugauuuaacacauacuccuccccacuaaacaaaucuucccccuggggaucuucugcuuuucucuccugcugccagcagcuguaagcaguaauaaucuccuucucuagggauuugccuguugggggcauuuuacauggaucaaaucguauaauauguguuuuuuccccuugauuguguuuauuaugauauuugauuuaaauacacagauuucuccuuacaaaucucagccuuuggcuuuuuaaaauuccuaaaaagcaaaauagcuuuugguuuugaaugacauacaaugaugaauugucuuagccauguaaaaaccaaaacaacccagaaugaaagaacacaggcccaucagugucucagccugaguauuguuccugccuccggaagcaagcugggccuucgggcggagccuucuguuuccagggaaaucucuuagauuuuucucuuuuuucaguuuucucuagauuugaucugugcuauccuugcuguugguuuugugugugugugugugugugugugugugugucugagcacuggagcuagccucuugcuuuaccaguaugaugucaggcuuguacaguaagcccuauucaacuagaaguuuaauguaaagguauuuguaaauuguuuagccuaguaauuuccuacaguugguuugagcaugagcaauugguauuucugauuagguaucugagaagaaucucuaucuuacccacuaauuugauggugggauuuacaaacuuaaagaauacugagguccggcugguugugaggguccagaccugcaagaggcaggaggagcaagaauucaaggucauccucugcuacucagaaagucugaggccagccuggcuacgugaccuccaaguuaaaaguguccagugacugaguugugauaacacagcuacagcugucaguggcgagauaguuugguugguaaaguacuugcuaggcaagaaugaggauuugaguuugacucccagaaccuauguaagaagccaggcuggguggcaaaugcuuguaaucacagcacgggggccgugaagacaagaagauucccuagccagccggccuaguccaccuagcaaguuccaggacccagcaagaaaccaugucucagaaaacaagguggacagcuucugaaguaucugaccaccacaugcauguaagcacacacaugcaugugcaccacuccccaucuacacacaaacaugggaacaccgcccccuaccucagggcugugguuggaacgcaggauccuaugcaugucugggaagugcucuacugccucagccccuaagcuaccuuggagaugagcauucuguacaguagagcagacaggcaauguguggaagggcagugguuucuaaugcugcagaauuagcuacaggacuccauaaagacuggggucucugguuuccgaggccagcaaaggcccuggggauuugcauuucugcaaaggcuccuuacagguagcugucgcguugugucagucccuccaggucucagcccugcucuauggcuuucugacuacugcgucuguuuccugcguaccuuccucugugcuguugauguucuuaacauuauucuugauuuguucccuuucauaagccuguauguguaaaauauguucucuuucugauccuugcaggagacuagggcuauggauccuuauggaaacaauaaaacuugaacaauuguauuuaagauauuugaaaucuuuuguucuguuuuaaccccaugacauccuacguguaagagauggacauaauaaucaguacacuacagaaaccucuccaacauucuuccugauagacacacuuuuucauuauuguguuuuucaaacagucucuucuguguagcccugauuggccuggaacuugcuauguagacuaggcuggccacgaucuugcugcaauccucuugccucugcuucuugaguucugugauuacagggaugugcuaccacaccuggcccauuugguauuuuacugcaauuuaauugaaagacacuauuggcuguuguuuguuuuuguuucuguuuuuggagacaagguuucucugugcagcccuuccuguccuggaauuugaucuauauagaccaggcuggccucaaacucagagaucuguccaccucugccucugaagugcugggauuaaagacaugaacuaucacaguccagcugucuuuuaagcauucauucauucauucauucauucauucucugagugugcacuugggucaugggauaccuguggaggcaggaggauggcuuuucgugguuaguucucuccugccaucauaugggucccagggaccaaacucaguuugucagccuugauaggaaaugccuucuuuacccacugagccaucuugacagccugccugguuuuucacuaaugcuuucauuguaguuguuuauuuguuuuuaauuuuuauauguucauggaucugugucugccuguacauuugcaugcagugcccacagaggccaaaagagggcaucaaauucccuggagcuggagcugcaggcagaugucaguugccagaugucucugaacagcagcaaaugcucucaacugucgauugucucugcgggccuuuuguuguauuuauuaauuuaagauuuguuuacuuuuaauucuauguguagggguguuuugccucaaagugugucugugcagcacaugcaugccuggugcccgaggaagccagaaaguccucuggaacuggaguuacauaauugugagcaaucugauggcuaaccaccgagucaucucucuagcccccuuguauuuuuuuuuaaagauuuauuuauuuauuauauguaaguacacuguagcugucugcagacacuccagaagagggaaucagaucucauuacagaugguugugagccaccaugugguugcugggauuugaacuccggaucuuuggaagagcagucgggugcucuuacccacugagccaucucaccagcccucuagcccccuuguauugagcauuuuguaauuaaucauuuuuuucccuucuuucugcuuuuuuuuguuuuguuuuuuaauuaaaauauucuaguguacaaaauaguggguucauuuaggacauuuucuuucuuuuuuuuuuuuuuuuuuuuugguuuucaagacaagguuucucuguguagcccuggcuguccuggaacucacucuguagaccaggcuggccucgaacucagaaauccgccugccucugccucccaagugcugggauugaaggcgugagccaccaccgcccagccacuuaugacauuuucauacguacgcuuugccccguuugguuccuacuuacagauacugcccuuucccaccaguccuccucuugcuggccccucccccucucacaaauagcgcacuuugugguuuuaugucacaggaguguacguguguuuaaauguacauuccucccaucacguuaaacaagcuguguuuuaugucuccugccucuucugucuuuacccucucaugucuccaucuuuuucccugccccucccccuugcacugaccugcucauguucuuuguuucuugucuuuugaacauuucuccuguacuuuccugucaacacccuccccucccucuuuuuuuguuuuuugagacaggcuuuugcuauagugcccuggcuggcuuggaaauuacuguguagcucgggcuggucucagaccagcagugaucuuccuaacuuagccuuccacaugcuggguuuauagcugugcaccgccacaccaggcucugacuguuuugagguagggucuccccagauagccuaugcggaccucgggcuuacagcccuccugccucagccuccagaguauaggaugaugcucucccuugauuuucuucuucuucuucuuuuuuuugguuuucaagacaggguuucucuguauagcccuggcuguccuggaacucacucuguagaccaggcuggccucgaacucagaaauccgccugccucugccucccaagugcugggauuaaaggugugugccaccacgccuggcaauuuucuucuuuuuaaaaaucguguuuucuuauaugcauuuauuuacuuuauguguguuugucuuuccccacucagccaucuugcugggugguccccugacuugcuuuggcgauuuauuaugucaguuuuuaacuuaucaucuguuuucaucccacucccuagagguguuucuugguugguugguuuguguuuguuuugcauuuagccucuugggaauggauauaugauugaaguggcgcugggaacgcaugucuccagccuugcagcaucuuuccaggacuuugcuguaaugacuucuccauuucagaugagguggaggaucauccaaguacaguacuguuuucucuugguuccgugcaugcugaccgcucuggaagcuguuccuaucgauguggacaagaccaaaguacacaacacugagccaguggaaaaugcaaggauagagccaccaguaaguacguggguggauuaugauggcagcagaagugaggaucacugcugagacucacucagugaaauccuagcuaguggauggaccgugaaguguuaauuguggccaguggagggacugugaaguauuaauccuggccaguggauagaccaugaaguauuauuaauuguguccaguggauggaccauggaauauuaaucccggccaguggaggggccgggaaguauugcuaauguugacugcaugcauagucccauauuuaggaaguauuucugaagcaguaguaaaaagucauuggccaggaaucaggugacauaacacugaccaaugauauuuaauguaauuuguauguagaagaagugaucauacuacauuuuuaauguaacagaagagaaauacuguuauuuucuaaggagggaauauaugaucaugggagagaccauucuuaccccccccaaccccccagaaacccauucacaccauugugcuguuguuuuucaguggugaggauggaaccuggaacuuucugcauucuuggcaaccacucuaccauuuagucacacacccaaccuuaaaacuuugcuuucuaaacccuacaggacguuuauacuuacuuuguaguaaaccaugauauuggucccuauuuggaacucucucuugacaguugaagcugucguugacacccgggguaaaugaagugggauguagagucagcagcaggcccaaagcugguagcucugggguccuccauugaucucuucggguaauuaaaacagaaaagagagggagccagugcuggaggcucugguggcuccagaccagcacugcuaguuacuggcuugaaauucucaacucuuuuacucuucuggggccagaacuggcugcuucuggcaauugccuccugcugauagcagcaagugauuaaaaaaagaaacuucauuacuuggggcuggugcuuucugugaccagugagaaacucuuaacucuuuuaacucuuagggagcuguugagaaagaaaaagggagaaaaucacacacacacacgcacacacacacacacaaacacacacaaacacacacacacacacacacaaacaaacacacaaacacacacacacaaacacacacacacaaacacacacacacacacaaacacacacacacacauacacacacacacacacaaacacacacacacacacacacacacacacacacacaguaugaagcaaagggagcuucaacaagcaaguuucaucaauuucauacaugcacauguauauauacauacacacauaccuauauagauacacacuugguggauugagcaaacuccaacaacuuuauuuuuuccuuuaguccuuuuuauaugcccuaagacaaaguuuucuauguaagaaaaaauaccucauucagacauagauaaaauauuacacaagauaaaauauuacagcaggauuguugauuauaaguucaaaguaguaguuuuaucucuuuuucauuucauaagcucauuauaaguucaaagcaguaguuuuuauaguauuacccaguccuaguucauggccuugcuuuaucaugaugcacaccuguggccucauccuuggaccugaccuagaaugaauguuuucuuugaucauuaauuuguuccgggacuauuuuuuuccuccugcucuuuucauccguguagugcauggaagcucauuuuaccccuucucauggaacauuugcuuacuguuuuaugaggagggagcacauucuauucuugauucuaacuuuguuauaucuuuuggcagaauaacuaaaaauaucuccuuaaacuuucuaucaauuacucuaacuuccuaaaauuauuuuaaucaaaucaggaauucuauaaagucauuacuucuaaacagcaguaauucaugaaagugaacaucuuucauguugaucugcaggacauuugcucaacaggaugagcucauacccaggaaucaaucauaacagguuacaggcagacaggguauuucuuugcccagccacaccaugucagaaaaugaagaguacagcaauggcaagcaugagagacaugucagcaacaagaagcaauccugggacaaagucccuaggguccaugccucucuaggguauaccaaucacagucaugcaaaagacagugagccaccuccaggaagcucacuugcuugccacagcuuuuccugcauggcaucugccaaagagacauucugucuuggugccauucugcuaggaguugcuuucaggucuuucuguucagacuaaggcaaacuuucugaauugugacuguuuguaucaaaggauacuggacuuuauuaugaugaauaccucaagcaagugauugaagucuuggaaacagauccacauuucagagaaaagcuccagaaagcagacauagaggagauaaggguaaguggaguucgacaguggacaugacacaugcugaacuaaauauuagagaugagagcuuuguagaaaagauggggaaaaucacacugagaaguggauuggauguauggauccgugcuguuauauuacagagauguguagaagauagacacguggccagugggaagcaguaggaagaggaagucauucuucccagcagagaucaugucagagcucaacuauagaaggaagauuugauggugucugaaccaaacaugcaaaggcugugacucacacaauguuuagcaaauacucuggagcuggauuccgggguuagaaguggaggccacaaguggucagauaauggcuuuggagucaugagccagauggcagagagcuguguacagcaaguguaguggauugcaucauguucugaggagaacaggaaguuauucaaaggugaagagcagguuagggccuggucaguuccagauuaacagaggagguagugagcagugucuuauguuaauaugguagggacagcuaagaauaccauuagguguaauauacgcauugaaaauguagcuuguauugguuauaugcaacacugcaguaucauguauaagguauuuacauaucauggauuucaguguguguguagguccuauccuagggauugaaggagggcugcuguagauuuuuaccuguuaaccaguugauaaggcauuuggguuauuucugcuuauuuuggcuacucugaguaaggcuucaguggacaacagugcugaagcuguuguguuaacaugcuucagaauuuaaguuacaguccuggggauggaauuuuugggucaugugcucacucuguuguuagcuuuuaaaagaauugcuuugaaggaauagcuuguuucugucuuuugaggcagggacucaggcauucaggcuggacucuaguucacuauguagccaaagccuuugaauuuuugauccuuccgccugagauuacagguguggccuuggauuuuuaaaauacagugcuaagcuucuugcaugguagacagguacucuaauaaaugagccaaguucucccaauauuuuuuuuuuuuuugagucaggguuucauguagacuaggcugguaggaagcuaaagguagcuuugaacuucuuaguuccugcccccaccucucaggugcuaggauuauagucaucaugcccaaugaaauaaaaggaguacuuauauaauguaaaauguauccaacucagucaaccuauuaccaauuuaaaagaaugcuauuuaaaaauauguuuuaaauuuuaaugugugcguguuuuucuuauguguguuuguccaugugcaugcaguguccauagaugucagcuaggauguuggauccucuggaucuggggcuacagguguuugugagcuaccauguggguccugaggucuucuggaagagcagccugcggucuucauugcugagcugucucucuaguuccuauaaugcuauuuuuacuccauuacaucagguauaaaguaaaauguacuagauaaaacuaauuuauuaauuuuguugacagagcgggaggcugagucaagagcuggacuuaguaagucacaaagugaggacgagacuggaugagcugaagaggcaagaaguaggaagacugcggaugcucaucaaagcuaagcuggaugcccuucaagguaggcgcuggauggaugggaggaugcuuucaguguuggcucgugaagggucuuauguuacgugccagcauacuuuauauuugugguauguauguguucauguguuugcaugaguagugugugcacacucauaugugccuguguguagagccagagguuaauguuaggugugcucuggggcugauacuugcuguuuucucacgcuguugcagacacuggcaugaaucaccaccuucuucugaagcaguuugaacaccugaaccaccagaauccuaacacauuugaauccagagauuuggauaugcuaaucaaagcaguaaggaugcgcccccaacacggggucuuucuguuccuuugaggauccgugaguugcagauaaucucaaugaagugggaaccugacuuucauaugcucugggcuugaagcuuucucacuacagauaucaggacuaacacggugcacaucauucauccacaccucuaaauccaaaauucugugaaaacugaaccaggcuuggacuagcuagucuccaugguaucuguagguuuuauuuaggcucuguaaagaaguccugccuacgaagguucuaugggagacucaguuuccuuuaucagcucaguauuuccuaguauuucuuggcacaauucggugucauugaagucucucucuccaucuccauuugcccuuccucccugugcccuaaaauuugaaaaaucccuuaauaauuuuauuacuaugacaucuaguuuggaugucauaguaauaaaaaaaaagauugggagaaauuggcucauuuauuggaguaucugucuaucaugcaagaagcuuagcacuguauuuuaaaaauccaaggccacaccuggcuauguuuauuuuauauaugcuacaauuaauuauaaauaguaauauuuauuacuauuauuuuauuguaugauuauguauuguauuuguguaggaguauaacucagaauuucaugcauguuagguauucaugcauucugggaauacugguaugagcuaccauaucuaguuggcccagguaguuuuagaugagaguuuguggaccuauuauauuaguuaugagagaaauugacaagcuagauguuuuaguugggcaguuaugaaacucagugaaauagcuguugacuaccacuuucauuuccugccguguccacauuugacccaguuucuucuuuuugagaucaguuuauauuuuguuugcuucgaauaguccaguguuuguugguuuuacucuccaaacgucuguuagagagcucaggguauuuuuaaaagcuauuuuauuuuguuuuggggagauagcucugggcucaguugagagacccugccucagugacuaagguagggagccaucaaggaagacccccagcaucaaccucacgccuucacacguaccugcacacagaugcccacacacgugugaacacacauguacacucgcaugcacaccacacacauagugugaggaagaaaaaagacuggcacauaacacuucucgcucgcacguugacguucacguguugugcuuuaggcuaccgcggaucuggagcaauaugaccggacucggcaugaagaguuuaagaaguacgagaugaugaaggaacacgagcggagagaguauuuaaaaacgcugagugaggagaagaggaaagaagaagagucuaaguuugaagagaugaagaggaagcacgaagaccaccccaaaguuaaucaucccguaaggacugggguucauagaagucaugucuagaugaguuuuguagcagaauuuuguccuaaguuuagcauauaaaaucuugagucuuaauucugaaaaguuccucagauguauuuuuugagucucuauacauagauuauguuuuguuuugagcacuuucuuaaaauugguucacagggaagcaaagaucaacuaaaagagguuugggaagagacugauggauuggacccuaaugacuuugaccccaagacauuuuucaaauuacaugguaauagauuugauacaaauauugauauuuauaccugcuguuugaaaagucuguauuugauauacuuauaacugauuacugugauggcuugcuguugaguucaaccaguaguuacauuuagaguuuucccuucaacugagauuauuaauaguucauuagcugaucucagaaacuaucuuagaucauaguugugucugucugcccacauuuacuacugagccauuguaugacuuaccccaaugcugucugcagacuggagcuaguucuguggcugguuagguaauaccuaacacacuuuucaugacauaacuacaauuuacuaagcugauaugguggugauaccuguaauccccgcacuugggaagcugaggcaggaggauuacugcacagguuauccuggacuacauagugaguuccaggccaguuagggauauauagcgagacggugcuuaaguuuuguuuuagcuacuuuuuuauucuuguagauacugcucuaucucuuuggaaagaaguagauaauacauacucuucuaaaacaugauaaugaacuguaacuauagaguuguccccuggauugaucugaggccucaugagaaagcugaagccccgcccugcagccgauugucgcuuuacucagcacuacugcaaaccauuguaauuguuucuuaaguauuuacucuccgaaggaaucaaaucugcuuuugcauuuguaacuauugaacuuuagauguuaacaacgauggauuccuggaugaacaagaauuagaagcacuauucacaagagagguaaguggucguuacauccucaggcgguugggucugccuuguucuccucggucaccccaucuucuuuaauguuaggucuucucauuuucuuuuuucaguuggagaaaguguauaacccacaaaaugcagaggacgauaugauagaaauggaagaggagaggcucaggaugagagaacacgucaugagugagguaugcuguaagguuaaagcgugccccagucuuccauuagucaaguucuugcaguaauuuguaucacaagauggaggaauaaacaggcagucaguauuuccuuagauuuauucauuuuaugugcaugaguguuugccuauauguacauaugugcauuugugccugccugguaccugagaaggacaaaagaacacugcuuaccuccuggaaucggaauuaaagacaguugugagagcccauguggcuacugggaacugaaccuguguccucugcaagagcagcaagugccuuuagucacugagucaucucuccaaccccccaaauaaguauuuaauuggauuuuguauuugugaccacaguauuauacuagauuuccuuaacaaaauaauuuguggcuacuuuaaauauuuuauaaggcaaugcugcuacuauauauuagcaauaaacauuugggguagugaaaaaacaaugauguauaguuaauauuuuuuaaauguagauaagcuuuuaugaguuggaaagcccuugucagaaacccaaaaugcuccaaaauucaauacuuuuugaucacugauaaauaugcaagaugugggaaagccuauaccaugaauuuuucauguuucuugcacaaaauuauuuauuguauaacauugccuucaagcuauauguauaaguuguauacaugaaccauaaauugauuuuauuuuggggucuguccuuauuagaguuucuauugcugugaagagacaccaugaccaaggcaacucuuauaaaggaaaacauuuacuugggguugaucuacaguucaaagguuuaguccauuaucaucuugguagugugcaggcagacacggugcuggagaaucugacaguucuacaucuggauuugcaggcaacaggaagugacagugacgcacuggcuagacuggagcgucugagaccucaaagcccaccccuagugaugcacuuccucauacaaagccacaccuagccaacaaggcuaauaguuccacuuccuauuuaauugguuccaucccaagauaccucauuauguuuuugcaaauaucucaaaauuuuuuggcauggaggcgggguaagguuugaaacaggguuucuuuguguagcucuggugucccagaacucucuuuguagaccagacuggucucaaacucacagagauccuccugcaagugccucucaugugcugagaucaaauccagaauuaauuaauuaaaacaaaucuaaaauuuaaaaccacuucuggucccccacauuuuggauaauggauacuuagccuaugcuaagaagucuuccgaguucuguuacuuuaauaauuaugacaacaaguauuuacaucuuguuugccuuccaugugcuucaaggguacaagaagguagggcuggcucagcugagcuugugccuagcgugcuuuggcucuuccguguccuauauucccaggcuucaggagcgaucccucacuggaugacauaaggaacaugagcagcucaaggcccgaucauggaguguaagaccgaugcccagcugugccaaggcccaugucugcucacuucccacugccugaaguguuuccagucagugaggagagaauggcaccucucacaggcuaucucagcagcacuugcugagcugaaggcagggauguagaacccuguugguuauaggauuggagcaguaauugcaguaacaacacaaaccaucacagagaccuaaaauuugaauuucugucuuuuagagcaacugacuuuuaaaaaaacuuuccuugugagugaguuuuucuuucucccaugacuugggauucuagaaacagcacccugugagguacugucguuaagugccuggcaggugugagcaggacaggugccucggcacaguguuuguucuagugugugacccugcugugcacccccacccacccgccugcucccguacaggagcagagacacgugauggagacuaacacaaaagcaugcuaacuggcucacuaaauccaggcugggaccccagaucacuaagagguccucugucuggacaugcuaaucccugccugguccauuaauucccccauuccuauucuuuguucuuaaaaccucaaaaugccccucuucuucuucccugucuucuagugcuuuacagaggaacaaccaacccaucuuucccaccaaauccuccaggcccucuuccuuucugcccguucauuuugccuugcaucugcuaugugcuugcaucauggcuacugcuccuguugaaagcccuuuccuucauacaggaagaauacuggucucucucuucaaagacuccugcugugucucuugggucugguuucaucucuguacuggaucacucccuccacuagagggcagacaugaucuuuuauuuucuccauaaucuauguggccagugcagugcuggccaaugcagugugaccucauagcacuuggcuguuagcacgcugguacaauccacaccaucuucuucaagucccuggaauccccaguaugaauauggcaguggcugggccuguccuuggccauggucaccuucaugcucucguccauuccuugggugaccacaacacccucuaucagcgcaugugcucuauagaccggaaguagaaguacaggaacuugugaccaccaagaggguucugggaauugaaccccagucuucuucaaguacaguaaauguucucaagugcuaugccuucucuccagccccaggguagcugcuguuuggcuucagugguuuccuugggaauauugcucuuucagugcugaacuggggccucuguagaguagagguuagccuggacugccaaugagacccugucuuauagccccagugucaaaugaauuuguuuggucauuaaaguucaccauuguaauugaguuugccaagaacuguacacugugcauugaagaggacuuagagaggccacugacuucugcuuagauauauuuguaguaugguuuagauauauuucuuaaaaaagaauugaaucaggcaggucagguguggugguacauacacacugucuuagucauugcucuguuacuuugaagagacaccauggccaagacaauucucucucucucucucucucucucucucucucucucucacacacacacacacacacacagacacacgaaugaaugaucauggcagagagcauaaugacacauauggcagacauggugugggagaaguaauugaaagcuacaucaugaucugcagacagaaagagugagacacugggccuggcuugaguuuuugaguccucaaagcccacuuccagugacacacuuccuccagcaaggccacauccacuccaacauagccacgccucuuaauccuucucagauagugccacuguugccaucccugugacaaagcuuucaaauauaugagccuaugggaaccauucuucuuuagaccaccacgcaugccucuaaucucagcacuugauaggcagagacagaagaaccacuaggucgucaggccaaacuggucuucauagccagauccauacauaccgaggcccugucuuggaaagcauauccccaugccugagcaaccaguagguugagcaucuuaaccucaccugcuuuauucuuggccuuuacagcuguuccugagagguggauuuuucuugucuaagcacuugggucuagcuggauuauauuuauuguggugaaggcacuggccauaacaaccuaacuagccagugugcuggucuugagcauaucagguagauggauagcuugcauuuucaaguuuuaauucugauagaagaggaagauguuuuucuuuauucuaugaaaauggaauacuuuucuucauuuuccuuccuguuucuguuuauguuaaccuguuccuaauaauaauaauaauuagcugaauauuuacaaaguagcauuccuaagauuuauaccuuaaaaauauggaagauuuauuuauguugccuuuguauuucccucuaaucagauugauaacaacaaagaccgauuggugacucuggaggaauuccugagagcuacagagaagaaagaauuccuggagccugauagcugggagguaacaaggccaacuuuacagggacaugagguucuagaagcucugucccauuggguccugcuuuaacugucauuccucauuauguuuguuuguguaauuuuacaguauucaugcuugauauaaagugucacuauaaaauaauaguuccuugucuccuuggaaaacguucuagcaauuuaucuuuuuuaugaucauacuguguaaaauuagaaaucuuuuaaaaaaaaggauuuauuuuuuauguguaucugugccuguauauauacauacauguauacccugugcauacuuggugccugaggagguggaaaauggguauccaauuuccuggaauugaacuuauagacaauugugagccaccaugugcauucuagggaccaaaucuggguccuuugcaagaguggccaguguuccgaacugcugagucaucucucuagcccucaaauuagaaaucuuuuaaaaaguauacguuugcuaaauauaaaaucaccacuggcuggagagacucagcgguuaagagcacugacugcucuuccagagguccugaguucaauucccagcaaccacaugguggcucacagccaucuguaaugagaucugaugcccucuucuggugugucugaagacagcaacaguauacucauucauauacauaaauaaaucuuaaaaaaaaauaaaaucaccacugaaaauuuaaaacauagguacauuuuaagauuaaauuaaaggacccacugagcugucuuuacuguagagcgacucucuuguguacaguguggaagcaucaccagucaauaaaaaacugauggccuauuagcauaaggaaguaaucggugggaauucuuguaggaagagaggacuccaggauagaguuaggugcaggaacagauuugcccggaaaucugaggagacagaugcauaaaaaaaacugagagagauaacuagccauguagcauucauagaauagaauaaacagguuaauuaaguuauaagcuagcuggggaauaagaucaagcguaucuaggcauuucuucauuaauaauuuaaucuaggggucguuauuucaguaacugggguguaaguaggaaagccagcuguuacacuguauagauacauuuucaugacuguuguuugaagcagugucucauguagccaaggauggccuuaacagauuucccugccucaccucccaugugcugugaucacaggcaugcaccaucauguuuuuguuuucugagacuguuucaaccucacccuugaaauagccuuccugccuuggucuccugaaggcugggauuacaagcauaagccacuggaccuguccuccaauauuuuauugcuauuauaaaagaagcuggggccugggaggauagcucagggggucagaauguuuggugugcaagugugagaacuggaguucaaaucugcagaauccacgugaaaagucaggcguggucacacacaccuguaacccugcagcuggaggaggggcagaggagguggacugcugggauuugcggucagccagacuagcuccaaguucaaagacccugucuaaagagauaggacacccaugucuucucuggccuaugcauuguucagccaccucuacucuccaucuauagaagaaacucaaauagugauguaaaucuauuggcccagguacucuccagagacugagauaggaacacugcucuaaauucaaggcuaucccugagcuauagaaugaguucggggccacccugggcaaauugguaaaaccuugucaaaguagaaagugaaaagagaguggcaguggcaaaaagggaaguggggaguguagcucaggaauaccccauggucaugugcaggguccuaccuauguuuggucuccaguaacacaaauaaauauaaaggacauacaguccaugugcugucaugugugccuauaucucagcaccuagaagguggaggcaguacggucagggucaaggugucaucaccagguacacagcaagggcuuccugaacuauaugagacucugucuccaaaaaucauaaaggaaacaguuaugaacaggaguuggagagacagcccaaugguuaagacauuugccguuccuguggagaaccuuggcuggguuuccuguacgcucaaggugacuuacaauugccuauacuuccaguucuauaggauucagcacccucuucuggccucuacaggcaccaggcaugcguauggcaccauaaauauacucagucacacacauauguacacauaacauaaacuauuuaaaauauagcaaaucaauuaguuaaaaagaaaugacugauaaacauaccuuuuuucucccaucguuccuuucuguuuacccacccgcccaccuauucgcucccacucacuucugaucacucauagcccaggauguucuggaugccauaucaacuaacuugggcaugaaauccuuuucacuuguuuguuuuguauuuugagaggauuuuauggcccaggcuggacuggaacucacucuagcucgagcugacuuugaacuggaggccauuauagggaugaaccaccaugccuuguuaacauauauuuucuuauuuugcccaaaaguauguuacauauauucuuuuguacaguggugacucuggaauuuucaggcugagcacaaacaccucugugcuccugaccauguucuuuacuucccuuuuccuuuagacacuggaccagcaacaguuauucaccgaggacgagcuuaaagaguaugaaagcauuauugcuauccaagagaacgagcuuaagaagagggcggaagagcugcagaaacagaaggaggaucugcagcggcagcacgaccaccucgaggcgcagaagcaggaguaucaucagguagacgccgagggguguggcuugcagggacuuucagggcacaucucgaguccaagggccugagacaggaggauugcuugagcccagcuaccaauugugucacagaguaaaaccugucucaaauaaacaaaagcaaacaacaaacaaaccccaaauuaggggcuggagguauagcucagaggcagggagugugcuuagcauguuggcaucccugggcuuggucuucagugggacaagaaacccaagccagauguuagaugcuuugccaagagcucauguuuuuugugcuauuuauuuauuuacuuacuuauuuugcuuuuuugagacaggguuucugcgugauggcaguauaugucuuuaaucccagcacucgggaggcaaaggcaggugaaucucugugaguuuaaagucagccuggucuacagagcuuguuccaggacagguagggcuauacagagaaacccugucucacaaaaacaaagauuaaaacaaacaaacaaacaaacaaacaaacaaacacacaaaccaccaaccccccuuccaaaagaaaacaaagcaaaacacugccaccaaaacaaaaaacccaaagagacaugguuucucuguguagcuuugucuguccugggacucacuauguagaucagguuggcucgaacucacagaggaguucucuauguuauccuagcuguccuggaauuugauguguagaucaggcuagcuggccuccagagauccaucugccuuugcuucuagaguccugggacuaaaggcaugcaccauaaccaucuugugguggugguuuuuugauuauucauuuauuucaaguucucagguagccaggguuggccuggaacuuccgauccuuaauaucaagcuaaccuuguguuuuuauaguaugccucgaugaacuacuaaggugucauauuuuaaauuuuuguguuuuuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcuacaucuggguccuuuugauaaaaucuugcuaguguaugcaauggugucagcguuuggaugcugauuaugggguggaucccuggauaaggcagucucuacaugguccauccuuucaucucagcuccaaacuuugucucuauaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggauauuauaaauaaggcugcuaugaacauaguggagcauguguccuucuuaccaguuggggcaucuucuggauauaugcccaggagagguauugcuggauccuccgguaguacuauguccaauuuucugaggaaccgccagacggauuuccaguuuguguguuuuaaaacuacuuuuguuacaaguuuucuguuuuggaguugugggaucauugagaacaugucacgcuagcugagcaaugcaaacaacuuuuaucuuuggccaagagcaggaaaagugaggcaaaaugacuaaucaacuuucccagucugugggggggugggggggugguuaggcuaggggcuucuuaaaggggaggggagggaggcaguggugcaauagugagguacuggggugaauuuagggccauuggucacuuuggaaccuggaacuaggagcuggcuuuguccaguauuuugcacaggcuuuugaaagcauagguuccuggucagaagacaaggguagggaccucuuagcccaugccaaaccucuggccuaacaaaaaggauguccauguccuuucuggauauaaguauagauuuuccagaaaucugggcgccaccucuuuuuguuccuguuauggcuucuuccaugacacucgccaacuauccuggcccggagagguguguccuucagcaugccuauggcaugauaggaacucagaggcugucugacaucacucugacagccaucuuggauucagccaguuuugucagcccaccugagaggaccuucugaccuauacaugccuugucuucaagauaaacaagauuaggguggggugaaaacucaucugugucccuuaggcagcacucagggugacaaauuguauugcuuucuccuuuuuaugcaguccaggaccccaguccauggaacggcgacacccauacauacaguagcuuuucccacauccauugacucaaucuggaaaguuccucacagacacgcccugagcuuuaucuucuagagcuguagaccuucucgugucaaguuuacagucaauguuacucauccuacccuggcuaugucuuacugagcucucugauggccaaagcuucaccuggagcuucugcauuugaacaucauuaacagagccauuaaaagacuaaaaucuccuuauugccuggucagagacuuacccuaccuguuuauaccccagacucugccacggguaacuuuaaggcuauuagaccuuucccagugaaugagaccagagcguuaacaaugcacagccccaagaacagagccaagcaggagugucaucagcuggcuacacuggauaaaaaaaaaaccaguauuguuuaguaggcccucucaaccuuguuucaaaucuugauuacaguuugauaagggaccagguugccuuuucuaauaacccauggggauuacaugacauucauguaaaacaaaacaaaacaaaacaaaacaaaacaaaacaaaacaaaacacccaaaaaccaaacuggguauguuaagcaacugugaguguuucaggacaauguuauuuaauccuugaguaaggaaaaucauuacuuaauacuucucauaaagcagaucuacccaagagaccaaacugauuguuuuaauuggcuuuugagacaggguuucauguaguuagggcuggccucaaacucuguauagugaagauagccuugaacucuugaccuucuggcguuuccuccccagugcugggauuggaggugugcaccacagagccugacuaugagguuagagcuuugucagagggguaacugaauguggaugaaaguaacugguacacccucaggcuggaggaagagcugcuagggacccccagggaaccgaugacccacagugcucucugccuuaaagcccaucucacgagcuaccuuccgcuccgagucuacgugaagucagacaacauucacccagcauucaugcccaggguaugauaggagaguguucuagaaaaaaagacucagguuguuaagcuuagccaaagauugcaucuaugacccaaaauaucaagcaguacuuuaauauuuugcuucuauuucccaggccguccagcaccuggaacagaagaaacuucaacaaggcauugcuccaucagggccagcgggagagcugaaguuugagccacguauguaauuuuguuucuuuguuuguuuagggaaauaaaccuuuauaaauugauauccauuuucauuuugaaugcagucuaucuucauucagaugauuagaauucaugcuauauuucuauauauuugaaggaaauuuacauuaaagaaaauugaaauguucuccaaaaauuucaugggugaacaguucucaaauaccacauaauugccuucauuaugguacagugauuuauuucaaaauuacuuguaauuuuuuaugaucauuuauauuaaucuuacuagggaacauguuuauaauuuauagucucugaugagcuaaucauacuuucaaaaaguaaaauaauguaucuguaaguaagagaacauucggaauaaaggaagauauguuuaaaaugcaagcauacuucuuuugaacagacacauaaaguccugaugucugccagaacuuggaagaaaaccguugauucaacaucuauuucaucuuucaacauccuuucuuuucucuccacucaauaaauacuuuaaagcacauuuggaauaaaggaagagacuuuuaagugagaacacacguuuuuaucuuuugacauggauauuuaaggauugaaaucucccagaacaggacaaaaacaaacccagccacuccucccacuguucuuucuuucu

SEQ ID NO: 4054 - RNA, 2492 nt, Mus musculus
uuuuuuuuuuuuuuuuuuuuuuuuuacuauuucuuaggacuguaaaacuuuauuuaugaguaucuucaugaccaauuaaaaaucuugagaaguccuugaucuuuaggauucacacuuugaucccaaagcauccauaaguauagacagcgcaacgagcuuuucuuuuaaaaagaucucauugaaaugguaaaggcugauggccacagacauugguccccuccucagaggcagugacacccuccugcaucccagggucagucagggcugugagguuaccccaucauccagaauuuguagcuuaauuccuacccugaccgggaacagcuguaguaaacuauccccaggucacacuuagguauucaaguucaggcgccagugaacgcuucugucccgcccauacagugucaacuguucuccucucuccuuuucaucacaaagucaauggaaaagcuucuuugaauguaacaugguacugagaugcagccagugaaaucuaacugcaggggaucguacgugguugaaucuuuagugagaauagcuagcguguauauucacaaaucuugaugcuacauugagucugaauacaaaggaacucuaaauuguauuguucaaugaaggagaugggacaugaguaucccacauaggggaugaacauccuagaaaggggcuuuccaacuuuccuaaugguccccacagguccccauuuuuauuuuuaaaagucagaugacuaauuuguaucugagugucuaagagaaucugauauuccuuaaacucacaaauguccuaauauugucgaaagcaucaccaacacgaauaacauguaggcgauuuaacauuauguguacauuacacaguaaucugaguguaagacggaaugaauguugaaggauguuaaagggcuaacccuugcagcuuguguaauguaucgucagccagcucccaaggggaauugaaugugagacaaacaugagcccggccaguaacuaauugucugaagguuacuaaauuuaaacuaacauucucacaaugucauauuccuugcaagugauuuuggauuuuaucccacuuuuuauucggauucauuauaccuuaaaggaguaacgcaaacauaccaaagccagcuggacacuguaaugucuuuaacugaaguuguauuguuugaacuguaucuccuaaguguuacuacuacagccucuaaugcauuuaauuuagcuucuaggguuguauuuauauguaacaucuuguguugccaaagcuauagagguaucgcaagcaagcugauugcaaaauagguaguuugcauuuggaagcaagggccacaguggaaggagcugcagaugcuauagcagugacuacuguaaaacugguggcuaaaacgaagacuauacccaauuagagggggaacaauugguacaaguaacauugaaacaucuccacauuuuaaaauauaaggucuccgguucggugacauauaugaaggguuuaauaggcagugagucuaaacaugaaagaauguucaugcuagaguuaucuuuuccagaagucucacagauggucauaguguccagggcuguggcuaacagccaaaggucuggcugaacguuuccucuggagacauuauagcagggcauggcuaaugaggagaaccuaggagguuaccuucauccagacugggugggugccuccaaggcaagucaaccagcaauucaggucaucuacccagagacacaaaguucuuuagaagugugcaucauuccacccaagagggaauucuaaagccaggcaccagauucucacugcacagagggaaaugucuaucuaacaagguaaccugugagugaucagaaaccagaaaacucaagugagaaugaguugaugauauugaaaaccugcacaucaaauccuugccagaccccaaagccaaaguccugugggucacucagaugagagggauauauauguacugacucacuaacgacaaaccaguuggaauacuggaugucaaagagagggugagaaaccuucagaucaauuaccccagucugaggauuuauaacuauuauauaauauuuuaauagcgaguuauuuuaaaguaaaauuugauuugacauacauuauagccagcuguccauaauuguuaaucauacacuuuauaaaguuaaauaucuuauguauaaguguuauccucuuucuauauuauaccuucugcuauucuuuaacuuauuuggacguuuauaauuuauaaaagucuuuuaguuauucauuuuguaagcauauaucaucucgauccuuauauauaaauucuuacuuauuaaaauaauuuuaaucauuauguauuuuuauuaagauaauuuuuauuucuauccuuauaacauuuuuauuuuuaaugucauaucuuuuuauccuuaaaacauuaaaaaauauuuuaaaccauaucuuuuuauaauuguauaguuauaucuccccuuuauuaaaacaaaauugguugggau

SEQ ID NO: 4055 - RNA, 1458 nt, Mus musculus
guucaccauucuuuuuuuuuuuuuuuuuuuuuuucaauguucaguuuccuuuaaugacccccaucucccuugaaggguaggugcaggcagcuaggcgacuggcaagacuuguucacuugaagaucuugccuugauugacggcuuugcccacaugcuggaagguccccucccaggaaaaguacucucgaaccagggucuggguuucuucgcucccaggauccaguuuccgccauguauacgacucauaguccaccugccaaucuggacucagcggaaaggcaagcucuuggccucggaagacccaaacaccagaaauggagcugcuguuguugguuccaaagaggauaacacuagcaaaggcauucuuccucaguuuguccaaucgcugaaacaucccagugaugagguugcaacucaugaaggucugggucagcucuucagggaagcgguacucggcauaccacagggaccagccaucuuuaucaaagugcucccaaaaauauggcagugccacagagaggguguccucauuggaguacuuacgcuuaaacucauccaacacaaagguacucuugggcaggugagcgaaaggguccuuggccuugggcucagcagccaaugccugcucacacucauccaucucuuccucaggagcuggggcagcugcauuuuuuuccuccuuccgcucagccugggguuucuguuucuccucucaugaacccuuuucuuuccuugggguaucuuuuuuagacuggcucucugcaaacuucuuagcaucaaacugagccaucuucucacacagcuucaccucccccaagauagcccugaacuggggcugguuaaugcagguaaggaaccaccgguugguauuggggaaggccuggcgaaaagaaggcucuaagaccuguuuauagagccacaacaggguacagacaacuguaauaucagccagugucacucgcucgcccacuagaaaaguucgagucuucaagugaguguccagcagccccaggauucgcuucaccuccucuuucgcauuuucaguggccuguuuguuguggugcauaaugcccaagguggggaacacccagguacuagcuggaggaacgaugucacugucagcaaagcugacccacugcaccaccugagcugccgccucuggcguacuuccucgcagcucuucauugcuuacauaauaggcaauggcauugcucucaaacacacagaauccaucaucacccucaaaugcuggaaccuugccggcaggaaauuuucggagaaauucaggggugcgguugguuuggccaaaguggaagugggguggugcggagagcacgcggaccugagccccgcuguacugagcagcgaugagggccuugaaggcccuccaauuuucaggguauguguacagggucccagccgccauggugauuccgcagagaaaggggguggggcuca

SEQ ID NO: 4056 - RNA, 4616 nt, Mus musculus
auuucauagagacauuuuuuuuuuauuuuaaaauucugcaucugaaaacacaguauggcagaaagcgucuauguacaccugugguguuuuugguauaauacaguauuuaauaauccacuguuuucugcaaaaaaaaaaaaaaaguugcuuuguuggacagaaacaaauuccccuagacagaaauacagcuaaggcacaauuuuguuguuguuuucugcuaaaaucaaaagacaggaaagaggcagauaugggcgguaacacaguugucugcgagaacgggacuggauggcaagucuucagaugauuagaacuuucauuauuggucaauuucagauaguuuaauaucucuuaaaauacuuacuccuuuaaauaaauagcaaaauaucuacaucuuucagugugugccaugugaacucucucuuauuuuuuuaaacuuuuauuuacagauucucucuuuuuuaaaaucaauacauuacaaaauauuucuguacaguuuuaugcauauuaugaucuauaacaaaauaguuauuuuuaaaaacuauaucaccacauaucuuugaaaacaaagaaggaggcaguaaugacuuaucuccaggccucuaaaaacaaacaucaagacaaaugcuacagaugacaugaggagccucucucuuuuuuccuuuaaaaguaaagaucgauggauaaagacaauuaugcccaauaccagcgaacuuccuaugaaaacccugggguugucuuuggcuuccaucagcacuggagugauggaaggggauucuagguggagucugaaggacagaguggaccaccccuucaagaacgugaccuauccacugggaauacuccaugcugucacuuuccaggcaagaaagaugaagcgauacacggagaaacacuccugauucauccuuaaaugaaguaccuaaagucacugggucccgagggaaggggagacugaagcuguagugaacaucugcugguggugccagccagugccacggcaacacggagagugcucagaacugcgcgagcagccaagacuucauuuugcccauaggaaaaaauaugagaacauuuuuucuuaaagaugacauuuaagucauuccuagugcaucugcagacuacagauuggcagucccuuugcucaggaggccgccacacacccaggcuucaagauguucucucuucugugauggugggggaaauuagagggggaggaugccagcuuuccaaaaauaauuuuaaggccacauuucaaaacggagaaaccuaaggcuuuuuagagggguggggaugaaggugggagguaggagaaaaaugcagaaaggagaagacggugcugugaugggggaggugagauggggugccugcuuccuggugaugucugcaggcugaagcugugagaauauuccuagccaagugaggggaggagagaggccacuuucucccagugugggggcuuggcaagaacagaaccaaagacaacaggagggacauacacagguggugggugacaacccuccucggucuuaagagguccuuguucauaagguuaaaaaaauaacacacacacacacacacacacacacacacacacacacacacacgcuuguaaguaaaagggaaagaaaaagagggagucagacugagggagagggacggagggggaaagagagagggagagagagagagagagagggagagagagagagggauuugcauagauuguacauucagcuucagcauggguaacaccuucauuccgccccacccccagguaaacuucucagcagacauugagguagugccuggguugacccuugggcaaaguaagguaacugaggcagaagcaaagaagacuacuuaagcuagcacagccccuugugguuucugaagaaccuuccagcacaguggcagcaugcggacucuggagugggaccuaguacuccccagccucaucuuaaggauggcaccauugccaucucggcuugguuugauggaaugcccgaagguggaggccugagcagauucaaaccucagaccccaggucacacucuuuccucgucagcacaggccagggaagugaaugagccagcccuccugcagaagacagguuuucucaggagggaacuacuaagcagaaaccuggagucuuauaguuuaaugugagcuguucuuuuugcacucuuaacucuggcuuuccaugacuccuuaccccuaaauucuuucccucauuucaacccaccuuuccagaaagaggauuuugccuaagcacaaccaugaagcuacuuuucugcccgcaucuuuaaaaauaaauaaauaaaauuaaaauaauaguagccaauauugaacaacuagauuuccuauuaaacaaaacaaacaaaaacaauaaacaaacaaacaaaaacaaacaggagcuggauauauuuggcuucccuuauuagcuuaaagaguccacugcaaugaguuuugcuuucuugcuugcuguaauaagcugggagcugagccacagcugccuuuauuaccagaggauucaugugcgugccaguaagaccacacuccccaccacucccuuuugucuuucaccugugguuuuacccaucuaugcuugugucccggaccucauuaugcuuuuauggcccccgcgguagaguuucucuggucuggcaagccuucucugcaugcucaagcucacaagguugacacugguuucaagccuauucucaaugcucucaggaacugcugauccgaacccucaugaacucggugguaaaugguuucuucuucauacucuacacuuuguggccauugauugcucuucucuguuauggagugucuugggagagagguuacaguuucaaugaacauccucuuaucuaucggaaaacuagacaaccagaagggguuaugcucuguaaauacccagacuacauccaaaguagcaacaaaccccuuagggguguuugcacaugugcuugugcguguguguguaugagugccuguguguguguuuguguggcuguguucauacccucuaaacuuaaucucaguuuaaaaaguuaaaccaauaaugagaaaugaaaccaggaggccccugaucuccaccagaaagucaccuggggaacagaaaaagaacuucauuguuaaagccaaggggcacugggaguugcucccuucccucucagagacuuacacagccugcacagccugggaaguuggcuuugggagccauaguuaccaaauggcauggagaggugccaucucaaauacuucuucccauaagggaccuggucagcguuaaacccaggcuucuugcuucugcaggcugcagacuuuaagguucccggagaugaugguucuguguuuucaaaacucuugggcagccaccucccaaggcuguuguuucaccaauagccuccaacaaauacaugguuuucaggcaggagaacaccaagaaauaaggaguuaugccauuuuccauaggaaaacauauuuucuuaaauuaugcugaacuucuuuuaaauucuccauuuuuuuguuuuuguuuguuuguuuuuacuaaaagaaaaauuauucucugggucaaaaaccagaggaaacaaauauccucaaauuacuuguggugaauaaagagggagaggagugucuucagaggaaguaggcucugccauuuccaagugcauuccaguaugaaaaaugucauugagugucacugggucuagacagacccugucucagagucuguggaucccagggaccuuccaggacagaauacacaaaucuuuaaaacaagagaggucaagggggaacucaaagagguuccauagucccagagaagcuuugaccaaggcaaaggcucgggguauugagagaauggggcacugggcucacaguucccauggguuaguaaaagcaauguaaauccuguggguuuuuagaggaagacacugaaggcucccccaccagcacagacaguagcuaccuccugagcucuccuuugggucugacccccauuccuccuccuaagaucaaucauucuuggaaggagccugucuuccucugcuagugauagcuugugcucaugguuaaacuggguagaucuauaguucuagacuuggcacacuucuccgaccccaagccaugagcccaucgcauccucguccauaggucagcggucaggguaaagagagaacucaggcauuguaacacuuuugaauauagagggacaggugagaccagcauccuggguaagcaaagaggagguuccagccauccaaaugggucuacuuccugagagugggagcacugguugaaacugugcaggauguaggguggacacugagagacagauagagagaggaugagggagaaaggcaggcagaccagggaaagggaggggugggggagccuuuugugaauaaaggcaauuucaguuaguaagauaacauaauugacaagcugcaaaaacagcaccuacuaauuagucauugacuaaaacauauaaauaauaaauaucaagggucccuucucuaugcccgccauguuagauggggaaagggcugugcagucgacacaucaagguggacuucaguaccuuauccaugcugggagagacacaa

SEQ ID NO: 4057 - RNA, 11090 nt, Mus musculus
auuucaaagccauaggauuugugacuuuacuugaacuugcagaaagggaaguaugcuuaaggguggauggagccuguucccaaugagaccgcaaguuaugacacccaaauuuuaaaaggcagacaaaugauuaucaacuacugaugauuaucaaccaccugcuuugggagcuuaaguacacgaucuuuugagucuccacugucuccuccucuucaguguucucccuuuccaucugacauggguaccuuagagaagagcuccaaugacaacagguggucacuaguuagauucauaaacucagaguuaacaaagaaagugagacaaaaggguuccaacugguuuuuaauuuuuccccuuuaccacaaaacaaagaagaaaugauuaaaacugccaaaguaguuaacucguagaacauguauuagucacacacacacaaauuccagguaggaaggcaggcuuauuuacaagaaaacauguaaaaucaaagugggagucaugaaacauuaaaaaacaaacacacaugcuacaagaggcaccgcugcuuacagugcuagggaggugagagaacagauacacacaggggcaggcuucacagcaucagugcauggauccacaaacuauguuacagcuaguucauggguuaaggaguuguucccaaauguccuauuuuggcccucagagguucaguucugcagauuucaacugcucuaaaagcccccuacugagagggcacgugaucacaguaagcuuaaagaguugcaaaagcuaggcagaccagagucaccaaucagcagucugcucucagcugcagcccugcauuuuucugagaaaugucaaggggaaagucaaacagcaguaaacacuugucucucaagugcaaagcuggaggcacugaaauacagccaauacuacgaaaacaagugagauuuuccaggcuuacucuuaagccucuuuuuuuuuuuuccuggucuuaaauauuaauagauaaucuaguuuucuacucauugaacaaaggauacuuuuaucccuggcugcccuuacaggaaagucacaaacauuuuaagucagcugacaaucugaaacaaagaaacugcuacaauccucaaauauaaucuucugaaagcuugcugcucaaaggccauuauggacuagaacuaaccugaagcagugcaaagggaaugagaggucagucaaagccugccaguccucacaggaacaaaggggcaaugcucccucaaacuguugcauuuccuaugagcgaggaacuuacacacacuaggguguggaauuaauuuuuuaucuuauuccauggguauucucccacaguggaaacucaggaaugaauuuuaaguggucuccucagcagaagugguaaacccaaucucuguacucacaaagacaguuuguuaagcagacaguagaaccagcuuccuguagccacagaccacugccuugaauauagcuaaagcaaacaucaacaaagucacaguucacuguacaaaacaguaaaguucaccacuuagcaucuuaaaggaaggaaguugucaaaaugaaaggaagucacacugacggggaauguacccagcuacaccuggcacuagagcccgcacagagccuggccugugagaauuucuauuaacaagggcagagugagggaagcaacgagccacuguaacacuucagugcccagggccagggcacacuccgcggcagccacacuacucauuuuucuuuucuuuuugcuugagaaguuuguuuaucucccuuuuggccauuccaauguacuucagaaugaucccauguugguuuaguccaggaagcaacagcacaaaugucacuagaaaugaaaaaaaaaaaaaugaaguugaggagacaauauuuaacucucugaagaugacuacaguugaauguggguggacuguggagaagugacacaaaagccauccaacaggauucagcccaaaacugcagccaaggugccuccugaaggugcacucacgcucacacuacagugccuucuaucucacuccucuuugcucacgaccuaccuggcuuuaaugaacuccaggaaaacagagaccagucuuuuuaaaaaagauuuguauuuuauguguauacacaagugcuuugucuagaagcauauauguggaauauaugugugcccagugcccacaaaauccagcagaggcuaucagaugcccugagacuagagucauagguugcugugagccaggaauugaaccaagcauguuuuuagccauggagcucuaucuuaagcccugacuugaaucucuagcugggcugguuuugaacccgaccuguagcauauagaaagggaugaccuugaacuucuacuccuucugcaucuagggcuggaaugacagcuuuauccaguacugggcaucaaacccaggccuuggugacacagggcacaaucugagcugugacccagcacagacuggaaccuuuccuucucaccuugccccacucccauagguccugugaaaacucaaucuauuuacugacuacacaccacagucagacuucccugcuaaguugaacaugugauguuucuucaacgacuuaccaaucagguaggugagaagcagguugugaacuugcugucccacccaagccaccgcagcaagagaaaugaucauggucaugaaguacuggcaaaaaaagaguaacaacuuagcucccagcaacaaaccagccagugcaacucugaagccuggccucucuacacugcacacagcaaccacagccugaaggcuugccucaggugccucaacacuacacagagcuccaaagacaugcuauguuacacacacagcuucaugggggggggggggguguuaaacagauuucuuuugggagggggggggucgagacaggguuucucuguguagccguggcuguccuggaacucacuuuguagaccaggcuggccuugaacucagaaauccaccugccucugccucccgagugcugggauuaaaggcgugagccaccacgcccggcuuaaacaguuuucuuuuaaaggcuaggaaaaauaauaccauguuuuacauguuuuauuaauuuucuuucauagaauguaaauaaauuacucuuagaauuacugugucuauauagauuaauacuuauaaacuaagcuaccuucccaguuagcacuucccaccaaaaccaaagcuaggauauggagacauuuauaagucagcauuacacaaaaggggacuaaguauugaacuucauuccuagcaaugcuaucacuaggcugaaaucagugaacucaugauuuugcuucacauucaguaaguuaaaaauaaauaaauaaauaaauaaauaccauuuuaggcuuuucuuccuuuagggaaaagaggcguuuccaccagcccacagcucugcgucgaguuuuuacuagauuacugcagauuucaugaaaucuuugcuguuguucagugguccuagaaaaggaauuccucuuauugauuguuauaaguaaacggcuaugguacaauuuauuuacuuaguuaauuuuccuaaggcagaaucuuuuuuuuuuuuuuuugguuuuucgagacaggguuucucuguguagcccuggcuguccugaaacucacucuguagaccaggcuggccucagaaauccgccugccucugccucccgagugcugggauuaaaggcgugugccaccacgcccgauccuaaggcagaaucuuacucuuuggcugccucuacucaucauccuucugucucagcacugugaaguccuaggacuacaggccugagccacaauacccuggcugacagcuaagacucuugaccucccucgggcugagcgcacaggaaggugcccccacagugaaaaacuguguuccuuuauguguaucaguguugggucuacaucuacacaccacauacaugcagugcccgauacaugcagaggccaggagagagcaauaaagccccugggccuggaguuauagacagcuguuaaguacugggaauuaaauucagguccccuagagaaaagcaaguacucuuaacuucugagaccuuucuagcccccaaaaugacuacauuuuaaggccucuuucacagaacaggauuaugucuugcauaaaguaugcccaugcacauauucucuuucuuuacaucuuaccuauuuuaugcgugaguguucauauguguuuaaguacaagacaugguauacauguggaggucagaggacaaccugugggaguugguucucuccuuccaccaugugggccccagguuucaaacucagguaaucaggcuugcuggcuugcaccaucacugucugauccaccucaccaguccaugugugcauacuucuaauaauaugaaucuugcauugugcccagcagggcugcaagcagcugcaucugaguaucugugggagaauaacuucuacaccaggucagcaagauggcucagaaaauaaagauucuuacugccaagccugggaaccugagugcaauuucuagaaccccaugaaaggagagaaacaaacuaaaaaauugaccucugacuucuccaugcuaagguacaugugccaguggguggguguacauggguaaaggagcgcgcgcgcacacacacgcacacacacauacgcacacacacaugcacacacacauacacacacauacauacacacacacacacacacacacacacacacacacacacacacacccuuauuuuuaggguuuuuuuuuuuuuuuuuugaguuuuucgagacaggguuugucuguguagcucuggcuguccuggaacccauuuugaagaccaggcuggccuugaacucagaaauccgccugccucugccuccagagugcugggaguaaaggcccggcuccacacacccuuauuuuaaaauguaagagaccaguccaaauucauuauaaacucaguucagucccagggagagaaaaaaaugacaggccucucuaaaaaagcccuuuuuucuuucucauuucuaaucuauuucucucuucuuuuuguggcacagguccaguacuaaaaaggacccaugcugaggacgcgcuacccucucuccucuaguguuagccuggcaaaguacagcaguggugggaggauuucucagauccugcaagcuguccauggucaaggccaggugguggcuacugucccuucuuucccacagcuuucccacugcaucaaggcagauaaucaaagcagaaacuuucuccacugaugcuauuaacacuaacuguuuauucucugaagauuuuccucuaggauuaggaguuaguggacugcugucuggcuaaugucaaggucauaaacuuccccaaacauaauagcuuuaacuccucagggcaagggaaaagcaguuugaauaacuaacacugauccauuauaaagaaacgugcuuacuuaaaucagaguuuaaucuaacucccccaaauuaugugaauuucuucuuaaagauauggaagguacauaauaaagcucccauugcuggauuauauaaguugcugucauuuggauaaaaaaaaaauuuaagagaacaagcagaacacuaagcaacugaauaugucagcugauagaaaaaacuacucuguucauuauguguguuuuuucacuccuccagcugagaagagaauuaaggguaccauguguucugggcaagcacuuuaaauacugagcuacaccuccagugccuggcuugaugucuggaucaaaacggagaaagccaacauuccucaggaagcucaaagaguuauuaauguaauccuuaaccacuuaacuauaauuuuaggacaucauaagugaccauuugagaaugguaaaacugaagucaacagcucaguguauccaaggcagcaccuacucucaucgacugagaauacauguggucaaccacuccugcacugccucaaugcacccccucacucaaccuuaaacacaacaucccucuugguuuguuuugggauguguggaggggcacugcauguguuugugacagaauaugucuauguagccaagccaagccaagccaagccccgaguuuguuauguguuuguagcccacucaaucucacaaugucugccauccagaguacugggauuagagcuguguaccaaucauuagcgcaaaagaucaagcuugaaagucuaauaacuuucaaggguuuuuuuuuuuuuuaagaguuucucuguguagcccauaccguccgucucuugaucuguagaccagacuggccuugaacuuagaccugccugccucagucucccaagugcugggauuaaaaggugcaccaguauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaaggggggaaguggguggguaggggaguggggguggguggguaagggggacuuuugguauagcauuggaaauguaaaugagcuaaauaccuaauaaaaaauggaaaaaaaaaaaaaaaaaaaagucuccagcugcuuuaaaugucaugcacacauguagcucuugcugauagggaagcagaaaugauggaugcuugaguuucaaaauugcucgcaagcaugggcaaccugcugagacucugucuaaaugagaauagacacaaaaccucccaauaucgguguuagggcagagaaguugguugguaaucaucacuagagauuauauuuucaaacuagauuaugugcauguacaugugugugcguguauguguguguguaaucuuuguauauauagagaauuuauagauuuaaaaaaacagauagcuaauaucuauuaaauaauucuccaguuuacauaaacucauuuaaugauguuaucaauaaaacuguuaauagcaguauuauuuuaaauaucuacaaaaugcaaacaaucuagaauuacaaaauaagaacacggggacaccauaacagcacguuacaacauaaaaacuaugaguuuaaaaaaaaaaaaaaaaaaaaaaaggugcaccagugaaagcaagaaugagcaacaccugggguguccuucaaccugcuuuuaaguugccauaaugaccuaauacuguuguguuuggggaaaguuggugaccauacaauguaacacauuuaaaaagagaacaggcuacugaccuugauugaccugagauuguccucaaguguacacacaagcaaggacucacacacaucaaaaagaugcauuuaaacaacugagcucaagguccacugagaggguugucaggcaaaggugcaggcugcaaacccuucugacuugaguucaguccccaagacccacauaugguaagagaacaaacucuggaaaguugcccucugaucucuacucccaaauaaacauacauaguuuaauaaaaaacaaacaaacaaaaacaacaacaaaagaguccuggaauucuuaaacaucaccuuuaaaaaaauacucuuacuuaagguagauauagaacugaauaagcaacaaaaaagcaaguuuucgaccaaaguuaaggacagagauagaaguacugaaaacuccugguacccaucugaagucagguaugaaauucuucacauaagagcaaugacucuaacuccagcagacagacaucugacgggcagacaagagucuucauuuaaccacagcacacuuaucaugcagagccaccuaccauuuauuagagccaaaaauucuuggugcuagaaugggaacaagguagucagccaggcacaaaaacauaacaaagcaggaaacaccagacagcacagauggaucgagauaauagauaauccuauuaaaaacagagaaaauuaaccaagguuagagaagagcagccgucagucacuauucccagucagagcuauucccucccucccuccccucgacucucagagccggggcugcucccuuucuaacuuccucacagaggcguuccaggggcaccauggcgugauguugucacagccauagcgguuaauguaaacagcaguacucaaaaccucuggaguccucaauauuuuuuuuccuggggguuuuuucgagacaggguuucucaguuagcccuggcuguccuggaacucauucugcagcccaggcuggccucgaacucagaaaucugccugccucugccuccccagugcugggauuaaaggcgugcgccaccacgcccagcuggguccucaaaauuuacuagaaggaauauaauaaagcaagagugcugaaacacaagaguuugcguguccgggauuuacucaacugcaucaaguuacaacuuuacauaaggacuacaaaucuagaaagagggcaagcugcuugcaauaaaggcauuccuuuuggauuauguauuacaaaagcuucucuaagcacaggcuaugaacccucugagcauuagcaauagaaucucacuuacaggaacagcagggaaaccacacccaugauggcagguggaaaccaggcucuuucccaucgaaggacuuugucagccaucagcaucaccucuccccagccuugcagcugcucuucaagacuugcagucuccacggccuacacaugaucaacaguuaagacuguuacuuugccaaucucaacacuuugguggcucagagaguacuuucucaggcaucaaaaacacguaaaaugccuuuuacaaaacuguuaucuuaaacaaggugagucaugaaaaccugcaauuuuggcaccaaauaugaaaauccauggguaggaaaaagccuaggcuuuaauggucauuuuagcacugggccauauguccaugauguauaauaauauucccaagauuucacaauuuauuucaauauucaugaaagugagcuuaauaugggaaacuaauauccccaaaugcagccacagagccaagaggcagugcucagaauauuacuagauugaauauucuguuugcccauuucaggugguuggcauugaucugucgauuggccguuuuauugauugaaguccuucuaaauccaucaggagaaccuuucccuuaacacuaaguacauaaaucucuaaaauagcuuuguauaauggaaugacucugauguuggcagucacuguggaauuaaagaaaacucuuucaaccaaacuaugugagcucagcacuuaauggcuccucaucauuaaugauagaauuucaauuaaaucucaaaauuuuucugcauaugugacaacuagccaaaagcacaccuuuaccaugggcuacugugaccugaaccuaucagggacuuugguaacggaagguauuuagaaccuguuugugcagaacucuggauucaacauccaggaacuacauacacacaaugcccaacugacacuaucaacucuucacaaaggaauaugcaaauauagaacaguucaggcuaauuuuaauaaagaugagauaugugacuaaguacuuuugacaucuccccauacuagaaauccuaaacauuuuacauguuauacuucaauugacgcuccaaaaaaacuggaaaagguauucucacaaccucuacuuuaagauaaggcgacugagacauaaagggguuaauauauuuaaauccaggaaauccaagacuaauggacuugcucuccuuaaaaugauggaaauaguagugaucaggcccucucccaugauaguuuccuuguacagcaauuaauccucuuauugaauuguuugcugguauuguguaggaggaguuuaaggguacaggguaagcaucucuauuguaugguacuguguguguguguguguguguguguguguguguagggaauuuaaggauacagggaaugcaccucuaaacacaaauacaaacugaaaaucuugcacuaaucaaaacugucccgaagaaucuugucggcacuuagcaguuaaaaaggcaggcauuaaaagcugauugcuuuuuucauuucugauauggccugccuuuucuggggaaugacaauacagaaaaaaaaaaaaaaagaucuuucguucuugccuaggugggugaugcaguuaaaaauuugaaacuagcagggccuggugaugcgcaacuguaaucccagcacaggaggaugacaaauacaaggcuagccucgucaagcuacacgaaaaccuagccuuaaaaaccaaaaacaaagaccuaaccaaaaacaaagaccuguaaugaagcaaacgcgcccucuucuaauaccaucaucucguguagcuccgucaaauccgugcuaaaucauuuuuaaaguugcauccagucccgugagucccucgccaguucccagacaagugccaggaucccccacuguccuuuccgcagaacccguuuucagcuuccugcggugaacuccaaccagccagcuccaacaaauucugugucagcgauaaacuaauucucuguagcagcccuuugacccuccacccuugcgccaaguuuuaggagaaaaagaaucaugauuaaaaauaaucuacggaacaugagauuaagaucaaagggcaaaacagguaggucuccggccugagccggagcgcuagacaaggccccuggcggccgagugccccaaccuguuacccagguuccuucuugccacagcccccuucucacacuuccucacgcacggcccaagccuuauggugcaggauuccgggggacguuggggaucgccagcagcgaccuccaccguggagauaaggccuggcugucccugguaguccaccgaggccaggaggcccauccggaaacuccggggacagacugaccaccgcaacucaccagcagguugcugcugcgguuaucccccuccgccaucguuccagacucgcgguuaucaacgagcgaacacacacuauccccccaacaccagcaaggcaacccgagcgcgggggaacgccccgcagucugcuuauauaggcuagcugccuuucccgacagcccucgcgaaacucgcuccucauuggguagaccgca

SEQ ID NO: 4058 - RNA, 11090 nt, Mus musculus
ugcggucuacccaaugaggagcgaguuucgcgagggcugucgggaaaggcagcuagccuauauaagcagacugcggggcguucccccgcgcucggguugccuugcugguguuggggggauaguguguguucgcucguugauaaccgcgagucuggaacgauggcggagggggauaaccgcagcagcaaccugcuggugaguugcgguggucagucuguccccggaguuuccggaugggccuccuggccucgguggacuaccagggacagccaggccuuaucuccacgguggaggucgcugcuggcgauccccaacgucccccggaauccugcaccauaaggcuugggccgugcgugaggaagugugagaagggggcuguggcaagaaggaaccuggguaacagguuggggcacucggccgccaggggccuugucuagcgcuccggcucaggccggagaccuaccuguuuugcccuuugaucuuaaucucauguuccguagauuauuuuuaaucaugauucuuuuucuccuaaaacuuggcgcaaggguggagggucaaagggcugcuacagagaauuaguuuaucgcugacacagaauuuguuggagcuggcugguuggaguucaccgcaggaagcugaaaacggguucugcggaaaggacagugggggauccuggcacuugucugggaacuggcgagggacucacgggacuggaugcaacuuuaaaaaugauuuagcacggauuugacggagcuacacgagaugaugguauuagaagagggcgcguuugcuucauuacaggucuuuguuuuugguuaggucuuuguuuuugguuuuuaaggcuagguuuucguguagcuugacgaggcuagccuuguauuugucauccuccugugcugggauuacaguugcgcaucaccaggcccugcuaguuucaaauuuuuaacugcaucacccaccuaggcaagaacgaaagaucuuuuuuuuuuuuuuucuguauugucauuccccagaaaaggcaggccauaucagaaaugaaaaaagcaaucagcuuuuaaugccugccuuuuuaacugcuaagugccgacaagauucuucgggacaguuuugauuagugcaagauuuucaguuuguauuuguguuuagaggugcauucccuguauccuuaaauucccuacacacacacacacacacacacacacacacacaguaccauacaauagagaugcuuacccuguacccuuaaacuccuccuacacaauaccagcaaacaauucaauaagaggauuaauugcuguacaaggaaacuaucaugggagagggccugaucacuacuauuuccaucauuuuaaggagagcaaguccauuagucuuggauuuccuggauuuaaauauauuaaccccuuuaugucucagucgccuuaucuuaaaguagagguugugagaauaccuuuuccaguuuuuuuggagcgucaauugaaguauaacauguaaaauguuuaggauuucuaguauggggagaugucaaaaguacuuagucacauaucucaucuuuauuaaaauuagccugaacuguucuauauuugcauauuccuuugugaagaguugauagugucaguugggcauuguguguauguaguuccuggauguugaauccagaguucugcacaaacagguucuaaauaccuuccguuaccaaagucccugauagguucaggucacaguagcccaugguaaaggugugcuuuuggcuaguugucacauaugcagaaaaauuuugagauuuaauugaaauucuaucauuaaugaugaggagccauuaagugcugagcucacauaguuugguugaaagaguuuucuuuaauuccacagugacugccaacaucagagucauuccauuauacaaagcuauuuuagagauuuauguacuuaguguuaagggaaagguucuccugauggauuuagaaggacuucaaucaauaaaacggccaaucgacagaucaaugccaaccaccugaaaugggcaaacagaauauucaaucuaguaauauucugagcacugccucuuggcucuguggcugcauuuggggauauuaguuucccauauuaagcucacuuucaugaauauugaaauaaauugugaaaucuugggaauauuauuauacaucauggacauauggcccagugcuaaaaugaccauuaaagccuaggcuuuuuccuacccauggauuuucauauuuggugccaaaauugcagguuuucaugacucaccuuguuuaagauaacaguuuuguaaaaggcauuuuacguguuuuugaugccugagaaaguacucucugagccaccaaaguguugagauuggcaaaguaacagucuuaacuguugaucauguguaggccguggagacugcaagucuugaagagcagcugcaaggcuggggagaggugaugcugauggcugacaaaguccuucgaugggaaagagccugguuuccaccugccaucaugggugugguuucccugcuguuccuguaagugagauucuauugcuaaugcucagaggguucauagccugugcuuagagaagcuuuuguaauacauaauccaaaaggaaugccuuuauugcaagcagcuugcccucuuucuagauuuguaguccuuauguaaaguuguaacuugaugcaguugaguaaaucccggacacgcaaacucuuguguuucagcacucuugcuuuauuauauuccuucuaguaaauuuugaggacccagcugggcgugguggcgcacgccuuuaaucccagcacuggggaggcagaggcaggcagauuucugaguucgaggccagccugggcugcagaaugaguuccaggacagccagggcuaacugagaaacccugucucgaaaaaacccccaggaaaaaaaauauugaggacuccagagguuuugaguacugcuguuuacauuaaccgcuauggcugugacaacaucacgccauggugccccuggaacgccucugugaggaaguuagaaagggagcagccccggcucugagagucgaggggagggagggagggaauagcucugacugggaauagugacugacggcugcucuucucuaaccuugguuaauuuucucuguuuuuaauaggauuaucuauuaucucgauccaucugugcugucugguguuuccugcuuuguuauguuuuugugccuggcugacuaccuuguucccauucuagcaccaagaauuuuuggcucuaauaaaugguagguggcucugcaugauaagugugcugugguuaaaugaagacucuugucugcccgucagaugucugucugcuggaguuagagucauugcucuuaugugaagaauuucauaccugacuucagauggguaccaggaguuuucaguacuucuaucucuguccuuaacuuuggucgaaaacuugcuuuuuuguugcuuauucaguucuauaucuaccuuaaguaagaguauuuuuuuaaaggugauguuuaagaauuccaggacucuuuuguuguuguuuuuguuuguuuguuuuuuauuaaacuauguauguuuauuugggaguagagaucagagggcaacuuuccagaguuuguucucuuaccauaugugggucuuggggacugaacucaagucagaaggguuugcagccugcaccuuugccugacaacccucucaguggaccuugagcucaguuguuuaaaugcaucuuuuugaugugugugaguccuugcuuguguguacacuugaggacaaucucaggucaaucaaggucaguagccuguucucuuuuuaaauguguuacauuguauggucaccaacuuuccccaaacacaacaguauuaggucauuauggcaacuuaaaagcagguugaaggacaccccagguguugcucauucuugcuuucacuggugcaccuuuuuuuuuuuuuuuuuuuuuuuaaacucauaguuuuuauguuguaacgugcuguuaugguguccccguguucuuauuuuguaauucuagauuguuugcauuuuguagauauuuaaaauaauacugcuauuaacaguuuuauugauaacaucauuaaaugaguuuauguaaacuggagaauuauuuaauagauauuagcuaucuguuuuuuuaaaucuauaaauucucuauauauacaaagauuacacacacacauacacgcacacacauguacaugcacauaaucuaguuugaaaauauaaucucuagugaugauuaccaaccaacuucucugcccuaacaccgauauugggagguuuugugucuauucucauuuagacagagucucagcagguugcccaugcuugcgagcaauuuugaaacucaagcauccaucauuucugcuucccuaucagcaagagcuacaugugugcaugacauuuaaagcagcuggagacuuuuuuuuuuuuuuuuuuuuccauuuuuuauuagguauuuagcucauuuacauuuccaaugcuauaccaaaagucccccuuacccacccacccccacuccccuacccacccacuuccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauacuggugcaccuuuuaaucccagcacuugggagacugaggcaggcaggucuaaguucaaggccagucuggucuacagaucaagagacggacgguaugggcuacacagagaaacucuuaaaaaaaaaaaaaacccuugaaaguuauuagacuuucaagcuugaucuuuugcgcuaaugauugguacacagcucuaaucccaguacucuggauggcagacauugugagauugagugggcuacaaacacauaacaaacucggggcuuggcuuggcuuggcuuggcuacauagacauauucugucacaaacacaugcagugccccuccacacaucccaaaacaaaccaagagggauguuguguuuaagguugagugagggggugcauugaggcagugcaggagugguugaccacauguauucucagucgaugagaguaggugcugccuuggauacacugagcuguugacuucaguuuuaccauucucaaauggucacuuaugauguccuaaaauuauaguuaagugguuaaggauuacauuaauaacucuuugagcuuccugaggaauguuggcuuucuccguuuugauccagacaucaagccaggcacuggagguguagcucaguauuuaaagugcuugcccagaacacaugguacccuuaauucucuucucagcuggaggagugaaaaaacacacauaaugaacagaguaguuuuuucuaucagcugacauauucaguugcuuaguguucugcuuguucucuuaaauuuuuuuuuuauccaaaugacagcaacuuauauaauccagcaaugggagcuuuauuauguaccuuccauaucuuuaagaagaaauucacauaauuugggggaguuagauuaaacucugauuuaaguaagcacguuucuuuauaauggaucaguguuaguuauucaaacugcuuuucccuugcccugaggaguuaaagcuauuauguuuggggaaguuuaugaccuugacauuagccagacagcaguccacuaacuccuaauccuagaggaaaaucuucagagaauaaacaguuaguguuaauagcaucaguggagaaaguuucugcuuugauuaucugccuugaugcagugggaaagcugugggaaagaagggacaguagccaccaccuggccuugaccauggacagcuugcaggaucugagaaauccucccaccacugcuguacuuugccaggcuaacacuagaggagagaggguagcgcguccucagcauggguccuuuuuaguacuggaccugugccacaaaaagaagagagaaauagauuagaaaugagaaagaaaaaagggcuuuuuuagagaggccugucauuuuuuucucucccugggacugaacugaguuuauaaugaauuuggacuggucucuuacauuuuaaaauaaggguguguggagccgggccuuuacucccagcacucuggaggcagaggcaggcggauuucugaguucaaggccagccuggucuucaaaauggguuccaggacagccagagcuacacagacaaacccugucucgaaaaacucaaaaaaaaaaaaaaaaaacccuaaaaauaaggguguguguguguguguguguguguguguguguguguguguguguauguauguguguguaugugugugugcaugugugugugcguaugugugugugcgugugugugcgcgcgcgcuccuuuacccauguacacccacccacuggcacauguaccuuagcauggagaagucagaggucaauuuuuuaguuuguuucucuccuuucaugggguucuagaaauugcacucagguucccaggcuuggcaguaagaaucuuuauuuucugagccaucuugcugaccugguguagaaguuauucucccacagauacucagaugcagcugcuugcagcccugcugggcacaaugcaagauucauauuauuagaaguaugcacacauggacuggugagguggaucagacagugauggugcaagccagcaagccugauuaccugaguuugaaaccuggggcccacaugguggaaggagagaaccaacucccacagguuguccucugaccuccacauguauaccaugucuuguacuuaaacacauaugaacacucacgcauaaaauagguaagauguaaagaaagagaauaugugcaugggcauacuuuaugcaagacauaauccuguucugugaaagaggccuuaaaauguagucauuuugggggcuagaaaggucucagaaguuaagaguacuugcuuuucucuaggggaccugaauuuaauucccaguacuuaacagcugucuauaacuccaggcccaggggcuuuauugcucucuccuggccucugcauguaucgggcacugcauguaugugguguguagauguagacccaacacugauacacauaaaggaacacaguuuuucacugugggggcaccuuccugugcgcucagcccgagggaggucaagagucuuagcugucagccaggguauuguggcucaggccuguaguccuaggacuucacagugcugagacagaaggaugaugaguagaggcagccaaagaguaagauucugccuuaggaucgggcgugguggcacacgccuuuaaucccagcacucgggaggcagaggcaggcggauuucugaggccagccuggucuacagagugaguuucaggacagccagggcuacacagagaaacccugucucgaaaaaccaaaaaaaaaaaaaaaagauucugccuuaggaaaauuaacuaaguaaauaaauuguaccauagccguuuacuuauaacaaucaauaagaggaauuccuuuucuaggaccacugaacaacagcaaagauuucaugaaaucugcaguaaucuaguaaaaacucgacgcagagcugugggcugguggaaacgccucuuuucccuaaaggaagaaaagccuaaaaugguauuuauuuauuuauuuauuuauuuuuaacuuacugaaugugaagcaaaaucaugaguucacugauuucagccuagugauagcauugcuaggaaugaaguucaauacuuaguccccuuuuguguaaugcugacuuauaaaugucuccauauccuagcuuugguuuuggugggaagugcuaacugggaagguagcuuaguuuauaaguauuaaucuauauagacacaguaauucuaagaguaauuuauuuacauucuaugaaagaaaauuaauaaaacauguaaaacaugguauuauuuuuccuagccuuuaaaagaaaacuguuuaagccgggcgugguggcucacgccuuuaaucccagcacucgggaggcagaggcagguggauuucugaguucaaggccagccuggucuacaaagugaguuccaggacagccacggcuacacagagaaacccugucucgacccccccccucccaaaagaaaucuguuuaacaccccccccccccccaugaagcuguguguguaacauagcaugucuuuggagcucuguguaguguugaggcaccugaggcaagccuucaggcugugguugcugugugcaguguagagaggccaggcuucagaguugcacuggcugguuuguugcugggagcuaaguuguuacucuuuuuuugccaguacuucaugaccaugaucauuucucuugcugcgguggcuugggugggacagcaaguucacaaccugcuucucaccuaccugauugguaagucguugaagaaacaucacauguucaacuuagcagggaagucugacugugguguguagucaguaaauagauugaguuuucacaggaccuaugggaguggggcaaggugagaaggaaagguuccagucugugcugggucacagcucagauugugcccugugucaccaaggccuggguuugaugcccaguacuggauaaagcugucauuccagcccuagaugcagaaggaguagaaguucaaggucaucccuuucuauaugcuacaggucggguucaaaaccagcccagcuagagauucaagucagggcuuaagauagagcuccauggcuaaaaacaugcuugguucaauuccuggcucacagcaaccuaugacucuagucucagggcaucugauagccucugcuggauuuugugggcacugggcacacauauauuccacauauaugcuucuagacaaagcacuuguguauacacauaaaauacaaaucuuuuuuaaaaagacuggucucuguuuuccuggaguucauuaaagccagguaggucgugagcaaagaggagugagauagaaggcacuguagugugagcgugagugcaccuucaggaggcaccuuggcugcaguuuugggcugaauccuguuggauggcuuuugugucacuucuccacaguccacccacauucaacuguagucaucuucagagaguuaaauauugucuccucaacuucauuuuuuuuuuuuucauuucuagugacauuugugcuguugcuuccuggacuaaaccaacaugggaucauucugaaguacauuggaauggccaaaagggagauaaacaaacuucucaagcaaaaagaaaagaaaaaugaguaguguggcugccgcggagugugcccuggcccugggcacugaaguguuacaguggcucguugcuucccucacucugcccuuguuaauagaaauucucacaggccaggcucugugcgggcucuagugccagguguagcuggguacauuccccgucagugugacuuccuuucauuuugacaacuuccuuccuuuaagaugcuaaguggugaacuuuacuguuuuguacagugaacugugacuuuguugauguuugcuuuagcuauauucaaggcaguggucuguggcuacaggaagcugguucuacugucugcuuaacaaacugucuuugugaguacagagauuggguuuaccacuucugcugaggagaccacuuaaaauucauuccugaguuuccacugugggagaauacccauggaauaagauaaaaaauuaauuccacacccuaguguguguaaguuccucgcucauaggaaaugcaacaguuugagggagcauugccccuuuguuccugugaggacuggcaggcuuugacugaccucucauucccuuugcacugcuucagguuaguucuaguccauaauggccuuugagcagcaagcuuucagaagauuauauuugaggauuguagcaguuucuuuguuucagauugucagcugacuuaaaauguuugugacuuuccuguaagggcagccagggauaaaaguauccuuuguucaaugaguagaaaacuagauuaucuauuaauauuuaagaccaggaaaaaaaaaaaagaggcuuaagaguaagccuggaaaaucucacuuguuuucguaguauuggcuguauuucagugccuccagcuuugcacuugagagacaaguguuuacugcuguuugacuuuccccuugacauuucucagaaaaaugcagggcugcagcugagagcagacugcugauuggugacucuggucugccuagcuuuugcaacucuuuaagcuuacugugaucacgugcccucucaguagggggcuuuuagagcaguugaaaucugcagaacugaaccucugagggccaaaauaggacauuugggaacaacuccuuaacccaugaacuagcuguaacauaguuuguggauccaugcacugaugcugugaagccugccccuguguguaucuguucucucaccucccuagcacuguaagcagcggugccucuuguagcauguguguuuguuuuuuaauguuucaugacucccacuuugauuuuacauguuuucuuguaaauaagccugccuuccuaccuggaauuugugugugugugacuaauacauguucuacgaguuaacuacuuuggcaguuuuaaucauuucuucuuuguuuugugguaaaggggaaaaauuaaaaaccaguuggaacccuuuugucucacuuucuuuguuaacucugaguuuaugaaucuaacuagugaccaccuguugucauuggagcucuucucuaagguacccaugucagauggaaagggagaacacugaagaggaggagacaguggagacucaaaagaucguguacuuaagcucccaaagcaggugguugauaaucaucaguaguugauaaucauuugucugccuuuuaaaauuugggugucauaacuugcggucucauugggaacaggcuccauccacccuuaagcauacuucccuuucugcaaguucaaguaaagucacaaauccuauggcuuugaaau

SEQ ID NO: 4059 - RNA, 6867 nt, Mus musculus
guuuccacaaguuccuuuauugauauagcaaaauuggaaagaacaagguccccaagugacccacagguucgaaagugcaaagacacuccacuucgaaugaagaugagugacagacaggccuugaccacuggggccauggaaauugugugaugaagacauccuuaaucacacaguugcuauagcagccaaccaggucugauuaacucuuuggucucuuuuauuggaacaaacuuaggcuguaaccaugaccccaaacuguauccccauaugcaguuuggggucauaagggacguuuaaaacagccagagcuggagugcuucaagucaagugacugaggcaagacaucuuuuuuuuuuuuucccuaaaaggugcuaaaauaucccugcauauauaacacuuccaggaccagauuucauaucagcuagcugcauauuucagucuauuuuuucuguguacaugaucuggaauuuacuacccucucccaccccaccgugugccauaaaaaauaaauagauaugucuaaguugcagauaagcaauuaaagaaagaaaaaaaaaaccuaacacauaccacagggguaacacugagccaguuucccucuggagggugucagaaauuugggagagguucauuuuuuuuccaccacaggagaaaauuuuccuuguguagacauggggggggggggaaccucuuugucaaggucaaagccaggaagcacaguucuguggaaaacgugacuuccucugggaggugacaagaggugcuuuaggaggaggcucagcuggugcuccuuuuggugggagacacugagucagaaaggaauagaaagacagccaguguucuuggaggugggaauaguacaaagccaugcaauuuggcccaaaguuggaacacuggcuguugauauuguuuugguuuugcugguguuuaauguuuccaaccaauauugugaaggcccaggcuagguuaccauggucaacaacaacaacaacaaaauuaauuuucacauaagaaccaaacacgaagaaagaaauuauucugcaauucuuccucauuacucaucggcaagcuccagccaggcuaagaaaguugaucucaaaucaccagccucccaccccagcccuccaccccuccaaaaguugccccaacuguuuuuugggguuuguuugggguuuuuuuuuugccccaaauguuuuagcugggauuuuaauuggagagccaggcuugcauggaaacccuaccagccuaccaggaacugggauaaauguuaucuguggcuguauuuuguuuuuuuuguuuguuuguuuguuuuuuucugcuguuauuccuauaacaaagcuuaacucugagagauaaaguagaaaugaacuaacacccccccccacacuuauauauauuuaaccacugucucuauggcaaagaauauaagccuauacauaccugggagaaggcuaacuguguaaggcaaggggucgcaaacugcuggccucagguucaaccagauaucuggcucacuuggugguuucagacuuuuuaaauuacuucuuaaauuaaaaaccagugagcguuaguauuuuaauuugaaaugccgauuguuggcccagcccuuuauuuuccagucuggagcugaggugagcugccuccuuuaagguaggcacaguccccacacccuccacccucuuauuuaucucccugccuuuaggcugcuaaguuuguaacuccugaccugaacuagcacauacuuaaaaacacauuuccucacccaaaacucucucccacccuugaggugucuucacccuucucccucccaacucuuccuuucacauacaccuuaagaccuccuccccacaaauccucagagaauauuugcauccauucacacuguccucuccuucauuugcaaaacgcauauucucccagcccaugagcauuccaggaaggcuccgagcugggcagugggaauuacugaggugucuggacgcaaaagagcugagucaucuuccucaaaaaaacgauuuucuuugggcacuggcuaaacaacucuuuuuauuuuuugguagagccaucguaucugagaauauuggcauauaugacucuccagcaccaaauauacaccaaaggugugugcaugucagauagaggccaugacaguagccauaugaaaugcagaacugagcugaauugaaaggccuugggcagccacuggacucaguucaaagccguauuauugcaucuguacauaguacauguuucagaucacuaaauauugaucaaaauugaucgaaaucucuuguuuuuguugccacauggcaagaacaacuguucagcauggcauuuaaauaaaacauuaauauuuuuuaaaaaauuuacaaacacaaugcccauuaauuuaauaauaauaauaaacuuuaaaaguuugaggauggaugaagcuuuggguaauuaauacaaaaaaagaaaaaacccuacaagaaagauacguuuauauaagcuauucauauuuaugauccuaaccagauuuauacuuuaaaauauuaucaagacuuuuuaaaaaagggauuccuuagcuagaaauuucuagcuaagcuagaaauagcuggaaauuugccucuccccuguucuaacuuaaugacuacagaggcagcaacaggcugaauguagaaaucaugugugcauuauacacacagacacauacacacacacagauacagauacacacagagaaacacacaaacacacagacauacacacacauacacaugcacacacacacacaugcacaaucuucccuuggcauuggcuuuuuaaaguaauuaaaaucaaaccgacugugcaguuucaaucuuugcaagaggcugacagaacaacccuuucauccaaugccguaccuuauaaccaaauauuggccucaaaaaaacgaagaaugaucucugggguaucaagagggauggccuccaaaacaacucucuuucagucagaguugcaaaggacaaaugagaagucccuacacucuauuccccucgauugccaaccgggugccccaaagagaguuugcagaguucccuccacauagcuaagaaaugaaacaaugaccccauucaugugacuauuuuuaucuuccaacuuucacuuuaaggagucuaagggagcucagaucuuuguuguuaaaaaaaaaaaaucccuaaguguauuacugagacuggccacacuucccacgaggagagaggaagacgaagcuuucuaaacuugaacugcuauuggaaguugucuggaaggcaggaggauaggaggcacucgaggaugggauccucccaacagcaaggggcgcccaggccagggaaguucagaacugagaagggcaaagacuguaagccagcucccucuuuucucccucugcuccugucgccuaucucuucugcccacugcuggagacugacaggucuccaagcacacaccucaugcuacuauuuuacaagucauaagcagaagcaagaauugacuggccuucaauacgauguaaggcugcuuaggcaaucaagaaccucccagccacuaccccgauaucagacaucacuggacccuaccccauucccaggcagcacaccaagcauuuucuccucagagguccuuaugcucugagacaagccuacggggccuuugcucagaggcucugagaccuaaguggguuguauccagccuacgaugagcccuaggcaggagcuucuaaaagacuuauguucuacacuuuugccagaccugucuuaaucaaggaucuuucccucugcauucugccuggcucaaaugaacagguauugagugucaagugcaaauccccaccuaugaccuggaggagugcugaugguggcuggcuggcugcuuuucagagcccuggucuuucagauaacuguguggaagcucuuuugaauagcccuugguuccaacaaacacagaacaagaaaaugacuagacauaaagugccacuugcucugaaagucucugaccagcucuuggccaccucuuagcauuggucacuuaauuuauaacaacuccauuaaucuuauucaacaaaccugugauugcaccacuaaaaaauacaugcaugcucauggaaauagcuaaaucaggacucuggaaugcuaacagcuggacuagaauuucaauuccaguuguggauaauuauucuuuaaaaacaaaacaaaaacuaacaaacaaaaaacugggagcccaggauguagcuuugugguagagggcccaccuagcauagggaucuaggauucuagccccagcauugaaacauacauacaacaccccuccaaaacuagggaucaauugggaaccuaguauuuaccaaauaaguauaucaaaggugauugcuucuaauaauucggggucagagacaucuguguaugagaccacccaagauacucuaauaggucugcagaagaugccacugauaucuuaggccauagagccuaggacagaacauuugugccaucaaauccugugacauccuucaaauuuucccacaccuugaacagcucuucuugaauuuagcugccauccgcucucucaucucaugggaaaggggcauuuggucagguggaguguaaucaggguucaugguucaucuucaggggagcccuggaugcguugacuccggggugcuggacaccuggcaagguagcggggaccaccguagacucggagaagcuggggcaaccuucgccacguggacagcaaccgcgcugcugcaagcucccgggagugcgggucgaaaggcgccaggaggucaacaggagcggccucccgcagcaccuugggcagggggccaaccucggcagccgccccagucggaccuaggacacaauggaagagaucucggcgucucagcaggcagucccuaaggaacuucaccaacuucuccaagcacucacucaggugugccucgucccagcugggcguugggcugcccucguucagaagcaccuccagcaccgccguuuugagcacguaagaggacaggauacguccccaguguguagcagccaucggguccagcccgcgggcacccaagucucgaagagccuuaagcagcugcaggcacuugagauagcaggcaccuggaggcgcccguuccugaagccagcccagcaguuucugcuccugacgugcuguguucacaccccacagagccucggcgcgcaggccacccgggagcucugacagggccccgcuaggcgagggugguggugguggugccacaaggaagacgccaucacccagguggacagcagggaugaggcgcacggccauggaaaggcggcagcagccauaguccgugcggcaaggaaggauguggaggguggggggcugcuccagacugccuggggucaggcugacccgacagcgacccuccaagcuguagcgcacaguggccaaggagcgcuguaggugcgccuggaaccagcgcaguaccaggguagcugagagguggcgacggcccugcacauccacacagaagccuucagcgaaggguuugcagucgcgaugccacuggcccgucgaggcccccgauggcgaggguggugccuugagggcgcacacgaagcagcugcggaaggcuggggucagcgaggguucgguccccaggcuccgcggcuccagcgccaccugcggcgggagucgcaguggcaccaacacgucgaagcugucgggucggcggauuuuaugcuguucauaggcgcugcccaccuggaugaagucuccccggaaggccaaagccagugcucccccggugaugaggccuggagacccucgggcccggccagcuugcacuaguucccccacaauccggcucacaugugccuugcugugaccuagcacaugcggcgacaggcgcacuucgugcucauaguaacucuccaguaagaugcucaggccuggcucuugcaaggaucuggcugagaaguuggcaugaccacgcgggcgggaagagccuggcaacaggcgcuggcggauggcguggcgacaucguaggaggauguagccgaggagaagaaggauggccaccuugagcaacgggaaaccgcugucugcgccgucgggggacucggcccgggcauccucgcugcugcguagggcaugguagaggcacaccagcgccgugcacagcccggucaccaagggccagaagacccgcagguugagcguguaccgcacggacaugccgggagaccgggcggcccagggcgcgagcccgggugguguccccugcccagcaugcgcgcagcgucccggaggccccgaggcccccguguccuuggccuugaaggaggcuccccgcucgcagcgccggggccagcagccccgcugcucugccuccacucuuagcucaaguuccccuuccaggcgccgcccgcgcagcucgcuccggccccugaccgcgcccugucccugucccgcucagucccagccgcgcugcccugggcuggcuucugccccggacuccuacccuacccugggcggcccuccuggcuccgccacagcugugcacaggggcgaucggccggguuacucgggucccgggauuuucuucuuucggaggggaaggccgcgccgggcagccgggaggaaaugccggagucuggagccucgcggggagggcggcccccucccagccuccgccugguucgacgucggguggccagagggacuucgggacuugcgggagacugcacucccgagggcuacuccugggcccccuccuggaaggcagaacggggaaggccugguuccggggcgguggcugcaucugaucccgcacuuacugggaaguugcuggaggaaggcuugcagccccaccgcccg

SEQ ID NO: 4060 - RNA, 6867 nt, Mus musculus
cgggcgguggggcugcaagccuuccuccagcaacuucccaguaagugcgggaucagaugcagccaccgccccggaaccaggccuuccccguucugccuuccaggagggggcccaggaguagcccucgggagugcagucucccgcaagucccgaagucccucuggccacccgacgucgaaccaggcggaggcugggagggggccgcccuccccgcgaggcuccagacuccggcauuuccucccggcugcccggcgcggccuuccccuccgaaagaagaaaaucccgggacccgaguaacccggccgaucgccccugugcacagcuguggcggagccaggagggccgcccaggguaggguaggaguccggggcagaagccagcccagggcagcgcggcugggacugagcgggacagggacagggcgcggucaggggccggagcgagcugcgcgggcggcgccuggaaggggaacuugagcuaagaguggaggcagagcagcggggcugcuggccccggcgcugcgagcggggagccuccuucaaggccaaggacacgggggccucggggccuccgggacgcugcgcgcaugcugggcaggggacaccacccgggcucgcgcccugggccgcccggucucccggcauguccgugcgguacacgcucaaccugcgggucuucuggcccuuggugaccgggcugugcacggcgcuggugugccucuaccaugcccuacgcagcagcgaggaugcccgggccgagucccccgacggcgcagacagcgguuucccguugcucaagguggccauccuucuucuccucggcuacauccuccuacgaugucgccacgccauccgccagcgccuguugccaggcucuucccgcccgcguggucaugccaacuucucagccagauccuugcaagagccaggccugagcaucuuacuggagaguuacuaugagcacgaagugcgccugucgccgcaugugcuaggucacagcaaggcacaugugagccggauugugggggaacuagugcaagcuggccgggcccgagggucuccaggccucaucaccgggggagcacuggcuuuggccuuccggggagacuucauccaggugggcagcgccuaugaacagcauaaaauccgccgacccgacagcuucgacguguuggugccacugcgacucccgccgcagguggcgcuggagccgcggagccuggggaccgaacccucgcugaccccagccuuccgcagcugcuucgugugcgcccucaaggcaccacccucgccaucgggggccucgacgggccaguggcaucgcgacugcaaacccuucgcugaaggcuucuguguggaugugcagggccgucgccaccucucagcuacccugguacugcgcugguuccaggcgcaccuacagcgcuccuuggccacugugcgcuacagcuuggagggucgcugucgggucagccugaccccaggcagucuggagcagccccccacccuccacauccuuccuugccgcacggacuauggcugcugccgccuuuccauggccgugcgccucaucccugcuguccaccugggugauggcgucuuccuuguggcaccaccaccaccacccucgccuagcggggcccugucagagcucccggguggccugcgcgccgaggcucuguggggugugaacacagcacgucaggagcagaaacugcugggcuggcuucaggaacgggcgccuccaggugccugcuaucucaagugccugcagcugcuuaaggcucuucgagacuugggugcccgcgggcuggacccgauggcugcuacacacuggggacguauccuguccucuuacgugcucaaaacggcggugcuggaggugcuucugaacgagggcagcccaacgcccagcugggacgaggcacaccugagugagugcuuggagaaguuggugaaguuccuuagggacugccugcugagacgccgagaucucuuccauuguguccuagguccgacuggggcggcugccgagguuggcccccugcccaaggugcugcgggaggccgcuccuguugaccuccuggcgccuuucgacccgcacucccgggagcuugcagcagcgcgguugcuguccacguggcgaagguugccccagcuucuccgagucuacggugguccccgcuaccuugccagguguccagcaccccggagucaacgcauccagggcuccccugaagaugaaccaugaacccugauuacacuccaccugaccaaaugccccuuucccaugagaugagagagcggauggcagcuaaauucaagaagagcuguucaaggugugggaaaauuugaaggaugucacaggauuugauggcacaaauguucuguccuaggcucuauggccuaagauaucaguggcaucuucugcagaccuauuagaguaucuuggguggucucauacacagaugucucugaccccgaauuauuagaagcaaucaccuuugauauacuuauuugguaaauacuagguucccaauugaucccuaguuuuggagggguguuguauguauguuucaaugcuggggcuagaauccuagaucccuaugcuaggugggcccucuaccacaaagcuacauccugggcucccaguuuuuuguuuguuaguuuuuguuuuguuuuuaaagaauaauuauccacaacuggaauugaaauucuaguccagcuguuagcauuccagaguccugauuuagcuauuuccaugagcaugcauguauuuuuuaguggugcaaucacagguuuguugaauaagauuaauggaguuguuauaaauuaagugaccaaugcuaagagguggccaagagcuggucagagacuuucagagcaaguggcacuuuaugucuagucauuuucuuguucuguguuuguuggaaccaagggcuauucaaaagagcuuccacacaguuaucugaaagaccagggcucugaaaagcagccagccagccaccaucagcacuccuccaggucauagguggggauuugcacuugacacucaauaccuguucauuugagccaggcagaaugcagagggaaagauccuugauuaagacaggucuggcaaaaguguagaacauaagucuuuuagaagcuccugccuagggcucaucguaggcuggauacaacccacuuaggucucagagccucugagcaaaggccccguaggcuugucucagagcauaaggaccucugaggagaaaaugcuuggugugcugccugggaaugggguaggguccagugaugucugauaucgggguaguggcugggagguucuugauugccuaagcagccuuacaucguauugaaggccagucaauucuugcuucugcuuaugacuuguaaaauaguagcaugaggugugugcuuggagaccugucagucuccagcagugggcagaagagauaggcgacaggagcagagggagaaaagagggagcuggcuuacagucuuugcccuucucaguucugaacuucccuggccugggcgccccuugcuguugggaggaucccauccucgagugccuccuauccuccugccuuccagacaacuuccaauagcaguucaaguuuagaaagcuucgucuuccucucuccucgugggaaguguggccagucucaguaauacacuuagggauuuuuuuuuuuuaacaacaaagaucugagcucccuuagacuccuuaaagugaaaguuggaagauaaaaauagucacaugaauggggucauuguuucauuucuuagcuauguggagggaacucugcaaacucucuuuggggcacccgguuggcaaucgaggggaauagaguguagggacuucucauuuguccuuugcaacucugacugaaagagaguuguuuuggaggccaucccucuugauaccccagagaucauucuucguuuuuuugaggccaauauuugguuauaagguacggcauuggaugaaaggguuguucugucagccucuugcaaagauugaaacugcacagucgguuugauuuuaauuacuuuaaaaagccaaugccaagggaagauugugcaugugugugugugugcauguguauguguguguaugucuguguguuuguguguuucucuguguguaucuguaucuguguguguguaugugucuguguguauaaugcacacaugauuucuacauucagccuguugcugccucuguagucauuaaguuagaacaggggagaggcaaauuuccagcuauuucuagcuuagcuagaaauuucuagcuaaggaaucccuuuuuuaaaaagucuugauaauauuuuaaaguauaaaucugguuaggaucauaaauaugaauagcuuauauaaacguaucuuucuuguaggguuuuuucuuuuuuuguauuaauuacccaaagcuucauccauccucaaacuuuuaaaguuuauuauuauuauuaaauuaaugggcauuguguuuguaaauuuuuuaaaaaauauuaauguuuuauuuaaaugccaugcugaacaguuguucuugccauguggcaacaaaaacaagagauuucgaucaauuuugaucaauauuuagugaucugaaacauguacuauguacagaugcaauaauacggcuuugaacugaguccaguggcugcccaaggccuuucaauucagcucaguucugcauuucauauggcuacugucauggccucuaucugacaugcacacaccuuugguguauauuuggugcuggagagucauauaugccaauauucucagauacgauggcucuaccaaaaaauaaaaagaguuguuuagccagugcccaaagaaaaucguuuuuuugaggaagaugacucagcucuuuugcguccagacaccucaguaauucccacugcccagcucggagccuuccuggaaugcucaugggcugggagaauaugcguuuugcaaaugaaggagaggacagugugaauggaugcaaauauucucugaggauuuguggggaggaggucuuaagguguaugugaaaggaagaguugggagggagaagggugaagacaccucaagggugggagagaguuuugggugaggaaauguguuuuuaaguaugugcuaguucaggucaggaguuacaaacuuagcagccuaaaggcagggagauaaauaagaggguggaggguguggggacugugccuaccuuaaaggaggcagcucaccucagcuccagacuggaaaauaaagggcugggccaacaaucggcauuucaaauuaaaauacuaacgcucacugguuuuuaauuuaagaaguaauuuaaaaagucugaaaccaccaagugagccagauaucugguugaaccugaggccagcaguuugcgaccccuugccuuacacaguuagccuucucccagguauguauaggcuuauauucuuugccauagagacagugguuaaauauauauaaguguggggggggguguuaguucauuucuacuuuaucucucagaguuaagcuuuguuauaggaauaacagcagaaaaaaacaaacaaacaaacaaaaaaaacaaaauacagccacagauaacauuuaucccaguuccugguaggcugguaggguuuccaugcaagccuggcucuccaauuaaaaucccagcuaaaacauuuggggcaaaaaaaaaaccccaaacaaaccccaaaaaacaguuggggcaacuuuuggagggguggagggcuggggugggaggcuggugauuugagaucaacuuucuuagccuggcuggagcuugccgaugaguaaugaggaagaauugcagaauaauuucuuucuucguguuugguucuuaugugaaaauuaauuuuguuguuguuguuguugaccaugguaaccuagccugggccuucacaauauugguuggaaacauuaaacaccagcaaaaccaaaacaauaucaacagccaguguuccaacuuugggccaaauugcauggcuuuguacuauucccaccuccaagaacacuggcugucuuucuauuccuuucugacucagugucucccaccaaaaggagcaccagcugagccuccuccuaaagcaccucuugucaccucccagaggaagucacguuuuccacagaacugugcuuccuggcuuugaccuugacaaagagguuccccccccccccaugucuacacaaggaaaauuuucuccugugguggaaaaaaaaugaaccucucccaaauuucugacacccuccagagggaaacuggcucaguguuaccccugugguauguguuagguuuuuuuuuucuuucuuuaauugcuuaucugcaacuuagacauaucuauuuauuuuuuauggcacacgguggggugggagaggguaguaaauuccagaucauguacacagaaaaaauagacugaaauaugcagcuagcugauaugaaaucugguccuggaaguguuauauaugcagggauauuuuagcaccuuuuagggaaaaaaaaaaaaagaugucuugccucagucacuugacuugaagcacuccagcucuggcuguuuuaaacgucccuuaugaccccaaacugcauauggggauacaguuuggggucaugguuacagccuaaguuuguuccaauaaaagagaccaaagaguuaaucagaccugguuggcugcuauagcaacugugugauuaaggaugucuucaucacacaauuuccauggccccaguggucaaggccugucugucacucaucuucauucgaaguggagugucuuugcacuuucgaaccugugggucacuuggggaccuuguucuuuccaauuuugcuauaucaauaaaggaacuuguggaaac

SEQ ID NO: 4061 - RNA, 735 nt, Mus musculus
uggugaugcaggccuuuaaucccaucauucggaggcagacguaaauggauuucuauuaacaaaauaaaaagaaaaaauaaaaucaaggccgaugacggagcuuggguuuugccgggccauugcccgauacaacugcggaggaucggaauccggaggaaguugccccucacaaucauggcggaugacggagcccgggaucuucagagcggaagcugcccuucacaaucauggcgucuggggcggggccgagcuucccuggaugugagaaaaggggcuggacgcggaaaacaggcgaucaugugacugggaagauggcugucuuucccugguaaggaaaaacccgcuaguaggcuucggggagggcuccucucagugggggugggcaguccuccuuguugggaucgguggccuccguccccgcccgggcugucaggacuacggaagagcagaaccgcugucaguacucugcuccucuccucuguuccgcagcuccuucacucagacggacuccauccaaggcuuccgccuccuugggagacguuggcacgccugggaguucuggggaaggggaugaauucgcccggagucugcaccugggagaccuggucgcuuguuccuugagcuccuuagacuuucucaucuguaaagugggaccauucacccuacucuauguaggguccccagacacgcuucuuuaccucguuguucaacguaguagaacguauuagagagagg

SEQ ID NO: 4062 - RNA, 2018 nt, Mus musculus
uaauauugggagccuuuaagccaaaaaaugucuuuuaaaauguacagauggagccagugagguggcucgguggguaaagccauuugccucaaagccagugaacuaaguucugcucccaggaacccacaggguggaaggagggaaccaacuccucaaaguuguucuccagacuucauacauuccugugcaugcacauaugugcacacacauaacacacacaguuaaauaaauaauuuaaaauguuacuacauguagagauguaccucuuuugucggcuauacaggaaaucacaucaugaugcuauaugcauuuaggauucuagagccuauuaacagugacacuuguccuucaaagcuggaaauacucugcauuuuucucagugaccccuccccuccccuccucugguucaaccugggcuauacagguuaugacugagagggugcuggguaaguaaggucuuuguagugucuaucuuguuuagagcccauuucaagccaccagcuugaugcccauacaggcaggaagacaaacaaugaucacacagcaggacugcacuggauccccuugagacauacaaggugaccuugcccggcaucaaguggaacuucagaccugugagauggcucgcaaauguggucaagggggugucccguggagaaggcuguuacaaacucaaguccaaugaugguuuuaauugucaacaacauaaucuacauacuuggaaaggaauuucaaugagggauugucuaaguuaggcuggacuucaggcauuccuuugaggguuaauuggguuaacuaaagugugaagauacacccugaaaauggacaauguuauuuuaugccuggaccuggacuggaugaagcgaaugagcuggcucuggcuugaacgcaugcacugcucucugcuccugaaaugugacugauucucucaggugccugcugcuguaacuucucuacagugguaacccggaacgacgagcuaaauaaauccaauauugcuuuugucuggguauuuuaucauaguaacaguaaacaaaacuaagaggaggcccaauccaguuauacagagaggaucccagggccagcauuuuaacaagcucccaaguaacucugauggaugccaguuagagguuuuggccugcagacaacagguucuacacccagaguccauauaagaacgacaaggucacuuuccaagaaucugggccucaccccagaaauugugauuaucaauggcauucguaggaguuccuguaugccacuaauauucagaguugaaaauagacuauaguuagaaucacuuuaaagaaacuugacuacaagacccucagagccuacagccugaugcaucaugguggcuccugugagccuccaauuaaacugaucuacaacugucagguaagcacagggugcuguuaguggaugaaggcaagauuugguuuuggggaaggauucccagcccuuggcuuuccuuaaaucuuccucugcuauaccugaagaauccaccuguguaccugugugccucugucgccgguucuaacaaguccugcccaucucucacugccucuuuacugcuagucucugcccuugcucuagaaaaggccagaacuuuuuuucccaagcaucacagggacacccagagaccugaggggacaggacugaccuagagauuucuucaaaacagacagccaagggacugucuagaguuggggcugaaaguaaacacagagguguggccuuacggugaaaucuucuggggagcuuggaccauccccauuccuggccccaccuacagaguugucaaucucuuuuaggugagcaagcauauugggaaaauguuagcaaaggaaauggaggcucaagacaaauacaggcgacaccauaucuguuguguugugcagaaggcucuauaggcaugaaccacucaaugagaauuaaauucucacagcaugguguugcugugaagcccaagacuguguuauuuacugaaagacaaaaauaaaacuguuucuaguugu

SEQ ID NO: 4063 - RNA, 23745 nt, Mus musculus
cagcgcgggccgggccagggggcgccucgcgcggccgcagcucggaagggcgaugcagugaggcgggcucggcuggcgggcgugcgcggagcgggggccgcgggcgcgcugcagagaugugacuugggcccagggccagcaggagcgucggcgcugcggggacgcgagggucggugaguaccagccagcgcgggcacggggagggcgccguagggaccccagaaacuuuucccgccgugauuuuggaaagauccggagcggauccuggcucgugcuuuuucuguucucccuucucccccuccuccuccuccuugggguacaucugcagaagccgugggguucgagugaggggugccacagugcggcgggagaggagccgcauuggaccgaccgagggcagugguuuggggaccuuuaucuggugggggaauccacgaacuaaggcucugacuaugguccggggugaggacagacuacaagcgucugggaauaaaggggaaucuggcccugugcuagugaccccugugagggacgucgccugcagguuccagggggccuggcgguugguggggugcgaggacagccagggugcugguccugaacuaagcacuacauggccugaggcaggggccggccuuuggagaccugaaaucucaccugccgcagggucuggggaacccagcuugcagcccgcaguggccacgcacucuuggaaaaaggcgcgagagggugggcaccacagggagggaaucugaagcugggggacaaauagugggcuggcaaucuaggggcggcugcuuauggugaagcggaagaauuucuaucccaggcgagggcacuugggccucugaggaaagcagccaggcuagggguaaggacuacccagugcaacguccccucuuccuaggggacuggggcucgaagccccaaaggaccccacacauuucauggaccuggugggagagaugagcacagaugaggauccagcaccccuccuuggccggcgguagcugauuaaacaguuuuggaucggcccaccgaccuugcuccagaggacgcccccagaucagaguguucaucccccuguucuagcucggccuagccaguuacccccuucuucuucuguucgccaagggggcggcucuuuggaagagggacaaaggccccgggaguguggcgggcaccaucgucccugccuggggcccccaagcacacgcgccgcaucggccgccggacugcgccggggugggggcaccugagcagcguccagaaagcuccggggguccccacaaagacaagaggaugcagaagaggcuaagcacaccccguagacaaagcacuugagaacguuauuuccuaaguuucuuuggugggcacucagagcuuugggaauaaccgcacuuggaguuaaacugcaugcaaauuacauguaaauagaaugcaaauuggcaucuguugguuggaaacccuccucugggcuaguuuucuaucugggcugugaacacuguuucccugauccucucgcuucuaagucuaaaaagggucagcugggucgcaagaggggaagaugggaugggaaggaguuaaaguuuggggcccaggcagccaagaagagggcuuucuuuauaaagauagacucuaauguuuacuggguuguugguugguugguuuuuaacacauguggugaacacauauccgagugcuaaaggaaauaucuuguguaaaaugaaaagguccagacuggagggggggccauggaagugcgcagagaaguagaggaagaaacucucuaagugagcaaauaccuacuacaccugcugggacagggcugccuggaaaauaaagugaccaggacuuguggggaauggcauuuaagaguggacccagcaagagggguccuccacugagagagcgacuugagggggguggggggggggagggcauccaggcuggagaagguuggagaugggaauagacuuggugaaagggacacaaaggucauuguagccagagugugugggcggauuuagagcuagagaggaggcaggaggcucuggacagaucuggucuuuggagucacggaaagauauuuagaauuuauuccgucgggaccccugaacucuuggaagguucuggagcucaccagggugugauuguaaaagcuucguugaccucuacaaggagacagagacagcagcucccuucucucugcuugcagggaugcuguggcgcagggaaucugggcuauggagucagucuugggcacugcuuuaagccucagagugccaggcgagcuaguugaaggaguggcuuggauuuuuaaagauccgccucccgcuucuagacauuucuuaucuaccccaaggagccccuacccgggguccaagaccucuguuuuagcauugagcuugcuggggauucccaguuagucacgcucuugccucagaacugcaccaagagaaggauccuagacugagacucaggcagccuaggcugcaauuugcauuuaaaugauugcuuuuauuuacaggccccacagcugcuuugcauauucauggaucguacagcugauguucuugcuguacuaaguuacuaaccugaaagggucuguaaaguugagagccccaaagaggcucuagucagccaaggcaaggaagacgaugacacuguaacuuggaaaagauaucagagggaggcagaaacauuuugagucugggaaagaauuuaaugucaggaaaccuuguaacgguuuaaaccagccaagcaggaaacacacccggguuccaggggaguaagacuggacagaguguaacgcugggggguucaagaagccccaacuuggacuucugccagacauggggccaggacuggggugcaguggaaaggcccuggggucagaagcuggggaaaauguauaccuaaccuggucugugaagccuuugaccaggcggcuugcccucauugccuucaugguuccaacaggacaaugggacuccugagugucuuuuuagccagcuagcaccccugcuuccuacgugcaaagggcuuuccacauggaccucaugcuaguggcacagccaucuccaucuuacagaggaagggcugagguucagagagcuuuaggaacaccaaggucacacaguucuauuggacugcccuccuguuggcgucugaggagaguguaaacuguggcaggcauucagauggauccugaaccaugaaguauacuggggcugagaaaacuggcccugccccccccaaccccaccugcucguuuugucuccccccaccccuucccaucuauacucugguucagauucugccuggcuggccuagcaggaagaaugggguuuuuggaacccugcugguagccaaggguugagccuggucagaaggguuucagggcaauuugggacauuuuguuuuuccaucccuaugguaggaccagagggaggggauccuaccucccaggagaaggcccgguguguggucuccagcagcuuuggcugagacuaccuacuagccauggcugguuucagagucacuggccuggguucaaucuugagagugagguucacacacuuccuguucccaucagacagcucgacucccuucccaaugcccuaaggaccuguugucugugguauaugaugggagagaggcuggaagccaguaauagauaaacagaugggagaaccccucgccauuccauuuccauggcaacagccccuccuaggaaaucuauggcaggagaacuuaccccugcagacaguggaacauuuaccaaucuuuuacauuucuuuacauuaacuagucucuacaccgugugugugugugugugugugugugugugugugugugugcacucauguuuguuuauggcuaugaguacaaaugggauguaugcacauauaaagggccagaaguugacaaaggguguuguggguuuuuuguuacuuuauugaggcagggucacuuacuaaacccugaacaugacaauucaucuagucuagcuaggcagcuugccccagguaacccaucuccaccuccuggcacugggaugacagguggugagugcugagggucuaaacucugcucuucacacuugccuggcaaaugcuuuauccacuagaccgcuccacagccugggcucaaacuugagauccuccuaccuuagcuucucaaacacuaggauuacaagugaaugccaccaucucacucccaauagauuaccuccauccucaccacaaucccgugaugugggugcuguucuuacccucgcuuugccacugaagaaacugaagcuagaaaggauagcucagcagcucagaguuggagugcgcuagcacgugcucugggcugggauuagaacccagcaccugcuggccagugugcacgcuggaccacuccccagccccaggguaggaucugaaacugggggaucugacucagaagugcuuggggagacucaggcuaggagaagcaguguuuauccagcucacacaaauaagguccuccauggucucuguggagccaggacucagagcgcugggagaaacuguuucugcuccucuguagacagugugugugugugugugugugugugugugauguacgguaugguguguggagaguggguguauguguuucgcaguauauuuaagaacauccgagugagucacacauuucugagcgccuggcuggcagcagagguaauuaguaugugagccuuccuugugcauucauucccauuuagucucugcuugaggagccgcugcucucaccccaugguuuguuaccauguauucauccaucccaggcagcccugccuccaggcugccuuggaaccucuacucugguuuuguuucacacagugcucuuggaggugggaggcagcagguggcugacugaaaggaggggguuaccugacaaggggcguuuuggauggaaaggguagggccugcuuggggcuucugcucuucaugucgucguucagacagacagaaagaaggacagacggacagacggacagacaucugggucugagugugaccugcaggccugggguaaucgaacccugauuuaagccucucagagccucccuuccucuuuuacagaagggauugaugcacacccacaugcaccuuuagaggccacacgagaguuagagccuguaggucaguuucuuucuuucagcagccgagggccaaagcaaaauagacgagggccugggccaguggagaggaacacaccaaaaggugaauaaggggaaauugagcuggagggaaaaugcaagcaagaggaccugaguucgggaucccuguagccauccacaucucaaaccccagugcugggggucagagacacacagaggcuuacuggacagucuaguagaauagacucugagauccagguucagugagaggccccaucucaaauacuguggucggucauaaagaagucauccaaaggcaaccucuggccagaggugucuucuugggugaggacaacaguguacacacacacacacacacacacacacacgugagccauacaacagagucagggaucaaaaguacaggcauaauguguagugggggcugagagggccucuugcagaucaauccuccagcaaaggucaccagugacucuccaaccaguucuggucuagagaaagcccagcaacaauaagacacuuguuugccuugggcuccacucuccuggcagcgugugaccuuggucaagcggcugcucuccgaguucugcauaguguuaucucuaugaaaugaggcagccucagcacuugccucuagguuguucuguggauucucucuguuuaauugguuuuugaguuaagguuucucagugcugguagcucaggcuggacuagaaguuaccauguagcccaggcuggcuaugauccucuuucucuaaccuccuaaauauuaggauuacaggccuguaccaccauaucuuguccccuuaggcagaugcuuggauguuacuguauguguccgggagccggggaagcaguuacuguaguugucagaaguaggaccuccuagaaacccuaggugagcaagugguuuuggcgucaguguaacccuccccaccccaaacacaguucuguggacuuggguggucacaccccacaaucauccuuagagacaaauagugaccaccuugagacaacugagcucucucuccuguggugucugaccaugccugguuucaccuguaugccuagauauggggcaaaaagaggccauugcucuagguuuuugagaacugguuggcaagugucagaaacccagaucaaacugguuucauucaaaugauguaguucauuggaugcuggugaauccagcugccuuucaauggauuagaacucagauccauccucgagcuguugccucccagucaaccucacucucaaacaggucaaauccuccggcuaauucacuggucuauuucaggccaugugccuauuugugaaccaaucgcuucaaucaaagagugggacaaaguccagauuggccaagccugacccggaugcagcauuagcuauaauucucuuacgucuccuauucuguaagaauagacccugacaaaagaacuuaagaggagaaaaggguuuaucucaggucacaguuagaggguauaacugaucaggacagaggagucaaggcuguagggucuugaggcagucggucacauugaauccacagucaggaggcagggaaagaggaacgguaguguucagcagcccagucaacaguguguccugcuuucagugugggugcacucagcucaguuaaccuaguccagauaaucaauuccucauggucauauccaggacuugucuccuagaugaguuagaguuuaucaaguugauaucacccaucacagcuacauuuccucacacaggaaauaacugaucaaaacaagaugaaagggacauuuugguucaugguuuuugagauuucauuguggcgggauggcauggcgguggcacuguauggcaucaguucuucacauggccauagaccaggacucugcagcuagaucuaaaaggugaccuacuuccacccaucaagcccugccuuguaaaggccgcuuggccauuacaacagcuccaccagcuaagaacuuccccacuuaacucagaccagcugggagcgagggcuugagauaacucuccaaaggcaagucucgagcuaguuccagaaaucaaagaaucagauguugcgucaaaacccauagcugcccuggaaggagaaaagggcucuaccuguggccguggaaacggagagcaugagagggcccauuuccugugucugaaaggaaaugaaaacucugcgugcaaggacacugcacgguuucagacgcgcggguguccuggugcugcucauuucaggcuggagcagucagaagcagcaggaagcaagugagaggagcugagggaacggagucacacuuuacagccgagacccuggagcuugggaagcaagugagaggagcuucacccgaaaggguggcuggacucagcuaaaagaaagcaaguucuugcaagagaggauggcaagguccacgcacaaccgagaccuggugggcuuccuggugucucucaccgguucugauuuugaugucuaagaccagccuuccucagccuccgucccauggucuuacugggcugugucacucuguuggguggugacugcuauucucauuguaggccuagucuuuauucaacagauguucauuguccccucuccagucgcgacauccagaauugccucugacugagauccaccagucaaagggugcacagaugagagauccauauucuggaagcaucuucccaaacaucauuuccucaccgcuggggaagauggaauuggguauaaacuagacuggggugugugacugagaacaguuuaccacugacgacuccucaaagggagacucaccaggagccccuccgccuugcuguggaccaaugccagcuuguucugucccgucuaauucuuaaauuuuguuuccuagcaugcuuuccagcccugacaagugguucuguucggaaugauuucucuccaaagggcaccgugcagccagauuccuuggcauguacgcagaacuuauggguguuagaucuuuucuaacuuaggcugucaggcuuggcagcggguacuuuuaccccaauagccggccuccaguaccguuuagaaauauugagagaaguauuuuacuggaaugggguuuaaaugaccaauguacaggacacaguuaaguaaaugauuguacccggugucccugauggagacccauggcacuauuaugacuagaccauaagucaauggugaauaucuagggugcauccccacuccuauauuuuuuagccugaguggggggaucuuguuuaaggagucccucuucccaaguaccuucuguuuguagcaugccuuuucucugugagcacagcagaccacaccacaccaccagccaucuucuacacaucaauaauuuaugcagucgauggccuggaggucgaggcaggauccgagaugcacaagggaucucuguaagggagaggaggagagagagguggucgauacugcauuuacuuaacagaagccccagggauggcuggugcugggcuguggggaggguagcugguuacugaccucacauagguggaguuaagaccccaaacuagacuaauaaugagcaugggcacagaugugcaggcuguggcuucuugaagguccagucccuuucaaaagcaaggaccugguguuggugggauaaagggcuggaaggaugcaagagucucugguggagauuuccuaagugccugccuugggccaggugcuguguauuaauaugggucuuuaccaguaauccuuuguggggggauuuugugccccucacccagggaauauuuggcaguauacagaagcaggguuguugagaugcaucccacuaugcauaggacaccccaacaccaccaccacccccaaaaaaagauaguuucagcugccagaugugacaagauugggaaagcugggugggcugaugaguaaaagauacugucucugccugggguaguagacaaagacaagaagggaggagaggagaaagggaaggagaaaagaaacaaaguagacaaaaaauggcacacuugauuagagcucagcccacgagaccccgcccacaggccugugagagcucggcugaccuuggcagagucugagcugaugguucuggugcugggcugaggggugagcaucuuugcagggcuagcgagacaugaugauacuagccuauaagaacagggguguguucuagcaggggaggaggagacugggucagagcucucacugagccucuaaagcacaugagaguguguggcaacuuaaacucucaggccucccagggaaaggacagcagguggguuggagagaauggagccuuaagagaucuuuggaagagaaagauggcaugucugugagagacagagaugaaaauucuuucuggauguacagguagauccacaggaaaugcuccagagucccuuggauaccaacagccuugaugccaggauccagcugaugcuccagacccucccuucuucugugaaaggccuuucuuucugugaaagucuauccacacauaaccuauacccaugcccuauggucuucagaucacuuauaauacccaauacaaugucaacccuuguuaugcaaauuuuagguaacaaccacaaaaaugucuguguagauucagaacagacagaaucuuuuccuugaauagucuucauccauccuugguugaauccauggguguagcaaacuuaguuugggaccacugaguauaccauaaguuaaugcuggaagguuucucccucugcugagagggguggcuucugagugugguuuuaugaccuggggccagugucacacccugaagaaccucuuuugccagaugaaaaugaaggucacaauaggaccugcugcccucauagggcauuaugaggacuggcugagcccaguuuuuggccuagagagaguggucaguaaauauuucccauuagccuuuggagauuagaggagagagagagagagagagagagagagagagagagagagagagagagagagagaggcagcagggagacagagagagagagagacagagagagagagagagagauugccccagcuaaguaccugucuggugguugucucuuuaaaauuuccuucauucccuuacuuuggaagaugccagauuuacauacuacaaagcaguagagagagaaggugagucucuccaccauagguccuccagccacugcugauggugguucacgguuucuaaucugggcuaggguucaagugggugguagagugccagagugaggguccacaaggucaggagaaagucgauacuguuaccucaagugccaaaggagccaugagggcuggcagguuugaaaacaggcaaguccuugggagaguggggccuuacaacgaacugagcuuucucucugauuguucccauuuucuagaauguuccugguguuagagagaaagaugagaacccaucaaguguuucccuugccccugcuccuggugauugccuccguggcuucagagaacgccagcacgucccggggcuguggacuggaccuucuuccucaguacgugucccugugcgaccuggacgccaucuggggcaucgugguggaggcaguggccggggcgggggcccugaucacacugcuucugaugcucauucuccuagugagacuacccuucaucaaggacaaggaaaggaagcggccugugugccuccauuuccucuuccugcuggggacccugggccucuuuggccugacguuugccuucaucauccagauggacgagacaaucugcuccauccgacgcuuccucugggguguccucuucgcgcucugcuuuuccugccugcugagccaggcguggcgggugcggaggcuggugcgccagggcacaagcccggccagcuggcagcuggugagccuggcacugugccugaugcuggugcaggucaucauugccacugaguggcuggugcugacugugcugcgugacacgaagccagccugcgccuacgagcccauggauuuugugauggcgcucaucuacgacauggugcugcuggccaucacccuggcccagucccucuucacgcuguguggcaaguucaaacgguggaaggugaacggagccuucauccucgucacuaccuuccucucugcgcucaucuggguggucuggaugaccauguaccucuucggcaacucauuaauuaagcagggagaugccuggagcgaccccaccuuggccauuacacuggcagccagcggaugggucuuugucaucuuccaugccauuccggagauccacuacacccuucucccaccccugcaggagaacccacccaacuacuucgacacuucacagcccaggaugcgggagacagcauuugaugaggaaaugcaccugccucgggccuacauggagaacaaggccuucucaauggaugaacauaacgcagguaaagcaaccacugucuggccugaggcugucccugaaaagccucuccagcaggggcagaugcucccaggcccagcaaucacgaauggcuccccugcuaacgcuggcucagagauaauuuuauggauccuuuuccucaugcuaauuggcaacugauuuguuauaaacuuccaaagaguggagauggggagauggcucaguuggcaaaaaacgcugucagagguaaaaugcaagcgaggggauuggguucacucucuagggcccagagaaaagccaggugugguggcacaugcguauaaucccagccuugaagcagaggaggcagacccaagggcuugcuggccagccagucuagccccagacccaaggaucucaaaaaaaaaaaaaagacaaacaaaaacaaaaaaaaaccaaacaaacaaacaaacaaaaaaaaacaaaaaacaagggauggcuucuaagaaacaauaucuaaaguagaccucuugccuacacacacacacacacacacacacacacacacacacacacacacacacacaguguaucuauugggucuaacaaugcugagccagccugccuauguggcugcaguuuucuggaucucacuugaaggccaggccucuugcuucccucaagcuguggcuaggaacacaccuucugcuuuacacacuaccacgcccugcugaucccccaaccuuaggucccuagcucccaguaggcacugaguuugcagccugccugcccugugugucgaugcaugcaggccaucaugacaaaugaugcuccugcccuccuccaccucagucaucguuccaacugggucccaagguccaaguuuaaacccugccucucccucccacuucauacuuccuggcuuuggaguagauuacacaaucucucuaaaccuguuuuuuuuucucauuuguaaaccaaaaauaacaggagugcauacuauauagaaagugacacaguggagaccagauccugguggcacugagcaugaggcuugugggucucggcuggggucucuuaaaaguaggaggagagacaccaagggauagggguuuacuugaauaguggucccuacaaggagagcacagaggcagguugucaaaaauaguuguauuuauaagcuaaucucugccacaccaggcccaguccugcggagacccucugaggauguguguagaauagaacuccaaauagcucaccaugacugaggcuucgcucccaccuacucuuaaccucccucuuccaucaccaacuucucuauaacuugguuaaauggucacaaauucuugguagcaguugggguaacaucuggguagccaauacuaccugucugugcucaggggugaggucacaguagguggaggggauauugucaccaggaccuccaaggcccuacugcugaugcuggacaagugccccuuaggacacugcuuaaaggaagcuggcugggucccacaccugagcuuaaguaaaugaccuuucucaauuccccaaaaacacuucagggaccugucaagaauacugaaccccaguccugaaugagcacugaccacugggcauggucacauguugaacacugugugccagcgcuagucugccuucagccugcacuaguuuaucagucccgauguuacccugugagauuggcccauuauuacccccccccaugauggaucgguauaagcuaaggcucaaaagaaugccuuuuccugaggacauacagcuggaacguggccugugguagacggaaaguuagugucauuucucuuuagcagcauccauccauccaguugccaggcacaagugugagcuguaugcaggugcuggacccuuuaaacagguuugcaggguugaucguggaagcccaggguagagccugccccucccccauagacagggaagcagguugagccacccauagcccugccauaccucgauguagucagcuuccucagcacccugaaccccuagccaggaggggugccagaagccagccucuggacagaggggaaagucccaguguggcugcaauccaaguuacucucuucuuacauaaaguuccaggccagaugccugugucuguggagauguugguaaggacucagugccaacccugcuggggacgggagaaggcacagucaaguuagaggucaccauugggagccuagaggccuccucgggagcuguggugacagaggaggggccuggcuggcccuggcaaccugguagagccaccucuccuugccagcuccuccuggaggggccucucugaggcccuggacuccccaugaaccuuagagguagaggaaacaaaagugguuguguacugauguacauuugugucuccugggggauugguccaucacuccgucugauucuaacaguaucugucacacacacacacacacacacauacacacacacacacacacaaagaguguuaagaaccagugauuaaauagaauaaucugauguccuugcaguaaaacuggaaggucagaaacacucaagcagugguguuuuaaaaguaaugguaucgggcgugugaaagcaccugccuguagucccaggacucacugagagaguagaggcaggagggguguggguucaaagcuagccugggacacacagcaaggcauagaacucccaauagcagcuacaaauaacaacagcaacagcaacaaaguugggagcauuuauugguuacugucuccuaagucauacaauagcccugagaucuguuuggaaacagauggaaauagaugccaagugcuacccugucuccaaaacaaaaaugaaacagagcuaaggcagagugguccuucuucacccgucucuccauuagagucacuugggcuaccacuuaagaaaaacacuaguaucuucccugcugccacccagggccccugauuaagucugagucuggggucuguauaauuuauaaguucuccaagugauccuaagguguuaauggguggaaaccuuggguccaggcacuggcccaccaugagcuuaaaucagugauggaggccucucccgggucaggggaugaggagcugugguauccuggggaugcuguggaauuuuccaucaggcaccagcauuuaguuuucugguccuccccugccugcucagcuugccucaggcuucccaugauaaacugugccgcagugagagcucuuauccauucaucuuucugcucugugguccacuagcuccuugcaaaagauguccuagauaugaguuaaguaaucugcauuuuaaaucuugauauaucaugcaagguagcaccccagaaagguagguugagugccuacuguguaguggcauugcaagucccuaccuaaaucuucagcaaccuuggguauugucagacuuuuuuuuuuaaagacauuugcuugcuuguaguggugaggaugaaaccuggagccuagugcaugcugggucacugagccacaucccuaguaaccuuuaccaucaacacuuuuuuuuuuuggggggggggggagcagggagacaucuuuuagucuaucaaaaauauauauccgccaaaaucacuugagaccagcaggcaggggagcccucagacgaggcucacacagagagcauucuggcuaggcuggccuuuauucuagaaacucuugcuucaccggccaaagaccaucugggcacgcuccuuugccacaguaggagcagcuguuggcaccuuccaugcuccuuuagccaguuuguauuuuaggaaaccggccccgugagggaccuuauccuuagaguggcuagugcccacgagccaccaugaucauguccuuccugcacugggaacuuccggccagcuucuggaguucucucccccaugccagagguccccuaaagugucaugagagggagggcguguucuccaggcuguacugugacucuaugaagcugcaguggcaucaccccuaauauuucuuguaaucauugagaccccccccccacacacacauauauacaauuagccaggcugaguuccuuaguaucaaagggcaugagauaagugcuaagagauucagaugucacaccucagaucacaucuuacaaagugcuaacgaggcauaggaaacacgcaccuuucgaaggaacguguguucccucuuuuguuauggauccugggcucuaaggucucauuaaggcaaaggcuacucagccauuuuuguuuacugcuagagacccagagugaagccugggggaagaaggcauggcuaacuuggccucauuugcaggaccuaccccagagaaaguuggcaucugaccaaugaguggaugccuccagguacccacuuaggaauaacacucccugcccuccaccucugcuggggguuggauagagucagcucugauauuaggcaaaggccucugaaauugauuacuagcauuuuaaaaaaauagaauuugaaugcuuaauuauuuguuaaacgaaugaaaauucgaaacgcccuagugcuucaggaagggcuagauucaagagacucaagggaugaguaacuuugacuucucaucucuugguggaggcauuaugguccccauuugcacagaauaucagaaauuccauuuuuuuuuucuggggaaaaaaaaaaaaaaccuuuccagaaggcuugagaaaaucccauucugauugacucuaaauguuauccccuaaccaguauguucucaaagaugaaaugcucugauuggucagacugucacaagcuggauccuggguccaugcugagggucuagaaugccaaagcuacacucagagauccacaaauagccugcaagagggugugcuugcaucacagcagaagcugaugacccuagcagaagucugugucccugucccugcuucgugugcugcuucccagacagggccaugccaucacucagcauaagcaccugcucaagcccuggagauaccggagcagacagguuuccugcgucugucuugcaguucuuugguccagaccaugaugagccugucccuaaugccacuuaacacaucuugcuucgacauacccaacuguaaugacuaacagcagagcauauggaacugguguggugguuaggagcagccugucucugccaggcuuccaguguggacucugcuagcugugugaccuuggccuuaguacuuaaccuuuagcucucggaaaaaaagaaaaagcaucugugaugcuaugaaaacuaacccucuauaugcgauuuacucaagaccuagcucuaaggucauucugacucuucccucguagugggcugcacagugcccaagacgucucccuguauucccucagagacaucucccuguauucccucagagacgucucccuguauucccucagagaagacuuuuagcuaaaagccuuucuuuagcccagcaacauuagugcuuccuccagugaaacugcagguuaacugucaucugacagugaagaucgccauucgccugaugagaugcugaggguggagccuaaagccucagggaugcuaggcuaaagcucugccagggagccaaagaccagauuuuaauuugacugcaucauuuugguggguuuugacaaaagcagugugaccuguauccaccuugaaguaucacacagaacaguuucaucauccugaaaugcuccccuugccccaggcagcacccaaccaccacuaacagccuucaccuucuggauucuaguuuggcgugaugcgagaagcccucauaggcuggcuccugucacucagaaacacguacuugaauuuucuacguuguuucaaguugguuuuucuuuauuuaaaaagaaacuuaaucucuuaaaaguacagaaaccgaggccuggggagacagcucaguugguaaagugcuuguuguucaagcaugaggaccggcguuuuauccccagaaccagugugaugcucacuugugagucuggagcugggaggcagagacuggugggucccugagauucccuguccagccagccuaggcagugaggcaccgucuagaaccaagggaggggcugcagagcuguuaagaggauugauguucuucugaggaucugaguucguucccaguauccacaucgggcagcuuggcagcuccaacacccuuuuuuggcuucugcaucugcgcgugcgcacacacacucucagagagacagagacaauagacacacacagacagacaugcgggcggauaggugugcacacacacacaccaugacacagaguacacuaaauagcuccauguggaccccaacauuuggcaugcagcaacaggaggaccaggaaucuaacuagggccaguguggccgaccuuagauggugucuuuaaaaggacaguaacucagaacaccugugccuacguucagagguagaguguucacccauuuggccaucauugcuucggaccuucuauuacucuuuugggaauaacccaaacaagagaguaauuuuccaguguugacagucacuguccuguacaugcagucgccagcucugcagcauccagaaauagugguggcuuuugacugauaugguaaauacagaccuguacuguucuacagugagguaaagacucuuauccaaagaguccugacagcccagaggugacugucacccagccuggcuguagcuguuuggggagagcaggacuucagaaaguucccaacccuucugaagcuggaucagucuccuagagaacugagaacaaagccccuuugugacuuuuguuuugaaucaggcuugugacaaaggggaggagccacugugguggguggauagagguacccagaggggaggagcugguugcuucagaaaaacaaaauucucuuccuuccucucucccucccccuuaucccucuguuccccucccccauccucucccccacacucucacugguguugucaucccgggaacuccguccucagcucuccgaucagcagugggcuuuuccaauggaagcuuggagcaaagaucuagcagccugggaaagaagcccagcagcuugggaaaccggcccagugcaccguucagaagcaauguguaucagccgaccgagauggccgucgugcucaauggagggacuguaaguaucaaaaucugaugucugggcaggaggccugagcgcguccgucccguguggggcagcuucagcuggguacaccuggaggcugcuucucugggcugcucacugcagcuccaugcaugcacgccuuccauuuuuugucugucccccuugucauaaggaaaacucacccauacucagaaagccaucuauagaugccuaccuacugcucgaggcucuucaccugaugaauuuuccuccauaagcacagcucccccaacccugucccagaaaggugacucuaaggaaaagauuucugugagggugcucucagccuugcuaacauccaucaggaggcucaagcccccuggucccuacuccauccagaaccuacccccaccaccaccaccaagcuggguaccaggucccccuucccuaagggaaguugaaguugagucccucacacaccaaagcagcuguacuuaucugucgccaaacaggccugcagcagaaaguguuaccuuuggcuuuuugccuccguuggaaugacuuugcuucauuccagcaaaauccaaagaggcucucauuccuacauccaccuuccagacauagcucugugcuucucagaaacaaugcaugagccgguucacauguacacauuugauuuucauucuuuauuuugugccaauuccauaaaucaaucuggcuuuuuuuuuuuuuuuaauagaccaucagggauggucuuugaucccuggaggaaaggaagggaauuuugguuuuucugcccugugaaggaaggcccugcuaggcucugauucacuuugcuuugaucaagcuauaagacaaauagaaacaaacaagcuauaagacaaauagaaacacagauuuguguucuuaaaucuuccuaucaccuccugggcuguuucuuuguccuggggccaagaaaagccugacuugacuugugaccacugaucuccagaggggucagcccaugugccguaaucaacacagccuguccgucauuccuaaguccuccugguuccuucaaggccaguguagggaagaggacagaggccugaccaagugaugcucuagggacucagggugaagcucaguguuaggacacaugccuagccugcccaaggggucccccucucuucaaaguacugaguuucugagcgaguuggaugucccgucaggugggggacaugacccuccaguacauuucugggaggacacagccccccacaggcaggaauagggagauugacgcaucaguuccuaacgaugacuuugcagaguucucaguccuguccuuauguaauuccagaucccaacugcuccgccaucucacacgggaagacaccauuggugaaagaccuuaaguuccagagaauaagaauauuucuuaccgauuuuauucccuggcugugucuuucuugagggcgaaaucacuaaccauggcagagacaggccacccggaagccaggagaucugagaagucccaccaaggggauuucguguaaaugugacauauggaugaacuggaaagcuaacagugaccgcccuccccuccccugccacacaugcaaacacggaaucguccugcaaacuaaaucagagcuaacugccaauagucuuagacucacucagaagcguggcugggaaacugagucauucagcagggggcaggacagagaagaagucacagcugcuguaccagacuaucuuggcuuauuaugugagggguuggagccagccugucacccccacccuccucaccaaaugcugguccccagagccaucuuuuggagagaacugugcccuugagguuaacucauggaucauucucccuggcuuuugcuugccugguggcccaugcaguucaggagacuuuaagagguuguggcuaugauucucaaggcccagcuggauggucagggagcuguguagccaguaggaauggaggaaccauagaacgugccaaagaagagaagguacucuggacuuugaagugaccaucacauguagacagaggugaccaaccguuguuccuucugugggccucuugcucuaccaagcaccccaccuaccccaaccuccccuacagagugauagaaauaucccuccuccuuccucuugcaggugcuccuccaugccuucccccaacccuagcccacccucacccuccacccccuaacccccaaguucauuaccaucuucauuucagaagcucaaguagggucgccagcuugaagcuucaggggaggcaggcugaaaggcaggcgccauggcgccuuuucguaaugauguccuauggcuggguuccccaggggugaccucuaggaucgagagauggcauccuguugcccagcugccaguggcuucugggauauuuccccuucauguggguagaaguccaggauacaaugagcuccaugaagguuucuggcugcuuuuggaggguauggagaacgucuugauucugguuuuccgauggcucuauggauguggcccccuucacaacugucauuugucauggcuuccaucuguccugagcaagucauuccuuuguugcuaggcaucuccagcaucccugccauuaaaagcccugcguucucugcacuguuuggccagcauaaucucuagcaaccuuuccaugcugaguuugaaccugaccauauggacuguauaaacaaggguugcagccucugcauacacucgaaucgcuacauugcuuuuucuauaaaaacuacccauaagccuuuaaccuuuaaugcaaauuuuuaaaagguuaguguuuggggggggggguggggacugaccucgucuuaagccaguacaucugagcugaguguuuuaauaaaucugauauuucucaaggccccagucucugcuguguccccucccugcccuagccuauccuuguagagccuuagggagguguggccaaucuggccagcgcuuggcucuccugcaaguuuuccuuacagcuagcacaucaccaugcaugggaaccagaaagcauggcacccaaaggucaccccuucccaaccuccugagaugccucacccccauccagagcacgcgcuugcuuucaaucagugcuuaagguccaucaaguggugggcuuagaacuuagaggccugaggaggugugggaaggaaagaaagcuagggcuguguggggcuggggcuggggcuguugcaugcacuacccugcccuucugcaaagauaucuccgagcaccuggggccaguccggugacaaacguaagcgcuccgcauucuugugccaggaaauggcuguccauccccgcucucuggaguccuuuggagcuuucugaugucaccaauaacucggucugcaaaacccccccuugcagaagggagaagcugacaugauugacgguuuucucucuaagcuuuguuguccacguauaaggugagcaccccaccgugcagacggcugugcagaaagcagcuuguuucugcacugugaacacagaaccacgcugagccacaggaaaacccaucgcuuagugaggccuuucaguuuugcuuuuuuuccuuuccaauccugauagguuauuacgcugcugggcuuuguuuuaucuuggcuuuaagauucagggugggcugaauguuuugacauggagggcggaaguaggagcaaaagaaguagggccacaucuacuacuauucugaguucgaguucaccuggagaggaccacgaggcaacuccacccagagacuguggcagccagcuucugacagagcaaggcugaagugcagaagcccacggcaccuguuuaacaguugauagacccgaggcuugguuggggaaacggucuagaaagucaccugggaauaaccccaagcugcgagcacaacuuggcaugccaccauauugggacuauaacagccacucuguccccuccugagagaagacuccacagaggucuggagucaguugccaagguagcgggacaauggcagaggggaggggcuccaaugugccagcuguuucagaaguuaagaucugguuauugcuccaccccccacagaugagaucaaggacagccaacaaguguagacgggugggggagggguugucuuuugaauuugccaaauggcagaguagaagaggacacuggcauuuacacauccaaggaugcagcgaccaugugagcugaugagagcccuuggcaggugcuuuauucauaaagagcuauggcucguuuuuugauagauaauauauauuuauuaaauguauuaauguguauuuuauaauguacccucacucuuccccuuauccuggcugacuugcauacuuauaaacaaaaauuguuugagaaauuucaagacaaucaguauguacagggcuguauauaaaauaucacagacuuuaaagguuguuaagcaugggcagauagguuuuauuuucaaaaugcuguucuuaacaagaaaauaaaggcuuuacuauuuaccuaagaugcgugguagcuugucagucagauacuacugaggaggcuuucagccacgucugggcauuuuaaaugggagaauccuggcgagcagcagccacagaaccaaugggaccauuaaguuaauagggcacugcuguaauacuuuggggcuuuaacaauggaaauccuuucugacaacugccucuuauugggcuggaaacaacucagugcuagagccuuggccccacugguuaccccaacaccccaaaaccaaggcaaaacaacacagagaucggagguaaguuaaaauagggaucuuggcaaaagugggaacacuggugucagaggacacggucacgaggcaugccaauagugacagcucagaggauguugcugacaccguggagaggauuuggggucaggcaggaagcuaaagugcuuuggcuucucggcaacaaaucccuccucacguucaaaggguucuguauccaccacacuaaggcuuguuaaagacaccguacuagggaaaguacagacuggauacaucauccuuccauacggagcaacugacgucggcuaaggauauggugcugaggcag

SEQ ID NO: 4064 - RNA, 43505 nt, Mus musculus
cccuuuccccagucccccgcgacuggagccggcgucuccauccuuacacucacucagcgucacuccugcuuuuccccacccacaggagccggcugggaagaggcggugccaggagcucugccgagccuuggccacaccgggcuguauccagcagguccaguaggccaggccgggccaaaccaccgggcggaccgcuguguuagcaugaggcccagguuagaggucgucucaaaccuccugaaacuuccagauuuagccgacuccccgccgcacucaacaacugagcuaaccucccucuccuccagccuucccuuucacccuuucguuauccccuugccccauuucuagucagaaaauggccuggcccagcuccuagcccacccuccgccgcuccccgccuugcccuuacuuggagacggcuucggacguccucgcguacgucgugacgucacccuccucguuccuguccccgccccucucccauucucucccuccucgagccagcggccggcgggguuaccggaagugaugaugcaggaggcaauggagggggcggggcuucggggcggccgccgccggugggcugcagaugaggaggaggcggcggccgcgguggcagaaaaggcggcggcggcggggguagggagccuggaaacgcaagcggggaugguagguaguuuggacccgccgggccgccgucguuuccagaaaggguuugacuggaggaaccucuggagcagcugugaguuuggagggggggaguugaggaaaaggggggagcguugagagaugaaggggcggggguucgguuccuucgagaaaggggguggugguggaaagggaggagugcauaucagcgccuugucuggacuggucccucuggaagaagaggcugugaggggagccuguggcuugucaagcgcaaggcuccgaaaacuuaccuacugucccugccuguccaucgccagcaccccucaaucccgggccuggggaccuggggcuguagauccccggggagggucugcagacucugagcugaaaguccaggguaagagccgugagguaggagcccaagggggagguggugggugaaucugcagcucccucccugauuuuucuccccacccccauccuuuucuguaaucguuaacagcucuggaauuaaggggcucagaccugaaggccuuucagugcaccuuugcuauaaacgauaaccaucugugccugagguaauggggcuggaggguuugccuauauccuguuuaggaagugggacgggaugacaaauguauuguuuuuuccauccccaucucuuaucuccccucauacacaccucuguuucauacuuuaauucucugugguuaaguggcagucguggacacccucuccccuuuguggcacuuaguaccucagcuaccucuuuugaauuugguguucagccucuaucccagcuccuaacugcaagcuuuguaguacuucaguuauggucugugucacauuggggaguaccucacaacgccgccuggcucccgauuauaaugaacauuuucuuuuaugaauacuagaauuccagagcucuuccaaggcaucauaaguggcuucauagcccaggaaucaaggucucucgcucuaaauacuuuauaugugaggaauuuacauguugucaacucuuuccaaaaaugauuugauguuaggcuaauucuggauuucuguguuucucuccacccacacuucaugaugcacuucagagaacagaaaacccuauauuacuguuuuuguuucuacaguuggacaauagcucuuuuaugccugucucgauuuguaugucuuacaaucagcuugauuuuuuuaucuuauuuagccgaugccuuguguauagguggucguagaagagacagugugauaugugcuuaugcuuuuagcaaaacacagugcauaauggguauagaaaugucugaaaaaaaagaaagacugauuggaaagaacucucucauauuguuuaaaaaacaaacaaacaaacaaacaccccaucaugaguaaguagugccucuucuaggcugucagagauuccagagugaaguguuaaugaaucuuguuuugguguugauacauuuuaaaagaagaaauucucuguuaauuauggaacugucuuuuaagaaacuuuaugcguuaagaaagagugcgagauuuuagggguccuuugacuagaaagugcaaacguguugcucuuuaacugaauuuguugugcaguaucacuaggcuuaucauagcagauguucugauggugggaagagagucccaucgcauuuaucagggcccgauaaaacagaagacuugacgccuugauuguacaaguaaugauguuuauuacagaaauauagcagaagaguuacugcuagcugucucacuuuaauucauuuggaaccuaguuugucauucaaugacaaguccaaaauucauucaaacugcuauuaaagugcuagccaguguuucagacagugaguguacaaaggugaacacaagcaaaaaggguccucucucaaggaguuuaucagagugggaggugaggacagaaaugauaaaucagcaaaucugauuuugauugucagcaaaucugaucuugauugaaugcuggagaaaaaugagugauaggcuagagugugugccuggaacgcaauggagggagaccuuccugcuuaaacagaacuuuaaacgaaaaggagccagccaugcagagaugaagggagaacucuuggagguuuagggaacagcuugugcagaaacucacuggaaugaacuuggcaaguucuagggacaagagagugggggugggguguagauuuagggaguaaaaaguugaaagaaauagggucagaagaguagaguuggggcuuauuaguuagacgaaagaaagaugaguaaggaggaggagaaacagaaagaguccuuuugguucauucuguugcccuuccuagagcauuuaugauuauuuuugcacguucuuuuggacuguuagagacaaagggagcucaccuagcugagaggagagggcauaccuggucccguaaaauauuuugcuguauaugcauaguaaguacuuugaauguguccuauaucuuccaucuccguguaaacuuaaggguaaagaacugggcauguguuaauucugcugaugaccauccaaagcugagcuucuuucuuucuuucuuucuuucuuuucuuuucuuuuuuuuuuuuuuuuuuuuuuuuuuuuuugcuuuggccaggcagcauuuguguugcaauaguucugcacuugccuuggccuccuagugaguaauaauauuccacugagagguagguugguacuaaaaguucacucuggauuacauuagauaaggacuauuguggggcccauuuccauucugucaccaucuuuggguuggcaguaacucgggugucacuacuuuugccuuccguugggggcauucaucuccaguucaaccuuauguucaacagagaggccuuaucaauauaucgcuuggauuuggcccucuugugcuguaucacauuaggcgaagaugaaauaguauuuuucuucccuucucaaccucacaaaagugacuguagcauucuuugaaucagucuuuugagcuguguauuugagaggcauaacuguugcuuagacaguuuauaguaaacccagucuuaaaauguuacaugaaaccuuuugguguuugguaaagacaaaucagaaacaguagccccgucucuuggguuauguuuuaguacuuuacugcuaccugaaaguggcucuucagaacuggguggagcuuucuggguuguccugggguaagggaggaugcagccuguuugaaugcaaacagcagaucuuaguuugcagguaacugacuagugugaacucuuaggacuuggcauguauuaaacagcuuggccuugacuuuguguguuauuacugggcagacagugcucuauuugguguuaagcagucuacuaucccucuucaugucaaugauuuauuacaauucaaguacaaaaauaucaucuaggcugacauuucaucagcuaguuuguaggggauagagaugugagugggggugggaguguugggggguggggaacuugaacauguugagaagcccuuaaaaccguacaucgacugcuaauuguguuugggaaaugaaucuaaaucuaagugaauuuggagucuuggagcugaaguggccuuuugaccuaaggugccagucaguuuguuucuuaggguuuggggaacuuugagcacauucuaauuaaaggugaaaacccaaagaaccaguuggugccaccugcccuuggaauugugggcagguuguuuuucauuucaguagcugguuuaaaguuaaucugauuuuacuacugucuugauaugcguucuguagugaggagaguugauuguacacugacugccaguuguuuugaggugaagaaguaguaacucagaucgaaacagugguaauuaugugguaacuccuguuucccuaacucuugauaacuuauaauuacucuuugugucuguuuacagacauucauaccaguguaccagaaugagaucuuccuaauguuggcacaguguuuuggguucuuucccuaacaggccagguugauugaguuaauguucuucaguucaaaucuaguuucacuaguucuuguaucuauuuucuugggcaauggaagauuuuauuuuuuagggggucagaaggagauggggauaacaccaaaaagugaugcaaacugauucuuuggaguuauacuauacuaaaagaggaaaaaugcccaggauauaugcagaugagaucuuauuuaaacaccauacauuggaacuuguagaugaugaacucugcuuccuugagaguuuguccuugccuaagucuaaguugugaguugaaauguuggguuuggggcugagauacagcauagggaccuagguuguacagcauguaagcaucacuugguaagcaucaucaugugucccugucccaucccuguccaguuccuguccugcugccuucccccaucaucccauugugcauugcugagccuucaaccucaguaccugguaacugugcugacacugaaaccuuuaaaucuagcccagcucugacugacagagcucugauggcacucugcagggagcaggacuugguuuucagggagcucuuguagccauuguugcucuuuguguuaguccaggagauaguguguuggggagaucugcccuguuuuaguacucacagcauuuacuguauugaaagcaguucaccagauggugguggcacacgccuuuaauccaggcagaggcaggcagauuucugaguucaaggccagccuggucuacaaagugaguuccaggacugccagggcuacacagagaaacccugucuugaaaauaaaaacaaaaacaaaacaaaaaugcaguuaguucuacucauuguaguaugggaaguagcaagaaaaacucagaccccuuagaauaucugguguagcucugaaacacuguagagaccaggcuguccuggaccucacagggaucugccugccucugccucugccucugaauugaaaacacacacacacacacacacaaaaccacaaaaaaacaaaacaaaacaaaaaaacaaaacauguaccucauggccaccauacccccuccucuuuuuuuuuuuuuuuucuaagccaaaguuugaggaacccuccugaggcagaaguauucuugcaacagaaaugaggacauuuucuuucuuucauuuuuuuuuccuuaccccaauacaucauuuuaccaacucuuuaauucuuugagaauccuuuacuguggcacauguaaagcagugauuugauaauggaaugagagugcccuaguguagcggagguugaggaugcuuucuagggagagcugaagucuucuccagaguguuuucugaagggacccauuuacauccaaauaggaguggagacuucaguacccugagugcuuucaguuuucugagacaaggucuucauauguagucaggcuggccucaaacucaauaucuccucucaucuuccaaaaugguuuugggauuauauaguaucaccaugccuugcuucucaacucuuugauaacuagugggcaugaguuaauaauagcugugcaaaguccugaauuguauauaauugccuuuccaaugaccugcuauagcaucagaacaggaaaguucaaguaugcccauugauagagcaauuucauguaaauaacuacaguaguuacauaagccaucuuuuuauauuaagcagauuuggcuucgauuaagcaguugcucuuguacucagaaggcugaggcaggagugcugcaaguuagaguccaacuuggacuacauagucaguagucaguaccaggccagguagaacaauaagauaccuuuauuucaaacaaaacaaaaucacaugaauccaccuucaaguccuauacuugucguucuacacucagguugaggcaggaggaucaagaaguuaggggcauccucagcuacacagaacuuuugaggcaacccugggcuauaugaaaagaaauccuaucacaaaaagccaaacagcuuuccacccccuucacacuacacuugcuuuauaucuacuugaugcuguuuaaacaagaggagaaaaucaggauaccaccucagagaagauacugagacuaccaucgugugacuaggaagcaggaucagggauaagauaacacuuuugagcccuuuaaggagacaguuuuuccuagcuauggugguguuuucaggggugauaaguuauaauacccauuuuaaagaauauuuucaugguucuuguugauuaauuuuuauuuaaaauaacuagucacuuauuuaaucauuuacucaaaacuguugcuguagagcucaugcucaugggaagaauucuacuuugggcuuccuaacuuaugaagaaguguaaagguguuuccagaggcauugagugagucaguugaaguggauggaguagcaagccuuuaugugaccaaaguuguagguaaguaggaguaucguggaaaggggauauaguggggaagagacuuguccuccguguuccagcuggaaaaggcuaauaaugacugagguagguaagggaaaaaaagcuuauaaauugcccaacuccagggaauaacauucacuaggaggagggguuaggggccugguugccuaacuuuagggaauaucacugaccaggaggggagagggaccuaucuccaugagaacacacauguauuacuguugcagaggagaguguagggauccaauggaugguguguuuauacuagucuucacaacugacuaggcauucaggaugggcugccucggggugcuggagucuuuuuuuuuuuuuuuuucuuuuugucuuuugguuacuuaagacuuguguuccacaaaucagaagcuggugagaugagaaauaaugugcuugggcuccuuagaguagauagaguagauaaugaagaagacucuaggugggguuuacucuuaugucaacaguuacuugugaacucuugagauaguuucugucugacuuucucuugggaacuaucacaaaugugagguaacagacaaaacuauugaagaaaauuguuuuaaacuuuguauuucuacaaccuguuuucuuuggcagguucaaauaguugaaccccuccccccaccccccaaucucuucaugguuuauuuucauuuaugugugugugucuacacauacacacaagcacacgcauacacccauggagaucagaagagagcaucugauccccuggagcuagagguaacagguagcuaugaguaccccagugugggugcuggaacugaacucggguccuguggaagagcaguacgugcucuuaacuacugagccaucuuucaacucuagguuuuugguuuuuuuuuuuuuuuuuuuuuuuuuuuguuuuuuccugaaagguuuuuacuuaucagguacuuguggauucccaaggcucugauuuccuacgaguuugugacaggcauagauucugugauuacauuaagcaguaaagugucuucugaacauuggggaaguugguuuuaaugugugcaucuguuucugagguuaccaaucacauuguuccaacaguuuucuggcagcaacugaguguccagcaacucagcucugauguugucuggaauuagcacagagcccacaugccagugacucagucuuacaggauugugccacuuagaugcuaacugugggcauucaugaguuagcuuaacuucuuguagauuacaaguucagaggucuucacagccugucagguuugauauuauacuagcacgauucauagaacucaagugcugcgugauauuuaggacacgaguuuuguuuguaacagcaguggcagcaggaacaguagauacagccccauccugcuuccaauagcugaggggucucuugucagcuggaaccaagugcuggagaaaauaauuucaggacaaguuuguaucaagcagagcuagauuacuaacagacuuuaauacuaggcauugagggaggaagacaguacacacccaaguguggcuaugaacuugagaaucucccugaagcgucuccauaugauuuggugcuuuugaauuacauuguugaaaaaauguuaaaguuaaguaaaacuguuugguauacucauuucuagccaagcuugcaguuaagggcacuuguuguucuucuggaggacccacauggauuccguccacuuacaacuguucauaacuccauuuccacuuuaucugauaccuucuuuuggccucuuugggcucuaggcacacaugugcucauacaugcauuuaaggcaaaacacauccauguaaaagaaaaaaaugaaaacagcaauggcagaacagguugaaaaaagccagucagggcuggagggguggcucagugcuuagagcagucagggcuggagggguggcucagugcuuagagcagucagggcuggagggguggcucagugcuuagagcagucagggcuggagggguggcucagugcuuaagagcacuuguuucuguagagaaccaggggucaguucccagcacauacauagcagcucacaacuguaacuucaauucuggggaucccaugucuuuuucugaccuccacagggacuuaggguauucaguaugcauacuaaaauaaaaagggccagagucaagacauguuuuuacuuuaguguaguuucuaaucuaguuuguaagauauuuauuauuauuuuggcuuuuucaggcauggucucuccacauagccuuuucuguccuggaacucacuauguagaucuggcuggcuucgaacacacagaaauacuccugccucuugucucaggagugugggauuccagacaaguaccaccaagccugcuuauuuauuuuggggagcucuuuuucuccucuguauuccuuuaacuuuuauugucuauuuugccuuaauuggcaccgggaauaguuuguauagugcuucuccaacauauguaaagccguggguugaaccuauggaucccucagccuccaaaagaggcagaugcuuuggucauguauguaguucucuuaggagacugaggcaggaggauggcuugagcccagguguuggaaaccagcugcauugauacaagggcaaaugaugaguuguaagugcaggaacuauuguucucucuagaugugugccaccauuucuggacucaacacaucuucugccaagccaauaaacugauuaaaggaucaaaauucauagugaaagaaaaaaagagagagauucaauguagccacauuggggagagagacaaagagauccacgaaacucacuccgccaccuguagccaguugguuuugauuauaagguaaacuuuacuuaaauagaaggccagagauuuguacagugcaacagagauccccuccuccucacacuccagucaaaugaagagcuguaaauuuuaccuaggacaaguuucuuuuaugccugaacauuuucccucuugcugccccuagagcuauagguauuacccccuuucagauugcuagggaaauucuaauuucuugggguccaggcaggccagucacacuaucaacuugaagauucacucccagccagucucugcucaccaacuuggaaauucucugaaaauuuugaggucucauugauuuauaguguuuugguggugguggggaugggugugugugugugugugugugugugugugugugugugugugugagugguucguguguuuccugguuacuauggucagagaugccacuauggucuuugauuuagaauuaauugagaguucauuauacagacgugguuauuggcucauuguaguucuuuuucacugcccaucucugagacaguagcaccuagaauugaauucugugcuuaaguuuuccugaugugacuagccccucccuugaaacuucugagggccuaccccgaaaucacacuguaaaacucaggugugguccaaagggucuuuuccuguuguaggauauuugaucacacugugaauccugagguuguguuacugaaaaaaccuguuucaaguugugguguggcucaggccuuaguacacaccuuuaaucccucuggcuguaauauagauaagcccuuaauauacagucuuaauuccaaacaauguagauaagguuaguuuguagaaggaggcaguuauauuuuaaagagaugucuaauugaguggcagacagagugacaagucagagaaagauuugacagaaugagucagauaggauaugucuaauucucacaggaaaaggaggcuacuuaagagcaccacagaaaagcgagggaagagaaagaggaaagaugcaguuuuacugggacaguuguacagagauagagugcagagagagaacaaggcagaaacaggcggagacagaacaagacagagacugagaaggagccagaggauuagaacagauugccaaaguugguaugaggccaagcagaacaguucauaaucacugguuaaagcacauagcuagagcuaacacugaucauaagucuggacuuuacuugcuacuugaacuuggaugcgcuacauuucuuuaagccucaggucuaucauguguaaagugaaauucauuaaauaguuguaaggauuguuaguguccuuauaguguuuuuaugacacauccuauaauaugugucaaaggaaguacuauuauuauuauuguuaucauuagcuacaaggcauacauaguuaagcuuauccagauugcaguucucaagaaggggcuauauaauuuuaccuccuucuauagaauauacaaacauugcuagaugcacaguuaucacuugaaaauaaaaccugcccucuggguaucugggaaauaaauucacaggugacucuaauggaaacuuccaaccuguuuccaaagcugguguaaaaauuggguauggaaaaaucuuucucuugaaauccuguaaagaaauaacuuucaacuuucuuaaugcugugcaaccuuuauuacaguuccucuuguuguggugggcccccccccauaaaauuauuuuguugcuauuucauaauuaauuuugcuagugucaggaaugguaauaauguaaauauauggucugcaggauaucugauaagugaccccugugaaaggguuauuugacuccuuaaagggguugugacccauggguugagaacugcuguuacagagccuguguugaguguagcaguggggacaaagggacagagauacuaugagguuaaaccaagggacaucuuuaucuuuggccauaugccuugaaguucaguaaguuggacaagccuucuugagacuuuggauggaaacagauuugugucagccacuccauuaucugagaagaucagcugcuaaguaccaugcugugccugcuguucguaggggaaagugaaaagcccagaccuccuucaagcucacuucaggugaacugaggccaacugaggccaggucucuuaagacucccagacagccuuuucaaggggaccaguggugaacauguagugcccuuugcuagccuauacucugcuacuaguugcugugucuuuguuguguaggccgcauucccucuguguuugcugucuuuaacugggaugcaaacgauuuaggaauaauuacuguuuugaagaaguauagauuuggauagacuuuuuuuaguuuuuuuuuuucacauuuauuguguguguuuauguggugguggugguggggugcaugugugaaggccugaggacagcuugaggaagaagaugguuguuucuuuccaccguaggaguuacaggaauugaacucuggucaucaggcuugguggcaagcguugcugaguccucuccagggcccugguucuauuuauauuuguuguugagaugaguguacgaguguccuuucugaacggcugauaaauguggggaguacauggugaaugcuuuucauguaucaguucuccuuaauguaaaauaugaagauguaacuagcagacaacacuucugacugcauagauaauggugcuaagaaugaucuaaaaaaaaguuguuuuaagacaggugcuaugccacaaccccaauaaaaccaccaaauaaagcucaaauuucuguggaacaauagaaggcauauuuugauuggcuuggguaaaacucacuauauggauaaaccagccuggcuucaaauucauagauccacuugucucugucucacaaguauaccacuaugcccagcaggucuuuauuuauuuauuuauuagauauuuucuuuauauacauuucaaauguuauccugaaauuucccuauacccucccuccgcccugcuccccuggcauuccccuguacuggggcauauagaguuugcaauaccaaggggccucucuucccagugauagacaacuaggccaucuucugcuacguaugcagcuagagauaugagcucuggggguacugguuaguucauauuguuguuccaccuauaagguugcagaccucuucagcuccuugggugcuuucucuagcuucuccauugggggcccuguguuccaucuuauagaugacugugagcauccacuucuguauuugccaggcacuggcauagccucauacgagacaguuauaacagggucccuucagcaaaaucuuucuggcauaugcaauagugucuggguuugauggcugauuaugggauggauccccgggugggguagucucuggaaaguccauccuuucaucuuagcuccaaacuuugucucuguaacuuucauggguauuuuguucccucuucuaaggaggaaugaaguauccacccauuggucuucccucuucuugauuuucuuguguuuuguuugcaaauugugucuugggugugcuauguuucugggcuaauauccacuuaucagugagugcauaucuaaugacuuuugugauuggguuaccucacuaaggaugauaucauccagauacauccauuuguccaagaauuucauaaauccauuguuuuuaauagcugacuaguacuccauuguguaaauguaccacauuuucuguauccauucuucccagcaggucuuuuuaaauuuuauuuuauuuuaacuuuuaagaaaaaugccagcugaugaguggacauguaaaggaauaauggugguuaggaauggcuggcuuguaauggaagaccuagugagcagugcagagccacaucuuacuacaugaugccuuuguggaauuggcacuauagaacagguccacguuugugcagauuuaaagacuucacuugucuaacucaagcaaucugacaaguuugacagaaauauccauggguagguuggauggaauuaaaaauaaagacauugccaaaccccuacgauauauuauaugcaauuuuaagaaugauagauuuuuaguaagugauacccuuauuuuuaaacagugcaaaagugaacacugucauguucuccucacuuuuagcagguccucacugucaggauugauaggucguucacucuacuguuggagcucccuaagguugcaggaguuuagaacccaaggcaagagacuuggccauggaucuggcaaccagacucaagguuucagaagucuugacucugccucaucuaagaggugaccucuacauuacuuguuggugacugcuuuaaagggacacugugacuugugcccugaaauaaacuuaagcacugaaaauuuuaaauagugcuaaaaaaaaaucuaccuuccucauucucacaauuccauguagaucuuaagaggcguguaaauagugauagcaaugguagcccguugugggagcugccauccuccaacucuacuuaaacucccaaagagaauucaaaguuuuguggaauaauauaagcugagaaagcugcauuuagauguaguuuguauuuuguuuguuguuuuagccauaauuacccaucgucccuagacuuuuuccuugucucuuauuaucuuuuauuaucugccuuugguuguugaucuguauuuugcaaaugaucuugcucuuuuaaaaucucugccauuaauuaauauucauucucucucucucucucucucucucucucucucucucucucucucucucucuuaaacugcccaggaguggcauuacccacauugagcugggcccucccauaucagucagccaucaagaaaaugccacaggucaauuugauaaagucaguuucucaauugagauucccucuuccagguauaucacauuuacaagcaagauuagcuaucaagugcacuuaacagccaagcuguuaagaacccuauucacaagaacccuauuccugaacugugucuccagcccucucucugcaugaugucguaauggaaaacucggaaguuucccagcaguggugagaucuaguacugugucugaauuuuuuauauaauuuugauuuugucauuucuacugucuugucuuuugaaauguugugacuuguguuagggcuggcuaggaaagggaaaaggcuuuugcuccaggcuguauguaaguuuuuagggggacuaaaaaaaucucacaguguccuuugagcagauuuuaauuuauuuggauuccauaucaggcaauaugccuuucuucuugaauguaaaagaaaucauaaggccaccuuauugaguauagagauuaauaucucaaauagucucuauucccuacuggggaaguuagucauuauuuauaggugacaacuguugagucuggauaaaucugaaagggaauggaaggaaguuguagcaguuguccuugcucuacagcaagccuuugcaaggcuggagacaguuguucauuuucuucuguuuuggggaaauugccauuggauuaguauguuuugguuucuagcaucauuuacugcagaaucuuuucauucuaagauaaagccugggguaguugaaaugagucugugggcccauggguacaggcacuugccagcaugugguagaaggagagcagcuacucuaaggaguuguccucugaccacuacaaggugcacacacacaaauaaaugaauugaaaauaaguauuuucaagaguuuggaaacuugaaccuuuguggcaguuucaaacuagacaaaucauuaauugaagacuuaacugugacuuugaacucuccuuagccaagaaacuggaguugcuuaauuuaucagaguauuuguuuucuaagugugcaacucucagucauugccugacccagcagaaagcuaauaaaguuacgcaacaggcgagggccuuuccagucgccuuuccccauuuguaaagagaugguuuuccuccuuguaagaaacucaucgcaagcucuccuuuuuguuuugcauauuuauuauuugcacacaauucuccgcuucaaacaaguuuagaagguccccagcacuuaguacuugucaaaaaucugcauaaauggaagagcuuuugauugccacagcagcacuuaagcaaacagauacaagauaauuucugcuuaagaagaaacagauuuuguaguuuuccaguuuuaaauguaugagcaagggacugacuuucucggauggaaugugcaucaucauaggggacuucugaaacgcaaaagcaaucuuguaagcuaggaaaucuuggccuuaaauauccugcccucaccaguuuauuccagggaguuauguguaguccacccuuuucugguggacaggcucuguagugguuggaucguuggcauuuuaggagagaauuguugccagguauucuuucuaaccgauucagggcacagugggucuuguucuucagggaacuugcagcuuuguagagacaccagacacaguaagaaccagacgguuuguaaaguaaaguuggugcuccaagaugugauaccagugcaggugcccgggguucagcagcaaggaguccugugggaagaaagucugagauagggcugaagaagcaagacuggggaaucaggaagaggggaggcauuauacccgccauauuaacaggaagguaaaguauggagacagguggcaucuugggaaauacuuuguacguuaauaugccagaagcaccugaaauaaaaggggaggacgauggcagaggcugagcucagaucccgaacgaagccucuugugugccuuggugauuuuggcugagucuaggugaaaagggucuguauuuguggaggggagcacuagagauuuacucaggggcuggcaccugcaaggugaggccugcaccacugaagcacauccccaguccuauugaaugauuuuaagaaugucaguauuuugugcgugaucacuccugugcagcaauauuagaagucgguacagccccuaugguagaaaccugaauugagucauggcagcacuacugaggaaguguggaguaaccugacaaguuuauuauugcccaacacgggucagcagggaagaauacugugcucaguacagcccugcagagacccaggggcagcagacuucacucucuuguacugaacuaucugugcugucuugguuauuuccuugguucaccccacagaugauggcagucaugacugaagaaucgcaucugccugaaucuccuuacaucauugcugccugugccaguagaagacacauuucccaacauaagggagaggagcaugaaaacagccgggcgugguggcgcacaccuuuaaucccagcacuugggaggcagaggcagguggaucucugaguuccaggccagccuggucuacaaagugaguuccaggacagccagggcuauacagagaaacccugucucgaaaaaccaaaaaaaaaaagaaaacaaaacuagggaacaaaugguaguugucugcuuuucuuuuccuuucauccuuccuuuccuuucuuuuucccccucccucccucacucccucccucccuccaucccucacucccuccuuccuguuuuuguuuuuguuuuucuagacaggguuucucuguauagcccuggcuguccuggaacucagaaauccgccugccucugccuccgaagugcugggauuaaagguucgugccacugcccggcuuccuuuuuuuuuuuuuuuuuuuuuuuuuaaagaaagucuguagacuggaacuugaaacacugucuuagucucccaagugcuaggauuacacgaguguaucucugagcuuguuucuucaucuguaagguagagauagcagaaauauuccucuuuguggguagcugugaagauuaaauuguauguuaacuggaaagugcuuacuaugccacaucgaacacacuaauuauaccacaggaaaaagccuagucuugagauuuuccaaacugagggucauuucuccuuggagggucauaaccaacaauugaaaccaaccugagaaaggaagcagcaucagucagagcacaucacagaagaaucggucagcauugcaucaccagagcaccuuaguuugcauauuagaucaggauguggacucuauuucuuuaaauaauuaugguugagugcuugccugcaugauguuccuuuugcagaggaggugaggaggccagaagagaggguaggauccuccggaauuggaguuagggauaguugugacuuaccauguggggcugggcaucagacucagguacacuaaaagagcagccagugcacacuuuuaaaccccgagccaucucccaagcuccagaauccauaucuugcuguacuuuguuugcaguuaaaguuugaaaacuacuagcuacuuucaagcucccuuccucagaggcugagggacuuuggcaccccaaacaaaauaccacucuuguuugaaagaggguuuuuguuuguuuguuuguuuguuuuuguuuuguuuuguuuuaaagacagaguauguucacuguguagcucaggauacccuguaacuugcuguguauaccauguuggucuuaaacucacagagauccaccugccucugccaggguuaaaggcaggugccaccauacucauccuguugcucucauuuuugauaaccaguaaaacagggguccuucagaaaguuacuuagaacuugugccucagucuacucaucugugaagaggugagaauaauacccauaguacucauguuagugcuguaucuuuguuuaguucuguguaaaauguuuacagugcuugguaaguacugaaccuuagggagcguaccuaggcuaacaugcaugaaggcagauugugcaguccguuuugugucacaugugaauacacuuccugugaaggcguucuccuaagaucuccagcuccagagucccuguuagauuuuuuaggaaccuuuccuuggugucauuugguccucucuuguacuacacucccuuuccagucucccuuuacacuuuaagaugcugucacuaagacagcaauauccuuuuucuucuauguucugguuaugauugcgguuaguuuugagaaaguaucucucuccaugguucugguuguccuggaacuugccauguagaccaggcuagccuugaacucacagagaucuucuugccucugcuuccuaaauacuagacugguuacauuuaacuagcaugaguauuuguguuccauggaaguaaaucauauauaaugcauuuauucuugcccaugucauagacauacaaauguauguuauaguaagaugucauauuacauccuuaaaaauucaguuuggaaaaacuuacucaggguugugggggagggaugaaauauuuucgguuuuugguucuuaagcuuuuucguuuuggcuugggaggaaaaaaagccacgggauuuuuuguuguuuguuuguuuguuuguuugguugguugguuugguuugguuuguuaauuuuuagguugaaagguuacuuuuucuugcagaauaguuaaugacagcaagcugauucuuggugaaaccagucauugugcccuugcucaguugugguggauagugagccuucauuuugauaagcccauugguaauacuguaucaacuuguaugaaugggagcugguccuggcugccucauagaaguguuauguaacuuaugguacucacaaacccuuuuggggggggggcuuuauuaucaugauacugucauucuggaucuucuguucuuauccaguucugccagagugauucucaugccugaggggcuagaaacuccauguaaaaaguaggcauuuggcuuuugcuuagagauaaaguguguugaugaagaauggcuguuaaaaccuggaaacacugaaguuggugauugaaguuuagacuacuuuagaagcaccucccucccuguuacacugacuuaauuucugaaaaaugagucuuauuuagaguuucaagcaucuucuuugacuagcuucagaaaaggcuuauuaauguauuuguccuguaaguuucugcugagauucguuuuugucagcccuggcauuucccauagaaacaaaagagaagugucaguuugguuuuccaucaccccacacaguagacuucuuaauucugucacugauggaugugcacuguuaaacaagccuuacuguuggccgacucacugaggagcccugugauaaugugaccccauccccagcuaccaacacuuacacuuguaguacuuggaauuuucaguguauuguguuaaaacaaacuucuaauucuggcuauuuuucuuuucaacuuuaagccuaaaauuggaagcucuauuuuuauacaacauauccuagaaaagucaccaguguugcuauucucuugcugcccaaauaucuucacugggcuuggggguggggagagcaagagccggcugucucauguggcuaagcagaaugugugggccugcuugccagccaguggagguggaaucugcucuuugcuucuuggcaaguaugucuggauuuggaagcuuucauuuaggacuuuagcucuuggccauuucuuguugccauaugcaguagagcucauuguuucuaggggauuugaagagacagagcuguauuguccucaucucuuacugucuuugacaagcuuuaaguaaaauaagucaaaagccacucugucauccaugaaauuccuuccuuuuccuuccuuccuuucccuuccuuccuuccuucucucccucccucccucccucccucccucccuuccuuccuucuuuccuuuuucauuucuuucgaucauuuuuugagacaagaucucucuauaauccuggcuauccuggaacucacuauguaaaccaggcuggccuugagcucaaagaucugcuugccucugccuccugauuaaaggugugccccacugugcucagcaucauugagguuuuugugaguaacuuaguaggagaaaauaucucaagaacuguaaaauggcauguuuuaacuagcugaaucccuauuuuaaaagacauauauuguauucaaaacaaggauccucguccccaaacccuuuaaauaugaugcuuucacauaugagcuagggaggcuaccuagcccuugcauguugccaucaggucuucauaucgugugaauuaacguuugggcuugcaccuuugguaagggaagaggcaggaaugacgucugugaaaaugugacaccuuucccuccuucaaggagugaggucacggaucagaagacacagcuggaccgucaugguuucagccucaagauucuggauuucacucugggagguaaaaauuagcuuauggagugaagaaauggcgcuguauuaccacuggaugagaagcuauuuguauuugagaaacugaugagguggggaauaauugaaauaguaacuccucccuccccuuguuuuuagaaggugguagaguauuguggggaaggggucugguagcuggucuuuuacuacuuuguggguucuuuuucacaccuuuuauccacuccccuccuuuucaccccauucccuaaaaaggagagagugaaggauagaggggagagcaagauugauccccgaaaucucauucuuuccuuuuguuucuucuuugagcaugacuucuaacugcagccaaucuccccugcugccacuuggggcccuagcauuuauguacccucugaaagguuccagaauccuaaaugucacacagucucaaacuaucugaagcugguaaauuucaugccucugcuaggacaugaggcaaaucacaguagucggcugcugcggucaguucgaaacagccccagauccccacgggauuaaaacgaaacacuuucuuauaaaaauuugaaaauuugaaaauucuaggauugucacuagugucucaaagaaauaugaccuuaagaaccaguucuuaagaaaugaaauugaguucugcauccauaggacucaguucccuuuguuguugcuaucauuucaucagaauugguauaaauaacugauuuguuaggccuaauuguacuagggcaagggcuaagcauuccugaguauuaguccugaguuaggacaguaaagcgauagacuagugcuuugugcaacaugagcacuuacuaucugucuuaguuacuguuguguugcuuugaguagguaccacgauuaaggcaacuuauacaagaaagcauuuauugggaagcuugcuuauaguuucagaggguuaaguuguccaagaucauggccggggagcaaaguggcagacaggcaggcaugaugcucgagcagcagcugagaguucacacauuaucuguaaaguauagacagagacagagagaaacugagacugacugggccuuguggguguuugaaaucucaaagcucaaccucagugacacaccuccuccaacaagaucacacuuccuaauccucucuaaauaucuaacuggggaccaaacauucaaauacauaagccuauggcaauauauccaaauacauaagccaggcuauuuuuauccagaccaccacacuaucagugggucaucagcagauauguagcaaacaguuccugugugccuaaaaacugagguagguacacaggauauaacuuguauuguuugggggaucaaauaagucaacgaaugagacucucagagaauaaagccagucugguauuacaaaccuguaauccaaguacucugugaagcugaggcaggaggaucaugaauucaaggucagccuggacucuaauuauaucuauaaaaacaaaccaaaacaccagagcagcugggcaugguuggcacaugccuuuaauuccagcacuggggagacagaggcaggcagaucucuugaguuucaggccaguuaaggccguguuucuagaagcaaacaacagaaacaagcaaacaacaacaaagcaaaacaaaugaaaaucuaaaccauuaaaaugaagaaagcaaaaacaagcaaaaagacaaacauaaaugucccagauuagaguacaaugcuacauaacuugguugacuccauuucaguauuugagacacaucugguacaagugcucuucugagguacaaaguaucccauggagagcugggaaggccucugauguguaagcccagcgauuuugcaugcccuguucucccuagaaggcagggagaggauuucaggaggagcugaaggagcuguaguauuugcauugcugaucugagugaaaggauuagaugugguugaaguacauguaaagcuggugacaguugaugcaugcaacucuuugaacccccuguuacuagaugcaaaaugaacauguguuuacgugcacauuguauucugggccuguaguugccuucagguuguuaaauguaucgaugaccagaagaagagcuuuuggaucuauuguuugucuuaaaauuuucuaaaguaaggccugucugggcagccaaaauagacagcucugcaucggcccuuaggugguagcaauuugggcaggacagaaaauagggaagaacuaaguagucuucuuuguuuuuauuguuguuugagacaggggucucacuaugugguccuggcuaaugcugaacucagauccaucugccucugacuccugagggcugggauuaaaagcacauauaaccacucccggcaagagauaccuuugcaaagccugcaguaacuccuugcuuguugcuuuuuaucauauguuggacacuauuuugauugaaguaucuguuuauuuaucucucucuauauuaauguauccauguaccauguaagcauuuauaaaaaugaauguuaagaaaauaaaauguguauauauauauauauacacacauauauggauuguauauaacccuuacaggauauauaauaaagacagauaaacaugagcauuuuuaguuucugucuuagacaccugaauucuuccuaaauuggcauuuagcacuuaaagggaaauuggguaauugaaaccaagaacucuggucaugucuaguuuuucaguuucauaggaugugguuuagaucaaauaccuuuugagcuggaagaggaucggucaugucauuacugugcagaggauucccgacgaguuggccguacauucuggcacauugugcuuguagaguaggagguagggguccuccuugggaacaugaagaugagauagaauguuuccacaagagaaggcaggaguacucuaacuguauuuagaggagggcuaggauaguucucuuagcuuguuagucaugccaucuuauauaaauaguauccuaauggcucaccuaguuguaaugggauuugacagcauucauggccagggaucauugcuccuguuguuuagcugaggguaccaugacauauuggguugaaacuguggccucguaagcugggugaggaacacgaaucaggaagucuaagcauuagaucguucuuucuuucugugcugcuuuaguaagagacugagaaguguuaacugucuuugugagaacucuuucaguugugacacaagcugacaucuggcaaauauaaaagggaauuuacugacugguauauucaugaagguuaggcuuugaucuuucuugaggccauuggauucaggguguaaaugaugucuucaaaacccaguuuguaauuucucaguauuaccuuccaccuaagaaucucauucuugaguucuguaugcauuggauuugaaacucaccagguaaagagagucacuuucuuccguagacauuuuacuuucccuggucuuucugguaggguggccauuuucaaugcucaauuuuuucugguugaccugggugccuguguaccccugauaauauaguuauuagccaggaguauuauaggcaacauaugagccuaagucacaugcuucauuaugaauuccacaaacacagucuuauaccaggaguuaauuagagggguagggauuaugugugaaacuuggguaauuaucugauagagucuagaugguguggaaauguacaugguucuaauacauucugugauguccuuugauucagucuauagcucaaaaaguccauaugauaggucugugguguaaaugcaacccauugacugcuuccaaggcuccauagcccagugugcagauagucacuggcucugguuaauuaaucugagagcuagacuuucagcccagugcuaagaggaugaggacucguagauuuuucaagucuaccaucuuucguuuuuggaggguggaaaggguaagguuugucuaauacuuaaaaaguacauagaagaaguguagaugaaacugaaggguaacauuugaaccucuugucucuuguccugucauuuacagcuguuaagcugcugugcucacaggaaagcugauacuucuuuacuggccaccuggauauuugucuugucuuccaugcuucuggaaaagggggugguguucuguuuuguuuauuuuaagggaaauugaauaaguuggcaaauacaauauguugaaaguauguguagaucuagaauagauuuuuauauaaaguauuuuuaccuaaucuuugauccaucaauuuuucuucuuaggaguuauucccaggaaauaauuauuaauguucugguuuuuaacuuuuuuuuucuauuacccuaguaugcccauaauagugaauuacaggaaguaaguuagcaucugagaguaagaaauuaaaacaacaaaucacaguaucugaucauugagauagcuguguacaguggguuaacacagggaauuucaguuucuuugcuuccucuggaguauaguaccagaauuuugauagauugaauaggauauaaauagccuuauggauuauaugugaccggccuggagcauuaacagccauaacaauauuuuaauuuuuuuguaggcauuuaaggugguagcucagccaaguaacguccuuccaugcaagcuuggagaccugaguucagaaaccucagaacccauguuuaaaaaacaaaaaucaaagaguagggcugucaagauggcucagcaagguaagagugcuugccacuaaagccuaaugacccaaguuugauuccugaaccccuauugguggaaagaauagaaucaaccccauguacacgauguguguauacacgaacugaacagauaaauaguuuuuuuuaaaaccacagcaaacagacaguggcauguaugucuaauccuuaagcuagggaggagaagacaggcagaugcaggggcucacucucuagccuccuugaucagcccaagaaauugagagacccugucugaauacaaaaggguuggagauauggauuagugguuaagaguauauacugcucuugaagaggacccaaguucuguucuuaguacuccuguuaggcacuuacaguuucaugagauuugauacccucuccaugcaaaccuguguucacauguacauacccucacacuuacauacauucauacacauaaaaaaaaaaucucgaaacccaaccauccaaacacaaacuagguagacagugccugaggaguucauguguacaugcacuccuguacauucccagcacacaucauuuuuuugagagggaaagauguuuaucaaaaaaaaaauguugaguggaaagggcugcaaaauaggaugugcaauauaacuuauaaguuuaauguauauauuacauguaugugugugugugugugugugugugugugugugugugaucugcauaugcuuacuaaaacaccaaaaguauauucuuuguugguauucuggaauaauucauauauacaccugccuguacucauguacuugcucuugcucucuccugcucucucucucuuacacuuacacacacacacacacacacacacacacacagacuguaauuuguugggggagggguugcugugccucuuuugcucccaaguaacagcaggguguuucuacaccugcucuaacccauuuuagcuccugaauaaauggcacagagucugguauuuuuauuaacaaacuacaggcacuaugcugggcagguacucaucuauucugucucugacugccuacuucccagccaugugguccuuuaccuguaguccugccuuggcuuccucuguuacauguguggccucauggcugcucucucauugagaccucaugguaaauaaaucuuucugguucuucucuuuccuggucuuucuccucugagauccccugcugggauuuucuucuccugccuaguuuauuggguaaucagcccuuuauuaaugaaucagagguguuggaaaacaauuuuacauaacauugagacuagaaugguuguccauaccaaagucaggacuacuagaugucugggcauagaaaucagcaucugcuccuauggggcuguaaaccccuucagcuaccuggguacuuucucuagcuacuucacuggggaccccguguuccauccaguggaugacugugaacauccacuucuguauuugugaggcacuggcagagccuuucaggagacagcuauaucaggcuccugucagcaagcacuuguuggcauccauaauagugucuggguuuggugauugucuaggagauggauccccagguggggcagucucuagauggucauuccuucagucucugcuccacacuuuguaucuguaacuccuuccaugaauucuaaccaguacccccagagcuucgugggacuaaaccaccaaccaaagaauauacaugguaggauucauggcuccaguugcauauguagcagaggauggccuaguuggucaucaaugggaggagaggcccuuaguccugugaaggcucucugccccaguggaggggaaagccaggaccaggaagugggaguggguggguuggugagcagggggagggggaaggggauaugggguuuuuggaggggaaaccaggaaaagggauaacauuugaaauguaaauaaagaagauaucuaaggaaaaaaaagaaaaaagaaaaaaaaaaccaaggaggagaccuuacuaugcaggucuuuuuuugucccuuuuuccugucugcuaggcauuagcagucagccuccaucaugggccucuaggaaggaauugguauguguggucuuauaauggaguuagauuuuucucuauaaagaaugaggaagcauuaggaaauugaucacuuaccaugugaugaacuugagacuuagaagucacaugacucuagaaaccacagcugugcacuugugaucaucuaaguauacuuuuaaggcauuugcaggcagucauuuaucauuuuuguaucagguuguuuccucaucuuuugaaucauuuuacaaucugcuuucuugccuuuuacuaaaugcaaaaaauguaaucuuaucuucaguuaaguauuuuucucaacucuuuaggugaccaaaaagugaacaguccauguguuaaccagauguuugaggacuaauuagcuauaaucagcuaaauuccucaguggcagauacccauaugcuaccuagaagcagggaauuaauguauaaucagcaguucgcuuucagagaggucuacugagcuaccaucccaaggaagcaaacagccuguacacauagagguaguguagcaggcaggccauuuuuuuauuauaguuccagggcguacaaacucaagacaaaguucugccuuuaaacaaggaaugccuugggaaacugagagagacaaaggagugacaauuugaaucugaaguguucagguucauguguuugaauauuuggugcccacuaggugacuagggaagcuauagaacauuugggaccguggccuugccagcaggagguggucucugggagugaggauuuaaggugaugugugcuccagaucccaggcuaacuucucugcucccucaucugccguuuugugaggagcugccuacgcacauccugcugcagugguggacugacuguaucuucuggaacagccgacauaaaucuuucaucccauuaaguuccuucugucgguaacaucaauuagaaaagcaacuaacacaguggccaacccagaaauccacugcccuccuaagcaugcccccuuugcacauguguagguagucagacuuacuuuaaaauaguugugaugggggaaaaagcaaaaaauuggacuguggaccagugauaugagaaggcacaguuuuggguuauuuuggguaaacaugcaacucaguucuaaaaccuagagaccaaaaugcuucauuacuuuguguauaugguaugcaccuguguuggcaugcuuguauuauuugacaaguaucccucagacuagccagcugcauugguuucacuccucaggccuuaauuauauauauugucucaugaguaucuagucauugacuuaggggauggauucugaaugcguuuguuauuguguggaugccgcuagugucauucacuucauaucuugauuuagucuggggacauauuacaugugauauguaugaacuugcugccagagucacacagcaaccuuuuaacaacagagaaguaacaucgacaguauguagccacaauguaacuguguuaaaauauuauagucgguacauaaguauauaugcuguguguacuuuauacaucuggcaguauaggguguucaucuguguaagcaucuucaugaacaagugaacacuuucuccacagcauugggguggcugugguggcacuaagaacuacauaauaaucuuaugggaccaccaucgugauuauaguccauuacugauagaaacgucauuauacaggaugugauuguguuuaaggugugacaccuaaggaccagugacaauaaugaaaguaaagaaacggucuugggucaaguuggaagguguuggucaugugacucaagguuauuuccuagaaauauaauuacugcacauauuuccuuuuuaaaauauuguaucuuuccuuccuucaugccucuuuccuuuugcauuuuugagauuguuugguauagcaagucuuacccagcucuaacuggaccugcaguuuuugcuugcuaguauagggcauuuuaggacaaagacacuguuaaaagcaugggcauagaaacagacgggucuuguuuguuuuggcagaggaaacugcuuuccccacuaaguagcucuggcaagaucuacucucugaaggugaucuuccagccuaaguucccagugagaggagcaagcuaucaguuuuuccucaugauguaugcaagcuucuagaagcuguuaccauuggacaggacacacuuugcagucuuuuuugaaaaggccacucagaaccuguaagcugccaggugggacuaggagucucuguggucuuguuuaaagacuuagaggauggcuucugccagcacgguuggcucagccucuggcugcuguagaaaaacugaggcuuucauguucucagguccuggucuuuaguauuugauaaguaagaacauagccgggugugguggugcacgccuuuagucccagcacucgggaggcagaggcaggcggauuucugaguuagaggccggccuggucuacaaagugaguuccaggacagccagggcuacacagagaaacccugucucgaaaacaaacaaaaaacaaacaaacaaacaaaaacaacaagaaguaagaacauggacucagcucuacaaacuguuuagauggacguuggaaacaugaauuucauauugcuauuaugugggaaugccaguguugguagcuucuugcugcagaauagacugaccauggagaaggacauuggguuggugguuuaagacagucuuggggcagaucugacacuugguugaccuguuuuugguauagcacuugccuguuucacaagggguggcaggcucccuaucaacaccaauacagcauuccuccgagcaagcuuguugaccuaacuagguacagcaaauagccagcuuacucugggcugcuuacuggguugugugggcuuggggagugggacacaacugcuuaccuccagucaaggucuaaaaugaggaaggaaagggaagacaguaaacuccacgguguggugucuaucacccauuguucagauuggagucacuuguuuuucuccuuguaagaagcaagggagcaauucauuauaacaggaggaaauuuucuugucuucagaggguuccagauuagaacugcaguuuccuuuaaauggcaaugaugugaagguagccccagaauauuauacuuugaaaagacaagugaagaccccuuguuuuaauguuggagucacagaaacucagagaggccaaaugguuuguugaagggauacauugcuuauggaaguccuggaugagaguccaagguguccuuggaauuuacucugcauauagauucacccuuuggaauacauuuauguguugauaaagaacauuuucuucuuggugcaccauuaucuucccaaggggucuggcaugcccugacacacaucauagcagagaagaguaagcaaggccagcgauagagaucagagaguguggagucagacugguuacuuuaagccaacucccugaauuuuauuauuuuccugcuuuuauaaaaugaaaaaaaaaaaaguuaacuuauagcgauguaacgauccaagugugauaguucacaucagucucaauacauauuaagugugggcaucguaagugugcaugcguaaaggucaaaggucaaugucaggugucuuucugccccguguuuucugagauaaggucuaucacugagcccagagcuuaucacuuuggcuggcuagucugcaagccccaggaaccuucccugucuucaccaccugccccagaacugggauuagauagacauggcuuaucacacccaguauuuacaugggugcuggagacccaagcugaaguccucaugcuuuuuguggcugacacuuuacuaugagccaaucuccccagcacccuguaaugauuuucaagauauagcuauuacuauauguuaauacauggaccaaccguuuuggcuuucuuuucuuccauuuccuguuuauugucauuuaagaacccaaacaagacccaccuuucugugaaaucucagugaagucuuagcaggcugguuuuauuuuguaauacuguugugugguuuccaaaucuguagagccuauaacaauuuacuucuuaggcuuguuauaaaacugcagcuauagccccagaccuuaguauccuucugagucgcucucaaguuuucuuuguaguucucuuaucucuccauuuuuucugucuccauuuacaucaggcuccagugaggguugguccuccacagugguuuggcugaacagccaagagcaagccacuugaagacagauuugccugguugucaccucauggaacuaccaaagagauaggugcagcugaaacuagagcaccuccagggaccuggggccuauaaggauugcccuuggggccuagugucugcuucaggcccgaggcuggguugagcugggcagguagugaagccuguccucaggaauggcagccagggcugguacagaggaaggaugggucuggaggcugacgugcagagaaaggagggaaggaggcagaagcagcuggaggacaaaagcuggauacuaugaugacccauuguaaguggaacaaaguuccugacaguaaauacauauucaaaggaguaugcaggcuuagaauagguaccccaguuauuguaugugugcaugaguaguucccccuccccuacugagguuuucagucaccccuuucccaccucucuuuuguucuuggcucuguuugacucauuugugccacagagcuaaagcaggagagcugucacuugagacauuugacuugcccugauagagcugggcuggcuacugaagaacaauuccuucgguaaaggaagcuuuggucugucagugacugugugauagcaguaauaauaaugauuacagaggcggacccuucauugacugcuucugugcaccagaugcauggaccaucucauuuccuccacucaagaguccugaggcgcaguggaauaagcugcagacaggucugguuaauagaugccuucacugugaugcacccaaccucuugauaacugcacuguuuucucccuuccuagguagcuucuugaccucagugugcugccauuuaguuuccuggaacucaauaauuauuucagagagcuauguuucuauacugcuguuauaacaauauacaauauagcaaauagaaagugguauucauuacuaauaauuguguuguuuuuguaaacuuggcacuggaauaucuagauugugcaaaggcugucagcagguggcagugagagggaguaaggcaccugggaagacacugucacuaacugagugaaauugccuagaaagcuagagauccugucuuugcaaaccuauagagauggaugcaagaugacaggaaagccugccucagguuaggagcagggcauggcuagcaauuuacaguuuuuaccaggcacagcuugguuuuauugaggaucaaucacaaggaaaccccuuccuguggagagucugauucuccacauguuggggcuuuggagcuuuugaauauggucaguaaugugguaugagacuuucuauguuuugagacuggguucacuauguagaucaaguuggucuugaacucacagagauccgccugucucugcuuccuaagugcugggauuaaacacaugcaucacuacgccuggccuauuguuauaauuuuuaaauuauuauuauuggugaguguguguauaugugugcacacagacaguaugauguucuuuguaguggcugaugguuaagauuugauauucuaagguugcuguaucuguuccucaccucaaggcccauuccucaguguauugucccaugaugcuuugacagauguggguucaguuauacaggucaugguuucuugaacuaaacauuccagguucuguuuguucugugauguugcauaaguuuacuacaugcagagccucaguuuuccugucuuuaaaugggguuauggugaggagggcacgugugcuaguguucuuaaagugcuuaguuagcauagaguuuggcccuguaucaaaugcccaguaauugaugguugcuguuguuagcuaacagccagugagacuuugaaagacugaaggcucugccagaaggggaaauaaacaagcaaccaaggagcagugcccacuagcaaagaacauacugacuucugacuugagaccacugcucaaccccaccagaaugggaaccuuuuaaagaaaggagccaugaugggagaaagcugaccuucugucauugugugauugaucaucuguccacauugauuuuccucuuucucaucugcugagcauguuaaaagccuucagguuucaacugguuccgcuguaucaggucaucaaaagaugcuuuuacauggaggcacagcagaguaaaugagauuugggccucuaugggagccccaucuguucugcucuuaccugcaggccuuggcgccaggcuuuggagggagcugcuguacagaagcaucuguccaguggggguggggugagcagccuggguaggugggucagaugcagggcaggaaauccucuuaccucacccgggugcugggccuccugcagcaggaucugagcagcaaacacuggugagucagccagccugggaauuagaguugccagucugugagcaugugggguuuguguaaguuugggccuuuuguuucuuucagcaauccagucuuuagaaacacaaaucuggaaaccagacccuccacaugcugcagucuuucuuguuuagagagaauucugcucgaacaauucuucuccaagaauuaacccuuugccuuuugagauuugaauugguuucacuuauggcuuacuacaugcucagcguauaacagccugugagaagccaugcuugggucugucacuuuucacagcgaaagcacuuuuaagaguuucuuugugugucuuguuuuggcuuaagcaaauugaaacugccuuucuuuugagggcauguguagacaugucuuuuguuucugaggguggagaauaggacacacccuuauaggagucugccuaacuacaggaaugauugugguucuuuuuagaugacuauacucucugcuuccuuuuagagagaauucccuuugaagauaacuccaguuuauccaggcacuguuugguggaagcuguuuauuuuuuuauuuguuuuuguuuauucagcuuuucuuaacaacugcccuuugcccuaucaccagacucuuaagugagcucugacuuugcacccugaagaaucaugaaggcuccuuagaagugagaggcccaagucuggcugacacugauuuuuaucuagugucugcuuucuuugcuacauucuacauacuaacagacaguggcugcuauuguucuaacacuuagcagaaguuugcaaguauuaaaucauaaauggauuuucuauuauaacaaaauaguugaugguuaauaacaacucauaaguaugcaguauugaaaauugcuucugcuuuuguucacacauuuuuagcaguucauauaaaaacuuaguuaaaauagauauugcucagugucaguguagccuuuugauccagcaguuuuaucucuuagagauuguauuggguguggagacacaccuagguugggaaaguaccuggaguacaggcucuauguagguggguggaacaggguggagcuaggacgguacaccuuugugcauccagagauccaggcacacugcacuuugcuguuugucuaggccccugcuuguaguuuugacacuucuuacuucaccauuagaccauuaugcgauuacagguggccuggauauggccucaucucuauucuacuagaauccagcuugacagaguacaggugagggguuacugucaggagcaugaguaacccuaaaauagcuacagcaucuuguuacugaagacuugauggagguuuccucauggaguccugcuuucaguuaauuuuccacgcguagugcagggucuguaagggggcggggagggaugcuuguggugaggugagguuccuuuaacucuccuugcuuccauccuuuaccauuaucagagacucugcuaccucuguauuguucugcucaauuaguugccauggcuaccaggccaaggucauuuacccucuaagguguuccuuauguugugcugagaguaaaaguuuguagcaaucuuuguugaaaucugaauguguagguauuagguauagaaccagauguaaacuuguggcuuaacucagguccagauaacugguuuuuuggucuguuuuuuuuuuguuguuguuguuuuguuuuguugugguuuuucgagacaggguuucucuguauagcuuuggcuguccugaaacucacucuguagaccagacacaaggguaagcaucccacagagcugacuuacaggagagguaauggugagcugggauaggguucucuccccugucucauuguuagcucagugaaauagaguguuaacuauuuuguaauuuccuuccagguugccuggcuccucuaacugauggcauguugaaguacaugggccaguggcagcgagggcauuugauccagagggguccacucuagaggccaggguacuaccaccaugggccagugugucaccaagugcaagaauccuucaucaaccuugggcagcaagaauggagaccgggaccccagcaacaagucacacagcaggcggggggcuagccaccgugaggaacaggugccaccuuguggcaaaccagcuggggauauucuugucaaugggaccaagaaagcagaggcugccacugaggccugccagcugccaacuucuucuggagaugcugggagggaguccaagaccaaugcugaggagucuucuuugcagagguuggaagaacuauucaggcgcuacaaggaugagcgggaggaugcaauuuuggaggaaggcauggagcgcuuuugcaaugaccuauguguugauccuacagaauuucgagugcugcucuuggccuggaaguuccaggcugcuaccaugugcaaauucaccagguuagucacagaugcuuucaugucaccaggggagcagaggaggaaagugugacacuggauagugguaccaacuaggauagaacugggauggcuucaguuaucaaguagcaguugcauaauuugucaaaguuauguauccauauugggguuguuuguuuguguauaagaauaugucagggucauggaagaccaugguuuuaagagugcaggguuaugaauaagaacugacuuuauuuuauuuuuuuaagacaaggucucacuauauagcccuaguggccaggaacuggauauguagaacaagguggccucagacuucagguucugccucccugccucuugagugcugggauuaaaggagugaaugacuauaccuggccuggcagaaggaacuuuaaaacacagcuaauauauaugaccugcucaguagaguaguugccucaccaccacagucccugagauaauuaguaugaaacucuguuacaaacugcaaagugcugaauacauguuaaaaagcacauaugcagcuggauguggugauaccugucuguaaucccaacccccaggaggcugagacauagggguagaaaauucaagguuaguaugagcuacauagugagguccuaucuuauaaaacaacagaaacaaacaaaaacaguaaaaaaaaauuuuuuacuacaguuuugguaguaguauguaauauguuaaugugcauguauacgugcauaugugucaugcuuuaaaugugaaggggccagaagacaacuugagggauuuggcuuucuuuaccauguaugcucuugagaucaaaauuagguuaucauucuugguggcaaguauauuuaccugcugagccaucuugccaugccccagaaggcacaguuauuguuguuggguuuuuucuccauuuuauuuuauuuuauuuuauuuuauuuuauuuuauguauauaggugucuugcccacauuguauauuucuuaggugcaugccugguauccucagaggcaaaauaaaaguguguuaaaccccuggaacuggauuuauaggcugcuaugaguugccauguagguugggagaauuaaacugggcccuaucuaucuagccacccaucuaaccacccacccacccaucuauucucgaggcaaggucugacucuacagccuuagcugaccuuaguagacaaggcuggccuagaacucgagauccugucucugccuucugagggcugcagguugggaggauuaguugcuguuaacugugcugucuugccucaucauauacuaaaucacuuuuacuuauuaaucauaccuuuuccuaccugucacaggaaggaguuuuuugauggcuguaaagcaauaagugcagacagcauugaugggaucugugcacgguucccuagccucuuaacagaagccaaacaagaagauaaauucaaggaucucuaccgguuuacauuucaguuuggccuggacucugaagaagggcagcggucacugcaucgugaaauagccauugcccuauggaaacuaguauuuacacagaacaauccuccaguauuggaccaguggcuaaauuuccuaacagagaacccuucgggaaucaagggcaucucccgggacacuuggaacauguuucuuaacuucacucaggugauuggccccgaccucagcaacuacagugaagaugaggccuggccgagucucuuugauaccuuuguggagugggaaauggagagaaggaaaagagaaguggaagggagagguacacucagcucagggcaagagggcuuguguccagaagagcagacuuagccgcucuguuccaggagcagcacugaggaucugccugcugcccugcagccaaaugaggaauuggaccuuucuggaaauuacugaagauccggauauuuucuacuuuacaccuuucucugccuuguauuugaaagggcucuaaaaugcuguaucauguuuuaggcacuuucuucauuuuuuuuuuuuuuuguuauuuugguuauuucuuuuuugggggugggaaaucccccaaaauauuugaaccuggcuacauguuguguaccuuuuuuugaagccuucagauagaauaagccugccauuucuugcacaacuugauaggauuuguuuugugggggaggggaggguguagcccggguugggaguggguuguuagguugaauuaacauuacaaaaugaugcagugccagaccucaguuuugcauauuauuuuucagggcaggucuguacuguguguagugcuguuuacaugguugaauuuagguuguaauaauuauuuuaaaagauuuacacagauaugaauauagcaguguuaacuguuagccacauugcauuaauuuccagacaguuuggagcucuuggagagccaaggccaaggccagucaagagcauuugcagucugacaccccaccccgucccuuuaagcuaauuuauccaaagcccugucucccucacuucuugcucauuccuucuuugaccuauugcauuucauauuuaacuuacccaucaucaugcuguaccugucagucaagugagcaguuuuguuuuguuuuguuagaacacauuguacugaaaaccacuuaagcauugaaugcagagaaagcagugcuaccucaguuuugcuggaaguagacuucuuugauaguuuucuuugauguuuuuguauuuucaugucauaaguggaaauacuucuuuuucuccccuuuucauuugccuuggagccaaaguuuccguucuggguggugagaaaagugugccugccagccgaccugaaagaaagcgguggcauggagcucugcuucaaacuguuuuuucucuaguuuuguugaguaucauuagcuuacuugucuggcaagugcagaagccugaggcuggccugaacucugccaaacaaauuauccacguguauugaaucauuaaauugugugcccucucccucuuugcugcgcccacguugucacuuaaccccuaggaauuauuuauugucuuuuuguuaaugucaagcucgguugggguaacguggugacuguuuagguuuacaugacccucuucucuuucccuuaccccagacauguauauauacauauauaagauauguauauauuuuaccuuuauaaaauauauauauauacacauauauguaucuauaucccuuuguuugucugcuaaaacuggccaugaaagagggagcugccuucaaucuguaguuuaagaagaugccagggagcaucauaaacggaggcuauuguauauuaauuuagacuuuuucacuaaaaagaacaugaaugaauuugcuugccgaaggaggaaccaguucucuagacuccaugcucacucuacaaggccagcuuuggucaagcugccacuggggccugaagagcugacucuguccuaccuuauuccacuaaaguaccaucuugauaauuuccccuuaaaaaauauucucaaaaauguacuggaaaguggguggcaggagcuuguacaguucagcuuccaacauuucggaacagauuuaaaagggaaucuuuuaauaaauaaaaguuacaaaaauauuuauacucuugauacaaugaaaaagugucuauuaaauauuuggaauuuccucccuugauuagucuaccccaaauccuggguacauguuucucaaccuggguaagaauugcaugcuuugaguucuucaugagucuuauagcucuaggcacuuaucuuuauaaaaaugauuauuuaaggagaugacagucauauuucuuaaagucgguauugacacagggaacauuuuuguaagccucacaauuguccuuccuugagggaugagaugaugaauaucagccacagacuuacgauagugcuggaaggcccaaguggcuguugggccagauguaccccuuuuuuuucuagccagaauaagaugaaauccuugaguaagaauccaggagcccaguaguuucugagggcacagcuacauuauaacauuugguuaagaucucaucuagccaguuaguuguuccuaauucaggauuagguagaaaucuaaugagggaagagguggaguuagguaagacuuucugucccagauaagaaaggguguauguggggaaagugccaagagggaguuugccaagggccccauggacucaaggaacuagaucuuuuccucauuggguagagguuuuuuuaacugcucaguuucuccaaucccaaugccugcaccccaaccccagccauuuagaaauugugauuauauuuuuaaucaucuguuguugagaaaccagagaaaggaacaguauucagggagggacuuuggguuuucuguguaguugcuuugcuuugccaagagauucucagugagguguaagguuugcaguuaacacuucugggaaacaaaaguuucuguuucacucacccucagauaggcuugcugcuuauuggguggaugagcaguggcugggagccaaauugcuccucagguuagcuagcuuuguggcuucaggugauuugggaaggggugauaucagggugccauuuuggaauucugcaaugucuaagcauuacuacacagaccguuggaaauugcauacuuugggcaaaugacuuuuugaguuuccaugguaauucuuuaguaacuuauuagcaagcugauaugagauaaaaaguuacuuuauugaauucuuucccuuagucuuccuugccaaacuugaauguaucauucucauugacgcuuugcuguacuucuggggguugcuucagcagcucucucuucauuguggcagaugcgccaacaugucuguuggguccagaagucuguauguaccuaucugauaaagaaguucucagagcugacugaaaauccaaauuucagccaacacuuugggccaagggaaagauaacagaaaaugugcaaagcaguacuguucauauuagaagggcagugaagaauuaccaugcacacagaauuagcuugaaacaguacugucuccuaggguguggucuccaggccagaucagguuaugggaucccauagauuauguacguagacugcacauuggugggaaguugcuaagauaaagacuuguccaaaaacuaacaaagcaaaagauguguuuauuggaauguauagucugcuguauuucaaguggggucuucagugcagcagguagaccuaguuauacaguuauguaagggauagagaacuacuguuaaaagguuuuuauccccucucaccacuuaaucuccuauguauguuaggauggcuagugaugaccugaacaucuugguaacagacagaggucuuaccuggaggacuaaagcaguacuuagcuuaaauacuugaaaggacaaaguuaucaaaauacguugauuaggauuauuuaaggucaugugacacugaucuuuucuucugggucacguagaggauagguucuugccacacucuuauucagaguuuccuugguaagcuguaauugcagcccauaccaguuugaccuggcccaggacuacaugcuggggaugcucaccaggagucgccccuggucucagccccucuccucuuuauuucagagaaggaugcuugagcauugggcacagaugcugaggugguuugauuagcugaaaaaccaaguucugauucagguguuggggcaucauguucuguuucucuuggaaacccagccugcucucauagauaccuacuuccaucacauauccugagcauugccaaaagaagccauuuagcagcugcuguuuuucucucagcacaaauauauuugcuacagaagaauucucuuuucucugguccugguccccagaccucagaaucuguuaacugcucuucccugcugcacugaauaugguucuagguuuugaagagggaauuugaagcaauaggcaaucagggcuugguugaauuggucuugcauauauccugucuuaauccucugaggugaugagacacugcucaugugaccuucuaccuuuguggaucccucuugguuugugaccuucguaccuucccugagguuguacaaacuugacaaaaguuaauacuuuuguauucucugcacuguugcacucuucaaauagcccccugaauauuaacuugauauacacaucuuucucuuuuaugucuacaguauuuuuuccuuuuuuuuuuuugaagguuaucugcuguugaauucaauaaauuuguuuaccuaauuauugauauuucugcagaaaacaaaaaacagugaauuuauucugagguaaaguuuaucaacccauugggaaccuuuuccaaugugaugcuaugcuauauuaacaacuuaggaaaaugacccauguaggauaggagucuuccuccaugcacaugaaugcuugcuuagaugcccauuacugaaaucaucuuucuuaccuuagguaucacaguucccaugagaaauaaaaagacaguuuugagcucuauguuaaauacauggguggucccuaggucuaauuaggcuugcaaugauuaaguuuauuuuuuaauucaucugcaaaauaaagggcauugguauuaggauuuaagaaaaagucugugaaacacc

SEQ ID NO: 4065 - RNA, 2179 nt, Mus musculus
ccaauaugucaugguacccucagcuaaacaacaggagcaaugaucccuggccaugaaugcugucaaaucccauuacaacuaggugagccauuaggauacuauuuauauaagauggcaugacuaacaagcuaagagaacuauccuagcccuccucuaaauacaguuagaguacuccugccuucucuuguggaaacauucuaucucaucuucauguucccaaggaggaccccuaccuccuacucuacaagcacaaugugccagaauguacggccaacucgucgggaauccucugcacaguaaugacaugaccgauccucuuccagcucaaaagguauuugaucuaaaccacauccuaugaaacugaaaaacuagacaugaccagaguucuugguuucaauuacccaauuucccuuuaagugcuaaaugccaauuuaggaagaauucaggugucuaagacagaaacuaaaaaugcucauguuuaucugucuuuauuauauauccuguaaggguuauauacaauccauauauguguguauauauauauauauacacauuuuauuuucuuaacauucauuuuuauaaaugcuuacaugguacauggauacauuaauauagagagagauaaauaaacagauacuucaaucaaaauaguguccaacauaugauaaaaagcaacaagcaaggaguuacugcaggcuuugcaaagguaucucuugccgggagugguuauaugugcuuuuaaucccagcccucaggagucagaggcagauggaucugaguucagcauuagccaggaccacauagugagaccccugucucaaacaacaauaaaaacaaagaagacuacuuaguucuucccuauuuucuguccugcccaaauugcuaccaccuaagggccgaugcagagcugucuauuuuggcugcccagacaggccuuacuuuagaaaauuuuaagacaaacaauagauccaaaagcucuucuucuggucaucgauacauuuaacaaccugaaggcaacuacaggcccagaauacaaugugcacguaaacacauguucauuuugcaucuaguaacaggggguucaaagaguugcaugcaucaacugucaccagcuuuacauguacuucaaccacaucuaauccuuucacucagaucagcaaugcaaauacuacagcuccuucagcuccuccugaaauccucucccugccuucuagggagaacagggcaugcaaaaucgcugggcuuacacaucagaggccuucccagcucuccaugggauacuuuguaccucagaagagcacuuguaccagaugugucucaaauacugaaauggagucaaccaaguuauguagcauuguacucuaaucugggacauuuauguuugucuuuuugcuuguuuuugcuuucuucauuuuaaugguuuagauuuucauuuguuuugcuuuguuguuguuugcuuguuucuguuguuugcuucuagaaacacggccuuaacuggccugaaacucaagagaucugccugccucugucuccccagugcuggaauuaaaggcaugugccaaccaugcccagcugcucugguguuuugguuuguuuuuauagauauaauuagaguccaggcugaccuugaauucaugauccuccugccucagcuucacagaguacuuggauuacagguuuguaauaccagacuggcuuuauucucugagagucucauucguugacuuauuugaucccccaaacaauacaaguuauauccuguguaccuaccucaguuuuuaggcacacaggaacuguuugcuacauaucugcugaugacccacugauagugugguggucuggauaaaaauagccuggcuuauguauuuggauauauugccauaggcuuauguauuugaauguuugguccccaguuagauauuuagagaggauuaggaagugugaucuuguuggaggaggugugucacugagguugagcuuugagauuucaaacacccacaaggcccagucagucucaguuucucucugucucugucuauacuuuacagauaaugugugaacucucagcugcugcucgagcaucaugccugccugucugccacuuugcuccccggccaugaucuuggacaacuuaacccucugaaacuauaagcaagcuucccaauaaaugcuuucuugu

SEQ ID NO: 4066 - RNA, 19826 nt, Mus musculus
cagucuuccauuagcagccuuuggaugaagucauagaacucucagcucugccugugccaugccugccuaaaugcugccaugcuccuaccuugauaauguacugaaccucugaaccuguaagccagccccagcuaaauguuguuuuuuguaagacuugccugggucauggugucuguucacaacaguaaaacccugacuaagacagaccuguuuaguagcagacaaguaccugggcuugcccuucuccccauuuaauggguaaagaagacguggcucagaaagguaauuucagcacacagucacacagucguagccagacuugggcccugagauggggccuccacagccccagccuguaguuuucugcucuaagcucaaagacagugcuucugaccuugccacauccccaaccccugggaagcauuuuaaguuaucacagcugggaggggcuguuaauguguuuguuuuuauuucguggguggagcccaggaauguuaccaagcagcccacagugcucacaggacaucucagaaacagauucaucccaucuuaaaugccaguauugacauugaguaacgaacgaggcaccucagacuuggaaccagcaaacaugggugucucuaucacggguccuugagacgaggauuugaguuuauuugugaacuuaauccuucuagcucuuccuucguuuuugucuucaaaacuguaaaacggagauaauccaucucuaagauucucuaacugcuaacacuugcauuugcguaaugacuaggaccuuccaguacaggagguaccuaacugauugacugguaugacuugaacucugggggcaaauccagaacuaguucugucucuaaaaccccuucuuugguugccaguucuccuaagauguggccccagaacuuucacuccaagccacugcuguaggaagagacugucuccaagcgcucauuuacucguuagucauccucuagaauccagaaguuuguggggguuguuccuagaguguguaggaagaagaagcaggguggccuagcaaagguggcagccgcgcggcuagccaucuagauaccggauccuucccagucgggcuggguaggcagggcggggacccaagccuggacagauggucagcgucagagcucagcaaggaagagucgaggggcggagccucugcgaggggcggggcagaaagggcggggcuucggccuuagaggaagagcgcuugcuggugaggaggaggagguccagcuuucaccccuaaucaggccugcgucccuucuugucuuccuuccacuucgcuuugcgcccucuguggcugcagggcgggguuucgcggcagccagcaccaggugagagcaaagaugggguguggaguagaggaccccggcuggcugaagccucccagcucggccugggaagcggaggaguucaggggcggucgcgggagaaaagcacuagcuuccuucgccuguuguugccgucggcuucuggguuggugaugaacuuugucgccuggaguugcugggcgcggguaggagcucauggggagaucucauccaccauuuccagccaucccgugcuuacccacuaguagcuagauugggggccggaggugggggacgugcggggaaggccaccaaugccaacccacgcagagguccuacuuccucuugggaaacgugcaugggaagauguaaauaaagucuugucucggcguccgcaccuuuucccuaggauuggucaacaagggugcuauucgccacagcaggagggagcuacaggugucaaagguggguuugccccagaugaucagugacgagaugcccaauuccccugaguucggaucuccuaguuucuaugccccguagucgugaucagacccccaucugcaucacaccgguuuccuccauggaucccuagccuuagaacagaaagucucaacccucaucggaaauggggaccaggauagauucccaggcgccccgaaggccugcccccaucuggggauucgaccggacccgcagcuggaacguucgcgguggcgguuugcuugcaagacgcgagaguccggaggcaaagcuuuauuuggaaucuuagaaggggcggagcacgaucuuagagaaccugguuaggcccccuaaaacggagaguaggcggggcaccucuaggcugguugggguggugccuucccaccuucccugugaugcugcucugaagaggacccuagaaggaguagauggucagaaaauugguggcuagguagaugagugugccugacugcgguccuccuccgcauucuuccuacccuagcuuucagcagacuccccagaccgguuccguggcauuugcauguuucccaggccaaagacgaguuguaaugguguauuuugacuuguagcccgcuguagaaaugugauuagguaaacugaagccuggggccaucuaaauucagcacuaacucggagcugcugcuuuaacaacauaaauaauggugcugacguugguucuccccugaccaaggggagagaaucuuuagcuggugugauggaggugugcauacuaggcucuguaguguagacacugguaagguguguuugcacauaaugggcaagugguauauucagucauuuggggcacugugauagaaucuacugagcgcagguuuauaagaacacuagguuagcugcaaggagauccuaugcuuuccaacccagaaagguguucuaggagacaugaaauaagaauaauauauuaauauagaauaauauuuuuauuugaaaacucagccgggguuaaaagcauaucuaauuugauucauugccauaaugaaaaaugcauaaacgacgugagaaagggacugucuuauacauuccaggcuguuguugaaucacagaaaauaauugugccaaggccucggggacaggucuuguuagugaagaccucaccacacauaaauaaaguguggcauuguacaagguucuugggagccaaagaaagaagaaaaagcaccccaagccccuguugucagagcaaaggaagccuggagugguaggguagcgagaagggggaggggugagauugaauaguacaguacaaucaguuuucuuguuuggcauaaguucucggagaauagccuuucuggaucuuuuucuacaccguguguguguguguauaaaacagugaaguguucauaauaaauaauaaauggauuuagcuuuuuccuccuaucuugcuggucuuuuuauguaacaaacaggaauaugauauacauccuaugaguauuuuucacauaucuaucuuauuuagguucauaaaaaauaaauugcugggucaaaguaugugcagcuuaaauugauaaauauugucaaauuauauucaucugcaugccugcuguuaauguauuggggaugguccgagcuccuuggagauugcuaauaauuauuuuuuuuuuuguuuccuucagcgauagcaagagacggggggacaugagagauugggcuacguacuacaguaaugcauuuccugguagagaguuuacucuagagugagacugacagacauuucaagauggccaaagaagagcccccgagugucuccagagacuuacaggagcugcaaaggaagcuggguuugcuguuagagucuuuccugaauaacucaaaggucagugcccaaugccacauauaaugggaaacccugaaaacacuggucugaacaagauuggacacuguuucuuucucaaauagaaaucuacaauaagucaggaaucuuccuccuaguacccuacuaugucugagugugaccuucauauccauguucauuguggcugcuagagcaucagccgucauagugacauucagggcaguaggacagcaggugaaugggaaggaagauuguuuucaagacaccuccaaauuaaggaagauuccuggaagucaccgagaaucacagaccacuaguuacaucccauauggugcagaauuugguuggauaguggccccuuguggucacugccauucuuuggcuggaucuaaagaagcuauucuuagucuauacagcagacacuauucuuuucuuugaaaugcuugacucauuuguuccccuaagcaaagaagccagccagugccucauuuacggucugaguuuuguguuccacuagaacuccaucauccagcagcaaugauucuugagccaugggugcacucacauuuucugguacccaacccgaacugcaaagaagcaauggguuaauuuuaagaauauauuuuaguuaauauaccaaaaauuguaucauuucagcaugccaucauuauaaaaauuaauggaaaagagaauauuucacacuccuuuuuguacuaacucugaaaucuagacuguuauuuaccuucacaggauuauugugaugcaaacuagccaugguuuuuuuguuuuguuuuguuuuuuguuuuuugguauccugucacagaucagugcggugggauuugagaugcucaguuucuuuguguauggaucuuuauuguuuucuguaugccuuucagcauguaaacagaaugcuagggcugggaagaugguccaacuggugaagcucuugucuguuaaucgugagauuacaaguuugaauucccagcauccacacacagauggccauaugagaacaucucccuaaucccagggucccuauggcaaagugggagguugagacagcaggauccugggaagcucgugacuagguauccugucuuauucagugcuagaacaacaacccauggagacccuguuucagagggucaggugaaaggcaagggcuagccccugagguuguccucugaccuccacaugugcaccauugcauauaugugcacucacauacaugaaagcacacgugugcacuuauacaguauaugcauauucacaaaaagauuguuaaaaaguaaacaguagggggcuggagagauggcucagugguuaagagcacugacugcucuuccagagguccugaguucaaaucccagcagccacaugguggcucacaaccauccguaacgagaucuggagcccucuucuggagugucugaagacagcuacaguguauuuacauauaauaaauaaauaaaucuuuaaaaaaaaaaaagguaaacaguaccagcuagcuaauacuauuaccauuuuguuguauaucuucuagacgucuaugccaugugcacauaaaaguaugucugcaucuaaagugaugggaacuguuuugugauuuucuuucccuauuggacaccauaguuuuaccagcuucuauaaaacacacacuuuaccaucuaaagccauaugcuucacagaggccuucuuuggacuugcuucagaaugcaauuggcauacugccaguuuaccaggcuauuuuuaagauggacaagcagcuuucuaguuaguuggcugagacuucuuggauguguuaguucaguaagaaagguccucguggccuuugcacauuuauaguucauucucaugacuugugggaaaucaccauugacacuggcuuagcaaguacuuagcaaaucacgauucugcaggaaacaaggaacucagguccugcaaguuucuagucccaguguuuuuguaaucagaucagugcauguccuuauuuuaugcauauuucuggaaagaugcauuaauguauauauuuucuguugauuguugacauugaacuuaggucuagcacgaggcuaauuugugucuugagcaaacaugcaugcauuuucuucauaaggaucaguaacaaaaagacacugcugcugcugcugcugcugcugcuggugguggauauuuuaaauugcuaagcagaaauuaagaaugugaacuuugggcuggagagauggcucagauaguuaagaacacugacugcucuuccagagguccugaguucaauucccagcgaccacaugguggcucauaaccgucugaaaugggaucugaugcccucuucugugugucugaagacagugacauuguacucauauacauucaauaaauuaaucuuaaaacuaaaacaaacaaacaaacaaacaaacaaacaaacaaaaaggaaugagaacauuguggcauuaaauaggccacuaugcuguaauuuggcuccucaguaucccagaaaggaugagaccaagggugaaguugaggagagacgguacagucuucuaggauggggccucuuaucucgggugcacacauaacaaucugggaauguucuugucagaugacuugaucuugacaucaaagauguucaaaggacugauuuugggguagagauacauuuaagugaguagaaaaaucuucagacaugguauucacagaugauaagaacugucuguguguuuauuaaccugauggaggccuuacuaaaucccaacccuguaccaggcauuuagcaugucuuaguuaauauuuauaccugccuucugagguaggcauuucaaagcagauggacuuuauuuuauucuucccuuccaacaacucagcuguaugcagugguguagauuugggcuagauaauuuccaggcuagccuacucccagacagauguggaaauggucaguucucuaugggccuguuguucucagguagccuugagauggaguuauuauuucuccugcaaguuuauaguauaucaaaguagguugauugucauuuuaaaaacuuuuauguaauguguuuguaugcguugaaugguacguguaugaaugcacgugugugggacacaugugugcagugccuggagaggccaggccagaagagggcauuggaucucuggaacuggaguuccaagcaauugucaguugcucugguugaacugaacucaaauccucuucaaaagcgguaagugcucuuaaccacugagccaucccuccagcccacagauagcgugauuuggggaggaagaaggaaagcaaagcaccuauaagcuugcauucgucagacuuucuguugcuuugacaaauacacagccgagaaacaacuugagggaggaggagcacuuauauuucuaucauggguuuagaccauccuggugccaagggcaggauagaacagagcaaguagcucacaucaugguagccaggaagcagggggauaggauggggauagacagacguacacagagacauagagauuacuucaggaaggcauaggguaaaauggagccccaggggcacgcuccugugacccucuuccuccugcuaggcuggagucuccuauagcuucacagccaucaagaacagcacaacagcuaaggugggaguggggcuggggggcccaggcuucaggacaugagucugcaggagccacuuuauauccaaaucauaacaaaaacccaucacugacagacagagguggugaucucaggugagaauuaugacccuucaguguguaauuuuuaauuuuacuuggcauggugcuguuuuaugaagugugagucuucaggauaauuuaccugugccacuagaacaucaacaaaggacaucagauugacauacaguaauuuguauagcaccucuugucucugggaaauguagaucgguucuuucucccauguaaucugugcucuucccucacaguuuaaugagcucuuugaacuucaggugagaccugauggggaugcagauagaaugggagugaaauuggacccauccugucuggggcggauggccaggucuuaguugucuuucuucuaaaacucaagagacaggaaccugcucaaaauaguuuuaagcaagcaaacaggugggaccuucagaggcuuuaggugaauucaaggcugccucuggaaucaugggagaagugaagccgagcugucucuagacuagaaugaacuaagcucaggcuggugaugggggccagaaguuacucucagcacgcccucuuccuggggcuguguagcuucucacguuagcucucuggggauuugcuucauuccagacucugcagcccacuguccuugguuuuccauccauguggacaaacgugguugccccgccugguacccuccuguccucaccuguccucaccuguccucuaacaccuggggaagaucgaggaguuucaguuuccucuucauagcaacaagaguuugguuuauggucacccaaggccauagaggugguuauugguuugggaucuucgauuucauuugaaaggcaccuggcuuauggggugcccuccugcagagggagggagcaguuuccagggaagaggaaggcagacagaucacaagugggcaggugaccucgguugacaucuccucauacaaauuaucugugccagaugauuuucuucuuauguuggagcuuuccugauaugagggacauuuuagacgacaucucccugggcaucugugugcccauaccuggauagugugcuagcagguauccagagccucgcugggagaggcugucauuguguagugccucugacuuguuacuugggcaauggcccucacuaccaucucuguccccugaucacagucagucaauuguccuagcagaguuuuccuggcugugaguagccuaagguggaaccauccugucacaaaucccagccauguagacccgacuccccacacucucaugccagagaacauuuauaaauaaaucacgcucaucugaccuuggccacauuaacucaguuggucucuagcuccucuuaucugggaugagcaauacuaggccuugggcugcuggaggagauuaucugggaugccauuugagaaggcucuugcacugagucuggcuaaugauggugcuguuuucucuuagucuggcguccuggguuguucagugcagcccacgucuguaaagcauggguaagaggcacaucuuuuccuccaaguuagcaaaugagcauugcagggcaugccgcugcaugccaagccucucaccuccuguccuucuguugccaggaaagugaacagugguggaagaagccuugggcuuggggauuguuaagcugccccucauuaucugccuaaaaccuuuguaggauauaugaaauguuagcugcuaagccaggcagguaccuuuaggggaaaagacccauacuauacacuuucaaagcagccuuugcuuuucuucagucaaaaguuacugaagaaaaugaggcuaaggaggugguuggcaggcaaaaugcaugaacacuugaguuggguucucagaaccuucauuagaaaagaacccaggggccugguaaguugguucagcggguaagagcacagacugcucuuccaaagguccugaguucaaaucccagcuaccacaugguggcucacgaccacccauagugagauuugacgcccucuucugguacaucugaagucaacuacaguguacuuacguaugauaaauaaaucuuuauuuauguaaaauaaaucuuaaaaaaagaaaagaaaagaacccaggagugaugguuuacacuuguaugugagcaucggacgccggagacugguggauggaucccugggccucuguggccuaccggucuacccugcuuggugaguuccaagccagugauagacuuuguuucaaaauaaagguggcuugugcccaaggaacaacaucugagauuaucuuuuggcuucaaauauauugcccacacauacgcacccaagugcacacacccguauugcaugcuuacacgcacacaugcacauacacacgggguggugcuauacccagagagcuucaugucacuguuuuuaugacugucugcugauuuuaccuuuugaacaugugcucuaggacccugagcuaagcaugucuccaacuguuugcaguacuaacuucuugaacugagcgugcucuggaaugugcuuaccucuaaaguguuuuccuauauggauguauguaggcucucuggaucccccccccccaugcuuucuuuguuugaagaaguguugcuuugggaauggcuccuguguucuccuuaucugcaaguaguaagucgucuuggccaugcuuauuucuuuggcuuugcacuuggcacgauagaagccuauugggauaggcuauuggaaaaguaccuggauccuguguuuaacggguaucaauguuagacauggauggauggccucuugccacuacacugugaacgucaggccagucucuccuagagaaagcaauuccuggguugaagaguuuugucguaguuaauuuucuauugcugugauaaaauaccacgaucaaagcaacuuucugaagaaugaguuuuacuugggcuuaucauuccagauggcugagaguccuuuaccaccgcauccagggaagcauggcaacaaguagcaggaauagcugagagcucagagaaauuucaguuucauaaugguguaaaucuuuaagcuuucaaagccagcccucaguggcauaguuuccuccagcaaggccacaccucauacaucuccccaaacagggccacuagcuggggaccaaacauucaaauaucugagucugggguggucuuucucauucaaaucaccaaaugguugaaucuauuggugauggggaucuuuccuccccuccccuccccuccccuccccuccccuccccuccccuucccuuccuuucccacccccuaacccccaaauaagaucucaauggaccgcccagguugaccucaaacucacaauccuccugccucagccuuccaaguacuggaaugugucaucauuacugccuuaacugucagacuccuuagaaacagucuuugcauuucuaaauggccuucugucuugggguguuaagcggucagacucagaagaggcucugaagacagaggagggauucucugaggacuagaagucagacacucuuacuuuuguaaguucgcuugcuucuuggauccccaugucaaacuguccacagguccuauugguuucucuuuugucaucuaaccuucaggcuacauuccuugccucccccacuggcccagauuugaccagucauacuuuugcucuauuuucugaaaaaucuccauugucccuuguacacucaccucuugcauacucaccccuugcacacucacccuugcucacuuaccccagguucaucuugcuuauaucgauccuuugugucggccacacucuggccacauucucucaauuuaccccuuauuuuaguuaguuuucugagauaaagcuuacauauuccaauagacauauuugagccacagauauaauuugaauguuuuuauuuuaaaacaaaaugugaaaaaaaaguaaaacaaaaugugucacagguucgcacuuaucauccuaggcuccaguuacgaggcaggagaacuguaaguccaaggccagcuuggacugcauagugaaacucugucucaaguugaaaauaaauaagggaacucauggaauuaauuuaauaacauauccuaagaaacccaauagaucccaaaguauaauuuaaguuuguaguuauaagaaauuguuaaugaaauauucuaggauuuuuuuuuuucuuuuuuccccccucaaacacagaacacaucucaauucaggugccagacuuucauggaaaauacuugcucucucgucagcauucauaaaauuuaguuugaaaaaaaaaaaaaaaaccagauuccgaugaacaaccuugaagccccccuccccaaaugaccgaauucaguagcagugaaaaggcccagcucucugucucacugccacauguggcugcugugcuggugucucguugacugcauacucuggacacugcuggcucccuuccucccaugccugcccuccccacucacugugcuuucugacauucuuuugaguaccaggauuuagagaggucaggugagccugucaggcgauggaggcaaguuuugcugagaauguaaguagaccagaccugcagagccuucaaagccugagacagcucagacagcagccugcccucuggucccacagccgcgauggcucccucucaccuucaaugccuuagcgagguggucucagaggugguuccuacugugguaccuauugcuagacagcugaacuauacaggaucucggaaagcagcaggcuagaagacauuguguggugugccagaaagauucgccaugccuuaggaggcaguguugaagcucugggacaaugucuggcuccuuugaaugaccuuaucuguuuaaacaaggcaagcccaugcuugguugccauuaccugggcuaucaacucuccugcuucuaaccugcccccaagugcccaccauuagaauuauuuggauggaaaccuauuuccaugagaaguauaugguuuggaaagacacaauuuuguuguuguuguuguuguuguuguuugcuuuguuuguuuuuccaagacaggguuucuuucuuauauaguccuggcugugcuagaacucucucuguagaccaggcuggccucaaacucagagauccaacugccucccccucccaagugcugggauuaaaggcauacaccaucaugacccaguggaaagaggcacuucuaauaauacuuuauuucagccacuggccuccaaugcccuaaggaacaagacaugggaaagaccaccuuuugauggaggaagcccaccucacuaccccagcuuccacuguuuuucccccacgguuuuuucuuauugaaaaaaaaauuuuaaucauacaauacauuucauccugacuuccuccucauauucuuccuccucccagaucuucagcaucuaccuacccaucucaguguugggaugcuguccagccugaagcugugcaggcccuacacaugcuuccacagucucuugaauuccuaugcgcaucaguccugcugugucuggaagauacuguuuccuuggagucucccacccccucuggcucuuagcucuucuguaagagggaggacuuggugaagacaucucauuuaagacugaguauuccaguaucucucauucucuguacauucuuuucagucauggcucuuuguauuaguucccauauacggcaagaggauguuucucugaugacggcugagugaggcacugaucugaguauagaagaauccgguuauaaguaauuuuauuacuauguuucuuuagcagaacaauaguauuugguuuuucccaaggcccguggccuaucuaguacaagguucuuggccaugagagcacuaucaaacauggguucugucuuguggagugagccuuauauccaaucauagaguggugacugccacagcaugugcgccaccauugcaccaaggugccaugcagacaguucacaguuguagauugcggguuuuguaguuggguuggugguuacuuuucuagaggaagguuuuugaaugaugggaucuuucaaggagugagcuucaaugccgguaaugaggagagugaagcccugagacccgaaaaguaaggaggaugcucauccuugcggaacugacuaagaucagcugugcacugaaguggccuucuccguggaguuuaguuccccauuuguuagccuuuugaagcaagguaaccuguuuauuaaaacaacaaaugguugccauuaucaggcuguguggcccacuauaacaucaagaugguaccauaaaagcauugcugugguagcaagccauugcaugcauuuaacauuuggagucgaagaucuuagcuuugaauguccaggcuuugccccuuagaaacuaggugacuccaaauaagccauuuaguccauugcaucuuaaacuucaccauacauauaaaucaccuguuuuuguugaaaaaacaggauuggacgcaacagggaccaggugggggccucauguacuauaucuccaauaagcucuugaaugaugcugaauaucugggacuuaaucccucuguuccuuggugaccuggacugugagaaccuugccuuaggagcagcaggcacauuguacaucauuguacacauaagaggguaucuuucugagagggcauguguuaggcaagaggguggugaugugaccuuuccuccucucacaggacuugacacuaggugaggaccucacauuugccacccuucccacaacugccuuauaucgcugccaggcgccucaggucaugggagauguuuuguaccgaugccuaugagccucugacuugccaaaggccucugauucuagcuguauuucccauagcuggggcagaucagcucaaucccagaggcggacguaucacuuaacccuggcuuuuuguccauugcccgcaggugguugccuuuaugaaguccccggugggccgguuccuggacagacauccuuuugugacucucaccgugcugauguuuguuaccaugucagccaucccuguuggcuucuuccugcucaucguggugcucaccucgcugggugcucucaugggggccauauuauuggaagguacucuacccaagguuccugggaaguaacucaauaagccggacaguauuuacugaccaucugccauucucaucaaaggcuccucuuucugguccaaggcagcuuguuagagugguuaaaacacagggucaucaaugggaggagaggcccauggucuugcaaagauuauaugccucaguaugggagaaugccagggccaggaagcaggaguggguggguuggggagcaggguggggggaggguacaggggacuuucagagaggaaacuaggaaaggggauagcauugaaauguaaaugaagaaaauaucuaaugaaaccaaaaaacaaaacaacacaggcucuugugugcaucccucagcaucauuaugauuugagacauaacuuacuccuucugagccuuaaauuggacaggcaacaaaaugagcguaauagaguuuguuaacaguagggaaagagucaacaagggguccagcuaguugaggccuacucagguguugaacuuguaacuauuuuacaugaugucagaaaugugauuuucuaugggaaaucugcugacuucaaaaaauuggagucagcggucauuauuuuaaauaaccugggcugggucuucucauucucagccuacuucagaugaagguaccuccuaaccacgcucuccuccuaggucuggucaucucaguuuguggucucucacuucucugcguccucuguggccugggcuuccugucacuugccuugucggggauagccaugauguccuaugugguggucuccugccucaugagcuacugguuuucucccagguaaaauacacgucaaugggacaaccuaaccuuggccguuugggggauucacacauauaacccucuaguccuacuugaugucuagaagccaaauuauaagaaagagauguuccucacaguugcccguagacauugcaugucagcuacacaauuacaguagaguuucauacauacauacagacauugcuaaccucccugguccuucacccauuuagcucaucucauugcugcaauagcuuccuaggcaguuacuaauuauucuauuuaaauuacaaaggccagaaggggccagaguuuaggaggguuggaaggaagguaaacaaggaagaggcucaccuaucagguugacacaccuaccuccaagggugguuugagaggugggaagcugcuguccccacaguuuaccuuggccuccucagcucagcucagcaagaacuucucugcauggugaguauggcucauguuuauuauguagaguuuccuccccuccccccccagcaccccccccccacccccguuccccgucccccgucccccgccccccauacacaguauggugccugggucuugacuggaggagcagugaucucuuuagaggauggagagaaacccaguaguauuggaguaccugggagacgcucuuuuguaaugugcuacucccugcuccuugagggauuuccaaagaccacuuuuuugauucuugauuuuucugcuguguauggauuuuagauucuuagguuccuagguacugagucugucuuguucuuguuaaguauuggcuuagcgccagagucucuacugagaacuuucuggccccauaucauguaacucuaggggugagccgcauucugugcuaggaaaaugaaagccaaguaccaaagcugagaauagcagagaagaaacuuaaaucuagguccauuaagucugguaagacucucaaccaaaauauaaagcggcuguaaaggauaggcgaacaaucucugccaugauugauuucccaguccaugcucuagaaacccauuagucuccugagcuucagucuucuuacaggauagcccuugagcaucuuaacaaaaggcuccccaaccacuugucuagauggucagcauccuggcuuugauccccggcauuuucccucuccccuacaaagguuguccugucauuugcacauguugaugucucugugaucuuaaauugcucagggcuuguucucagaagauugcuuaacugauaaccccuggaaucguagccagcuuagccuaaguugccuugaucaguaucaguuuuaaaggacaaacagugcccuauuuggcuagugcuucgagccaaaaucccucccugcccuugaacucuguuuuaauuaggcuccaggcuuagcauaaugagaugcuccgcggaagcugcugagucccaggagaugagucaggagucccagaaccaacauaaaaaugccaggcacaguaugcacuuguaaccucagcacuggggagacgcagacaaguuagacugcuguggcuugcucgacaaccagccuagucuaaucagaguuccaggccaaugggagauccugucucaaaggagguaguagccaguguucuugaggauaaugcaagugaacguguaccuacacauacauaugcacauucacacacauguauguauacacaggcaagugugcauuuaaaaagagaagcaaaaucagaccgguguuuguugguggagaggcgugacuugguucuccuccuccccucuucccagcugagccggcaggcccucucuucccaauugggcagagaugcucuacuucuuguucgcuggacucacuuuacuuucucaagggcuauugaaguggguuccaguacuuugauaauagucccacugcauauuauaacagcaacuacaaaacugacuauucacuuaagaggaagaauguuaccuaucuauaaaaaauauuaaugaaaugauuguguuuuacaaacaaaaugaauuuauccaggucacgcugccuuccuuauauuuuaucaauagcuuucucuguuuuucccaccuccagcuauauggccagaguugauacaguuuaggcuagccucagucucucaauccuccugccucagcuuucucuccaagggcuggaaccuuaggugcacagugccaccccuggcuguaauagaucuccuaacaauauguucugauggaaguagcgaugcuagcccuuauacccuguauuuguaccacggagcauauggucuagaggaaaucuuugaagaggucugagcuucacagcacagcuggggaaggggaaacccuucuacagaggacuguggacauuucucugauaguauaccugaacucuguaaugauauuugcuucauuuagugaaaaugugaauuuuuucauccuucuaauaauacacucaaaaguauaucuguagcauguaugguugugauguuauaccuuggaaaugaagagcugugauaaaugagguacccuuagagaacuccuguauuagggaaaucuuuacucaagauaaagaaaggcgcuccuugacugacccaaagcacaagagaagaaagaggaguuagcaauucaucccaugacuuaauguguuugaucuuaaaauacgaaaaugaugcaauucuucuucuucuucuucuucuucuucuucuucuucuucuucuucuucuucuucuucuucuucuucuucuucuccuucuccuccuccuccuccuccuccuccuccuccuccuccuccuccuccuccuccuccuucucuuccuccuccuccuugaaaaaggaaacacauuuuaagauggccuucuuuaggaaaacacacuagacaguuuguaagcaaugcacugugaucuucucuguagauaguuuuaaugucaaaggaucucgagagacuucuuagagccuacaggcugggggagggagaagugaggggccugggcagcuugugucuuuguggagccacucaacucauuuguucccugucacacugggucucccaaaauagccagaguggaccuggcuuugucacacccaacugaacccaauaccacagguagaauuuagaauucaggcaucuggggcaagcacucuuugggucuuuaaaauuaucauuuaaauuuuuagacaagggcuugauacacugaucaggcuggccuugaacucacucuguagcccaggcuggccuggaacagcagucaccuuccugccuuagauucccaggcagccaggauuacggagccugucagacuacccagggcuuccucacaucuuugcuuauaaagaguaagacgagcaaaaguuuccugguuuugugaccagcuaggaauguuuuuuuuaaaauagcaauuaauuaaaaacaaaaucucucaagcuaaacacuaacucaaauagaguuuuguuuuuaagagauggagacagcacagggcugguacaaccacuguguggugucaccagcauauucagcgccuucugccuuucugcacugccauccuuagcccacggguuugccuccucauggauaacugcuccagcuccagguauaaaccuguguucaggguugggggagaggcaccugugagacagcgcagaggcaugcaagggagcgcuagaucacuuccucauucuuccccagacacaucauuagccagaacuuugucaggugccaauucagcuuggagagcgagaguccggcuuucucaccuucuagggaaggagcucacagaaaaccccaaagugcugcacacauacugggccauucucagucuugcuccugagcuaacugcuuugucuuuuuacuuauccagcaggccacugacacagcaaaaugccaacgucgacugucagcuggcuaugaaguucacggagucugagaggcucauauuuugagaggcaugaccgggaaugacgggccaaauggaaucaaagauggcuuccuaagcacccagaggagagcuuguccccucaccucucaggacugcagggcagagagagggcuggaugggagcccugcuucucugcucacuguguccagacuccugcaguggccagcguggccuccccaccccucacggcuccccaguaugcagccuugaccuuagcagaguggugggcugcuagaacuuggaagcuuggccuuuagagccuugagguugagucccagagcccaucugcggcuaagauagauuguauuugaaguuuaguugcagucugggggcagggcagggaugaagaggacggguuuucuccagucauuugaaauaagagguuaaaaaaauaauccaaaggagccaguucuuacuguuuuguuuuguuuuuuuaucagaagagcaucagcauuuggaaaugguggccuuuuaaaaccugaaaaucugucuuaacccugcagccaggaguccuuuaggaaacaucucaaggccuagucuauugcaugccuugaucuuugacauauuugcacuugauauguuaauauuguuuaaagagcuuguuucugccaagccauuucuuaacaaaccaauaaaaccgaacacauacugaagaaagacuacaaagcaaaccagagccugugcgaugauuuccacuucauuuacugugguauuuuauuaaauauuuauuugcuucuu

SEQ ID NO: 4067 - RNA, 9889 nt, Mus musculus
auaaguacauguuuucugaaggcacuacuugugccuucaauucaggcauauauauucccuuguauauuuuucuuccauuuuuucauuuaaaaacauaccguuuauccuuucccccuccuucacacacuguauuuucccacauuguuaaaaaaaauaaacugucuucacuagacugauguacagauggucagaaauuguacauucagcugaagucuuuuggucaaaccuuuauuccaagaaagucuguuuuucuccucugcacaaguacacagcuuccaucuacaggcucuucacaguaauuaacugcucugauggucacuggaguugguuuccuuucccaguuucuaugugaacaucaacagaagcuguauaagcuaccugaaggacagcauuauucuacuauaagagacaaguuuuguuuuaaggagaagauggaggugaauaucuggauauuuuaggggaaaaagaagaaaaagaaagcacagauuguucuucaauucaguuuuacacgagccucuguaguuuagacacaauugcauucauuaguguaguguaacaaaaagaaaaaguauaaccaaagaaaaaccucaaagaugaauuauuuauaauauagucuuaaguaucaaucauccaagagacagcugucagagaugaugcuaaucacaaggaagaagaaaacgaagacgguccagaugagaaugaaggcagagaauaaagaagauggagugagggcuggugagaugguucaguggguaaaggugcuugaugccaaaccugauaaccugaggucaauccccaggacccacauagucggagagaacugacucccucaaauauaccacggcauaugcaugcacacaaaauuguaauaaauaaaugcuauuaaaagaagaggaugaaagggaaaggggaggagggagggugagaggaggagaaaaauuaaaacagaaguggagaagguggggaggagaggugcuuggcuucagccauucuuaccacuuaaacucaccuaugaaugaaaaacucauguuuuaaaugacagcaacccugguacccucugauaucaccuuggucaaaucuccuugugauauuggguggagaagagaaagaaacaaaaccaaacccuucuuaaugugaaguguugagguuugguuuuguuugcuguauacucuaauguuaaauaccagccccuuagauaucguugccucggggguaagggaauccucaaguacaccaaaugaugcuauguaaccugcuccuuaacuuauaacuacugauugaauaaagaugccuauggccuauagcugagcagaagagaaguaggcggggcuucguaucucagggcuugguguccauggagagacccugaggaggagaggagagagaggagagugaagagagauaaagaaaccaugagguaagggcucaugagauaagggcuagucagauggcguaagagcagccagguagaacugugcaagucauauuucuggguuauugacagggaaguggacaaaauagcauagagaauugauaucugcccaguucuagugguauuaaagguuuuuauaaauauaaagauuugugucuuuuaucugggaacuacaugauacaaagugggcuagaaacccccaguuaauuuuuacaacaacauuuuggcacccacuguggggcaagaacuuacucuuaacccaaauugagauuucagauucccaaauaaaaggcacacugacccuuugagauaaaagccaugauagugacuagaaagggagagauguuuccuuagcaauaucaguuuuuucccuaagucuuaugggguucugaccaguugaaauguaugcuaguuugguggcaugguuccaggggguuaaagaguaaacuaagauacaacccccaagucaaccacgcgccagagagcagagcccaugagcuacauacugguagacucaaaugccagccuggguucuuccugggcgcugcucugcucugcuagcacagcuuuggacccuagucgggcaggcaccggaugccuuggcugugcaaugaagccagugaaguccugccucuccaagcagaccgcauuccucccgcagccaagaauuauagcgaacuuauauaaauaaaauacuuugcuacuuugagcagccaacaaagucuuuggaaagcauggggcuccuacagaaagaccgauggcaguucaugaaaagucacauaaaauaaaggccaugcuacucugagcagcugguuucuuuggacauggacucccauggggaaacuggcgacugcuaggccuggcucauggcaugugguccaggccaaaaccucuaagcagauacaauguggcuugggacuaugcuuauacacuuaauggaagggaauuuuaauaaaguuuaauacagacccggauauuaaauuaagauaaaaggguaagauaaauaaauacacauagauauuaaucuccaaagaaggaagaaagagaugggaauugauauaaauguuuucaaagguacauagauacuaaauaaauaaacgcaugccuuugaucucaguacuugggagacaaaggcagaaacagauagguuacuugugaguuugaggccagcccaauccacagaguaaauccaaaucagcccaggcugcauagagaaagccugucucaacaaauaauaucaauuguuuuaaacuguuuuaauugcuuuaaaacaucagaaugauggugguuauaaguucaaugguuaugauguuaugguagauccucuuugagagaggucaaaauagagcagaccuagauagaaaagaggcugcuggauugaaucagucuauacuucaaaugacuuugccuggucuacaaagugaguuccaggacagccagggcuacacagagaaacccugucucagaaaaaaaaaaaaaaaaaaaagccaaacaaaggauaugcuuaugucaacaggaaaaaagaaaagauuuuuggauuccauccaaaauuauaaaaaaucagauuugacagagggagaaucccugaagauauuggcuauagucaagaagaaacaaaucaagaccaaaacagguaacuuggauauaguaauccuguacuuggaaacagcucugggaccaacacagcaaagaauuccacuggauacagaauccuaacuuaucauugcaugccaucacuucauaugacauaaauggaaauuuauauugcaauuugguuauauggucaaacuaacuucugaagaaaggcaguuaauuuucaccugcucuaaaaaggaucagaaaaucaucuuuacuugaucuauguuuacugcacauugcauaugaauacauuuauaaaaauauauauugcuuguaagguuuguauguugcagaauggaaggcuaaggaagcagcccuggcaagagccacccuuggggaugcugggguaccugauccugcuucagacugauacuguucccagaggcuugccuccagaacagcuucaggaaggccuguugaucccagaugaccuuaguucauccauccuuucagguugauccagucaggacuucacuuaaucaacuuauagagacugaacaacaagugacauaaccauuuuuuccaauuuccuuuugggcccccaaacaggaauucuuugccccaauucagcaggaggcaauuauaaaaagacugccugcugccccagucccuuaaguugggguggaugguuugggucauuuuaugaauuuuaaauauguugucauuuuagggggugauuacaaauaauuauggucaugaacagggaaaaaaauaaauaggaaacuuagauucggggauuuccaucuuucuuuuccuuuuauuuauccuucuuucucucuuugacaaagggaaggggguugucuuaguuuaccaugaccaaggcaacucuuauaaaguacaacauuuaauugaggcuacuguaccaauucuaagguucaguuuauuaucaucauggcaggaaguauggcagaauucuggcaaacauggggcuagaggagccaaaauuucuacacaaaauuucuacaccuugauccaaaggugggcaggagaaggcugucucccagguagucagaaagagggucucaaagcccacccucacagugacacacuuccucuaacaaagccauaccuacucccaaaaggccacaccuucuaauaaugucacuuccugggcuaacuguugggaacaaaauaaagggaggcgggggggagugagggaagggaaaagaggcccaugcccugccagaguuuuccuauucucuggucagucagguggggagggcugcuaccuacccuauccacucaccccuggguggacauuccucuaucccacucuucaggggguggccaaggggcagcccugccuggggaccccagagcuacuuugauaaagccaccaggguuauaggagagagggauaagggaagagguucccaacacuggcgagaauggugcaguagaucuagaaggagcagagacucucuaugguuuaagagcuuuauuauagaaaugcaggggaaagagagaagggguggggcaaaagcuagagagaaagagaggagaggagaagacgacaaagauaaagggaagaggagagagaagugagaggugagaggacaaaggagugagaguaagaucaagagagugaggugggggcugagcuuuuuuuggucuucacuguugcuagauaacuggggaggaguguagccugaaggucagaagcuugggccauugcuucuacugaccaugcuucucuugugggggcugugggaggugauaccuuaggcagggaccagaguuccagaagcaugagggaacgccuaccaugucauguaggugaauuaugaccaucgggguucagaccucagcucgacuggauaccagccuacaauuccccacagcuaaacauauucaaaccaccacagugggcuacauagcaaaaccuuuucucaaaauaguuaauaaauuccugcuuucugcauggccuacccuguccucugagcucuguagaauccuucaaccacaggaauugaaaagaaaaggggggggggaauagaauuaucauauagaaguaauauaauaaaaagguagauuauugaaucuacucuucaacuuagagcuauugcuauucucaaauaugguuauuuuguuacauugguacaaaauuuguauauugauacagauuucacgguuucauugguauaaaucuuuguauauugauacaaaauuuaaguuuaauauuguuacaacacaauguaugcauguuucaacucuuauguagguauuauauauaugcaauuuauuuaaaaauacaagguuuagucccauuccuuuuaauaacugcuaauacagacaguuuagaauaaucaagucaugcaaguuaauagucaauuaaacucauggucauguuagaaacuagucaggguuaguacaguaguauccaucuuggauugaacagauacuagguagcuagacacaggcaacguuuguuuauucagauaugcuaugaauaaauagauaaaagguccucaaaauauauaauagaugauccucaaaaacaaaacaaaacaaaacaaaaaaaacaaacaaaaacucagugacucauaggauuuggcaucauuuuauuaauuuaagaucuuuuuugacauugagacaugucaacuccuggcaguaccccauucgacuugaaaaaggauaagcauugaaaaucucuauauggaguugcuucaauuguguuaagcuagacacuggaggagggaggaaacaaaacaaaacacaaaccaacaaacaaaaagcccuacaauuaucugcagacagaauacuguucagaaaggacaaauggauacaggcaacucaacugccaagcucuagcaagacaggguaagcaaguccuucauaauuucugcuuuauagaaggucugucccagauuuuggggaagaaggcugaagauagauguuccaacauuaacgagaauacuggagagugaacaguuaguuagcugucucugucauuucuauaauuuuuggaaggugagugccuguguuuccugcauauucaagcaauauuuauuccuucucaggucucugaugggguuaaagacuagauagucauagucucaguuuaagcuugaguuguuuaggaucuaagaagauguuuuuaaguuaauaauacaaguuaggacagaacuuaauuuagauacagaacucgggacucaucaagauaggauauauaauacaauacuuccuacuaaauugucaaauacaaacagacuggacuuucugaauguaacucuuaccuaguaauuuucauaacugauucauaauuguuuuuauuguaugccauuuauuauuauaagaaagagccuuuuuauuuagacaaaaagggggaauuguugagguuuggccuguugcuauguauuuuaaugcuaaauacugccccgccccaccccacacccacaagaucugguugccucaggggugaggaaauccucaaauacaccaaaugaugcuauguaacccugcuccuuaauuuaaaacuacuguuuuaauaaagaugccuacagcuuauagccagaaaagagguaggugggggcuuuguuuucugagcauggggucugaagcagagguccugagaagaggagagaagaggaaggagaggaaggagagaugaagacaccaugggguaagggguugugagaaguagccaugagggcuggccagucagaguaagagcagcccagguggacacauggcaagucauaccucaggguuauugacagggaaguagacacaauagcauagaggguuuauaugugcucagcacuaaugcuauuaaggcuuauucuaaauauauacauuuugcgucuuuuaucugggaacuaaaugaucccaggugagguagaaacugccaauuaauuucuguaacaucagugaaguuccuaauuuccuguccuggggcgagccugagaagagcugaagaccuguggccuuaagaucuggguugaguuaggcagcugagucuccauuuccuuguaaaugaaacugaaggaugucacuuauaauccuauuaccagcaaacaacuuaauagcaggaaggacagaaugagaacaacucuuucuaaaauauaaaguaagguuuuacacauuaaagcagacagagagaagagaacuuuaguccaggaauugguguauuuucuuauuccucagagaaaauaaagugaaucggaaacagaaaauuuuguagggaaauugaguaagcagaaguuauuuaaauauguuaauugccugugugcccuagggcaguacucugggaaagcuggagaagauuuccuaugcacaaaguggagaagagagacuuaaguaucaggcaugugacugugaccuuggucacagcugucuucuacuuuucuuccuauuggagccacacccugucaccacaccucuuuacagugcacuaacaccagaacagcucaacucagaggacucuccugccugcgagggucaugugccuccuugcuguuacugcccuuugucucaacacuccaggcagguggccuguuauccaagaccuccacugcugagguauuugaaagacucuacccagacaccacguggaguaccugccuuccaccgagcaaucauuggccacugucaacugccacuguguuuaugcuucagcugccgugccugacacaccagccacugccugacugugacaguggauugugcugaccauagaguccaaucuuggccaagaggagccaauagacacaggaagaacuuaccuacccucugucuaugaaacagagcccugccaacccuguguguggaagagaaaggaagcaaagaugaaugagugguguuuaguacuuccaaucuacucccaagaaaaagccacguuagcaaauguaaaucaaaugucuuuguuguuuugaaaauguauuuuguagcuaauugggaaagaaauuaaacggaccguguggccuagaaacacauauuuccaguaaugaguuuggccucuguaucuaagaaaucugguuuccaaagcagacugaguuuguucuuugaggcuauucacgacugauuacugacuacuauucaugacuaauuacagaagaaauggguuuugguggggaagcacauccugugaaauaaagggaaagaaagacgggaggaacacagcuguuaacaagauuaccccaccuaaugaggaucuuaugaauuuuaacggauaugaaagcagugagauaaagggggcuuaaagggauaacaaaagugcccuuguugcauggaaaacccacagagcugggccagggcaaggacagcauggccagcagcuugguacauaaacuuggcuucugagaaaucuugagagaaagacacagucaaugccuugcccagaaaaggauggaugguuuucucuuuaggaugcuaauaagucuaaacuauuugggaugggauuucccuaaucaaaagcgaucccagcaucuccgcugcugauuuacacacauacaucucauacagugaaggccuuggugacauuauuccauugcuuuaaaaacacagacacaagcaaugaaggggaagcauugucuucauuuuuuacuuuuucuucugcaaacaaaaacacugaugaaaauauuuagguggauaaguugccuguugaaauuguaaugccccucaaguauugauagagcuuaauuuagucacauaaguuucaagcuacugaaagccccauuuuuuucugccagaaaaaauaaagacagaauuguuauuguaccaucugguuuacaugaggaaucucuuggcguuucuuaacagcacauuuuauaaaugccaaaucccagauggcauacauuguaacaguggggacuuuucuaaaggcuucaaaaaacaaauccuuuaaaauuugaauacuggcuagucuaagcaaggacaaugaauuuaaauucuaaugaacgagcuggcuuuguuggcaggacaaauuccccccuuccuuucacauuuuuuucuccuuccucauuugucacuggccuuaugaccuggaaauuucaaucaacagcauucugccacaagugagucacuuauauaaaucaaugaccugagcccucacucaaagcuccaacucaaagcucuaaauaaacugcagaaacaauggugacccugagugucugcaagucuacaccuguacuauggggcucacaaacaggccccaaaucaggcuugagcaccgaagcagaccucacuggaagaaccaggguaagggauuuaucacuacgacuuuuuuuuuuccugcaccugauacaagaugcaacugaagucagccauugggagugggaguguacaugaaccauaaagagaauggaaagcccaaaaccuaaaacaacuagaaccagagaaaacaggaaccccuguccacccccucuccccucccccuccccuccccccucuugucccaggucuuaccugaaacugugaugaugcugaccucuguaggauaagccucugccuccugggaccaagcuuacaugcaucugacucaccugacuccgaauuuagcaaggaggagcugcagcugcuaacuagaugaacuugcaucuuggccacaauccacauggucuccauaaugcugggaaucaaaugcccuucguuggugguauaaacauggccuguggguguguuugguuuaguggguguaggauuuuaaagauauuauauaagcaaaacacuaauccuuaaauugaagaaacuuaauagacucuggguacuuaugaugaaaagcugacgggcauagcaaugaccuuugcuugagcuuuaacagcaccggggcuucccaggcccguuguagucuucacugucccgggcuggaauccugcucug

SEQ ID NO: 4068 - RNA, 912 nt, Mus musculus
gucaagagaggaaggaacacaaaugccacguccuguuggugagaaugaaaacacugcaaauauuuaaaagaaauauuuuauuuauuuuuauauuuaaaagcaaaauacauuuuaaaaagaccaaguucacaauaagcagauuauguugugaagaagcacccgcaugcagcugaugaauaagaaggaauguuggaaauucuaaggguagaaggaguuccuugcuuuucaccaaacugcaggaggaaagggaaacauuauggucugcugcguauuuacugccuugaacuggaacuccaccagggucuguaacauuugcugccuccgcaccgcuuucuccuucaacaacaucaaacuccucagucucuccaucgccuacacugcgaagguacuuccugggguuauucuucuuuauagcagucugguguacaaauaugucuuccuuggugucauuccuguugaugaaaccguauccguuccuuacuuugaacccuuugacuguucccaaaaccuucgcugcgaugaccuucuuguccccgccggcggacgccgcugaugugaggcugcucgggccgccacuaccugcgucgcugccgguggagccgggcuuggugucggcggcgcugagggcggcgggcggcugcugggucucggccucgcugcucaugguugcggugauggugacuggggccggcggcgagggcugcggcuccuuccgggugugauggugacuaggcgggcggcggcggugggacucucagggcucucuaggauccgcucuccgcucccgaucgaaccaaagcuuuuaguaccaggauuguacuacaucuaauugaguuguuggcuaaagggaucccaugagaacccccaaacaacaaaggcugcucucagaaaacugacagcaaggccccuuug

SEQ ID NO: 4069 - RNA, 3513 nt, Mus musculus
uuuuuuuuugcucguauaaguaaugcuccuguaaacucagauuacaaacaacuuuaccaaauaccaauacuucacagccuaccagccuguuggggcaguucauauuuuugcagggugugguggguggauaaugguguucugaaugucuagggaaaggaaguagcauuaaaucaggcagucugugcuuuucugugucaucguuaacccugugcaagaggagagcuggcucuccaggcugaaaacugcccaggcucucucaggaagcaguaguaguugguuuaaguuuggguuucagacccagcucccuugacuucagguguaggacuccugcagcaaugccuugccaacuuggccagucuaaaggaaacaaaauuagcuccuccguguugcaugauuucauuggcucuggcauuagaagcuaaauccaugguuuguuucuagaugcagaaugcagagaaucacaaaaggaccuuauuuaagagcugcuccuuacggagagcaccugcugaauauuaucuucuuuguucaaagggaaaaaaugggaaaauguacugaaaauugucuuuaaucgcucaguuucuuucuugucaaggcucaucuuugcacucauauucaauggaaucacacaggguuggcaucucuaauuggugaaacuaagaccaccacccauugguuucuagcacguuuucaagauuugaacccccagggagguaucaccaaacaaguugcuccccauuuuccuccaggggcacuuaaaaaccaaccgcauucuucuuccuuggagguaggaaacauuaguuacuaagguaaccaaauaaaggaucuauuuguccucuguccacacauaugcuaauaggacuucaggugucucaugcugagugucacaguggccuuccuguguccaccccacaugugggguaugacaaacuggugagcuaggaauucccauggguaccagugacccaucucaucuccuuuuaggucuuaccaucucaccaagguauugcuaccaagcaugaagcaggccucuacuacuucuaauuuucacagucugguuucuugauaucugucuucuggagaaaagcaaagaucaaggugagaaggguuggcucugguuaacuggcuuguugugcuaccacaggaaccugaguucagaucucagugcccacaaaacaaaccaagugugcucuugugcaagccuguaaacucuggugcuaugggggauggacaggaggacugcuagacuuaaaagaaaguagagaaugauagacgaagacaccugacccucuccucuagccucugaacacccaugugugcaugcauaaaacacaaagacaaaaagcaaaacuuuggaaaaccugccccuuucuucauauggcuuagugccugagcccaccugccugcagagcuaaacagcagccacagucagucacguaguugguucagggaacaugguagcgugugaccaaggagccaagcuuaggacuugguuggagcuccugggaagaaagcucuaucaguugcuagguuaugggggcagaaauuggugcugcugggcccggauaucccugccaaaccugaggagccuugaccugagaauugagccaucccagaagagagcucaggcauggagaccauuuggccaaaaccuccucacccccaccccccaccuuaagcuaguuugaguuucucuuaauucacaggagcucgguacacuccccugugcuugacuuuaaacacaucccuccccugcccuccucccguccuuuggcagccucucuuagucaggaauuuaaaacgcaguugacuucaugcugcuucuccaccucacaaggagcaccugcuccguuugcaauaaaggaaaauacaaguuaaucccuccaacauacaucccaugauguuaccaggugagagcuuuuaaaagagugaccagagagggaugaacagacccuaccagcuccaaagaacuaaugguaagaaaacagauacaccuacccaggcagacagacauacaugccuuucaucucaguacucugaguucaagauugaguuccaggacagccaggacuacacaaagaaacccuguuucaaaaaacuaaaacuaaaaccaaaggaaaggaaaacagacaucccuguugugcuuugauacucaacaagagccacacucuagagaucuacaaaagguuugcugcuggguguggugacgugugcuugcagucccuacccuuggguggcugaggcaggaguggcugcacaucacaagccugacacacagcuuucuccucucccucuccuguggucuccauaagccauccuggcuuuccuuguagcucagguggauccagaaugugcuuagugggcucaaugaaagaaggcuucccuugaaauguuaaaaagggaaaacaaaacaaaacaccgaaaacccuguguaucucagaagcaagggagauggggaaaugccuuucugggacccuuacguuucaaaaaacaaugccaaaaaguuaaccagcuuccacccccacccaacccuuguaucuagggccucacagaauauaagcuggccuugaaauucuguacccgugaccucccaccuaggauuccccucaagaugggcacaugugcuccugaccuucauucacaucacaucucauagcacugucauccugucguccccucaagccuuucugaccugccccuugcccgccuuguugguguuggcaagagugcuacaugcccugaauuugcacagggcauuugcaacccacagagccugacaauuaccauuuucuauuugggaaguuugguuguuuuugaucuggccuggaaugagcaccucaaagacaaguccccaagucaccggaguuccagcuuccggagcaaaagguuccggaaaugaagaccaacuuaagggugucuggaaugagaagagcuuagccacuugcuagcugggggacccuggguggagccccucaucucugugucuguagaaaggugccaaggagugugaaacugugugccaagugcuaguuacaucacaaucacuugaggccauuguuaaaggguccugcugcacugcagcacaaucccgggcuacucuccugaaugagaccagaccacacaggugaguccucuugagucccuggguuugggaacugcuggagugaaugaccuuuguagcaccuggcugcggagacacugaccugcugacuccagcugggcguuggccuggugcugccagaucuccuagggcugcuucccaauccucaggggaacugaagaggaaggcucuugggcuucccuugcauuguuccuccauuccggccacaagaaggcagcaggcaacagggcuccacuggccuaaaccauacauagaccuggcugacccagagguucuaaaaguagaaaagcaggucacauccugccuuuaucaggaaaagaaacacagauuaaccugacagagggacuugcaacagucaaggagccccuuuaucccuggggugagcaagcucuuug

SEQ ID NO: 4070 - RNA, 25279 nt, Mus musculus
cuuugggaggguucugccaaagugccacguugggccgggcagcaggcgugaggagccggcucccggcgccacccggggcgcgcucgcuagggcgccggccuuugggcggcgcgggauagcggcgagagcugcugcgggaccugcgugucccgccccaggguggcucuggcugagggcggcggggccgggggagagcccggggcagcggccgaaacggcagggcggcggcagagcccgcugcccccggacguccccggcgacaugcuggcagauaaccuaguggaggaguucgagauggaggaugagccgugguacgaccaccgggaccuccagcaaggugagggcgaggucgccggucgggaggggggggcgggauuguuggggugggaguccggggguggcagguguggaaagugcuagaaaguuccuuaggcuggagguuugggaugccgcggcccggugcuucuugcccucaccuggcaacggauccgcccaucccgaccgcagagagcaagcgcgcgcggcccacggcccugcgggugcgccacacaggcugaugcucggugcuuuaagaaagcgcuugccggguaugagcggauggaccucugaggugggcaggaguggaccagcuuguccugcucuagaggcgagcugcuggccuggguccgggucgugcugcccugccugccccacaucgccuuucaugguccgcagagucugcaaagccgcugcagguggugggagggcagugcugcugugcgguacccgcgccaucucucugugagaguaaauuuuuuuuuuuuugucccguuuuccagaaagcagaggcuaaaagauuuagguggauucccuaaagccgaguaugaggagccuguagacacuguucaguuucuuagcaucccaguuuacagcuuacucaguuggguauuaaacuguuuuguuuuguguuuuaauuuauuacuuagccaucguucaucgggggcuaaaugaaauuauucgagggcagcucuuaucaugcgcuuaucuuucuuucggguuuucaauuaaaaauaauccugccuugguuuucuugcaucggggcaucuccagagacaaucucaagagugcccccagucugaagccaguggcccauuuucuuguacauucauagcaggauuuuguguuuggggacacugauaggccggcccucaacacccugguaggcuccuuuaauucucccaauagcauaaggugcugcaguagguaccucuggcugaagaagauacuguuggggagacuagguauucacggcagaccccagaguagacauuguuaaccaccaugcugagggauccgcaggaauccuuugugcuauucuguauaaugaucuccacuccaaacuuuuugggaaaauuaauaucucuuuugaguuggcuacuaaacaccgccucuuguucacaauucaacugaaucugaugggggaaaaauucgggcuugaaugauccauacuuagaaaaagaaaacagguagcucuuuggagagaugcuaauuuguuuuuuguuuuuuuguuuuuuuuuuuguuuuuguuuuuuugguuuuuuuaauccugucugucuugauuucuuaaugugaaaugaccuaagcccacauagaucccuguacugcuauaauugaagcugacuagcaguuacaaugccgauuugccaucacauuucuccauguccacaagacaaauuuguuagacauuuagccuacuugagauuugccccauaaggauugaugaccuacuuugauacuugaggacugaagcaaccaucgugcgauugcuucuaugaaagcaauucauauaauccaagcaagaguuuuuucuuugccauauuuaagaagaauccaaaaccuucaaggacuggccagucucccaugucuaacaucauauauaacacaucauaauagaaacuuaauuuaguauuuguugaccugaacugaggcucucacacaagauuaacguuuucagcucuccucaauccagagcccuagucuacccaacagccaaacccccgucuccaggagguuaucaggaaccagcaguuguacuaucucggucuacugagugguaaacaaaauacguuuggugcuauguguggcacucuuaacuucugauccagaugaaggugucacaucuucaagucuaacaaacccuaaccucugggcuaauuuacuguugauuuccauuuggaacuucuucucuacuuuccagaggcuuucauagcuguuaucacaguggacuuugccauggcuucugcaucauaaguagccauauaaaguacaaauggaagauaugaaauccugcuagcucauuaauaugcccaugaaagaaugauggcugcucuuuugagcaucuuuuccccauuuuguugacuuacauguuaaaugguuuggugugcugggauugacccuaggcccuccgugcgugccacguaagcaguguaccccagagccagccuagaagaacuaccuuugaacagaguuuacaguuguuucucaagaacauacuggcuuuuuucuaaccuagguauuaauguaggcaguggcaccacuuguagccagcuauuagggaggcaggacucccacucaaugggaugcuguucaugaaucuacucauagagacaucuggagaugcgaguaaauaaaugggacaccuucagcacuugcugcuaaggaguuugcgaacagcucugucucuguguagauuaaggaacucuagucggauuuuaucauguguucuuuaugaucuucuuuauuaacuuauguagauuuguauuagauagauggccuaaaauaaaaugcuuuacaaaaauagugagacuuguuuaagacuaaacaagccucccacaauaggcugggcccucccacaucagucacugauuaagaaaaaacccuaugggcuaauguacaacccagucauguagagauaguuucucaauuuuggcgcucuccucucugaugauaguacuauauuguguaucaaauugacacaaaaccagcccggguguauauggaagccagaggaagacuugugugggucgguucucguuccuccaugugguccuggcagcugaacucagguuaucaggcauaauggccagugcucuuacccacucacugaacccaggucuuuuuguuuguuuguuuuguuuuguuuuguuuuguuuugagacaggguuucucuguguagcccuggcuggccuggaacucacuuuguagaccaggcugaccucaaacucagaaaucugccugccucugccucccaagcgcuggaauuaaagauuuccuuauuuuacucuuuauguauguguuuugccugcauguauauccgugucccacuggaguuguaggcaaguaauccaccaugugggugggaacugagcccagguucucuacaagagcagccagugcacuuaaccugagccaucucuccagcccuauggcuugcuucauaaaacaacuuaccaaaaggagaaaaaaaaaaaaaaacccacaaauccagcugagcauaguggcagguguggugguacacaccuuuccagguggaucugaauucaagggcagccuggccuacacuggaagcucuaggcuagcccagguuauauagugagaacaugucuuuaaaaagguggggggggggggacucuaaagcuuuaagaguuuuacauucuuuucaucuaguaguaguugccguuauuuaaauggacaaacuguguuaaauguuagggccuuccuuucuagucagaguaacaaagccauucuuaccucagucagcucuggucucuuguuagguguaaagccacaaagagguggagaggcuuuggugaggagccguuuguuagaggacugaguuggcacgcuaagaauacugacaguaaucucugggcacagucuuuucugggacagcaggagccuucuauguagguaaugauggcgcuugcuuugaagugugcccccaagaacaagguggaagagcuucaaagaccggcuuuccuucagacccgcugccggugcaguugucacuggcagagggagcuuugcaaccuuugggacaaggguuugcgucacagguguauggaucaccaaaugaagugggaguuuaaaggaauacugaaagcccuuugcgagcugaguaggucuuucuaaguuucacaugagcucaucccugaauuucuaaugugcacuuaaucgcugaaucauuguuuagagggucauuaaaacugacacuguugguuuuuguauguguguguauguuuauguugagguugugugugucuguguucucaauuagaguaauguuggcaccagacauugacuacgaaugucaccggaugacgcauuugucuuuguaauaggaaaagcuuucagcuuucagccuucuugaauuacugcugcagauuacaauuaauagaagacuauccucagcguuuuuaguuguucauguuuaagaaacaaguaaaauaguaaaauaaaaagacuguaauacauucuggaagaaagaucuuuuaaaaaaaauagcagucagcuacuauugcuaacguuuuugcccaagugcaaggcugagugaauauuauucaaagcuagcagcuuacacugaagguagagcauaauagggcucaggauggaauaacucagugguagaggccuugcuuuuguauaugagauccuuagcauuaaagaaaaaaauuuuuaccugccaagacugguugguaaaagaauuaauagaucacugauacacaguaaaucuaugauauuuauagugacugucuaagccaggccaguucaguaggauuuagaaaagacaauggaaguccuaauuguaauagauacacaggugugcaaagcuuuggacguguaagauuuccuucccuuuuguguguuaauuaaaaaguaaaauuaaaggacauucagcauucuccuguccccuccgccaauuacuuagaaacgcuucuugggcuuccugccagcuuuuggcuccuuuugguuauggaggccagaugcuacacaagaggaaaugauguguuuuaaagacugaaacagucggguguuuuuacacuaacagaugaaguaauauccuauuauacagugugacuucaugggcgcauucuuguaguuacgcuuugacuugcuagaguucuaaacacuccaugaaauauucaagagacugaagcgucagguuacugagccuggugcagacucuguuuaacuggaacuaaggacugagaugaagaugagucucgaauuuuauuuguuguuggcuaaugggaaacaacaacaacaacaaagaggcuagauuugaccucuacaguagcaggaaagaugcugcuggcuguuguaauuggcaaaaacagcucagaacugaauggagauggugaggagcucaggccuugauucugaagaaguuucagcucaaaaguuuuuguagauucaauuggcuuaguuugguuuuaguuuuauuuuuuugaaaucagugagaaguggccuuuauuuugugagaauuguuuuuuauucuguuuuuuauauauauuccauuauguauauuaauugcauaugguacuguguuguauacaaacauucucauaaugaguauauagugcaugaugagacuauucucuccauuaucugccauucacccuuugguccucccacccccuauuagucccuuuuguucccuaguuuugcuuaccgaugugugacauacauaacauacauauauacguacauacauacaugacuauguaucuguguguggcuuugaacuuguggcaaucuuccuguuucugcuccaaagugcugagaccuuguucaauuauaguuauuuuucauucagugaaaaaaguuaguaaucuggcuguguggagauguuucacuggcugagcuggccagaaacacccaaaugucugaacuccucauuucucuugcugucacucacaggugacuaaagcccagacuagggagcacuguaaucucccccuuauguaugugcacaaaucuuuccucggccuugaaacuaugcagacauggguuugagcauuuaguucagugguuaagugcuugcuuaaaauguaacagaguccaguguuugagccccagcaaugaagaagggagaaaaacaaucuacuucacagcuaggcauaggggggugggagggcacaugccuguaauuccagcugaugugaggcagaaagauuggauuuaagaccauccugaguuaugucgugagacucuugaugaaggagaagggggagggggcuagggaugguacuuuggagcacuugccuugugugcaagguucuagugaugcgagaagaaaacacugcagagguagaugaugaagaguccuggugacgugaguuagaaccuuugguuucugacugugacucaccauguguguuucgcugaguacuuuaauaguuuuguccuucagguugucucaucugaaaaaguuagguuuuauauccuauagaaacauaucaagauuaaugucucuuaaauguuacugguuguugaaaaagguuuuagcuugugaauacaagauggaauuugacuucuuuacuggccuuaauauaacaguaacauguauuuuuaauauuauuaaaauuuaagaacacauuuuagcaacuaucgaucacuacaguuucauuuuuaaauagugauaaauuuguaagguacauagugauaaauuuguaaauuuuaugaugcuggauuugugguucauauaguuuaaucucagcugcuuggcaggaugaacaagaagguuuucaauuagaggucagccuggucaacaguggggccuucauuucaagaaagaacaucauuaaguuucucaggcccacgguccaguagccucagguuuuuggccacuuuuguagagagaaucuucacauaguguguggaagcaucaccugucaauaaaaagccuguggccaaugaguugagacaggauuaguaggugggauauccaggagagagagggaauucuaggaaagagucgggcauggagguacucccuaacgcagaggagagguacccaugcagcaguacuuagaauagaguaaauggguaauuaagucaugagcuagucaggaaacaggccaaagcuuugggccuagguguuuauucauauuuaagaaguuucagagagucguaauuucagggaacaaagaggcagguagaaaagccuacagugacacacuuuaacaguauaacguauagguucuagcucauggaauggaucuuaaaucuaguaauuaaaaaaaaaaagugguuggcugcucccauaacauuguucuaauauugcagcaguauaucuugcaagcaggccacuguuguagguccaggguuuguagcuaguaauuaacguccaaaguaccuuccaacaucacaggaucauuaggaguagagcuucuagcuagguuaccagcacuaccuuuuuguugucuuuaccaauagugccuuaccaaucggugguggaaagcaaccaauagguugugauguuugggggcuuccagggaaccgcuuuggucaaguucucagcaagaugcaacccaagcuugguacucuggguuuuacuugauggcauaagaugucuaguuagggcauugucuccccuauuauuugaugacuccguuuauauuccuuguguguguguguuauguacacauauauuuaagcuucuacaguagauguccacaugguuuuccaaauggccuuuacuguuacuuguuucuccuuuugcuucucuccaguccugggagggucugggaagagcuggggaagguaaacacauaaugaagacccacaggaaaagugucuguguuuggagcugagcuggaccggguuuguugcuuuguucccaccccucccccacccagcacaauacuaauuauguuguuggaugacuauauuucaugauacauauuuguauuccaguagcugaaguaauuuaccaucacauagaauacaguuuaaaaugucuccgccguggcuuguaacaaucuuaugugauugcucuuuggcugcuucucccauuucaacuggcuccacucucuucugcuuucuuccuccuggcucuuugccaggcuauagauuaugauaaguuauuuccuggcucuuccauggugacuucccaucuuucaagccauagcuaaaauuagauuccuccuuacauaauuuaacuuuuugcccuuauaguuaguauccaauuaaucaacaaauccuuucagccuuuacuuucuagucauguugaagucuguugcucuucuccaucgccagcaucuggucugagccaccguccuuucucacuccugcuuacaguguccucucacugugcuccguaucucauuccauguguuuguguggcagccacaacuggccugccaagccucccuagucucuccaucuacucuggcguacaaaguggugcuugaucucucuaguuuaguccugcacgagcuggccuaccuuggagucccucugauuucucucuauguccuacucugcuucagcauggcuuccuuaauaguuucacucaggauuccucccagggaccuggcacuugccuugccucugccuggaguucuguucccucagauguacacuuccucagcuucuuuacaucuuuauuguagcaucgucuguaguuuagccucucucauccaaacuccuccauacaucuuccuugcuuuacauggucuuccaaguacuugguguauauaaccugcucucucccauaggccguaagcucacggauuccuaaaaucugaauuccuuauauuccccaguacccaaagcauaaucugaucuuccugaauguguguaucucucucucucucucucucucucucucucucauugugugugugugugugugugagagagagagagagagagagagagagagagagagagagaauacaauuucaaagcaccauuugggcggugaugaugcuaucacauuugaagauucaguguuuauguguccucuagcuucccuuaguagcuuaggaaagucaacaaaguaggaacuucacccauucuguucuuguagccagaguuuagaauagugccuaccaacagacaucuuuaaaccaauggccugcuagaaauacuuuguauauugcaacuuagcuugcaaagaccauucuguauuauuccauuugauaguuacaaucugauacuaacagaauaauuguuucucaaaacaagacaauuaaguuuagagaccuucacaaucaccauaugggggcuaggaagaugguuuagcaguuaagagcauguauugugucuuagucaggguuucuauuccugcacaaaaaaacaugaucaagaagcaaguuggggaggagaaaggguuuauucagcuugcagguccacauugcuauucaucaccaaggaagucaggacuggaacucaagcauaucagaaagcaggagcugaggcagaggccaugggggcauguuacuggcuugcuuccccuggcuuguucagcuugcuuucuuauagaacccaagaacccggcccagggauggcaccacccacaaugggcuaggcccuccccacuugaucacuaauugagaaaaugucuuacagcuggaucucauggaggcauuuccucaagggaggcuccuucucugugauaacuccagcugugucaaguugacacacaaaaccagccaguacauacuguucuuucagagagccaaaguucaguuuccagcacccacaugaggcagccuacaaccaccuguaauuccgacucuggccucugugggcaucugcacucauuuacacauacacacacacagacagaaacacacacaauuaacaauaauaaaaaugaaaacauuuaaaaucacuucuagaaaauguuaaucagaucugggucuuauaccuuccuugccuugaagucauuacauuucccacuguauaucauagaguuggcccauaaaaugcacuacaugacaauuguuucauuuaccugugucaccauaauugcugggauuuuuaaaguaaaagccuuguccucuggcaaccccagcaagcuaagcucagucaccuaucuucaguacaccauuaaagagacagaugauugggaggcagaggcaggcggauuucugcguucggggccagccuggucuucagaguaaauuccaagacagggcuauacagagaaacccugccucaaaaaaccaaaaagaaaacauaaaugaaagaaagaaagagagagacagaugauagugaaaaacaaaagauuuauuuaacauggcuauccugggaagaggaacaaauaugagaggccuacauccccauguccauuuaagggauuacuaacaugagguguaggugacuagagaacaggagguuuauauaacuaagcagugcugaucaaggugagguccugccuauguuguuucagcucuggucuguccuauugggugggcugauaaguugucagucagaacuguauggaacacagccuuuccucugguagggggcuccugggggagauuuuaauuauuugggggacagggcacaggugucucuugagauaucuauccugucaggguguuuacauugccacuauuauuguuuuguguuucuuuuucuguuauuacuaaguuucuauuccugggauuguaauauaacaaaaccugucuugcuugcacauaugucuaagaagguaauugauaaauaagcuuuaaaaccgagaagccagaugcggugacuccuacuuguaaucauagcaugugggaaggugaaggagaauugcugugacuucccaggacagugggggcaagaggagcagggcuggaauacaauagcgccuggccccauguuuaagggaaguaugaaacaaaaccauauugcugcuuugcuuaaaagcugugauagggcuguguggcagugguacaugccuuuaauccuagcacucaggaggcagagacaggcagaucgaggccagccuugucuacaaagugaguuccaggacagucaggccucacagagaaaccuugccuuaaaaaaacaaaaaacuaaacaaaacggaaaaaaaaaaaaaagaagaagaacaaaaaagaugugauaggaauugggguugggagagacagacuugugugugaaacaaguaucucaccacuggcauuaauguuuagcugcccugagagucuaggauauaggggguuggagagagagcucagucauuaagagcauggccugcuuuuguggaggaucuggaguagguucuuagcacucacaucaauaggucacaaccacaugucaccccaguuccaugggguccaguguugcuucugaccuucagcgguacauaaacucucauagacacacacacacacacacacacacacacacacacacacacacaaauucaaaggaaacaauuuaaaggaguccagacaacaaacuuugcuuugccaguuguguucacaguagcuugcuagaaauuuuggaggcugcuaagaggccuaucucuuuggcucaaggauucaucucaaaagcacaaugucaggauuugaauaagucuuuuaccaaaagacuauuuggaauuguaagacugaauggucauuucugaaauaaugcccacaucucuaugaaauagacuacugucuuuuaugucugacagggugcaugagagaguccuucaccugcuagcaggccccaggucaacugaauuuuaaguaggacucggauuucuuuuaggucauucugcguucuacugggaccugacuugcauguguggggcuugcuucauuuacuuuaagaacugaguuauauaaaaauugaagugagcucauuggacuugcugcguccuaagaguuguuuguugugccagaucuccagcuugcugcugaacuuggaaagacgcuacuggaucggaacacagaguuggaagauucucuucagcagauguacacaaccaaucaggagcaguuacaggaaaucgagguaauuuauucagugggagagguacauccucugauguguggcucucugcuguugucaucgaccucuaaaauagcacuugcagcuagaaauaguauucaacuuggaaguagucuuuuuugagaaauugaaccaccaaagacacuuucuuuagaugugccuaguagguaaguaugcucugauuaaaaauaguuuucucuucaaccuugguaaaguguguaaaaguaaacaaucuaguauuugccaguguguaaagcaaaugcuaugaaguuguacuuaguuuuuuaaguuucuuuuucuuuuaguaauaaaauuaguuaugcaacauggaagguauacaggaaagcacgcacaugcagaaacacaugcagaaagcaugcacaugcagaaagcacgugcagaaacacauguggaaagcaugcacaugcugaaacacaugcgggaaagcacaugcggaaagacaugcgggaaacacaugcgggaaagcacaugcagaaagugcaugcagaaacacaugcggaaagcacaugcagaacaggacugugcagcccagcccccccaccgccaccccccaguuuggggagagaacugcccagacuauugacauucccugcauacucuucuuugguggcaccucccuccuuccaacuaaacaccauuccauauuuagaguuagguaggaagguuuguuuugaugcaguauuugauuuuauaauuuauuuuaacgaccugugcuuaaacuuaaagaauuagucaaauucuuguuauuuauuugagacaggaaguguuguucugcaaucugggucgguuugagacucagucuccugccucagccuuuacaaauuuuugugaaguaaacauaccggugcagccuacacucagauaaggagugaaaacauuaucagucauucacucacuaccccaguaaccagcaccccacccagacacccuggauuagccucuguuugaacuucacaugaguguagugacuugugcaaauuuuaaccuaacuuuuacuucgguuucauuugcuucuguggauuucgagugcugaauacacgcucugucccuaagucuccgggguccuaaacuuuucaaaauuuuauugacaguuuuccucacuagacaaguaauuaaaacauggagugggaguguuguuguuuucuaauuuacaaaaacaauaaggcaggugugguaaugcguaccuuuaaucgucagcacccaaacugaagcaggugggccugugaguuugaggccagccugauccacagaguaaguuccaggacacccagggcuacauagagaaacccugucuugaaaauugaaaaagauagagaaagaaaaacaguuaugauuaagaaccaaaaagucagcauuuaccccaucucccagagagaucuaaaaugaguugaaaccauuguugaacaaaauacugaucggggaugagggauacuggucagcuggugagaacaggaggaggaagucucuaagacuuacuaugaagaacacgggggcgggggucgggggucggguauugagacaggucucaccaugugguccuggcuauccuagaacucaccauguagaccaggcuggccucagauuugcagagaucuauuugccucugccucccaagugcuagaacuaaaggugccaugaugguucagcuuccaaggacugauuauaauacuaaugccaaguauucuuccagaggcuauuagugcauuucaaacagucauuguaaaagaugaucaguaauugaaguauuguuuuugauguuuaaaaauggcuaccaagaugacuuuacucaggacuuagaaugggaggggaaaacugacuccuucaaguuguccucugacuccacauuugugccaugguauucacaccccccaagaagauccauacacccagacgauccacaaccuccccagaugauccacacacaccccagacaauacacacacgcauaccccagacaauccauaaaugaaaauuuagaacauguuuguuuguuuguuuguuuguuuuaaagaaaauugagcugguguaauagggcaugauuuuaaucccuccacuuaggaggcagagaugggcagaucucugugaguucaaggccagccuggucugcauaguggguaccaguaggcuaaccaggacuacauaguugagacuuagucacacacacauuucuaaaguuuuauuaugauuuguaaaauuuuauguguauggguguuuuuucugcaugucuacgcaucauguuucugccuggugcccaugggaaccagaagagagcaucagauucuauggaacuggaguuauagacaaugugugccgacaugucagugcugggaauugaagucugguccucauguagcaacaaguacucuaagcugcugagccaucucucaagcccucaauuuuuuuuaaaaaguugaguaagcuauugaaguagugguuuuacuggcuucagaaaggccuguggcuugucugaguacugauuugaacacccaguuuuuaaauuacauuuauuauuaaccuacauuuguauauguauacguguauacacacacacacaccugggugucuggaggucagaggauaacuuguagaaucuccuccucauauuuggguuccagggaucaaacagguuuuuaggcuggguugccaguggccgcccuacacaucuaaguuauuaaagaguacagaggaaaguagcucucauuugcuuguuuguuuucagguccuggaugggagcgggaggcuauggaggguaaugggauuugaccagaucuuuccuacagccauguguucuagcuacuuuguugcuuuuacacgugugcauugucccgacaggaguuauacaugcuuauuaaagugguuccacuucacagcaucccauuuugcaagaauucauuccuucuugggaauagagggaaugaggugugaguaaguuugugaguguguguguguguggguguggguguggguguaggcacacaugccagcaccgaagauugaggugaaauauuuuucccuauugcuuuccaaaaugucucucacuuaaccuggagcuuaccaaugaaguaagcccagggaaucuuccugucuuuguccccagaacugggauuacagguguacacgccaugccagcuuuuuuuuuuuuuuuaauuuuuacuuacauauguguauuuuauuguuuuuaagacagggucuuaauauguaguucugauucucugggacucaguauguaaaccaggcuggccucaaacucacagagaccuaacugccucuaacuucugagggccaggauuaaaggcaugggccacauagcccagcuguguaugaguguuuuaccugcauguauguaagugcucugcaugccuguuuggugccagagagcaguuucaagguucugagcacugggcgugguggugcaugccuuuaaucccagcacucgggaggcagaggcagguggauuucugaguucgaggccagccuggucuacagagugaguuccaggacagccagggcuauacagagaaacccugucucgaaaaaccaaaaaacaaaacaaaaaaaauuguucugagcacuuaagugugggauucuuguagacugggcagacuuguagaggggcagagggagcacuggccuuuguauucagagacuuuugggcugugaauuugcaaauagauagccauguaaaucaccucucagaucugucugcuucgcuuggaauagugacaaaugucagcacugcauugguacaggaugcucugaagggaaggugagaucaugggaaugauauguuuuggacuuguguaauuaccacaucauuauuuauucauuugacagaauauuuguaguggaaaagucuuaauucuaaaaacaaaauucuguugauuuagugggcaagcuagggcugaggagauggcucgguugguaacgugguugccgugcaaacauaaaaacauagguuuggaccccccacacccacauaaaagccaaguaugauggcauaugucuguaauacaguggcagcagacagguggauccccaagaaccaguauagucuaugggugaacuccagguucagagagagacccugucgcaaaaaaaauaaaaggcagacaucucguaucagcucuggccuccacacacacauaugcuacacauacgcacaaaagccuacuugguaugcuuuuaauauguggccuuuauuuucauauuucuccuauccaacccuguauguccuaugguaaauauauuacuguaauuaggggaaauauacuuuucaucauuuauuaggaauuauuucuucacuguuauuaaagguuauuuuugcacaaaguuugaaagacuuggcuguaaucuuugauuaaagaauaguacucacacugcugggaagccaaauuuccauuuuuguuuugcuuuuugagacaggaucucuauauauagccauggcuggccuggaacucccuauguagaccaggcugaccucaacucagagauccacuugcuucugucuccccagggcugggauuaaagguguggccauuaugccuggauccuuuuguuuuuuuaaaccaugaguucuggggucugaacucagguccucagguuugcaaagcaagcauuuuccaacugaauugucuuccaagccagauguucuugccauagguuaggauuuuugucuauuuugcugccaaucccaaauuccccauugauguuuucuuugucuuuuuuguuuuguuuuguuuauuuauuuauuuauuuauuuuuuuggaacucuuuuuccccuauucaauauaacagauucugaauugagaaaauggguccauguauggacuucgaggugaaugggugggaaagauaaccuuuuuccuucuauacaaagugaagaaaaaguacgaauuuagagcccaaagcuaaacuugcguacuuacuuagaagccaguaguuuuucuugaaguugcugaccaggugacacuccuuauagguuauuugugacugauauugaagacugaauggcuuuucugauuaauuucagcuuaacuuaauuaaacuaaacuccuaccaugugaaaaaacaagcuccuuagcauucuuggguuauccucaagaccaaguccucucaggcuaagauaucacggguucuucaauggcuucguuguguuuuugucacagauuuuuacauaguaaauaagaggcucuuuacguagguuuuuaguggcccauuugcauguugacuuacuuccuguguguuggccacaagccuaagaugacaauuuuuuuuaaagaggcuuaacuugggacccaugcagugugugguguguauuguaaguaucuccccuccagguuucugaggauaacguuggggccaugggaaauagggaaucuaaguggaaauuagugguuaguaggcuuuucucaggaggucuauagccaagcccaucacagaagcuuucaaacuaaaccguacuugacauuugcacucugaauucugugguacugaaccuagcugcugugaacagaggucuugaaauagauauuuagcuaaauuguaauccuuacuaaaauaugucagaaaugggcuacauagagaacaauaaccauuccuucccagaaagagagugacagugacagucaagaauugugaguugauuguucuguuguugccuugagaggaaugagggcaaggugcuguguagacaagagcaaguccucugacaaaugcauuucauauguggggaugaggacaaaccaucuaggucccugcaauugucuuucaggugaaucuuagcauugcauauacaaaguuuaaaaacuaauucuaaauaaagaugacaguagcuaccucuuccugaacacuuugaucauuugucagauaccagaguggacucuguauauuaaccuucauguaaauaaaugcauauguaagaggacaguuuaacaggaguaaaagguguauuuugauauucauacaucagagauacucaagugagugauucucuuaagagguggcuuuggaguuuaucuuacacacggagauagauauuccugguuggcagccucacuacgucugaaaugaacuacaaucuagaaauggagggcacaccugugauccagaacuuaaggcuugaagacacaggcuuuugauccucuaaguguuggaugacgaaugcuuuugaucuggaucuugaggcauagcggccaugaaaaucuuaagcucagacaaggagguacauggcuuuaaucccaggagacagagacaagcagaucucugaauucaaggccagccugggacagaguaaguuccaacuagagaaaagcuuagguccagguguagugguauacaccuuuaaucuaggccauaccuucugcaggaggcugagauacgggcaauagaaaaaggaggaaggguuuguucuuuuugccuguuacaguucccugccaguucaucuguuggaaccuacuccuucaggauuccgucuuauaagaagaccagcugaaacaacccagccuaugagucugagcaacuccuagacucuuagacuucccauucacaguugcccacuguuggguuaguuggacugcagacuguaagucauuccaauaaauucccuuaauauauacagacaguccauaaguucugugacucuagagaauccugccuaacacauacacuguaaugcagaacaguauauucuuggagcagggauuagauggaggaaaaggacuuggacucuaaguguggcaacuuaguggaggacaaguagauaaaaacuaguaaagcuuuuggguuggauuccucuggugcugacuccuggcccagaagagucugaaauugugcucagugguuagcuuucauucugccugacagauagggagggauaaacauggagggcacacagcuuuccugcaucuguuucuuaaccguccuuaagccaaaaacaacacauagucugaagccacauauccugguuguauauauaguaaucuuuauagccucaugagguccugaugaggaaaucauagaaaaauucgcaaugucaaagggccuucaagccuguccugugagcuggcguaccacuuccuccauauagcucuggucuugaccucacuaaaagacuccauucguaaacugacuuuucauauguucccugugggacagauccgucccauguagaggauguaggaauagucucuuuguaaauaauuuguaccuguuuauacguuugccuuuuuuaagguuauugugcaucaaacccaaagaauacuuaggaccugauauaaauuauaaacugucuuaaaaauguuuauaguauauaugcauuuauuuugagugagugugugucugugugugugaauaugcaaaugugggacagcaagucuguggaggucagaggacaguuuacaggaguuagugcucucucuuccacggugugagcucuugaaauuaaaaucuggucaucaggcuuggcagcaagugcccuuaccacugagccaucuugccacccuaaucauauauauucugcuuacccuaacuaagcacuggacccaguccaguaguccuaagaaauuaaauacauuccuguggaugagccaagggcagaaccaaaagcuuucuuccacaggucugaaguaguuuccugucagaaguugagugguuaguuuucacaagggaucaugagaaacuugugaagguucaggcagcaaagaauaaguggauuucccuagaucccaugcugugucugucuaacuuugcuuacuuaacaugucaguuuggcaguuucuaacacuacaauggcuuaccacuucugaaccccagacagucgacugaggucuuccccauaaaguuuacagcaaauuuauuuguuaucagcgaaucuugaauugauuugaggcuguuuguaauauucacacuuuuugaugccaaaguaucagugcugcccagaccucacagggguguuaaaaacauguuuuguuugggaauagugauggugguguuaauucaaagaaauuuucagaacacuuuuggcccugagauucguaugagaaaguuaaagaguuaaaaagagguuguuagcucugugcauggccacugauauaagaaucugaaaggggcuacauuggaucacugaauaucaguuagcucuguuucuugaaagaagacuguugaaagccagugcaaggguugcacaccuguagucccaguacuaggaagcugagucaggagggccaaaggucagagccagcaugccugggauagauagcagacguuuucucaaaaaacaaaggucacuuggcucuggugguacuugaggagcugguuucaggaguguuuguaaagucaaaucugcugcuaccauaugguuauacuccaaaccccccucucccucucuucugguuguguccagaggaaugggcguguuguguuuggaauaugcuccgcuuuaguguguccagguaggaaugggauggaggggccgggugaccuagcugugguauuaagacugcgcuuauccuccaucuucagaaagcagucuuagcaggaccaaaauaaauaaccugcuaaguaucucaagaguaaggauaauagagauaacauuccuguagaaagagguaacaagauuuugauauauauuaaaguaccugguaaaauuaauguauuuuucacuaguuuugucuaaaaugccucauucaggaaaaaaagauugauuuuuuuuuuuucaagcaaaaaacccaucaaaauccucuacuuuaagcuuuuccuuccuuuuuccuuuugguuaaacauauauuuuaaccuuuuuugcuuuuuaaagauuuauuauuuguaucuguaugacuguuuugccugaauguguguacaugcacuugugugcgugccugacgccugcagaaguuggaaggagcagauccccuggaacuggagcuaagagaggugguaaucuguggguuggaugcuggcagugggucgucauguccucuauaagaacaagggcucuucaccacugccaucucuccagccucuguuagacacagugcuuaaacuuuuaucauguuuuccaaguuuucgugagggauuaucauauuuccuuuuggguuuuccuuuugaauauuaagcauaucguucguaaaaguagucuagacucauggaaugucagaguuuugggaaguauuaauggagcuaagcacauugaaaauagcuugugcugauuuuauuauuaaaacaagguaguuuuguugggauuuaauauucucuuuuccauuaaguaagcugaugacaacaguauaguaaaaaaaaaaaaaaaaaaaaaaaaauucacuuuuggucuuugucccugaauccuggcuucuuaaaaagucuucuaaaaccauuguuguccagaguaauaggaugacgagaggcccacauuauuagcuagccaggagauaugugggcagagcaucaggcaacuuuaguuaucaaagccuuugacaaaacucuaaggcuguggagcuuuugggcuggcaaacacauccccaugccaggcgggugcugagcccacaggugaagcccggcgcccucaccuggcuuuaguugguguuggagaaccauagaauugguguuaagugugcagguuaucucaucugcucugugaccugaucugacuccucuuuuacaguaccugaccaagcagguggagcuucuacggcaaaugaaugagcagcaugcgaaaguuuaugagcaguuagaugucacagcaagagaacuggaagaaaccaaccagaagcuaguugcugagagcaaggccucacagcagaaaauccucagguagacuuucuaacuguuacaggggacaaucuacaaagggguuaggauaauuugaaguagaaugugccuguagaagguugggcagucuaggauaaggguuuuuuuggggggagguggggggagaaggaggauuaacuguaaguccuuuccaauuaagaaagccaaguuugaguggcucacaccuaaucccuuucauugguuuugaucuuaauuuauuuugacaagcagcgaccggcuucugcuuuauucauagccugacagaaacaauugaaugccugcaaaccaacauugaucaccugcagagccaaguggaggagcugaagucuuccagccaaggaagagggaggcagaaggcaugugaccaggagaaaccagcacccagcuucuccugucugaaagagcuguaugaccuccgccaguaagcgccuuccuugcuguggauuugcacacugggagcaucccaugucacugacauauuguggguuacauagauggaacgugucagacaccaguggguagcagagccccugaaccuaaacguagcagugagaguucaugggugucaguaacuuugugaaaaguuuuucuuucuuuucuuuucauuuuaauuuguuaaauauuaguuuaaaauuaguaauacuuccaccguaguacagauuugggaguuguauuucacuuuagaaugaaggaaaagguggaaacuuuggaagcuggguuugguagcucaugccucuaauuccagcacucaggaagcagaggcagacucugcacgaucaaguccagaacauggcaaggucaggacagcuaggacuacacggagaccuugucccaaaugagaagaagaaaaguauuuuuuccuaaagaaaugacucuauaguuuauaguuuugguuuuaagucuuuaauaaugcuuacuuaacacauauuacauccaggaaugauggcuaaaauggacauguucuauguccucaaaacccuucauucuaauggagaguuagaugcuccauaaccaagacacacagauagguacaagcugccucggacugaauagaagagaggccaguucaugucucucacauuuccuauggcgauuuugggguuuugagauaaggucucauucggcccagcuggccuucaccucccacgugcugcugagaugacaugugugcaucuggcacugugcauguuuucuuagagcagauacuaacucuccucaggucagaauuucuagaugugaccauuaagcugccccagugguucugauggguagcccagguuaaagguccaaacacuguguuccuuaaccuugguuucacguuauggaaaacauuuaaaauuccauagguccaggcagcagaccaacaauuuucaaaaccgauggugugaacuccagguucuaagaccaccacccagcugauagugaucuccaacuauugauaagaauuucuguccauuauauuuccuaguaagcagcuaucuuucugcuggccuuggcaugcguuuucuguacuacuuuuacuguugggggaaaagucaaccacaaaaccuguauuugcuuucaagaauucaccagccucauacaguuucauguagccacugcuuguaguauggaaugggcuaaaaauugaugucacagcuuuuaaacgacuuaguugaaaagcagccuccucugcagucucagcugaccuuuauauaucccauguuuccucacagacacuuuguguaugaccacguguucgcugagaagaucacuuccuugcagagccaacagagcccugaugaagaagaaaaugagcaccugaaaaaggcagugacgauguugcaggcccagcuaagucuagagaggaagaagcgagugagcguggaggcagaguauaaaguggugcugaaggagaacagugagcuggagcagcagcugggggccacagaugccuaccgagcccgggcccuggaguuggaggcagagguggcugagaugcggcagaugcugcaggcagagcauccuuuugugaaugguguggagaagcuggugcccgacucucuguuuguuccuuucaaggagccuagccagagucugcuggaggaaauguuccuggcugcuccagaagcaccuagaaaaccacucaaacgaagcagcagugagacggcgcucagcaguuuggcaggggaugacaucgugaaggaccaugaggacacuugcaucaggagggcuaaggcugugaagcagaggggcaucucccuucugcaugaaguggacacucaguacagugcccugaaagugaaguaugaagagcuacugaagaagugccagcaggagcaggacucacugucacacaaggcugugcagaccucuagacuacugacuagggaccugacaggacuggucacgcagucugaggcgggggccaguggcugggaacccaccccuguaagcccagaguccaucaguucccccaccacuacaccuccagaauacaaagcacuauuuaaggagauauuuaguugcaucaagaaaacaaagcaggaaauagaugaacagagaacaaaauacccuucucucuccucuuacucguacugagacuccaguuguaacugcuuguuuucgcucacuugccuccccuucagacauguaagugcagucuccaaagcuugacguugcuaaugacaccugccucguugcuuugcuuaguuggcaaaagcaggaaaagaggugacagagaauguugacuccaaggucccuaggaaaucucacgauacacuggccgcugguugguacacugauuuccaggaaaagccccagaagcaguagagggagagccauguacuugggaguaggcugaaguaccuaacaguguaggguaaagaacagaauuggaacagaacuaaggcuguugcuuucauagcaucucagacuacuuggaacuccaaggacugccuaacuaaaguacuuucacaaacacuaacauucagaaggauguugagaaagcaagaucuaaucugaaauggaugacauuaacaagcuccuuaagccccugaaguuuuauugcaucugcuagcacuugaaugcugacugacaggcagauccugauauauccaaauucgaauuaauaccauuugaaauggcaagucuuggcuuaacgccuguuuguaugcccagcauucagcuguuuuacucaaagcuaggcaugucauaguaauugucuuuucagauggaaacuagagaacucuccuaggugugaucugcacuggccacuuggcaggcacaagcugcuuccuuccccucaggucuuaacccuucccagaccugcagcgauuccugucgacucccuuacacaguauugaucuucugacuguggaaacaaccuuccucucacuuucacaccuuuaauuuaaaucuauuuaagagaaccaugguucugauuguuguguauauuuuucuaaaggcugaauaaagcuaucuaugaaugugaacaaau

SEQ ID NO: 4071 - RNA, 888 nt, Mus musculus
gaguguuuuucgacuuucuaaguuaaggucuuuccaaggaauuuuuccugguguucuuagagccugggaccugggacucuucaccacuggacugccuucugugacgagaauccacccaucagcauacacugcuccuuuuuuuuuucuuauuuaguuuuuauucauaaucauaaacuuaacuuugcaauccagcuagacuugaaggggaaugaggaaaauauggaacccaaagaacuucagugagagcagagauuacaggacauugcgagcagaugggguagggauguucuccugagcuacagaaggaaugguuugauggguaaaaugcccgcaagucaaaagaaauuagaguuguccacagucggaaauggugaucuucuugcuggucuugccauuccuggacccaaaaugcuccauggcuuccacaguguucaugccuucuuucaccuucucgaagaccacaugcuugccauccagccauucagucuuggcagugcagauaaaaaacugggaacuguuuguguuugguccagcauuugccauggacaagaugccaggaccuguaugcuucaggaugaaguucucauccucaaauuucucuccguagauggaccugccgccagugccauuauggcguguaaagucaccacccuggcacaugaauccuggaauaauucugugaaaggaggaacccuuauagccaaauccuuucucuccagugcucagagcuugaaaguuuucugcugucuuuggaacuuugucugcaaacagcucgaaggagacgcggcccaagggcucgucaucagccgugaugucgaagaacacggugggguugaccauggcugcagcaagcggcgaaaagcgacaguggcgucugcaaagcccaca

SEQ ID NO: 4072 - RNA, 15027 nt, Mus musculus
acacaauuaauuaucaaacuuuaauugauagacuaaucuuacaggauaaacaauacaacagcuagucaagauuacauauuuaaaaaaaaaaaaauccagcagcgcaaaucuaauagacuaaauacguucaucuccucccaaacaggcguuuugauuuaaaaacaaacaagaacagaguguacaccacaaggaaacauaguacuuacauauugucagauaccucugcagaagucuguaggaaagguaaggaagguucucagacaccaaggaagcagagccacccacccuggcagcuaagccaccagcugauuugcacacuagaggcuccugucuacuucuaggccuaugaagaaggaaacgggucugauccugacuggaaguuaacuuuauuacaaaguuuaaagacagagggaccauccuuuuccaagggaacaggccugaaugguagcaagaagcaagagaaaguuggcagaugggugaaaagcccaaccuuggcauacaucuaucuauucccucccuucuuggcuccuagcaaagaaaagggcaggccaacugcaauagcucacaaugcuccuccaggcacauuaaagaggaaaaauucccuucugggugagauauggcgacuuuucugagaccuggcaauguagcaaaguucaucucuuuggcccucauaagggaaagcagcaacuaaggagcuacugaggaccuuaccaggcaggccccuacuaugucuacaggaugcaaagaaaguaauccuuagcccagucaaacuucauuuuaagagccaaagcuaccugcaaaggcccaucauggauuaaaauacuucuuaccaagaguccugcaacucagagucuaagagcucugagcugagggacccaggcucagcagcaguuaugugaucacauuuuucugccaagucaccucagggaggaaaaggaaggcaugaugccugugauggcagccuacagaagggccaccagugccacuugcagaugggagaacagccuuuucaguggcuacaugaugacaagcagaggagccuugcugugaguaggacucucuuacccagccucaugugauaccaccagaagccuucuccugcgugcccucucaucugacugaaagaauuguacagaaauaauccugaggaaaaaacauacuaggaugcuaccuaaagggaagaguauuccaaugcucacacagauuuagucaguauaucccacauguuaagaaauauauaaagacuguucacgggacugagugacaaaauagcaaauacugcugugacccagacagaucuaaacacuuauucccagggcuucuggcacugucugucuucuaagagcuucuggcaaagccuuccauacugacagagucaggagccagagcucaagcagauucagcaagcucuggaaagcaauacucaaaacggcuccauaugaaaggugucauuuacauuauuuauagagaauaucuccaaguaaggaaaaagcaccauuuuacuuaaaauaaaaaggcucacagaggcuuugguccucuugaaaugacaccggccugcgugagaagcaguuuggcccuugggcagcagggggauaauggcagggcaugaguacugggaggaggcggugaagagcacugggacccacacagaaaacagggcuggcaggaugggccucagagccaaggugggaacaccagaggcccgaucacagagaccaaaacuagguauguggcacugucaagacaggucucagagacauuggcaaacaaaugacaguauucaagccaagaagaugcucuaccugccacuuggucacuuccuugauaggccugccaagugcaggaggaggcugggacaaggagcaaagugcaccuucuccaggaacugcaggccaauaagaacagaaaauccacaacuaucacugaggugcaacacaggcaguuucuuggacgcuguacuucacacguuacuuaugcgcccaaaaagcagaguaguuuuuccuguccagaugcauaacuuggcacugaauacaccacaaaaagcaagaggcugucuaugugggcuggauucccaaacuacagcuuagaagggaagggcauaaauauugucauuaauuggcucacaaggaauagucaucuuaggcaauacaugcgaauacauuucacaggaugagggcggguaacagcuuaagaguccaaagugugacgcugggagguuucucaccaaaccuuacuaugagagccugcgaccagugagaggagaauugcaaagacagcagcagagaaacagcaaacagcacaaggaucauccaccaagagacugucccuccuuucagucaaucaaggcuuacagaaaagacagcaguucacauguacacagaaggucagggcuaaaaccaggagagcaagcugguccugaaagcaacuuaucccauucuguuguuggaauaccacuugcugacccacugggucagacgucuuccaugagaaaggcagcaucucugaaccugggauaaaggacacuugaacugaacgcaugagcagaaggaccgaauggagaagcauaauucaaacaaccauuggacugcuuaaggaguucugggaagcuucccaaaaaauaaaguguaugacguguggcuauauggcaagccggcuccucagagcagggggccuuggagcagcaaauccuaggcuguggugauaggcagggcuuuaaagucaagcuaaaggaaggcugucaacaagcaaaccagcaguggaacgccucagaacagggauccaaaggguacacaggaaucaagugagagauacucuacuguucgaagaccaccacagugaggugggaaccccuacaccaagaccacagcuguuacuucccauguccauucccaagcagcagcacauggaagagagccuggcaaagaggugaaaaugagguaccaaaagagaaacuggcaucuuugggauuaaaacgaaaucauagggaaauaauaaaaaaacaaaacaaaacuaucugaaucaaugagcacacacacaaaaauauauggcuuacucaccacccccauuuugcauacaauuuuaauaccaaagaaaaaaacaaaaacaaaacaaaaccaaccagacucaucacaaugcaguccaaauguuugcaaccaaagacaucaauauuucaguugaagucacuucuaggaaaaauaaaaguaaaaaaaagaaaggaaaagaaaaaaaaaaaaagaaagaaaggaaaaaagaaagaaaauaagcaaagaaggaaacaaccagaaagcuuuugaugauuccgucucagcauugcugguaggucuacucucaaacagacuuaagaguauaagaguauuccacacauguuccaaacuuggauuuauuaauuuccaccauacugacuuuaaaaaugguaugaagcugacugcaagaaagggaaccggugauuuuaaguucaaauuaagcuaauggugaaaguacaucaccucuggcuucagucaccacaucaccucagauugaauagagauuugugugugugugaacaaagucccagaacucugcaauccagggaugcugcggaccucucccggcaauguccuucacuuugggucagucuccugggccagaggugaaagugcuuucaaaaauacugccacuugcccagcacagugucuuugauugcauccacauauugaguuggaacccaguacacccaguaguaagaggcuuccguggggcccaacugaaacgccugcaagggaaaaggaaaaaccaagcgaugcuucagaggagggugaccaagcaggcagaacaacagacacaggagggagggagggagggacggagggagggaggggagcaaacugauuaaaaaggggagaaaaauaaaaccaaacuguacuuggggaggaguugccuaugcuuaaagaugagauggggaaugugaaagggcaggcggggaggggaaguucagcucagcagaguugacucuaaggcagugguuugcauacuucaguguacaucagaaccaccuggaagacucgugaacagauugcaggcuccagccccgggacuuaaguuugggaggccugaggcaaagcccaagaaacuucuaacaaacucccagguaauucaauauuacugguccagaggucacaguuugagaacagcugcccuagaaaaugucauucacacacaggaagcagguaugaaugaccaaagcacacuaugugaaauguuaaaauccuaacaaccuacauauccaucaguaaggaaggguacccauaauucacaguaguguggccuacucauacaaacacuggagucuuuuguuaagauauaaauagauccuuuggaucuugaguuaugacagaucacaaugucaaacccaagccaucaaguugcagaaggguaccaugaugcuauuuaugaaaacugaaaaaacacaacacaguauaccgucuuguucauggacauuguauaacaaaagcacugacagaugaagaacauauaugacagguuacaauaauggggauggagaaggggaaaacaauggggacaacaucacugcugguaaaaaauuuuuuuuauuuaaaagauuuaaaacaugauacaaaauauuuacaacuaucauauucuggugauggauauauggguaguggcauaaauguaagguauguccuuuucuguaucuuugaagcauaacucuaaauaugaaagagcgcugugaacugugacacacuacucuagcuagacaaauggcauaugcaagagaagaaguaaaccucucuucagggcaaggguaaagcgcuaucuaacagcauucaaaucagauagacacaaggggauggcuggauucacuuuuggcccuaaaugauaacuaaauuuaauuugaacuaaauucuaaaccaauauucauuaacacacauuuuuaaagaagcaucuauugugguccauucauccuaucugccuccccaucaccaaggugcaugaaaaacaaaaacaagaugugcaagccccacaggguuaaacuguucaaacaaauguuucaaaaaaagagugaaagggccaggccaaaaauaucaauaccaacuguuaaaacagaaaaaaauaacugagcaggcaaaacaaaugggcguguagagacuaccuaauggccccaaagccuaguaugcucucaucaccaccaggaaaaaaguccaagagccugugaccaucgacugcaguccagcugacccugagcagcaggaaaggccacagcaacucuccagaccauuguacccuaauucccccucacugauugccguacagcaaauagacuguccaacacaucucugugccauggacuugguaaucccgccuacaaucccaacaacugcuguuucucauggagguguaggguggggagggauaugguaacauuacuacaagcuacugaaaaagccacccacugaaagaaaacagcagcaaacccaacucugaaauuuggagucuaggcagguaaacuguauguauaaagagcucguucuguacaaacugaugagcuccaugaagaacaaacaugcccugagucccagccucccaaagggacccuggcuacacggcacgugcugggcaugacagaucacuacaagagggagccuucucggugucuucacagccuaaggggguguucucuuuuauaaguaagacaaaacuuaaaaugaaagucuacaggccauuucaauucauuuuccuggccuaaaaacaaacuaauccaaauaagagggagacagaagaaauuucuaaaaaggacagaaaaaaacauagccuccuuuagacaguugggauucugcaaauaaacacagcugggaacaaggucauggacacaccucuucaguagacaagaaaauguaaaggucuuuucagucuccugaagauugcuuucuuuuaagauagaauugccugugaaaaauccacucccuacaagaugaagcagaagcagguggccaggcaggcugaggcuacucaccaucaugugguagucuucauguccuucaauagguucacugaccacauuuuuaauggagcccaugggcaguuucucaguccgcucuaggaugaaagaaugacagcaguuacucaagggucuaccugucccaacuccuccucagccacaacuccucccauaccacagcugguuggauguauaguaacucagguagcagacaacgcucccucuggggaugaggaacaccaucuucugacugauacaccuaaagucugagagggaguugggaaauauggagcaccaaaaaaaagaacaggguuuggugauggcaugggaagaguccgagggcacauuuaccugucuuguuaugauaaaugaucauuaauaacaccucaaaacucuucuauguuuucauaacucaaaccuaguaucaguuaagguuuugaacaccuaaaaaaggcaaagucaggaagcacacaagaaagcagcaacaggaggaguaugccaagcuugcaaggcgaaugccuaugccaagccucacccaaaccuacaaacaucaguuugcgguggccucucaaaacauuuacacucucaccugauuaacacuggggacaccaaugaucacacggauagagaacauuuuacaacaaguuaaggauggcacaaaagaggaggcaauaaugaggcuggccuucagggaggugaagcaagugcaacagacaaguguaaugauggggaggcacgaggaucugugccaaaggaaauaacccaggaagcaccagauaccugaggugcaggcagguauugucagaaaacugguaaauaaggugggaaagacuccuuauggccuccgcaggaaagaaaaaaaucuagaaaggcagacaaguacacaaauaaguuaucaaacuagagauuuaauaagaguccugggcucugguuuuaccagugacauaaaguauuucgcuuacauaguccuggaacuucagaaaacugggaacagggaaaguuuacuuugugguccuaaauaaaacaacagucacauacagacaagaccaauggcauccuuaaagacugagacuuuaaaauuacuugcacuuaggggcuggagagauggcucagcaguuaagaguacugacuauucuuccagagguccugaguucaauucccagcaaccacacaguggcucaaaaccaucuguaaugugauccaauacccucuucuggugugucugaagacagugacaguguauucacauauauaaaauaaauaaaucuuuaaaaaaagaaaaauacggguuggagagguggcucaguggauaagagcacugacugcucuuccaaagguccugaguucaauucccagcaaccacauaguggcucacaaccauccaugaugagaucugacgcccucuuauggugugucugaagaaaccuacaguguacuuacauaaaauaauaaauaaauuaauuaaaaagaaaaaaaaaaaaaaagaaaaauacuugcacuuugaaaugccuggagauuucauaccaucauagauucugaccuuucuucaaauuccaaagguuagacaauccaaaccccacaaggcagauaacagcaaucagcuaagcuuugacuguacuacaagcagggugggacagcugauuacaaccugcgaaugcucuuauggacgucuccaugaucucacacugcuucuuccuauccagacagcaaaauguuguguguggcagccuugaaggucccuucgcagcaaaaaagccauggagaagccaauuagcugcugggacagucacuucauugcagcuucuuacagaaaacaagcuaguggcuuucagccaauucccagaacaaguuguacuucugcaaguccuuuugaugcuaggugacaggccuccugagcucacaagaacaacacuuagccagccccuggguaugcuagguugauaaaaggaaagguccagcugagaaugaagagcucagccucaucaaccaugaaaggcauaaggacuucauggccaugcucuuuuaacacaguuccaaucucuuugcaucuggacccuuucagagcucugcccucacacuaaagcaggaagccagaugauuuucgaagcuuaaauaaaaucucuaagccuggcaugauaguucauguacucaaaagccugggacaagagaaacaucaaaagucuaaagccagggcuaccccaucguuucccccaaaguaacaaacaacauacacauuucauggggaaaaaaauuauuccaaggacccauaaagcacaagacaugauaaagcuucacaugauagcuuuacuagaccagacuagucaccugcucugaaucuguagcccagcuacagagcagaaccaugugcaucagcaagcaaaugacauaacagaagacaaaaacaagaucaccaggaaagccuagaggcagggcagcuaaucacuagccaaggagaugacaagacaagcucuccagaacaaaauguucaagcaaagccaacauaagucacuggaacacuggaaaaaaacguuaaaacuuaaucccuaggguugaaacaguaguguguguucuagauucauguuuuagaaaauaaaaaccacacuucccaccacccugcccaaguuuuauuuuugugaaacuugguuccauuuucugcauucugcccuuggaagcaacaaaucucugaugauggggccucuauucuuucuuuggcauuuaccucgaacacugaauaccuacagugcuggccagaaacaggugaauuaggcauguucgggucccuccaggaaucuaacggggacagacaagucagagaguaaugagugcucuggggacauagagugcuggagcagcagcagcagaagcagcagcagcagcaguucaagagaagaguuaggaagauguaaggaagguuucuuuagaaaagggcaucuuaggaggaggagggcuuuagaagacuauuaauccuaagggcugaggagaagacauucuaagguaggcccuggaaagacaagagcuaugcaaaacaugagcugggaaauugaagacuguggcucaagugcaugagacaugaaggcaaacccagcagaccaaggauuuagaguaggguaauguuuagaguagggaaccgagccuugaagagcuacgacuguuuacaggcacaagaacagacaaaaagcaguacaacaaugaugaucaaaagaugauggguggggacagggaaacagaaacuugggucuaaugcaauuuuuuaagaagauaaaaacagccuuuaccaguccuggugaaugguaaagaaagggacacgggauauucuggaguguuacuaacaagauuugguaacuagccaggauugauggugcacaccuuucaucccagcauucacaaggcagaggcaaguggaucucaaaauuuaaggcuaaccuggucuacugagcaaguucuaggucagccagagagaagccccacaucaaaaacaaacaaaaacacugguaaccuucaggggaagguucaguggggauggucagagagauauuuuccagaaauaccaagguugaaccaaccagauacugcgcacauguggggaacugggugacaagggauaaggauauauauaaaguggaaucagcaggcaaaggagaaauucuaggcagcaauuaggaaaacuucacuucuauagucaaacugaccuacagaggucaggcaggcaggcaccauaagcaaagcuaacuaaacaucagacagggucaugaggaccauggugaacaccacugcucagucacagcuccucaaugccaugggaagaguacaggcuccaauggccagaucuuuugauauuuuccaagauaagcuccccauuaguuucaagaaacuauguaauuuguacaacuaugugauauauccauaaaacccuugcuuaaguaccagacgcuuggggccucuugguuuguauguaauuuaagggccgaauuuugaaggaaggucucugaggucagacugaaaaggaugagggguauggagucaaccaagaugcaagcauguaaagacauugucaaaaguaggaacacaaaaagcaccaugaggagaggggcuccaaacgaaaggcagaauggcagucaggagccagugcugcuggcacuagaggcaggcagggugcugggaugccaaggaggcuaagagaacuagaguaccuuuagugccgauccacagcuggucuugcucuagcuuaaaggugagccucacuuucccgccagacuuauuguacaugccagacaaggguaccguuggcaggcgcuccuagaggcauaagagcacagugagaaagggagagacaauaggacagagagggagaugagacagaacuucaaggucaugauuauagcaauguuagacuaugaacuggcuccuuuuuaggggcuuaaaaaguaggccagcuuaccugggcacccuuaacagacggcaucacaucuucaggcuuucccuuguccaacacuuuccuguguugcuacaauauaagccacaacaaagaggaaaugagacagcugacucuaugagcugguuucuagcucuugaguagacagaaugaagcagucuuagaguccauuugaaaguauuuaguaucaacagacuauggaucccuucacacugcagggcaauuauguucaagggaguuuguguugauaaugaaauguuccauaccugggcuagccacuggccugacuaaugagcaccuuauaugugguuagcaacacacagauuugacuucucaauuuuuuguuuuguuuuguuuuuguuuuuuucaagacaguuuuucucuguguagcucuggcuauccuugaacucaagaaauccgccugccucugccucccaagugcugggauuaaaggcgagugccaccacucccuggcuacuucucaauuuuauuuaagcuuaacuacuauccaugucauccacagccacugaauuagauguguuccacagacuaaguaggauuuaaagguucuacucacagcucuccagguaaaaaacuaaccauuaagucaacaaguaggaaacaagagcaauagcuguauuauucaacuucaaagaaacuauaagcugacuauauaaaugccaagcggggucauuuuugcauuauuauggaaagucauuauuaugacagaagucuucucuaccccacccucaacccagccacaaagaaaacccaaggaaccacauuuugaaaacagaaaaaugcugacaccccuauacccuaccauuaagaagcuuccaagccccacuccugcccucuaccccaggacccagaaguuuaagcucauagcccucaaaugcuuucauuuccuuuacaucuguaccuuuacagguacaguagcugcuugguaaagcuggaacuguaggccaauaaauggaccagggguaaaacuaagccaaauguaagcauuaacaggcagugggccaauugaaaccuucaccacugucacagcagaacacugugguaggguugcuagugaagggcuguugcugacaccagccucagauucuggaacacacugaucaaaagccuacugagggaguggagucucauuaggucgugcuaugccucguaaccaguggcaucaccaaagcaaagcagcacagacuggaguacaguuugagucauaccuuguaaggaccuuugggagcacugucccugcacugugaugagcagcucuaagccugcugacccaccauuaguaaccuaaaacccauauuuacaaggcagguuauacacuaaggauuugacagaggacaguucucacauuuucuucauagguaugucaggggaagauagaaaauaccaaugacgucaacaaauuacaggaaauuuggauuccauauguagggauuaaaaugguucauacaaauaauuacuuuuagaucauaauucaucuuuucaacauacagcgacucugcuuugcaguagagcauguguuaugauugacaaggucacaggcucaaucccuagcaccaaguacaacacaaacaaauaccccgaggaaagcuguuuugaaaucaaaguuucagagauuccguaaagauaacacaguuuucgaaugcuacacaauauucucuaugguaucuaggguagccacuugucacuaaacauauuucuuucaaacacauucguguuuccaucaaaaaacauuaauauaguauaacuauucccacaauucuguuucaauuuuacugccaaauuuguaaaaaaaagacuuuuuggguuacaaaguaaacauggguguguaaaggaaaaccaucuuucuuucucccagugcuggcaaugcgccuuuagugucaacugucccucaaaugcugguucaagugagaccuacucuguugaagauacagaguaaauaaaaaguucguaauagacuggagcagcucagugcaggcuucuuaucuacuaccaagaguaagacucuagcuucaauccucuguacuguacacacacacacacacacacacacacacacacacacaauaaacaggcaugauggcacaugaccauaaacucagaccuagggaguuagagacaagaggauuguuaaaaauuccaggccagccauucuccaaaucauguuucaggccagucagggauaaagaguaaaacccugugccucaaaaaacaagcacacaaaaaugagcaggagagauaauacaaaaacucagacuccuucaugaagaaggaccacuauuaauacaaaacaaaacaagugucaguaucauuugcuucagcuugguuugacuuccugaaauggucaguuuuaggggaaccucuaaaaucuguccacuuccauaccuuuccagaauuggauuuucugaacuugacaagacacacagacacagaaaucaaaugggagcaguuagaaggaacaagggcuuaauuccaauacuggucauauucucuggcacuacuaagagaaacccacuugugacuuccuuugcuaacucgcuagagucucccuuuacaaaggccuuauccuaacgcgggaagucuaagcacacugacccaccagaugacaaagaugcauauuucagguagcugucaacuccacucugcugcacccaacugcuccauacauuuccaucaugggcccuguccagaaaggagcuuauucuagggagacuguaaccagucucuacauucccaggaccacaagcagaugccgaauggucucaccuucugccugcagaggggcuccuucuuguuuucuucagccuuugcauccugcugggcagcaucuuucgggguguuuacugcuaaaacaucauuuauaguagaaccaaccaccaugaucuuggccccacuggucacuuuuauuucucucaaagucuugucuucaggaacaaguccuuuauacaugaccuucugcauggcaggugggagaccuugacaaaaaguggaaaggaauaagcaggaaaugcguggaccaucccccuucuauaacaaaacaggaagugaauacugguccaucaacuaucagcuuugugaacuugaaggaguucagaacaccaggacuauuugauugguaaaacuugguccuucuacaugaauguaagguauuuagaauuguuugaugucuagguaucauuguuuccaaguuauaacucuaucuucuauccacuuaaauacugaaaauucccaaguguaggagauacagaaagccaauaagcuuuuuacccgauacauggagaaagcuuuaaggaaaguauuucaaguagcaaaccaaaacaaauaaaacggccauguaugaauauuuauaaagggccauuaggacaguugauaacacuguuucaugaacuucccuuaugaaacugaucugucugcugaaaauaaauccguggcuaaauacuggaccuguucagaaucuccuguaaaguucauaaauaccgcgccuagcaaugacaguccaacauuaguuagaagggugagccuuaauacucaagauucaggcuugcaucucacuccaccacuuggugguaccacuaucauucugggccuaauuuucccucucugauuacuaauggacauacaaguacugauuucagaaaacugcagugaggauagcgggagucuaggcgcaagaaaaucgcuaacaguuuagcacgacguaagcaucaagagcuagaagguaggucguggguagaagcagucgggugucagcuccucgaauaccuguaauggagugaaucuucugcuuuagcucggaccccgugcuguccagagggaccuucacgucguguuuggucuuguuccagauuaucuucagauccaccagcuccuugcccacaccgccgcccgcguccucgccguugcugaccgaggccugggccgcaggguccccagggggcugggccggggccggcugcagguugccucgcgcgucgcaggaguccuccgccgcugccccuacggcugcuucggccuccacgcaguugaggggccgugcgggcgccucgguggccacagccucggccuccguguccaugccuggcuccuccaugccugcaaagggguuaggggggugggugcucgccacgagcccggccugcgacgagaacgggcccgggcaccgucguugccgcgccacgcuccucccuccggggccaggcccggucccacgaccccggcagcguccgcaagcucuucagccgccgaccgaccgccuuccccgccacacucaccauccggggcuccggccgccgccaugaugauuguguacaacacccaccacgaccgcaggggccgccgggaagaagcgagcuggcggagauuggcccccgcaccagccccuaauuucacacaggcuggccggaaacagguggagguuucuauggagacccgccuccuccgcuucccgggccggccccugccacgcuuuagcauucccgcagccggagggggcgggucugggagaucgccugcucgcagcgcucgguccccgagcggcggcgcaucgccgcccuaguccagaggggcgugagcagcccagaua

SEQ ID NO: 4073 - RNA, 20396 nt, Mus musculus
acuguuguuauucuuguuuacugcugagaguauugacguccauagguacuaaguguuagaauaggcagggcagucccaggcaaaucacaccaugcagcaggucucacaugggagguuuguuggcagaggcagccuaugggagaggguagaaggaaaaagggggcugguguggggucgaugggucuuuuaucugggcugugacucauguacaaagggacucagugggugcuguggcaguggaugcagaagcaguacugucaccuagagaugaugucuggucacugggucuaagagcuggcuauaaagaccagugucugauguuaacacuaagugauuugacaaagacagagguagagcuacaauuuaauauacauaccauuugaguagcugcacugccaaucggacucuuuguugccuugucucauaaaaccgugugcuauggaugaaggauauuguauuaguuagguuucuauugcugugaacagacaccaugaccaaggcagcucuucuaaggacauuuaauuggcauuggcuuacagguucagagguucaguccauuaucauagcaggaagcauggcagcauccaggcaggcaugguaguggagaaggagcugagaguucuacaucuuguucuuaaggcaaacagaauacugcuaucuucaggcagcagcucacccccacagugucaacacuuccuccaacaagaccucaccucccagcagugcuucucccuaggucaaacauagccagaccaccacagauaugaugggcaaauugaaacuagugccgaagacaauggaagcuugggaaguucaggagagggauuauugugugugagggccaguaucacuaaagggcauauuguuaggggacugcagguagugcagggagcagacaggccuccaauucagcaacaccugaaagacccucauccauagaagcagaggugccacaggcaagguuugguuucaugcugucuuguagcuaaagaaacagcugucgggguuucugacaauggugucuuaguugagaauguuaauaaccaaagguagucugcaugaagucuagagaagaugcuuuguauauuucagauguguaccacagacuggauuauaguaaaagccagguucuuccaucccagaugcagaacuaacucucugcccuagcuaagugucagauguuaaaguaucggccaugcaguucacaguucuuguucuagaagccacaaagacucagcauggauacagggggagcucauguugaugugaaaacaauucuaauuggaacgauaauucucccacauauucuuguugcaaaggcauuucuuacuauguguagagcaaaaguuauuguucagcucucuguuaaugaaagaggaaugaagaaaguugaucucaaucaaacagucauggugcgugguugaucucaauuaaacaguccuuuaaccccagcacuuugaaggcagauaaagaugaucucugaguucaaagccagucuagucuacauguagagccaguuucaggacagcaagaaacccugucuugacaaccauccccccuccccacacagacacacaagaaaaacaaacaaacaaaaaauugaugucaaauaaaagaaaggacaauaauaauuaagggagaagcuagaaggagaugaaauaagggcacuaauguacaguguagcaaggaggauguucuagugcauggcgcagcagaggagccucacuccacaacaacuuacuguaaggcuguugaaauggcucagugguuaagagcacugacugcucuuccgaagguccugaguucaaaucccagcaaccacaugguggcucacaaccaucuguaaugagaucugacgcccuccucuggugagucugaaaucagcuacaguguacuuacauauaauaaauaaauaauuaaaaaaauaaacaaaacaacuuacuguaaauuuaagaagugccugaagaggcauuggaaggcucuaaacaucaagugauaagacagucauaauuucaauugcauugauuugaucagcacauguucugcacagaaguaucacacuauaacuuacaaagacauacaguuacuacacugguuauuacauacugacugcugccagaaaugaacccugcccuguguaucccuggcaagcauucuauccugaguuacauuucuaacacuuagcuagucugcuugccaagaucugcuugccugugcuuccuucaugcugggauuaaagcagacugcuaccuguuaguaacuuuuauuugccaaauguaauugucuuggaggcuugcugcugaauuagcuaacccuuucuaguucuuuuugaacucuggcuggcagggucaacucagcuguucuggcucaaaauuccucuccaaguugacugauuuaaacuggcuucucucaguuucucagugaauuguucugcuuggccucaaacuaacacugacaaucuguucuaaucuucuggcuccuucucauucucuaucucauucugucuucaccugugucuaacuuguucucucugcaaccugucucuguaaaacugucccaguaaaaacugccucugaacugaagucagugaaacucaacccaacugcacugacuuuaauugcuuucaacuaaacugaacagaacuacaucagccaagcugaccuaacugaacuuggugcugcucuuaaguagccucucuuuccuggcuguucucaugaguguugggcauaucccaucucugacucauucugccagcucuuucucugauuuuucacuuugucccucaauuagacaucacucucaaacaugggugcuuccuucugcaaucuaaccuucgugguuugggauuaaagguguauacuaaggguaugucuguauucuagccagagggauuaaagguguguguccugucugcauuccagccagaucacacagaccuaggucuuuggaugugaucccuugccagaacagccgugcugcuggauuagaauuucuuuacagcuaucauuucuggugauagagccuuuuuuaaaauuuucacuuagggaagcuggagagauggcucaacaguuaaaagcacuggcuguucuuccugaggacccagaaucaauuucuagcacccacauaauggcucaccaccaucuguaauucuagcuucggggccuucaaaggcaccaggagacaaaauaccaauacacuuaaauaaauaaaacuuugaaagauuucauuuggcagcauacuuuuucucauggaaacaagcaggcugauggagauacaggugaauuaaagacagucagugggccggagagauggcucaguggguagugcuuucuguguguggugaagaaucugagcuucaaucucuagcaccaauaauagcuguacaugguggcacauaccuguaaucccagugcuuggagagguggagacagugcugggggcccaguggccaggucgucuagcuagaacagugagcucuaggcucaaugaaagaguuggucuuuuaaaaaagguugagaauuaccacuuuccugauauaaaccuguguccuacacacacacacauuuaaaaaauaguuaaagaauggaacuuugaucugcuuggugaguaaccccaggcacagguuuaaauuguauucauagauuuccccuaaaccuaacaaauaacugaguuuucucaugccauauuucuugccuuuaaacugcuguggauuauggaagaauugaaaaaaaaugguaccacuguauaaaguuaaacauaagguguagucuaaauauucaaauauuuaucuccugaggacaaacaaauugacuaauaucuucuacuuaagaauauuugucaagauuuuuuuuucuuuuggaauuaacaagcaaacagacaaguaaccguuaaacaggcaggugcccaaccaaauguauuagauuagcuaauauaaagcgggaguccagaaguagauccuaauucaugcucucaugacccaaagguucaucugauagcaugaaagcaagccuucaucccuuuugucuuccuucuggguuacuuccugacaaggauaagacgcugcuguagguacccauccaucuucugggaccucccggaacgugcuucguuucccugucuucccugcagaaacucauguuugagguucacagacuaauuuggcucauguguuaguucccuaaccagucacuggucaagcauggagucuauguaugggcuagagguaaagaaugugaccacgauggggguggguagugccccuugcaaaaagcuucuguuaccagaagaaaaaggcagcaaaacagcaggugccacuaggccaaguagaagagaaaaagaacucucagaagagaaagguuugccuaaugucuaaugccuaaaaugauauguauuauccuguagcauuuaugugugcgccugcacacacacacacacacccuuuacucguccuugucagauuccacuugaaguacauaauuucacccaaacacccugucauuaucccuggcacccuggcuguuauaagaagccaugagugcccggguauggagaugcaugcuuguucuccuagcacuccagagguagaagcaguuggcucucugaguuugaggcuagccuggucaacauagcaaauuccaggucaaguagggcuacaauaaugagacacugucauaaaaauaccgugaauaaagauaauauagaacagccucuacacagcacacuaaccaagcuuuacuccauguugugaucaauaccuauuaaugagauuauaauuucaggggcgccguuguguauugaaagacugcugcaaaauucucgacaauacaguauuacccccagaaacugugguccccccauucacugucuucuccggcugcccagguaauguugauguuaauaugucuguuucaaccgccuuaaaacuguuuuccgucacuaaaguaauagguaagacuucugucucugauaugugauuuagcaacaaaauacuacaaaaggcguaugaauaaguaguuuuuagugagggugguauuuguuuuuugagacaguggucucacuagcuuuggcuggccuggaacucacuauguagacuaggcugccuuugaacucagagaucugacuguaugugcccccuagagcugagauuaaaagcauguaccaccauacccagugaacaaguugcacuuggaaaucaguaacugggcucacaauuuuuuaaaacaggaaauaaucagaaacaaagaacaauggagacccagacuggaagauugcagugaugaauguugcuaucacagcagagugauuaaaaaaugugguacuuguggggauagacgagaaagccuuagauccacauaugguagagagauuucccaaacaccuuugaaagguuucuccucacaaagguugcgguagggucuagagugcuggcucaggggugaagcacacugaugcucuuccacaggacugguuuucauuccugacaccuguauggcagcucaacuuuuuggaauuccaguuccagggaauucaguucccuuuucugggcuguggaauaaccagcuguacacagguauacagacaaaacaccuguauacaucagaguaaauaauaacauugaaaagaaaaguuugcuaggaacaaauuugccaccagcacgugggaaggacaaagaagcauuucucucuugccugggcucugaguggacgaaggagaaaggaaaaucuccuuagagauaugugugcuucaucuuuuuuuuuuaagauuuauuuauuuuauguauaugaguacacuguagcuguacagaugguugugaggcaucaugugguugcugggaauugaacucaggaccucugcucacucuggcuacuuguuccagcccugcaugcuccagcccaaagauuuauuuauuauuauauguaaguacacuguagcuaucuucagaugcaucaguagagggcaucagaccccauuacagaugguugugagccaccaugugguugcugggauuugaacucaggaccuucagaagagcagucaguucucuuaaccacugagccaucucuccagcccaugcuucaucuucuuaauguauucacauucuuuaguaccagcuucuuauggucacugaacacuaaugccagaagacaaagaagccauccugguauuucagauggaaguaauaaagacuuuuuuaaaaagcccaaauaccugugaccauccagguugcuguacaugagcaaacuaagacuggaaggugugcuguccccagugucaaagccuuguccagcaccaaagaccccucauuuagagccuaaacuucuugcacugugacaagauacuucugauuuuucuuuuguguaguuucacagauaaauacuagacauuagaguacuuuuuuuuuuuuuuuuuuuuugagacaggguuucucuguguagcccuggcuguccuggaacucacuuuguagaccaggcuggccucaaacucagaaauccaccugccucugccucccaagugcugggauuaaaggugugcgccaccaggcccggcuacauauuuauuuuagaguauuuuauuggcacuuccaucuuugaauucagacaugugggcuugcaggaaaucuggcacauuaauggagagccaugugagauaaaauuaaaccaugaagcuggaaaccagaauggaucuugaucagaagccacaagcucagacgcuacugcagccacaggcagauagugcagugaugaaagccguagcccaucauggcugcuugacaugcaucugagagcaugaaagcugauguuuaaggaacugcuaaaaaugggaguuuuaugugauauagcuacauuuuuuaaguagucuaauuauuacauaacgauuaaauacuguauaguuuggggccuggagaggugacucagcaguuaagagugcuuguuucucuugcagagaaccacgguucaauuccuagcacccacaugauaacucacagcuguccauaaacccaguuucagaggguccagagcucucuucugacuucccugggcaccaggcaugcauguggugcacaaacauacauguagguaaaauauucauacgcauuaaagccagguguuaaagguacacaccuuuaaucccagcacuugggaagcagacagguggaucucugugagcucaaggcccgccuggucuacaugaugaguuccaggacagccagcacuaccuagagagccggucucaaaacaaaacaaaacaaaacaagaacacugugacguuugaacauguuugcaggccucaugugcacuuuuuauuuguagagugccuaugagaauucugugagguuuuugguuuuguuuuuauuuucagauauacucaguacauuuuguaaauauauaaaauauguaggugugcuuauguguuugaauggauaauauagguauuugaaacuguaccuacguaagugaaaucaaacuguuucucuguacggcuuggaaacugcccuuuauuuggcaguauacuauugcgauaaauagagacccacaucacuccucucgagaguuacaaacuucacauacugcauaggugaguuuaacacaaagcagugaaucagucccauaguacaauggaucauuaaacggugaaccugggcacuauuagaaacugcuguccugacauuguuuuacauguauugugcaauugggcacaguuaucucugacauacauucuuagaaguugauuuauaaguacagggguauaaauguugaaaacuuugcuaacuuuuuauuuuaugugucuguguccuugccugcauauaucucugcacuacaugcaugaagcacccagaccuagaguuacacaugguuguuagcugucauguggauguugguacugaaccuaggaccucuguaagaacaguuagugcugcucuuaacugccaaggcauuucuccagcccucugcuaccuauuuuuaaagugcaugaguggagacagcagcuuacauaccucuguuucagaaaguuuguuguuguuacuguuguuguugcuguuguuguuuugggacagguuuccuguguaucccuggcuguccuggaacucacuuuguagaccaggcuggccucgaacucagaaauccgccugccucugccucccgaguccuggaauuauuuuauuuuauuuuauuucauuuuauugguuuuucgagacaggguuucucuguauagcccuggcuguccuggaacucacucuguagaccaggcuggccuugaacucagaaauccuuuugccucugccuccuaagugcugggaucaaaggccugcaccacugcccggcaccacccuggaauucuuuuuuuuuuuuuuuaaauauuuauuuauuuaauguaaguacacuguagcugucuucagauacuccagaagagggcaucagauuucauuacggaugguugugagccaccaugugguugcugggauuugaacucgggaccuuuggaagagcagucggcgcucuuaaccacugagccaucucaccagccccacccuggaauucuuaaccaugcuuguuccaccauggacuguucuguugucuucuuuugauucaucuguacccaguaucacugcuuugguggauugaguuucacuguaggaauggcaggacaguucuuuccucaggauaaagauaaggcucaguggggcucaguggggaugagaagcccuuguguggaacaacccacagcagucagagaugcccucucucuuuggaucuuguaagcaaguucugaccuccuccagcuggacugagagcuguaguguuugguucccaaacaaacucagaccuuuccgaagauguauguacccagcaaccacauggcagcucacaauuucccauaauuccaauuccaaggcaucagaagauguauguagucaacagucuugucagucugaaggaccacaaaguuagauccucgauagagagugcaaaagucuuuagacuuugcacaaauaguaggguuacuggccucccuggcuuccuugcuugacugggucucucuuuucucaggacucuucucaggggagcucccagagugcacacaggagcugaugauugacgucaccaaaagcuacuaccagaaguuucuaccccuaacacaagucuaaugucucugcuucauaucuuuaauucuuuugaacucuuaagacgaaccuggagauaaagagagccgccagugacuacaagagcuguccuguuuuugacaacuucuacucucccguuguuggcuuuuuuuuuuuuucaauuuuccauggcucugagcauuuaagaauuuaauaaggcuagagagauggcucagugguuaagcaugcugguugcucuuccagaggacccagguucaguucccagcacucacauggcccuacgaccaucuauuacuccaguuccagaggaucugauggguuucuggcuuccauggucaccagacauauaugugguaaagacauaugcagccaaaauauccuacacaccuaaucugucaacaguugccauaccaucgucugaggaggacagaaaggucuguuccugacacucuagcccugugguucugcagaugguuggaaccugccuggcuugggccuacagagcaacagcacccucccagcauggagucacaugacccaaguacugcucagaacccuguccuauccccaggcuacacaguccacacagaugacaggccacuuuccugcugcuaagaugggaccaauaaccacaauuucuugugcccuggggaaagugugauuucaggcccagguuccuauuggugguuagaacaugaggaagagacaggcuguggugacguauacccauccucguaccugggagguagaggcaggaggaauaggagcuacauagugagcucacacuugccuggugggcuacaugagacccugcuucaaaacaacaaaaauaaagucaguaaaaauaagugguaucuguuguuuuaagguggccuuaguuguccuauaguagcuaauaaaagacguaaaacauccugguuuaggcucauucauuaaagaggggacccuacacugcagacugugcuucugcaaaaucccagguuuaggucuucagugcggauggcuuagucagguccucauuccuugacucaaggauuacuucaccaaaaaugaguguccgugagccuugcucucuagccuagaugcauuuguccuguguggaauuuguuaacacucccaugcuucagacuaaaauauuuguacuugaggucagccucacauuugcaugagaggcuuuuuaagucauccuguggacacagcccgaggaagcggcauugccagugccccuaacugguucugcucagaguccucgguuuagaggugaagggcuugguccauugaguucucucagacaguggccaaacaguucagcacugaagggcaagacccagcaggggccuccuugauguccagcuuggugggguuggcaggaaaaccugagugcacuugacucuaauccaauucagaaugcuuucuguuugucauuugucauuuuuucauguguuaccaacgaguccaaaaugguugcuucuuccugucuauuggucuagucagcaugauguugucaauauaaugaaccaaugugauauuuuguggaagacacagaggaucaagaucccuucaagcuguguuaugacuuagggcuggagaguuacuauuuccuugagguaaaacugaagguauucugcaggcuuuggcaauugaaagcaaauugcuucugguggucuuuauggaugggcauuuguuagauguuuuagucaggguuucugcugcugcuagaaaacaccaugaccaaaaaaacaaguuggggaggaaaggguuuauucaucuuacacuuccauauugcuguuuaucaacaaaggaagucaggacaggaacucaaucagggcaggaaccuggaggcaggagcugaugcagaggccauggaggggugcugcuuauuggcuuucuccccguggcuugcucagccugcuuucuuauagaacccuggaccaccagcucagggguggccccacccacaaugggcuccgcccuccccccuugaucacuaaaugagaaaauaccauacagcuggauuucauggaggcauuugcucaacuggagcuccuaugguccagguaguuaaaaaauggcugucuacuaacagaagguucaagaauccagcaguuguccagucugugaggcuggcugucucagcuggucuucaguauaugcuggaauccuaaagauguaggcucuaauaccagugaaggaauggacuugccagcgagagugagagcaagcagacaaaaagagagcaagccuccuuguuuccguguccuuuauaaaagcugccagcagaaaguguggcuuagauuaaagguagaucuucucaccucagugauccauauuagaaaugggucuuaucacuacaaauaguuuaauuaagaaaaaaaaaaucccucacagaugugcccagacauuuagguuuuaguuaauuccugagguagucaaguuaacaacuacgacuagccauaacacuccccuaggagugcagguucacaagugucuugggacgggugugugugcguguuuagauggggccucacugugaccuggacuaggaagaaguuucugauauuaaggagaauggacaucagcagacaauaagcagaucuucagauuuacuguuuuuuucucuuguacuuuugggacaugauagauuauagcuccagacuucuaccauugcaucccaauggcaccccaguuugggccuagcaaaucccaaagaaagugcugucugugguuucuacugcaaugcuuguguccuuuuggaucaauaacaguggccaaugguguuuggcccugugauuaacccagucagggucaugaccuuuccuuaugggaggaauggagucuauugccaagucaaggugcuaagaagauaaaaacagucccgacuacaaacaguagcaaguguguaauuaugugcugguaguguuugagcaugugcugucaugagccgguauccuaggaagggccagcuggacucugucuccaugguggcucucaccccauggauagucugcuaccaggcaauuacacuuccagagaagaaaaacuuuguucuuggaagagaagguagaugggaaagaccuuucccacuggauagacgagaaggaggaguuugguuuguguugccgagaaagccagaccucaguuggauuucaggcuggauucuaagaccaaacagcgucaucaagggcuugccucucuccaggucccuccucuguuuuccuuugagauggcucuucuuuguuucuuuguuuguucuuucaagacacacucucucuauaguccuggcugucaugggacuuacuauauauagaccagacugauccuagaaauccaccugccucugccucugucuccugaggagugcugggauuaaaggugugugccacuaggccugacuuauuuucagauacuguagugcaacugcccacagcuuuugucauugguagaaaaagcuccccuuugcugaaaacucccuggcuuugguucucauugguccagaccaaagagcuauccaggcucaugguagcuaggaagcugaaauacaggcacacacuagauuuagaguuaauggcuagugguugugggaagaagccgcuacagaggugauaaaugugccuaauagccugguuguuuagcacuggucucagcaaaaggccccaucagcuuggacgaauugccauaagcccaugcacugaaacacagaagucuagcaacagccuugugcuuuucuguugcccauuagcauagggaggugggagccugaccacgugcugugaagcagaagauggcaccaccuauucacuuaaauacuucccugagccuacauagaggaccaggccugcacuggagaguaagauucagucccugauccuggggaccuuacagcuuagucaggggagaaagccaugaaacaagaguucucugguggaggucuucguuugacaguuagucaugaugaagugugggugcuggaauuaggcaugucagcucucauucugccauguacuccucgcucaguuaugccagcccauggcaccucggagcucucaucuauaaagcaagaaggugguuugaggauuuuaguuccuucacucauggaaagcacugguucucagugagcacugcacaaacagccacuagaacucucuucagaaagggaaagaccccgagccgaagcccuguaguuaaaggcacagcauucugaccuaugguuuagauguaaaauaagauuaaucacaccccaccuuccuauucagacuaccacaaaaaagagaugaagaaaaaaaaccucauuguuuucuuuucuuuucguuuucuuuuucuuucuuucuuuuuuuaaucuaugggacaucaggcacucaccagaaacuauuuaauucucucaacugucaauaaaguagguauuuucauaacccaauuuacauaagaggaagcuuauuaucagggaaguugaguaaauuugcccagugcuacacuccagacaauuggccgaguagaaucaaagcuagcuguuaucugggcgcaaaguccgucuugauguagccauucccauguccuggauggcaaaagcaguuggcucagugccaggcaccugccagguguguucaaagcuuugcaugcagaacccacuacugcaagggaagaagagaccauacgcacuuggcuuggagcacucuaccugcugccugauuauugacuguucuggaauccuugcuucugaugugcccugccacuuucauggugacuccagcccugaagugagaagaguuggccuaggacagcuuuucucuugaagucaguuuguggacuuuuccuuauuaccaaauucauaagacaucaugcagaugaaccauccaagaaaagacagaguaaaauccacaccccuuguuuuccauccuuggcucugaacaguagcuguugguucuuucuggccuaccacaucucuuuucagcuguauccaucucaacucugggugucugggguacauuuccugauucuccauggagaaacaagccugaggaaacagagccagaggagugggaagaauuaagacggagccagcuguggcagcauaugccuaggaucccagaguuugggaaguggaggcaggaugaucaggaauugaaggucacccucggcuacagaguaaguucagggccagccuagacaacaagauauccuguuucaaaaauaauaaaacaaaauauaugagaaacccaggagcggaaaaggccuauuggggaagaaugagauaccuggaaucugcacauguguguuuuucauuugaauaacaaccguuaugauugugugccuuaugccuggaacugaucucauagaaccuuuuucacaagaucuucaggugucacuucuuaauuuagugcuagaaaccuacacugucacugagccaggucccagucuucugccccaagcuuuuuuucuuugaggcagggucuuucuuuguaguccuaggaaucuuggaccuugguauguagaccaggcuagcuucaaauucauauucaccugcuucugccuccucgcugcugaaauuaaagacaugcaccaacauuccuggcccaagugcuugaagagacaaaguggggacgggaggagggagcgcaugcaugcgcaugcucagguauauaaaagucagaaucauguucauagguagguucuuacccucuaccuaccuuaugaaggagucucucuucugcugcugugcugugugcucuaggacuacuugucccuagaguuuagggaagagucucuugucuguaggagugucaguauuacagccaugcaccacuccauuguagccuuuuuaacuggguucaaggacugaaauggaauuuagguugucacuucccuaauccacuccauccccuacccccgcccuuuuugaaucaggucuucuccagcuaagcuggauggaacuugcuacacugcuuaugcuggccuugaauucauaauccuccugccucaacuuccuggauaggauuuugaaccugugccaccaugcccagauuaauguuuacaauuucaucagggcuaaaugaucaucccagucagaaaaaaaaaaggcuacaaaaauugcgauggcacaguguuuugcuaguaugcccaaaguccuggguuugaucucuagcuauacauacauacauacauacauacauacauacauacggaugugcaugccauacauauaugcauacauauaugcauacauacugguagauauaauuuuuuuguuuuuugccccuguccagcugauuggaauuuaaguucuuggggcguuggagccagggcaggucucuguaucguuuuuguuuuuguuuuucgagacaggguuucucuuuauagcccuggcuguccuagaacucacucuguagaccacgcuggccucaaacucagaaauccaccugccucugccucccgagugcugggauuaaaggcgugcaccaccacgcccggcguucuguaucuuuuacuaugucuggaaccucugguaagagaaccuguagcaagaaaggugaaaagcugucucuggcuugaaaugcacauuugauaaugagguuaagucacuaaugagcccuuguggaauucacacaucuggacccugaaagcugaucauuuucuaguccgaaggugcauacuuuugggguagauccaucuggacucuuguuuuuguuuuuuucuuuuuuuuguuuuuuguuuuuguuuuuugagacaggguuucucuguauaguccuggcuguccuggaacucacucuguagacuaggcuggccucgaacucagaaauccaccugccucugccucccaagugcugggauuaaaggugugcgcuaccaccacccgguccaucuggacucuuaagacagacagagcacaaagaaagccuugccugucaugaugugaacuauagugcugcagcaaagaugccugaauucauuacugucugcuacaagcuguucagucccaacccaagccgagcuuaacuggaaggagauaaauugaugagcaagcucuugacccuggacccuggaaggucaggaccccucuguagagcucacaaccauaaacacauccuaggugcuugcucuuagcaucugacuuggagaaaugccuccaggaaagagcuuggucuuugaagggacccuguagaaccaggcugcuagucagcugucucuaaugcaucucucacuaguuaucccuguagaaaguugcacacuguaggaaggacccacccuagagacuguggcccccuccaacugcuuuggacacagcagacccugccccuuccuaaaagauugucuuccugcacugggcucauuguucugcaacuuuccucaauagacugauguucaccuuccccauuuuuucccaguacauaaugccaguaagauagggcguugauucaaguagagcuguccccaggacugaucuuuucuagguuucucaaugagcagauaaucaggacaaaggagguagaagggaaggaaacccaucuuaacauuuuugaauaauucaggauuucaccuuuuaugaguuugccuggcuuauacaauggaaaguagcguuccucugacuccggaggcuggauguccaggagcaaaggcagccgccuccuugcuggguccucacuuucccucuacaugucugugaccuaauuccuuuuuaacuggguuagggauuacucuaacacugccaccuuaguaucuuuuaaauuaugugugugugucugaguguguguguaugaacacaaguguggaagagaggacagauuccacgcgugggcucuugugaccuacccugugggcucagaggcucuagcucaggucaccaggcuuaggggcaaguaccuuuaccuacuaagccaucuuacuggccccgacuucuuuuuaauguaagcagcguuuucaaggccugucugcacauguagcccacagaagucaggacagcauggcucagucauauugucaauauacugucacuguuuccugagcacauuuuucuggccacauugcauaaaaauauucauuugccaaaaaaaaaagauuuucgugucuuuuacauauaaccaauccucuucaagacaaaaggcuaagaggugauuuuaaaaaaaaugaaaauuugggcuggcugaauggggcccagugauucuguggcacagggagugacgaccugagcugggagcucuaucuguuuccaagacugcucccagaagcacugacugcuuccuggaaggaaacucgcagugcccccuucccacauguuugagucucagacauugaucccagcuccagugcgccuaugcagaagccugccucuguggacaugcaagucaccaacaagcgaaacuguccuuagaaagaccuuaaggagccugagauccaggggguaccaggcaggacaggaagagguguccugaugaggagcuacgcuggggccuugacagucuaggccaacaauucucaaccuguggauggagacccucagaggggucaaauaucagauauccugcauaucagauauuauuuuacauuacaguucauaacaguagcaaaauuacaauuaagaaguagcaacaaggggcuggcgagauggcucaguggcuaagaacacugacugcucuuccaaagguccugaguucaauucccagcaaccacacugugguucacaaccaucuguaauuggauccaaugcccucuucuggugugugucugaagacagcuacaguguauucauauaaauaaaaauaaauaaauguauauaaaaaaaaaagaaguagcaacaaaacaauuuaugguuugggggagucaccucaacaugaagaacuguauaaaggguggaagcaucgggaagguugagaaccacugcucuggacugacugcugggcauaaguucugcauagggcacccuaacacgguaaauuccaggggagccccaggauuugacucugauuguccugacagugucuccauccuggggagcaucgccuuucccucauugaccuggggccuucgaacagcuaaaggggucagguaccucagaaacguucuguaauacacuuuuauggucagugggauugauuugaauugguuaaauccagacccacucacaggcauaauuguguuuauauuguagguuggucuccacagacuuaauaccaggaugugggaggcaaaggcagauggaucucugucucaaaaaaaguuaucaccuuuauuuggacugugcaugagugacugcaaguguggaaguagaggacaauuccacugagugggcucuggggaccuacccugugggcuccugggguggggcuggggcaggauguggcaccccugucauguagauucacuuuccaugugaaaggcuaggucaccaccaggucugccagcucggcucucacaguguccuaguaggaugccugccauaggcuggauucuaacuuaaccuuuuuacagaaccaaagaucuccugcaugccagcugauugcucuacaacugaacaguaucaucuuuuaaguuguguguguguguucauguuugugccugugagcacaggcaaucacauagagaucagaggaccuccuuagagacaggcccucucucucauuccaccuuguuugaggcagugucuaucaguuggauaauaugagcuaucagcaaacauaugaacccagaagcugcaguagcacagagcauaaaaaggcuguugccacauggcuggaugacgugaguguagucccugagacccauauaccuaaccugcaugguagaaggagaaaacugacucuccugcaaaacugacucuccugcauguucucugacacgcagaagcgugugcgcaugugugugcgcgucuagccuagaauucagaggccugccugccuguuuuccccagcacugggauugagggugcaugcccacuccuggcaagcuuaaguuuuuggagacaaagcucugccuuauucagaaaguacaaucguuacccagagacugggaaagacagcagcacugccauuuuuugcucaauccagcaauuggaucuugcuaagacccuccugggggaacuagagcaacaacagcuucuaacggaagguaucacuuaagugcccagauaggcaggggggcaaagagggugucugggaacagugaccagagcuggccguuuuuuucuaugaaaagccacacgccugcucuguguggccacucuuuuuacauguuguaaauccauuuuuuuuuuuuuuucgagacaggguuucucuguauagcucuggcuguccuggaacucacuuuguagaccaggcuggccuugaacucagaaauccgccugccuccccagugcugggauuaaaggugugugccauuacgccccggcucauuuuuuuuuuuuccuaagugaaggcugaacggacacuucggcagggcagacuuggccuugguauaccggcaugcuagcacucuucuaaccagcuacccccccaccucugacuaaaaaauuaauuuuuucuauuuggggcucugggccacacaacuuggaacaacccagguaaccuugcaucgcggggcagacguccgguguuucuuacauaucacagggcauaggaaucaucugaaggucuuguuugaccggcaggucaugccugggaaguuucuuuccuuugggguuaguggagcgguagcugaggcugaucucggcuaacuuguaauccugaacccacgccccuccuuugccuucuuagggaauuccaggugcugcagaugcugcuggccuccugcguuguucaagagaaggguugaguuacuucucaggggcugggagccccuagugccacagaggagaucgguccguugcgccgugaaggugcaucugccugcugagcuugcucaguuuuggguuuauuuaggcuagccggggagagggcuguccaccgcggaggcggugcacucucaagcuaccgguuggccuggaguuucaguucuagaaggccggguccgguggaggaagguguuagaucuuaacaguuaggagaagccccuggaggaggcgcaggugaaccacaugagcacgccccagccgaggagcagaaagcaggacagaauccuguucuucuagggaucuucacguaguugcuucguuccugguuucccaggcaauccugagcaaacgcaguccuccagucccugcccauuaaaaauuucgccggcaagaucggaguuuaaaggcggcugcgccguagagcacucccauggugccgcgcgcugggcggguuug

SEQ ID NO: 4074 - RNA, 10454 nt, Mus musculus
cgcaggcccuuguaacguucccagcgccgcguuugaauucggggaggagcggagcagagcaggacccucugcaccgacucagccagguucguggagcaacuucggcaucaugaaugcagcggccaaagcuggaaagcuggcucgagcaccagccgaccucgggaaaggugggguuccgggagaugcaguucccggugccccaguggccgccccgcuggcgaaagaaauuccggagguccuaguggacccacgcagccggcggcaguauguacgggggcgcuuucuggguaaaggaggcuucgccaaaugcuucgagaucucagacgcagacacaaaagagguguucgcaggcaagaucgugccuaagucuuugcugcucaagccccaccagaaggagaagaugucuauggagaucucaauucaccgcagccuagcacaccaacacgucguaggcuuccaugacuuuuuugaggacagcgacuuuguauuuguaguuuuggagcucugucgcaggagggugaguguuucagucgcagugcuggggcucccacaccuggaacuugcugacaaaggggcaccgagguuuuggagugaccuagaggagugguuggguuucaaacuuuuauggaaaggcuucuagcgaggguacuuggcacuccgaacugcugaggccgggguucuggggaaaccgagaccagauccuguugcuauuagggauggagcucccagacgcaaggcagcgagucgguacaggaaauggauucauaaaguggcuaaggaagggucccaggcuuggugugccacgcaccucuaacuuccggaguggggcagggucgggggagggggcggcuguuuggagucagauuuuagagcuuucaggaaagggagggaaucuccugccaggaggaagcccuggguaggggagucgagagugggguugagagaagacucaggagagggucuggugaaugauagugaccaaccaguguauggguagaacuaucagaaaccugcuaagacucuccacuccgagcgucuaguccuagccacauccagcuagccacucuucuuggacuucagugaccucuuucucccuccucagucccuccuggagcugcacaagaggaggaaggcacugaccgagccugaggcccgcuacuaccugcgacagauaguccugggcugccaguaccugcaccgcaaucaggucauucacagggaccucaagcugggcaaccucuuccugaacgaggaucuggaggugaaaauaggugaggugcugggccuucgggugucuggugucagggcaggaggggacaaggaggggaaggugaggaaauagagaugcugcccucuaguuaggaaguggaaaguguguguguguguguguguguguguguguguguuugugugugugugacacuuuccuugccuuuuuuuuagaugcauugguguuuaugccucaacucaguaguuuugaacuuggggccccucccccaaaugcuucucuauaaccuagcacugagccagacccucagccaauuucaggucuggacuuacgcuguagaguauggcaggcagcaucuccucaggugucucuuuacuaagcugaaaaaccugcccccuugagucugauuggccagucccuagaucccugucacuucuccacacacuugcccagcagcagucacgaagaucaucuacuugauuccccagugcaucuaauucugcuauccugugcauuuuaaauuucauuuacuuaugaauggagacaggcuaacuucaaggagucaguucuuucuuuccacugugugggucccaggaucgacguagaucauguuaucagucuuggcagcaagccccuuuaccuccugagccaccuuaaccaccguaacccugcuaucuaaagaggugugugggaggcuggcuagggccaguacaguggaaggguucagggacucuggggccucaagccacuaguucucaaugcucaggaucaaaacagagcugccugcaaccacagacagcccgggcuuagcagcugagcacccucucuucuuuccucugucccaggggauuuuggcuuggcaaccaaaguggaauaugaaggggaacgaaagaagaccuuguguggcacuccuaacuacauagcuccugaggugcugagcaagaagggacacaguuuugagguggaugugugguccauugggugcaucauguaaguuggcaauggccuuggcuccugggccucagcagggcuuucugaggcuucucacccaguugacuuugccaugugaaucuuucuaccuuauagaaaggcuguuuuaguggacaggcugucccacaugaaacccugcuuuucauauaucagucuggcguaggcuguuggauuccuguaacuugacuuguugguccagggaagggaucaaaaagucccugaacuuuuccuccuggcccuuggugcuuacuaaaaguaugcacagauccaaaccaucaacaccugagagcuuguuaggaauucagaauuucagaucugaaccuggguuuaauacaaucccugccugacuuuccauggagcauuggaaguccugcugagugcugaagggagaacuaggccaguagaaagccuggcgauaggcagaaccaccacgguggccugugguggauagcaguggccucuggggcacugggagaguccucggucacuguaggccagagccgucaauuccuggccccuugguacacagguguugucacuugcauccuucugagggcuugucccagccuuugguugcugugucacuggacugacuuggagagcauccccguccguucccagucaguaaguccagcacagcucccuuccuuccuacgguccccagacgaugacuucugcauuuggauuucccuuggaguuugaacaacaacaacaacaacaaaucccuucuuguacccccagguauaccuugcuagugggcaagccucccuuugagaccucgugccuaaaagagaccuaccuccggaucaagaaaaaugaauacaguauucccaaggugaagaccacacuuccuguuuucauuuauauuccagccaaaagcuauuuacugagcccauccuggggacagagaugagucaguccuacuucuaguauagccacggagaaugguguaugucugaugcuggcccacacugcauguugaguuugcacaccagauucuccugcucugccucccaagagcugagauuacaggcaugugccacuaugcuggcuuuaugguguacuggcaagcacucuaccagagccccacgcccagcccacgucuuuaggcuccuccugaaagggauguaaagcgcagggagaaaaggagggaacagggucagacacacuuacgccuggaacacgaaccaucuccauccagcugcgcucugccuaacaaaggaaguggccuuacgcucauguagcaggcuucccaucugcaaaguaggaguuuccccaagggcuucccaauaacaaaacaacagcaucccuuuucacauccaguggcauaaauccauucgaagggauggcucauuucugaggacuagguucacauggggaaagucaguguccuuggcuuggacauagaguagauaugucccagaaggucagcccaucgccgcagacaaccuggacugcuguggugugguccuggcuuuauuagugaggccaugcauauucucagauggggcacuccuguuucccaucuacaagugaggccugauaguggagaugcacacaccuguaguccuagcacuuggaaggcugagauaggaggaucgcaaguuccaggauagccuuagccauauagugagacccugccuccuuucaaauuauguagagagggaaaaggagaagagaauccuuuagauguuuuugugagggccaaaggaguuacuguacagaaauaaauguuacguggaguuaaguuaaugcugugacugacagccuagguuucaucucauuaagacauccugguggggauguugccuuuccccauuuaauaggucugccuugguaggccccggaaagcccggguuacuuguuauagguggaaucaagagguugaaguaguauuuaagcacagcucuuggaacuuggaugcccuucuugguggugguuguuuguuuguuuguuugagaugggaucuuacuguguaggccuggcacucaauauguaaacugagcuggccuugaacucacagagagauccaucugccccugccuuacaaaugcugggauuaaaagcuugaaccaccaugccaggcuugcacauaauaacugaauguacuuugaaagggcgagccgggggguggggguggggggguggggugggggggugggggaggggggggugggggggguggauuaucccagguuaaucuugaguggcaaguggcaagaaauaauccuucucaucaggauugcuaaagcuggcuagaggaugacuugauggagcucagggccacugagcuaugauauguuacagacaggaacagcugccugggguccuugccucaucucacuucagcucugccucuccauuccagcacaucaacccaguggccgccucccucauccagaagaugcuucagacagaccccacugcccgccccaccauucacgaguugcucaaugacgaguucuucacuucuggcuacauccccgcccgucucccuauuaccugccucaccaucccaccaagguuuucaaucgcucccagcagccuggaccccagcagcaggaaaccucucaaaguccucaauaaagguaaagaucggacuggggagaagagagcccagguuuucaggguacauuucagggugcaugugccuuacugcauagucagguccuaucuuugagucugguccgcgggcccuuugcccuguggccuuggcaggaagaacugacugaaucaacccauuggguggguccaagaaggaaaaaaugaacugaauaccaagcccaggaaauuccaguuaaagaguauagaucccucuugcaugguuuguggagaaagcugaaaguuuucugguacauacauggagcaagccaugguacuuguccuugguccucacgguccucacucgcagcacuuguguuuuguuuuucaagagaaguauuucugucaccuaggcugcucuuaaaaucaguccuccugccuagggcccugcugaguacagguuugcaucagcaccucccgcuuuggaaaagucacuacagcaacuccaggagucugcccuuuuacucuugcaguaaaguauacgucuuuuuccaaacuuuaccaucccuugccccugcuuagauaacuuuuguuucuggagcucuuuagagaucagagcuucucugauucauguguuaauaugucuucaccauuguccacacuuaugaaaagguagagaggggugaauguccucccaguucacucacacucuguugaugccuugaacucagaaguccaccugccucugccucccaagugcuugagagagcaaaggugugagccacuugccuggcagcaguaucugcuuuucuguuuucuacugucacucccuccuuccccucucuccucucucucucccccccucucucucuuucuuuugagacagacuaucaccacacagacucagguuugaaaucccccugccucaccauccacagugcugggcuuacaggacugugccacugcauuuaucaucaucaucaucaagucuuuuuuuuuuuuuuuuuuugguuuuucgagacaggauuucucuguguagcccugguuguccuggaacucacucuguagaccaggcuggccucaaacucagaaauccgccugccucugccucccaagugcugggauuaaaggcgugcgccagcacacccggccaucaucaagucuuauuuguccuuaauauauuucauuaagagcugugucuuugaggauagcuuguucucuguguggauuuaguauaaaacuaguauucaguauaaaauucucaguucaucuguuucaguuagauuuccauuuuuaggcaaguggcuugggauggcuuaguuucguuuuuggugcuuugagacagggucuuguguuguccagguuaacccugaguuccucccaagugcugggauuucagacugagugcuucacuucaccccugacucaaugacuugguuuauuuuggaauaacuguagugcuauacaaaauuuuuuaaaacaauaaaguugaauuccuguguacccuucacccagcugcuuccacggucagcaucucccuuaaaagcauagcauaauugccaaaacugaaguguuagcuagaagauaaucccccuaaucgaucaaccagauagauccccauuagacccccagaaugcaagucagcaccucacauggcaguuagcgaccuuggcuccuuaguuuccuccagccuguggcagucucuggguuugccuuaugucuugugaccuugacacguuuagagggugcugaugaguugauauccuauuggauuugaugcuuccucgggagugcagugagguucugcauucugagcaagaaugcuguggagggcuuugcccuucucagugugucagggagaccgugucucucccacagacauuguuuccuugguaguuaauaaauagcuugcaggaaguuguuugaaacuguagggaccaccagucuucgugguagcaauuauuacuguaauuucaauuuuguuucccuuuuugagaccaugucucauguggcccgaacugcuugggucucacaguagccaaggacaacuuugaaccugugcuccuucugccucuauauccugagugcuaggcuaacagucagggaugggcuaccaugccuaguucaugagcaguggggaaucuaagucauguuggacguguauguacggaggguagcucccuguccuuccccgcagugcuggaccuggggauuccuaacuuccucggcgguggagguuagaaugccgcugucuuauaaguauaguaaagaaacuguucuguagacagccuccacacucacccaaaggcagggaaccaccugcauuaucugucccuggggcauucauuucuccuucauuuccaauagcuaaauuuagacaggcuugcuuuuuacauacucuagucuauaaacacucauuuuugcuagguuuuauuuuuuaacuguguaugggugucaugcauguauguauguaugugcaccagguacaugugugauaaccacagaggccagaagauguuuuuggauccccuggaacuggaguuagacaugauuaugagccaccacguggguucugggaaccaaacccaggucuuuggcaagaccagcaagugcucuuagcugcugagccguccuccagccccuuuuuggcuaguuuuaaaaucagauccugagccaggcggugguggcgcacgccuuuaaucccaacacuugggaggcagaggcaggcagauuucugaguucgaggccagccuggucuacaaagugaguuccaggacagccaggacuacacagagaaauccugucucggaaaacaaaaaaacaaacaaacaaaaaucagauccugaauauuuuauuucacacuuaaguucuuaauguagcauggugguuuauuuuuuuuuaauugaaauuuuaagaaaaaaaauugugcugucucacaggagaacuagcacaugcuggucuggggaaacaagccagucgaguguaaagcuccccccuggccaccguagccaacucaaagcuuuagugugcaugucaucagaccugggcgguuuguaagcgcacaaaagcagaggguuacagugaaaggcuucuggggcuuuauuuaaaggaauccacccgucuuuccaacuuccugggugcucacagugcccuucacucuugaguuggugcaguuuugagucauuggugccuuccgauggccucccugagugacagcagcagcugcuguccugggaagcuaggcuguuggguuagagaccucucaguauaacaaugccugccacucaaacuggugcugacuguguccccacaucgcugauagugaaaaaguuguaguugucgccaaaguccugugcuccuuccccuaguuuugugucuguccagugaccgaguuuucuucucagguguggagaacccccugccugaccguccccgggagaaagaggaaccggugguccgggagacaaaugaggccauugagugccaccuuagugacuugcuacagcagcugaccagugucaacgccuccaagcccucggagcgcgggcuggugcggcaaggugagugcuacagagaggucugcgcgccuggggaaggcagggcugcucagucagcagagcacuggugagggcccagacccacgugaccuuugcuuugcccguuucuuauagaucaaaauccaggugaguuagccugacacccacggccccccuugguguuucuucugccuacuucugcaccaucuuguccuguagguggcugguaggccaucucugcaucacugcacauauugcucagggaauuaauuccuccagagacucagaucagcuccagcuuuagggcuuuuguacccagugucccugcccugacacccgcugccaucacuucuaaaccugacuuaauuaauucucuauagcauuucuucccagcacauuuguguuuuugcaucagggacuuguguacaguuuucuagcuguucuagcaucgcaggcagggguugucagccaacugucucucgucacuuuagucugggauacuaggccuucuaccacccccagggcgaaugauggaggggccuguagccugugcuucuucuucaucccugugguuggaacccgggcucuucugaagccugugggucucuuucccuguccgcaccucccacagcucauggcuacaguaggccuagaguacaggggcucacucgugaugaagugggccuuggcauccugggcuacaguuuuccauuugggugucagguuuguacugucaggcuccuccucagguuucauggggugccauggggagggcugcuugaaaggaaaggcgacggggcugaccuaaccauaaccaguguucuguuucuaccccagaggaggcugaggauccugccugcauccccaucuucugggucagcaaguggguggacuauucggacaaguauggccuugguaggugucccagaauguggaaugggcaggggaugguguagcuggggggcggggcgugggaagaauuaaaauucaggucuucugcaugguaggcaagcauuguacuacugaguucuacugaguucuuccaaggccuuugccugucuccuccugccuuucugagauaacccuccacuuaccaccaggguaucagcugugugacaacagugugggggugcuuuuuaaugacucaacacgccugauucucuacaaugacggggacagccugcaguacauagagcgugauggcacggaguccuaucucacugugagcucccaucccaauuccuugaugaagaaggugaguccuggcugucgagggggagcguggcaggguagggggcugccucggggccaggcccucauucuggaaucccucccccaacuuuucaaacuagaucacucuccucaacuauuuccgcaauuacaugagugagcaccugcugaaggcaggggccaacaucacaccccgggaaggcgacgagcuggcccggcugcccuaccuacgaacgugguuccgcacacgcagcgccaucauccugcaccucagcaacggcaccgugcagauuaacuucuuccaggugugcuggggcaggacgcugugccuggggguggcagugcugucucccucaccagcggggcgccuuccuccccuuugcccucccccugggcaccuguugagcucuucacucgcucccuccuaggaccacaccaaacuuauccugugcccccugauggcagcggugaccuacaucaacgagaagagggacuuccaaacguaccgccugagccuccuggaggaguauggcugcugcaaggagcuggccagccgccuccgcuacgcccgcaccaugguagacaagcugcugagcucgcgcuccgccagcaaccgccucaaggccuccuaggucucucuccuucggacuggugccccuucacucugcuagcucugagccugcacuguaggcuccugggggcugcuguucagugccccuggcccugggggcugggcaggagcagggcccccuuugaagggguugcuguguguaaguuauuuuguacaugucuggguguggguuuacaucugcuucccugcccucgcucagcccacuguaugaauuguauaaauguuucuauuaaauugggacugcucuuuccuuagcuuuauauauauuaaaauguguacaucucucucucucuuucuc

SEQ ID NO: 4075 - RNA, 995 nt, Mus musculus
uuuauuauuauuauuuuuuuuuuguucugcccccccaaccccgggcgcucuccggcccgcacccugcgccgacgacaccuccgcgccaggcacuauggcggacgcggccuggcuucgggcgagcgcccccacuccggggucucuuaagcagggacugcacgggcggcgcacgcgaggcggggcuugggcgugcgccgauaggcgggccgggggcggggccgucugcgucacaaagcgcaccggcccgcccacgugacccggcgcuuugugacuugcggcguggaaccugaggcuacgcggagaacaggagaaacuacguggguccgcagagagggggaggcggaccgucccaccgggcgggucuggaaggggcgcuuaagcggcggaggccccaaagugcggagggggugaaccgcgaauuccacccacgcacgagucucaucacugugauggcugcucaccaacuccucuccuaacagacuguauacccugagcucuuccaaagcugcuggugagaauggaccaucaucaccaccagcagcaucuuaagagcuguguccgacucuuaccuuguacuaggcaccgcguugaccgcugauguuugcaaauucuggagcccagucuccuaggucggaaguaacuccguucucccaaagacgcugucagagaauaaagaauuaaauccaugaguauauuucaauauuuaagaccaugccuggcauaucugugccucaauacagggggccuaauaaaugucaaauaaacaacagcaaaaaaauaucuccaauuuauaagauagaaaccuaaagccaacagccgugcauuuuucgaguuuucaaagaagggaaugcuugcuggguugcaggguccucauuccauuuuaaauuacaaagucccuuaggaggguuggcauucuuuuucucuuguggcauacgggacauauugcauuuauaaauucauaaauaauaaaaauuaaaacuguacaauuacuauca

SEQ ID NO: 4076 - RNA, 1190 nt, Mus musculus
uaagauauuuuuuucuuuaaauugaaaauagauuuuuuuuuucauacaauguagucugguugcucuuuccccucccuuaacuucuuccuaccuaaguucauauuccuucuuucucacucucauuagaauauaguaauaauaauaaaaaauuaaagcaaaccagaacaggacaaaacaaauaguguccucucuuaccauuuggaguuggagacacauguucuaaaaaaauccaugaauuuuaccacagaagguaaaaaaaugugucacucugugaugucagagaucuucuuaccccauggucucugugugaaaaauuauuuuuacucacacuugaacuguagaauucuguacuacaauuucugauaucaguaaggaguucaaugcuauuuugauuaauccaucucuacacugggaucauuguggcacuucccuuuauuuuaaggaauacacacacacacuugggaugaggguagagggggacaucagaggacaauuuccaccauauagggcucauaaaucaaacucacaccaucaagcuugguggcaagugcuuuuucuggccagcccuacuuuuguuucugaguuguauaaaacuuuugaugucguucuuccuguucuccaccauggcacaagaccaaggggaaaaggagaaccucaugcucugcuucaauaucugcgucgggaagagcagagacagacugacccgggcagccaugguguuggagcagcucacaggccagaccccgguguuuuccaaagcuagauacacugucugguccuuuggcauccggagaaaugagaagauugcuguccacuguacaguccgcagagccaaggcagaggaaauucuggagaaagaccugaagguacgggaguaugaguugcagaaaaauaacuucucggauacuggaaacuuuggcuuuggaauucaggaaaacauugaccugggcaucaaauacgacccaagcauugguaucuacagucuggacuucuauguggugcuggguaggccaagguucagcaucgcagacaagaagcgcagaacaggcugcauuggggccaaacacagaaucagcaaggaggaggccaugcgcugguucccaguaugcugggaucauccuuccuggaaaauaaacuuuauacaaaaagccaauaaaauuuccucagaaauggaaaaaaaaaaaaaaaac

SEQ ID NO: 4077 - RNA, 90773 nt, Mus musculus
uguagccuccgucaccgccuccggggccgggaagcgauguagguaggacccgccagacgguccccaguucuccuccgcccgccugccgcgccgccaccgccgccgccgccaugaagaagcaauucaaccgcaugaagcagcuggccaaucagacugucggcaggcgagugcgcgggucgcgccggcggggggcgcgcggggggcgggccgguccugcgcgcgaggagccggggagcggggagagccgggcgcggcccggccuugggccccgcggggcgggggucugcgccuagcuacggcuugggcgcugcccauuguccuggccggaggagcaucguccucgggagacucacgagggucuuuacuccucccuguccccgccagccggagcucgccgccuggugcgaaaacuccguaaacuugugugccucucgcagugccaggcgcgcagcuuuggggccgguguucucaggcucuccccgcugauccgcuguugcagccuuccuccuagaagagcuugcuggucacugggaaccuaagggguguuaggcuacuguggcuugcccaguuaaguucagccccccuccccucugugaaggaaucgagaacugcagucucaaaauccaggcuuuugggaguuugcugugaguucuugaggucuagagguuuggaaagcgaaaaggaugccuuuucucaucucaccuuggaugugguauuuucugacacugagugagugcuugacaagaaacugauuuuuuuuuuuuuuaaugaaagaauacaggagggacaguagaugaguaggcuguagaacaggaacgauuugcgguuuuuagagcuuucaggaggcuguugucaugugcugugcuaucuggaacaaauauuucaaggucuugcagggcggauagcuuugccgaaccaauuugcugguuauucugcacgaagauagauggguuuuucacagcucuugcuguuacccuccucccuuagcaguuaaggacaguuugguuugguugaagcacgugagacacuucuuuuuuuauguguacgaaaauacuuuuacuuccucuuggguuuucuaaauuugcuuuuuacaauguuucauuucccccaaccuuuugcuaaguuuuguuauugaauuucuaaaaagaaaaauagaagggaagaaaaaucccuccaucauguaaucuugguauccucuauccagacucagucccugccccuuaaacccacacaugccuaguuuuuuguugcguguagaguuagagaaagacuagggucaaggcgaguaauccuaauggcaugaacaagaaauaugaugagaagugauaauuuucuugugagucuuguacuccuugcagauaugcauggcagaaucaaaacuuaguggcugccacaaugccuuuguuagauuuguuauugauuagguuucguccugugugggacaagggaaaguugcugguuuuaugcaaagucuugagagcuuucugccuugaaagcugguuaggguuuugugggccccugcuucuccuuagucucucuuccuaguuuuacauucuggccagacuugcccacuuucaguucccacaggaggccuauguuucuuauauguuaaccucuuccuggaauucccauaagccucucuuaccacaccuggccgauagauaaccuuucaugcucuucacuucucucagucuccauguccuuagaagauccuugaugucuuggaugggcaccgucuugaggccaugcgcuaccugcuuucuaucuucaaacguccucuuuaccugcucguguuggcuauuugagcaccgggagagucuuuccuaugagucuuggauucccagggucugugugugacucccaucccaggacagaugaccugucaaaauugucaauucugggacuccagcuuguccugcauugccuggugcugcggaauuaaguuugggaaaauaugaacaggauggagugguagugauucauacugggacaguaauucuggcccugaccuuugacucuguuugaaagucuuuauugcuggaugccaggggaagcugcagcuauuacagagcuguaagggugugguagccaugagacuaaagucagaacaucuguuuuuacuggguugaaaaucuguugcucucuugucguugauuuccuagauaacucccccccccccccccguguguaugugugugugcgcgcgcacacgagcucaaguuuucccuauuuaaguaacccuaaggggguaggaagaaaaauggaggcuagaacugagaauuauuauucagugagccagaugguugguacacucccaucagaagcagaucgugggugucuuugggcaaagaagaaugcuuuucuagcacagauuucucccagcugugaucuggauagaggaggaguuuaucuguguaaucgacuacaguuaucaguuuguggaguucuaggugcuaucuugccgugaggaauuucgcuaggauggaaugcucgugaguaauucccccgagaaguuucaugggccuggcaugguugaggauuaguaaugccuagaaaggaugagcuaacaugaugcacuuugugugcagaggguggauggaugagucugugggcaaggcuuaugggguggucucacagugugggcaauguagugggguggauguuuuugucaccugcucuuuguugagucucauauucagugagcacugagugaggcuacacuguacaccacugugcgauauuaaagaaucaaagaccaagaauacaaacgagaucucugcccuggagcuucccaguagauacauggaggagaugggcaaaccccaagucauuauacacauaaaauaagcacuugcagaaggauggcagugcacggaggagagccugccugccacugcacggagacgcucagaacagcugcucuugggaggugugagcagggccugugcucucuugcccucuccaacuucuuucagacuugcugauaccaauuaggucucuucuggugaagaaaaaaaacauaauucaagguacccgagcagaaaagaauucguuggccugugagcaggagucuaggcauaggacggcuuuuguuugagacaaucucacuguauggcccagaauucccaguccuccugccccagccuucccagugcuggaucugagggcauucuggaugguucacucuuuagacaaaccguguucacagauuuccauuauccucagcgcaagucucagaggaaaagaauacugugugacuguggccaaaguccccggauuggcucuuguuucugggucacaugccuuucaugggaaaugaaauggacucaaccccacccaaauagagaguggaggagugcugguucccuacgguaaacuggggcacuauuaccagcagaaggagaaugggcagacaccgaucaguuaagcaagaaaagcccugcugagcuuuugcagucugguuguggaaaaggagaagcauucucucacucuuggcuucagauaaucuagagagggcagauggugcagcagggagucaggggugauggugggcaaguguugucuggauagaggagacuggacaggaggauaaggagugugaaguuaggagcugcugugggucaggaguacaucccuggcagagagucugcccugagagucucaggaguuguucugagugcuuucauuuggcaagucaagguccagggaaggaccacagagaaccugaagggccauguucuaauaaugggucccaaccucuggagugccuaaaauguaaauuuaagggaacauuagcugauauuuaacucaagcaagcacagcaguauuacaacauuacacuacucaaaaauuuuugaggcuagauguggucuguggcuguguuggcaacugcuuaucugagaggaccugcaaguuuccacuuccugauuccuucuuuaccugaccccauggugccauugguucucuggcucuguggagagcucauucucacugcugagaucuuucauagggacacaguaaucaucucgccuuucuacagcggcgugucuuaccaagggcugugccucagcaccuggccugguucucacccacagugacuaccauuuauauuuuaugaagaaggacaaaugauuugccaggcuggcacaucuacucggugacccacacaggacauggugugggccuuccgccucugcagcccauauauuucuaaccacagaacucuucaccaggaaagguggcguguuuaugaacaaaugucuugaacaucuuccgugaucauuaagcugaugcacuucucauaaggaacucacagcauucuccgggcagcucuggggugguguuguuuauuccuaauugaacaauaaggaagccagagaucagagaggucacagagcuggaacaugacagaguuguggauccaaaccagguucugaccucaaagcagacaugcaugguauuugauucauuuuuagugcugccuccaucaaaucuugggagcugugaguuggguguuacuguaauagcgggcuugcuaccugaggcuguguuuccucaggggacccuaggcgguaucuagaugccuuucuuaggacagaugcucuaucacagagccacauuccagccuucuugauggucauaauuuggguagguggggcgggaguugcugcuggcaucuuuugcugacaugcgugcugaacagugccaacaacaaagaauuauacagcaccagccacauuugugccgagguuuagaauccugacuuaguccucuuuaaaucauauauucucuggacauaugaguggucacagccaaacaugcacuguuggcuugcaggucacagauguauucuuuuuguauuauucgaugcuuguacauuuauugucacuuuaaaaaauuaguacuugucaucugaaaaauauggaacucaugcuuuuucuagaagaaucuuggaaauucugucaggaucugauaucccuguccaguacagguccugaagcaagccacagcuuucccauuggggauggucaucggcucccugugugugcaguccauggcuaauggguuuuaucucuuuauaucccuugcugaccucuuccugaucaucgagaucuuaggacucugucuaggagcagagguagcuguccauuacagcaguaggaguuugcagucgaagugcauggcugccugcugaugucacaguaccaugguauaccccugguaccauguuguauaaaacuucuccgugaggcagcauucauuaccugggcaugccugucacauaccagcuccuugcuuugccugugggaacacuguguaguccucacugacuuaacaagcgucuucccacacgugggguuugcucuaccuuuccccagagaucucugaacaaagcgucugaggaaagcgaggucccaagcccaguggcuuccaucuagccucugauacagcaggcuagggaaaggaucucuaucugagcaucuucuuaggcuuucugaggccaccuugggugaguggcagguuguagaauucuagaaucucaaacagcuuauuuacagguauauaaaaauccacacccccuccccccgcccgggugccggagaauuaaacaccagccccagaaggauucggucgccuagaucaucuuuauuuaugaagguaacaugggacacuguugugagucaucuggugacagaaguucuggugcuggggagaacccuucaugguuuguuguuguaaggaaggguguaccaugccagacuauggaauauuuuggauguaucguucuaacguagguggauaccaugguaaccaaguaaaaauccauugaaacauguuauggcacuccaucuacugacuguuuauguaauuuccugaaggcagaaagaccugugguuccagauguggagccccugagaucuuuguuuugaugacggggucuugcuguauaggcccggguggccuugaacucaugauacuccugucuagccucccaugugcuuugaugacaaggauguaucagcuucagaugaguuucagaauucaaaacuuuuguguguauuugccgguguuacagguaaccuccaacugaaucugccuaacagcucuucacacccagcauguuauuucuguagcaaaacaugugcauauaauuaccccaaaggauacauaaaaauguagccauccaugcacaguauguuauugccaucacaggccaaguuuauagucagugggcuucaagcuuauuuuuauauuuguccuccccaccccccaggaaaaaggauuguggaucuauuuucguuuuaguaauguaccuauaugauugucuauaaaucuuuuauuucaaauaauguuucccauacuccaagagauugaaacuauguaugagcaaggcucacacacucaaguugcaggacagauaaagaauugaggugagaggcgggugugaggcuggggaguggugggggcuguugaacacauccauuuacaggggggcugcuuacagcucuagccacuuguugccuuggagaauaagcauaugguuuagccacaacucccuguuuuuaaaaagagggacacacauacucauccauauauuguguaaguguaugugccugugcgugucaaugugcaccacaugcaugcaugagucuguggaggucagaacaggcaucagaucccuggagcuggaguuaccgauggcagugagucaucacguggguucugggaacugaacccagguccucugcaagcacagcaaguguuguaaccagcugaaccaucucugagccccacaucucccauuucuaaugaugcuccagaaggcugauuuuccugcaaaguuuuaugauacuuaaauguuagcaacgaaaaugaaaacaauuccauccauguaggccaaagaaaacauaucugcaaacuuuaucuggccuugggcugucugccuugaccucuagcucagagacuaaugcuuguggcaugaaagguuguugccuguggaguuaggauuaggcuacuccuuaagauguagauggcuaauuuguuuugucauuauuuguuuuguuuucuuacauauuaugcuacuuuuugcauacacgguagcuuauacuaagaagaaaagaaaguugguagguauuuuauuuuagaacugccuuacuuucuagccaauuggagaguuuccuuuuaaucuaccacuaccagcugaacucaaaguuauuuaccuuagaaaaggaaauggaagcccuccuuuaaaaagagcgcuggaaagauggcucauaccuuaagauuauuugugcucuuccagaggacuggguucccagcaucagaauguccacucacagcugucuguauucaaguuccagagggcccagggcugccuucuggccuucagaggcacagcacauacaugauguacaugcauauguuuaggcaaagcaguccuacacauaaaauaaaaauagauaaaccuuuaaagucggggagcccccucccgacuuuuuugagacaggguuucucuauguccuggaacucuguauguacaccagaauggccucaaacucacagagaucagccugccucugccuuccaagugcugggacuaaaggcuugccccaccauuaccaacaagaggagcccuguucuuaaaaaggaugacuuaaaaaagguugugcuaugcuauucauucuuucccagaccuuaaugguuguacauugcacacuccuuguauauuuguuucuggacaccuacagaugugaaaauucucaaaugcucaggucucauauaaaaugucauagugugugcacauagccauugaaguuguucugcauacuuuaaaucaucucuagguugcuuaccauaacuaauauauuguaaauacuguauaaauguuaugcuguauauuuuagggaauagugauaaaggaaaaaaucuguucggaucagaagcaauuucucccccaaagcacuguuggucucuucucuucccaaaccccuccccuaggugaucucagcccagcaacccucaccucuugggugaugauucgcaguuucaugcucugguccuguaugacuccacuccuaggugauacccccaucuuagucuugaacaucucucacuaagugugcugcagacauugaacucauggccgucauccuuaaauuugccucauguucuucacuucccuaaaccauggaucacuagacuuuugcuuauggucugaaucuuacccaucuuguuuugucaaaggcuuuuugcaacucacacagucacauacuacaguaguaggggugaauaacuagaaaggugagcuggguggcccauagaaccccaagaguugacagugaauuugcugggcuagggauauagcucacuaguggaguacuugugaguucaaggguucuguccccaacaaccuuaaaacagaacaaaaauuuauuuuccuuucccauggaugcaaaugucaccagcugggguucccccagccauuuuacaaguccuguuucucccccacauuuugaacccugcugucaccguccccagcuuucucuuauccuuucaugugcuuucuguucucgauggacguccgucuuuccugucaccuuagucagccucucaguucucaccuggacggaagauugucuuacaacuuguuuugcuggcucaaggagcacugcagugaauuguguggaguaacguguucuggacuaauaugagucuaagagaaauucuaggagauaggacagagccacggaaaaccugugucaaaugaagugagaucacguuugacgugaaagcaguguccaguccccuuuccaucagcuauaaggguuggugacccugggucacacccuguuguugauugcaaguuugugguuguauuguuauuggguaguaauuauccuaagaagucucucucuuccacucccuucccacaguuuuccuuuuuaggugucugccuuaucagagaugccuucugggcucgacauccauuugaucucuccuuuaauguuucauuagcauuucuucucuaguuucucacauucuuucacaugaguugaucagacgucugcuucauagaugcuugaacccauaaguccuggagcccgucaagagggacucaggugaacacaaguauucauucagcaaacguugagaggugcguggagagucucccaacuaauugucaccugucagcguagacauuagaaauucaccagcuuggauuucacacggucauuggauacuugcagauauaugggcugaagugcagccagaccugggggaauacaccgaguauuccacucauggcaccugggacugcuaggauucaagguguucuguguaguacaggggucucugacaugugcuggggggcaggggaauguguucaguuagggcuucucuagauacagagcacgugggcaucacgugacaagcugcuggagccacuaggugacaacagaguugcaacaggacagaaauaaccguaagggacauggcacucuguauuuucuauccuuuacuuuaauaucuucuucuguuuauaaaucagacagacagccgggucugcuucuuaguggggacaguccucuccagccuucuuaacaggggacagcccuccagccuucuugguggggacggcccucuccagcacuuucauuuucaggucacuugugcagaggauggugguuggcaugcacuaucaguuaguauagaguuuagcuugcagaaauguuagaauuggugugccuaauuuucuuuacuugguauuaacugauaagcaucuuuccuccaaagagaaauuugguugcaaauugaaauucuguuguguuauuguauuuaucauccacuuauauuuuuuuagauuuuuuucauuaaaaauuccuugguaaucauacaugaguauaauggauuuugggucauuuuuacucccauugcccuuccucaucuuucuuccucucccgaugaacucccucuuuucaauaagccccgccccuacauucaugacuuuuguuuauggccccugaguuuaguuacgguuguuugugugugaaggaaacagguaauaaagaaugaugcccccuccacuagcagccauuaacugcccacaguccuuccaugguggguggggacucauaaauaaaaccuguuuugagcagguuuauaugucucuuauucagaccauuguaguacucuuauuguguuugcauuuuggguauuaagacuuaauaauguaccaaugacauccccugaauucccagauaucaagauuaaaauacagucuuuaaccacuaccacccacugcuagagacagcaguauugguggcuuuugccuauuugcagccuaucauuaauuuucuuuuccaauucgaagagaucaauuaugauuuccaugauuugcagacugccacaaucagauuuggggguccuguguggaaggaagcuaagaaagugaagaugcuuugggcuugcagucugggagcaggugugucucggauguguugggagagugguuaggaagcuguggcgcuaggcuuagaggggaagauagacagaccuaagugauggcgccuagacugaggggaaccaggacuacagugaccaagcugcagaagaagcccaggaagaacugaggacgugucacgguuggcugcucauugcugaaagagagugacucuccaucugcuguguuuauaauccucuuuccucuguguucuugugucuuccgccuucccuccgugcucccacugcuucaggucugcacaugugugagugccaguucugcacugccucaguaacugaugguucuaaucugguguauagauuuuuuuauauauauauaaaauucuuccacgccacuacauagucagauagucaauuuggauuuuuuuuuuuuuuuuugguguauagauuuuuaaucugcaauuauccaguccuuuuuaugugaucagguuuuuuuaaaauuuuaggcuccccccauuuuuguuuaaaaggggauauugagauugcuuuuuuucuaacuuugagggaaaacuuauaauucugacuguuuggagacucauucauuaaaauauuaauugggccaggugagguggcacaugccagaaucccagaacaugggggccaggaaaaggaagauggugaauuccaggcagccuaagcuauauagugacagcuugauugaaaaauaaaauaaauaaauugguaguaauauuuuuuggguaccuucauguuaugcccuauuaguacaaaaguaaauuaauuuauuugccacgagugcaugguuugguuugucugaugugguuaucugugggggagccucagggagauuugguagaugcagaucuucuggggccauagggagauugggcacagcacuucuuuuuauguacacagacuuuuaugugccucccaaguguuuuccuauucuugagaaccuaacuacuuuuauugguuaaccugggugauauuaauguguuguguauaauugacugguuacaacuggucauuuuauuauaucuuugguuuauuaguguguguguguguguguguguguguguguguguguguguauacacuaucuaugucuguucuacuuuuuuauuguuucauuuuuccuccuuucuuccucuccucuccucuccucucucccccccccccuccuuuuggaagcagaguugcugcuccccaggcuggcuuugagcugcacucccugcaugauccuugugucucacuuuucagagugguugagaccauagaacauaccauugugcagugaccucuucccaugauuucuauccuacuguucaggcuccaagauaauguguugcuguauucuuauuggcgguauucuuguguggcaggccugugaagaccuggcugcagaaacaugaugaggaaugcuugacuccugucuuacuugggguuucuguugcuacaacaaccccccccccccccacacacacacacaaaagcaagucggggaggaaaagguuuauuuagcuuagacuuccacaucacaguccaucauugauggaagccaggacagggaacucagacaggauaggaaccuggagguaggagcugaugcauaggcuauggagggugcugccuacugguuugcuuaucauggcuugcucggcugacuuuuuuauagaacccaggaccacuagcucacaauggacugggugggacuucccacauuaaucacuaauuauaaaaaugcuguauaggcuugcccacaccugaucuuaugaaggaauuuucuuaauugcgauucccuccucuuagaugaucuuaguuugugccaugcugacaugaaacuaugcagcauaaauccugucaaaaugcuaguaaguguauacucuggguuacagugaagucuuugccuuagucaggguccacugcugugagcagacgccaugaccaaggcaacucuuguaaggacaacauuuaauuggggcuggcuuacaguucagagguucaguccaugaucaucaagucaggaacauggcaauauccaggcaggcguggugcaggaggagcugagaguucuacaucuucaucugaaggcugcuagcagaauaccgacuuccaggcagcuaggaugagggucuuaaccccacaaccacagugacauaucuacuccaacaaggccacaccuacuccaacagggccacaccuucuaauagugccacucccugggcagagcauaaacaaaccaaacagucuacaaacaguauuccucucuauuccgaagcacaacguguagugugucucuugagucuguguuauaagguuggcaagugagaauguuugcagaagaacgcaaaccuguccuuuaaugauacuuucagagccgauugguuuugaccauuggccaacacguugacagucagcuuauacuggaaugagguguuuucaugaguauaaucugagaaggaacauggcaaauaugauucucaaauguugcuuagaguugaggaggaaccauuauagucuggugcugaaacaggugaaagugaggcuuguaaacuaggagaaaggacauccuucuugaaggugacaggaucucagcccucggaagagugaaaauggcaaugugaccugcuagggaggccaagcugggcugacagguuugccucuuacuuuuuuauuuuuauuuuuuuccuucgugaacguccgucacaucccagguaauccucaccugagcucucuagcaaccguucccugauggcugcuuggaauaugaguuuuaacaggaagauagggagggugacugacucuguaauccuuuuacuugugauguguagggaugggggugggaggcaaggcuucgcuggauagcccaggauagcccaggauugacuauguagcccaugauggccuagaacucauggcagccauucugcuucagccuuccagguguuuggauggcaucauagucagcugggaacuaugcauuucuuuuaagagucccaugggugaagucuauuuuacaugggcccuccauucuguggggcugccuggcagguugcuggguuuuuacugcucugacuccguuucagacaaggaacugaaagaagagcaaugguagauggauuauugguggccguauguucauguugcucuuaaggaagugguuagcaagucaagaggcagcagacuuaauuguaggcucugacuccuuggguauucuuaaagaauagaagcuuugcugaagauuuuagguggaggucauaacaguccucgggccagaacuccucccucuguccgagaggaucuggguguaauuucauaggcucuagaggcaucaaggccaaggccaagaacacugaggugaggagaccucacuuccaaucuggcagcucagcaaauccagcaguucuccacuagagcuccaugcauggcuacucucuagagagaugcuagcaguguuugcgugugcucuuucacuagucuucagaacacucgcuuguguguuaaaugugagcuccccaagcagaaguggucucucagggaugagaacucauagucauccaauuauuuccucacagaaucaguuuucuaugcacuuaguuguucuuaaaggccagccuggggggugugagagugugcucaauugagcccaaagagcugaggcgccacagugcugaucucacaccuugccagugagcauacucucuugcgcugucucucucggucuuauucccucccccucuucucccucuucucucuuccucccucccucucucucuuccuuuccccccuucccucucccuccccugccuccuuuuucucuuucaccucagcuuggucaaccccuguguuguacuccaaaggcuucugacacagcaguaaaacacaccccgguauauuuaagacauuggcacauaggaaagagguauaagacaucgaggaaauagcauaugacaagaggugaguuagcgucguggucuagucagguuagauaucaccucaccaccauaugccaaaguaaaucccagcuggaucaggaguuuuauacagugguuggggucaguucaggguuagaacacuuaccuagcaugcuugaagacacugguuccauguccaguauaagaaaaaacaccauaacaauuaauagaaacaaaagcagcuuaucauagaaaguauuuguggcuuggcauagaagugcagagaaagagcaauagauaaccugaagauuugagcaauuaaauuuugggcagagcucaaaacugccuaggaacucaaggccuuagguuugguuccucagcaccacaaaauaaguaaccuugucuguugugguuucauaacgaaugcuauguuguaugcuauuuggaaaaaagcagccacaacugagggcuaccaccccagugcguaaagcucucacuuugaagaacacuggcaugaugagcagaugaaacaacauucauggcugugugcagaugacuaggacuggaugagacucuuuuuuuucuuucuuuuuuugguuguuuguuucauugagaugggaccuugcuauguaguucuggguggccugaagugagucuguguagaccaggcuggccucagacucacagcucuguccaccucugccuccccagugcugggauuaaagguguggccacugugcccggcugugauuguuuuuagaaaugcaaaacuuuaagauucaauuuuucaccugcaaaauugugugcaggauaauggugugcugcuguuggagguugggagggugugccgcacacugcugcuggggauggaaaugguuuuuacacugcuucuagaagugucaugcugauccuugucugcucugaccacagucuaucccuucuuagaguccccuuccuucagagcgucuggugugacugagucagucacgccacuuccucuuggacaucacuuucaacacuuauuccagcuggccuuuccuuucaucucuccugcaaaaugccugacuuuggcuucucucuuguaccugggacgugggguuguagugcagaaagaguccaguugugcagguuggcacugccaaaccuuaccaucuccaacuccuuugggccuuaguccugcuuuccagugguuggcucugguucccaguccaucuuccugaguaccuuugccagacuuucacuuuuaucauggcagguacacccacuccccuugaauaccuucccaguuuucagagaagacuggaggagcuugcuucugcuggucucguggucuagcugacaggcgcucuucuugguuucagcaggugugucuuuauccucccccucccagcccugaccacuccucugcucugcccgcccugcccccucuccugcaccgaacucugucuucucaguugauaacaguuuucuccucccuucuugguaaugacuucuugucaguggccugcaucuugaccuuugauacccauuuggcuuauuuuuguauccacgggacauagccuagagaaggcacccaagaaauacuauuuuaaugaaugaaucccaaaccaauugaaguugaaauuuaaaaauuuuauuuauuuauuuugguuuuuuuuuuuugagacaggguuacucuguguacccuugucuguccuggaacugacuuaauagaccaggcagaccuauccuccugccucugccucccaaguguuaggauuaaaggagugugccaccaugaccccauuuacuuauuuauuuuuauuucauguguaugacuauugccugcacgugugucauguagcauauaugugcuguugcccgugaaggcaacaucuggaacugguguuacagaugauugugagcugcccugugcaugcugggaaccaaacccagguccccuagaagggcacucagugcccuuaacuucuaagccaucuccccagcccagaaaugaaaucuugaaaucaguuuuucuaggcacuagaaagaaagugguagcaauacucacuuuuagacagauauaggaaaagucauugaaguagguuuugaggggucgcagcuguccucuccaucccacguauuguccuucaucccagccucagcucacauccauugcugacuucaacucuccuggcaccugucaacucagccuugguuuccuggcaucuucccuuccuucugcagggauucuuucucuguccccugcuguggcucucucuugucugcauggaugugcccaauggccugucugcaggucccuggaacucagcauucccagggcuggucucauucaccccauuagaucucugagaugcuuucucagaaugaaggcuucuguguccagcgcguauucaguagaugcucuuagugguugugugagguuccuacuucccacuuaaaagggcugcucaucaccguggggucuguuccugcucaauccacaguugcagcacuuuccugcccccucugcagaaugcagaccuauuugcuuagacucucuccuucucaccugagucuccucuuuuuuguggcuuuugauauuuucuuccuuggccucuaucucagccaggcuuuacucuugcugugauggaacaccacgacuaaagccucuuggagaggaaagggucuaucuggcucacacgugcacaucacuguucaucaucaaaggagucaggacaggaacucaaacagggcaggagccuggaggcaggagcugauacauggaggccauggaggaguguugcuuacuggcuugcucagccugcuuucuuaaagaacccaccugccuaggagugacaccacccauaauggguugggcucucccacaccaaucacuaauucagaaaauguccuauagacuugccugggcccagucuuauggacaggggagcagaggcagaggcagguggguuucuauauagugaguuccaggacagccuucucucagaugacccuaacuuguaucaaguugacauaaaaccaucuggcacagccuuuaauaugugcucucucucacuucuuccacacaguugccuggagaacuuucuggaagaacagcuacaguaaugauagcuaauacuugauuuuuacuagaugucagcacuguuucaaguuuagucauguagcagccuguuuagacucagcaaacccugggaaaugauugucuagucccuuucuaccaguuagauaggaccuggcacaucuguuuuuuccuguuuuuuaggaagcaggcacuuugcucaucuauucuuugaaucuuucaagucuguaagguagauauucuuccuagcuucauuuucuaauaagcacaggcacagagauaccaaguaauuuguucaugguuucucaggucuuuggugguggcuagauuuggcuccaggcuuaacuguuggacauauuccccaucccaagcagcuaguauauuccugggaagagguuuccagauaaacuuauggguguuuuagguucuuucuucaggguucuggaguaguuguagacauuuggagucuagugggaagaagccauguuccuacuuagagugaucagggaccagcacugugccagaacacuagaacaauugcaagagaaaacuaauaucccauuugaacggcguccagguaacucaugggggaacgauacauuuucccaguaauccuaaaggugaagcgcuccaggcccugccucucucuccucccaguucaucaguugacuucaugaacugauguuaguuuguuuguuuaugagauaggaucucuguguagccuugacuguccuggaacucacuauauagaaauccaucugucucugcuucugucucccuaggauuaaaaguacacaccaccacucccagcuacaaauugauuuuugaccgucuuaggcauauaaugaccacaguggcauguagcagcugcacagcacauugaaauucugucuucaccuccugguucaucucugaaacucagugaggagagaaaugaauguagggcauugggaaacacaccacuucagugguucucaaccuuccaagugcuggggcccuuuaauauacuucaugguguggugaccccagccacaguuaucccauugcugcuucuuaacuguaauuuugcuacaguuaugaauuguaaaauguaaguaucuuuguuuuugauggucuuaggugacccccugagaaaggauuguucgacccccagagagucacaaccauagguugagagccacagcauuaguuugacgugauuggcuacacagguuuaguuuuucuccccugcuuaaauccauuaaauguuauaagagacauuuuuaaaagaugauuucuuucuuuuuuuuuuuuuuucuguguguugguguuauugacugcaugugucuauaugaggaaguuggauccccuggaacuggaguuauagacaguugugagcugccuugugggugcugggaauugaacccugguccucugaaagagcagccagugcucuuaaccacugaaccaucucuccagcucugacuuaauuuuuuuuuuuaagucuuagggggaaaaaaaggaauggaagccauuuagcaaaaaguuccaggugugccuauuaagugggucacuagacaagguaucaaguacaguuugcucauucauucucugcuagaucaggacaguaggacauuagacuaagcuucagaaaugccauuauaucuagccuuuaacagaaagugggcaaacagaaugcagaguucacagaaauuaaaaucuaucucacugugacauguucagaagcagaagucaaauguggucagaaaauaaagcaaguguuuauauuuucugcgucccaggacccagggcucgcaauuuacacaaucccuaccaaacugcgggcuacagcaauuaccuugaguaagacacugguucucucacagacacaccuuuugaacuguaaugcugagggcaggguugccuccccuuucucucagggauguuugggaguaucugcagacauucuuucugugacugcuguggaggaggagagaauagaacacauugucacucauugcuacguggguagaggccaggaugcuaugaaauacuccacagugcucaggucagcccccacaggaaggaauuaccuacaucaaaaugucaggagugucagguuugaaaaacauuaaaaucuuaaagaaacuagccagcuagcagcccaaguuccuguaucccaggaccuugcuauccagcaccucagacaccagagaaguccaagucuuaaggguuggaaauugguaaucuuucagaagccguucuauucggaaagucuccugaaaaguagacaaaaaucucuuaaauuguuuaaacucuuaaauuguuccuugcuuaucugcuugaguaguagggcugaaagcaugguauuaagccugccagccgggagcaagaacacccucuagaucucucuccacucugugugugugugugugugugugugugugugugugugugugggcgcgcgugugcgugcgugcgugcgugcugggugcagccucuuguuguaagagcucuuugcuauucuucccuaggagacucccuccuggcuucucuucaucugccuuuuccuccccacuugcgggguaaauggggccuccuggagaugaccuuuuggucacugucucucuaaauacaacauuuuucuccaguacuucaggaugcuguucuguugucccuuggucuuaguguuucugcaagucagccauuauucuuuuucuuguucccgguauguccuuuccuccuucuauuuacuuuuaagauuuauuccaugucuuugauuucaacaacaguuuuucuugaugaauauagagaaaauacugauguuuuucucuauauuauccagcuugggguucuauggucuuguuggaucuuuagcuuaauaucauucauuuaaaagaucugucuacuugugccugccugccugucugccugccugucugucugucugucugucugucugucuugugacccugcgugggugguuggagcgucagguguucucuagcacccuccaccuauccccaagaggcaguuucucccugagccuggcuuuguguuccucugcuaagcuggaagucagcaagcccuggcaguccuccuuugucuccuuccacucagaguugggguuacgagccuaaaugggauacccagcuuguuacuugggugcuagcaucugaccuccacucuuggcaauuggguagcaggugcucuuaccugcuguguaauuaauuuguucaugguugcucaggucuuuguugguggcugaaguuggcuccaggcauaacucuuagacauauaugcccccacccuaaagagccaguacauuccuggaaggggucuuccagauaaauuuguggguguuguagguucuauuuucaggguucuguaggaguuguaagaguuuggggccuggucucuccagccucugcucgguuuguuuuuuagaaaauucuuagguguugacucuacacgcuccuucugucccugcuuccucauuucccuaccugggauuaauaacgugcaugauagacuuuugauuuguauccuuuagauccuggguccuuuguucuacuucuuuuccccuguguuuuacuugggagaauuccuguacauuuccagaucccucaucugcucguguguguuguuuguuuguuuguuuuguuuguuuuucguuuugcuaaccucuuuuauacauuugucauauuguuuuaaaguuccuacaugucaguuugagccaguaccuuugcugucucagaguugaguuggauuggcugucauaaugauaccuucuggguuuuugcuaguuguuugugaacaaauguuugaggaaggugaauggcaugccccuucugcuaggcugcuaguguguucacuuagcuugcaguuguuugggucuuggcuuuguuguugcuuaagguaguuuccucugggcgggucuuacauaccauggcucugcugccuugccccagaacuuagcaggcccguguccaugcaccaagggcucucuuagcucucuuguucuucugaggaggacuacugccugauacucacuuuaagguccagagacacacagugcuucucucaguucccauuguucuucagcaggcucuguauuccuuugccacaguuguccuagaggaacugauguauguuaacauugcccauccacucaguggucugcugcaucuaccucugcacaggauaaggccaggauaagagauuucucuggauaggacauugucuuguucucugacuuuggcaggcccauauguuaaaccugaaaagcaugagagaaagaccaguuccauguuuuugaguaaaauuggaagcaaguuuuaauuaaaugcuagccagaaugguagacuguagccaagaccauucuggaauugccagcaaauggcgaggagucacauuuugcagaggcuuauaaaggcuacgucuuucccaccagguccaaucaggggccagcauacauccugacguacuuccugccuacauaaccucccaucuacaucugaucaagcacauguggugcaguuaggucaaacaagcuuguuuaggggagugaaaaccuaaaacauucgccgccagcauuucaguaagugucuguccuugggcaaggcgcuuacaaggguagaggcacuuuuguuuuauggcucucuuagccauaaaauuaaaacuuaaaacauaacuucugcuuauauacauaccucugcuuagguaccagccgugcacuugcacuauauccaacguuaacaucuccagcccuccgguuagauuggaucucagaagucacuuucaggaagccucuuccguauccagaaccuguguucaagguucuuccuguuucuucacuuucucuacaagagguuuuugcauuuucauuuuucugugcagacaauugaaccuagggccuuguauaagcuaggcaaguagcccuccacugugccaugccacauccccuguucugcaaguuagugaacuugucugugccuaggagucucgucugugagucggguauaguaguaguagcacucccaaggcuauucugggcucaguagaugaguauauuagaugguuuauagcagggucuuucagaccccacugcugaaaccuaggcaaguuuuuucccugcgccucaguuuccucaucuauagagugggauaauaaaaccuucauuacaggguuauuuuggguuuaguggaauuauuucugacagaacaccuggaucucauagagccccaguaaugggcucaguaggcugugaugucagagaacccagcgugcugugacugcccuggcggagugcucacugccuagaagaaaagacuucauuuuccucgauagucugucaggacaggggccaugucucuuacucacgaagcgcucauagaagggaacuaaacaaauaguuacucagugacugaaucaugagaagauugugugguugaagucagugccucugcauggccccacucaguuuccauuaauuauucuguagguccuuuugagaacaagccguggguuugaaaugaguuuucuguuuugagugucuguaguaguauucaucuaccaagcacuacccgaccuuuagaaaaagugaguaagauuuauaguguuccacacccagggucuuccuguucaccccuucagcacagccucacccaguuuuccaagugaacagauuuuccuuucauuuugugagcauguuccucuuggaaccuucugggcugcuucugauuuguggucauuguagaaaccuggaugagcucagcuauucagguucucaggacugcuucugucuugaaauguuugcagagacagucuacauguuccaagaagguuuggcuauucucuuuuuggcuaucaaauugaagcauucuuagugugggaaugaucuugcaaauauaaaucaaaugagggcugaaugguaaaaagaugcaguuuuagauccuaugauuaguuugugguggcaucagcaacagaaucugucaugagaauagaagaagaacacagcuuugucuggugcugagguuuuuucuugaggcucagaggcuggccacauucuagagguugucaacucagaaaguaaggacuggcuguaaagguuccuaucauccuaucaguguauugagaguaucuucauaaaagaugauaaugucacauguuaaguuuuuuaacuuucuuuugucguacuuggguagcuaugaggagauuguacgugguaagcacguguucugccaccgagccacacccccacuccagagaccauucugaaugaugucagcaaucugguauuaaaugggaagcucucuugauaggaauuuuagguucccaaggcuuucaguuuauaaacacuggcccuccuacccacugaucuuucugaaggguuuccugagugaguaguguguagacagugauuuugcuacacuaacuagccuguugaaauggccacuuaccauuagcuuugugucuguguucuugaaugugccauggcagcugaggggccugagucagucccuaccucuguucuuguauaccacagucagaguuuucauugaaagcucagcucuggguccuuauggcaaagaucucaugguauuccucaaagauggcaggggucuuagccagaacccugcccuguccugccacguccaggaggcuuuguccguacccuuuccuagacccuagaccugaaguugcaggauugcuuggcaagccuguccuggccacguagaucaccacucuccuguaauaggguuguuuguguagauuucugucuuuucccaugagcuucucaaggguggggugugacuccccucugccuuuuucccucuccccaguucuugacauuuaguguacuccauaaauaaugggugagcuaauggcgauccaagaucugagugccuucaggcaaguucauucuggaccugguacuucagguagaggcuggcucugguucugugagcacuccucugggaacugccucccguagcugaggguuuugcagcuccagaugcugaaccuuuaauagaggacugcacugcaccuggaaucccgucucucaguguccuguuuauuguguaccagucauucucccugguggcuccugucccacaggugucaucacagacucgguuuuccuggaaggcuguucugccccugcccucucuugaagguuguccuuuguuaccuugagguuucuuugaacaguaccuuauucccaagagaaacuagaauggcuuguuaacuugggaaaggucaucuuugaauaagaugugguuuuuaucugaagaguguuugaauuuguuguacuuuggaacagcucacacucccauagaccaucaauggaugcccauuaucauuguaaaugagagaaguaaucacaaaggugguguuggggcuggagagauggcucagugguuaggagcacugacugcuuuuccagagguccuggguucaguucccaugugguuacauguuagcacacaaguuuccuuaacuccaguuucaggggauucagugcccaauucugguucuucaggaaccaggcauacaugugaugcacauguauacauacaugcagccaaaacacacauauacauaaaauaaaaauaaauacauaugaaaaaaggaaagaguugaauuucuaaguaaccaguauggugguauuacuauuuuuauuucuguugguaguuauaaugacuuucauuuuacacuggaauagacacacaaaguccagggcaucuggcuucacagaccuacuuccugguuccugucacacccuaaauccaucucuuucccugaaaugaaacucagacucuuaucacugggugacuucuagaagcaaagauggcaagaguaguuccaaccaugagucacacauuugagauguucuccgggcagcacugagcuaggaagagugcucuccgccuaguaugugagaggcuuuaagcuagccuuguaccugccagcuguucacugcagguucccccugcucugcccuagugcagguucccccugcucugcugucccuaagacuugcacuccuaugucgccccaggccagcuaugcuuagguaucagcugcagagcuuucucuguaaaggaauggagcaggggaggcagaaggguguggagaagauaccagacacugaccucuggccuccacaugugcucaaaagugcuauacacacaugcacaugcauacaugccauaaacguuuaaucaugcgcugccaacucccagugguucuguguuggguccaggcauggagauauugagucauguuuuccuuaggaccuuaggacaggggcacugcucagaaguguauugugauuucaucuuugugggccauuauggaguguacuuacacauauagaugauacacuugccguguaauauggccugcuuuucuguugugcaacguauaauagagauuaaauaaaucccaagagaaaaugaccagagccagacagucagauauaggaagcuauugccauaguaaauaaagaaguaccucucucacucucgcucucgcucucgcucuugcucuugcucucuuuuuuaggacagggucuuuuuauuacauagccuuggcugcccuggaacuuacuccauaggccaggcuggccucuaacucaucaguccuccaaacucggccucugggauuaaagguacgugccacccaacuuaagaaguacauucuaaaauaacagugaaaaauguaguugugaugauuagaguuaauuacaacuugacacaucuagaauuaccuaggaagagaaucucaaugaggaauugucagcacuggguuggccugugagcgugucuguagaggauagucuuaaauuaauugguaugggaagacccagcucagggagggcaccaccauuccuuuggcuugggaucccuggcuguguaagaaugaagaaacagagcugagcguagucacaugagcaugugugcauucguuucucucugaccguggguguuaugugauuggcugccuugaauuccccuaaugauggacaguaaccugggauuauaaacugauauaaguaucuaaccugcucccauugaguugcuuuuggucaagguauuuuaucacagcaacagaaaugaaacuagaacaaguaguaaauacggaaagugguaaccauugucuuuaaucaucauuuaguacuauauacccugaacauaauugucugugcuguuucccugugaugggcagcaagguugugcuuacagcagcaucucuacaaaugugggaggaaugcaccaugcucccagugcacugcccuuuggugauggaguuuuuagcugcaucuuaugggacugcuuaccugugcaugaguuugguccaucagugauuacagcgccauuaggggacacuuguucuacauguccaacucacuucuaguaaauuuuucaucaucccauguaagaucccucauucccuguuacagugaaaccugacaaucauuccacucagccagccaugccaggagugauagcaacucaggcucggcucacagccacuguuuuuaucuuuaguauuauucuuuucaucacuauucuuugggucuggagugguucacuaaaaacaguaggccccucccagagcugccauuuacaucaacugagcaacaaagcugcuuugugaacugaauuaggaacugagucaccaucuauacccugacuucugugcaacucacuuuccaaaggcgagauguaguuaacuuagagagcacuucaauuuguggucuuuuggcacugugugugugugugugugugugugugugugugugugugucugucugucugucugucugacugacugucuguccaucuauccguguagauagagccuaaagccucucacaucucuuauaugcuuagcaguuauucggccacugagccccacccagacugcuggcgacuuucuaugagguuuucagcucuuccuggccucuuguugccuugcauagcaauaaaaagguccgcuuccuguaacuucucccauaggccaugguguuccaugccuuuucugccuuaacaguaacuugaauguucgguuuuuguuguuguuguugauuuuaccuguuucugauuucaaaaagaaacuuugcagucugaaacuccuccagguccaagcaggugaacacagaccuguaaguaggcuaggggaugcgggacuucagggagucuaaagaggacgccacugagaagugcagugugcugcugguggagaaguuuccuuggacccugccauaggcaaaaaguuuugguggagcuuugagacuuaggccaugugguuagagaagggccagcaaaagauuccacuucgugugccagagggaaaggccagccagccagcagaaagcugugggcaugcucacauaugugagaggacgaugaagugugacugcugggcuuagucacugaccgggauucaauaauccuccaaaaagauucaguuaagauugauaaggcuucauauuuguuaaaauaaaaguaaauuaccuccaucuuagagaaagaagcuggauaaacucuagguuuggaauucagagugcagaacgcuuagcugucucugccugugccguugcuuaaauacuccguaugaucuuuuccaggacaagcacccuuuccuuucgcaugucaugccugggaauccccuucccccagaugaccccuuuagaggucugugaacucaggacuuuguaaacuguucaguggaaugugaaacaaaucguuugauguacaaaguaugagaggggccuuuauuuuuaaaaauccaauuaaguagauuucagauuccuuuuuagcagcucaagaagacagcagagcuggugagagaaaauaguaagagcucacccaggccugcagcucuuugggucuuggaagcauuuguaacaggaucacacaaacuugaauuccuagggacagagauccccuucuagucuguaagccugccucugucacuucccuguggauacagucaugaugugugcagucuccagcuggggagaacacugggguuuccugaccaacugaggcuucccuguuuuguuucuagauaacuagaauuaaaaucaguuuauuaaaaauuauuucaacuuucugugguagauuuuuguuguuguuacauaucaagugaugugugggcaggacugcgaucuuacaugugaguauauaaaccgaaggcagcuguguggucucagacaugggauggcauuaguguuugguaucaguguugaugccccaucuguaugcuuguuuaccccagauaccguagcaaggguagaauuaugagccucuacacugaaaaggaaaaacuuuuaaaggugaagucuugggccauagucaaauccaucccugugcuaucuauggcuacuuccaguggagcugagcaaccgaccguagcacaguguaggcugcaagccuggaacguuucuuccuuggucuuuccagaagaaaacuagccgaacccuuccuuauagagauaggugcucauuucaguucugacuugagguuuguuuaugaagagagaccaaacugaagauagucuacugucucugugugugccugagggauggggaggggugaggagacacgcauacuuucucauugguucugucaccacugacuaucccugagaugugccucugcuucagggcuggaucggcucagccaccaccauucaguguaguuaguaggcacaucuugaauauaaugcaaaauauugagaaagaaaauguaguggauacucuccuuauauacuaguccacagaaugaugcugaaaggcuagcuuucgaggucucugccgugccuggucagagcugcugauguggaccagguuggcaugcacuuuccauaaagacccuguuagugaguuccuggagcucugaugauuguuggggguagaucuuagcucuaccccuaacagucguugguaguggcagugcuaggccuggcaguauuccaauagacuuuauuuauagacuguguuuguuuauccuagcuucauuucugagacagugagaaaacacccugaaaaaagcaucuugguggaggaaaagguuuaguuaguuugacauuccagauuauagucugucuuugaggagaaguuaagcggaguuuagcggaugaucauuccaaaugcacagucagagcaggcagagacagaugucccaugucgucugcucauugcugccacuuuugcucuaggcuuguuucuuccucguaugugguccaggaucuccugccuagggaauagcacugcccacaacugucuggguucuucuguaucaaucaaccaaaauaaucacccacagacacgccacacaucagccugaucacccacagacacgccacacaucagcccgaccacccacagacacgccacacgucagccugaccacccacagacacgccacacgucagccugaucacccacagacacgccacacaucagccugaccacccacagacacgccacacaucagccugaccacccacagacacgccacacgucagccugaucacccacagacacgccacacgucagccugaccacccacagacacgccacacgucagccugaccacccacagauacgccacacgucagccugaccacccacagacacgccacacgucagccugaucacccacagacacgccacacaucagccugauccagacaguuccucagcugaggcuuucucaggugauuucaaguuguggcaaguuaaaguuuuaacagugaccaucacaaacauacacaugugcacacacaugcauauguaugcaugcauguauacacaagugcgagcaugcacacacaccugaucgcacgugcugacauuugaauuucaagugcuauaaaacauuauuccucuuuuaaaaaaaaaacuauuuaaaaauaauaaaaacucucuucucugacuggcuuuggcuugcagauguaguuugcugaacccuuggauaaacaaggagaaggcugcaggaugaaguaugcuggguuugaaucagagucucugccucugauaggguggccauaggcaaguuuccuuccacagccuuacuuugcucaucugguagaagcucuuaccucauggaguugauguaagaauugagggagagaccagcugagacagcucuucugugccuaagauacaccggcugucuuagcuguggugucuccgcucucaguagggcucuuacagggcuccugcagcccuggcagaacgguuugugauauggguguugauacccuggacccgucuuuagucauggucaaguagacuccacagggaggggggcuugggaagcacugccuuaguuucauguaguggccucaguguguuuaaacaggcaggggcacauacagguauuuacaagguaggccugagggcucugaccuaugaggaugcuccucagguaugucugccugucagaccuguguggauggcugucacauacacaugauucuauaugugugucaauguaucacugggaucggguucuucagccuuggcacuguucauauuuagggccuguggcuggcaaaaggauacuugcugucccuacagguguccacacgguaguuuccagaacuugugcauguaugacuuuguaauggcagaggggagccaaggcuccacguagauagaaggagcagugacacuggguuuucagguagccauggaaggagggagucacugagcguccugauaggaagcugugacugggaagaaaagcacaggguguccauugcugcuguccugcacaguacaggaaaggaccaaggaaugcggguggcuuccaggagcuggggaaggaaggaaguggauucuccuccaacuguccggaaaagagccuggcagugcugacccugaguuucugcccagcgagugcugcuuugaacuuucgaccucuagaauugcaagcuaauaaugcauuuguauccucuaagcccucaguguguggcaggguguucagcagcagugggcgcuaaugcagcuggaaacucagccccuggucagcacugguaaggagaaaacagugugaugcggugaguggaggucgucuugcacucccagcacagcaaguccacacuagaugucccugggagguugggguggugguaaggggacagucaccucugguugggaaucacuaguuuagauuucgagugaaggauguguaaguugauaacaguagcuucaccugcaguguggagugacaggagcgagggaugauuucccuccucucuaaucuagaaguuaaacgucuauaguaauauaggugcacuuacucuuuugguuuucugauacacgaucuuacugaggccgaggcuggcaguaaacugauuguuguuagcugaggaugacuuugaacuccugacuuccugccuccccagugagcacgagauauaggccgacaccaccaugcucauuucguuccuccucauuuuuaaacacauucauuuugaaaaguacugcccuaguuguguuaguggccguggguuuugcuggggaaggcaguccucugugccacagccgcucuucugccugguuacauuggaauuguuuuacugccucuuuugaaguaaaagucagguuuugguggcacccguccgucauacagugaggaucuccccagucccugcugcauggcagguaaauucugcacucggugcucaggaggagggauggcugcuugcucucagaugcuagagugccucagucuggccagcaguggucacugacggcagcacacagcuuacuaugaugguguggauggacuucugggucucuagucugaccaggaagcccugggggucccguggcagauguucuaggcaccuguuuauguaguagugaucaucuuggagacugcaugggcauuuucaacaguggcauuuguugugcaggugccaccaugacaguagcuuugcuauaagucagcccacgagucaguccaugggaggauugucaaaccagcuagagcuuucccuuugaggcuacugugcacuacaaaacucugcuuuucuaaguugaaugauccaguuuggaaguacuaggagcuggagagauggaugacucagcgguuaaaaacacuggcuguucuuccagagguccugaguucagcacccgcaugguggcucacaaccaguuuggaaauacuuauguuuucuccuugcucaguaaguaggcugaaugaaagauaagcggauggcugaauguccccagaccucguccagggacagggaagccacagugaagggagugaagggagccacagugcugcucugaggacuugagaguuccagggagacaucuuagggcuuuagaaaaacuacaagaaaaauccuaccuggggagguggugggagguuggggugggauagggcuaagcagauuagaacacuugaugaacaagcuugagcuugguuucaaucccuagcacccacguaaguauguaacuccugcaacggggcacagagaccuacagauuccuggaguuuaacugccagccaccccaaccaaagcagugaccucuagguugaguaagagacccaaucucagagugauagaggacaccuaccugacggccuuucugacuuccauauauguauguguacgugugugugcacacaugccugccucuuugucucucucuucucuugcuuccauauacauauaugugugcacaaaugcauaucucucucugucucucucaaauaaauaaauaaaugauagcaaauauucuguguggaguaagccauauguaaaugcuuugagggacugcaaaguggccugcauaggaaacaacaagccccagagugacauggcaagugggcagguccuuccugaugcuauuguucuccuaauuaggcacaggaaacuuugaaguguacuuugaagcacagaacuuuggacacaaagagacucuaaggguacagaguugaagucuguagcaagaugucuggcucgaaacucuugcuuagcaaauguuuuacaaggggcuuguuuucuaccauugucuuuuauucccaccuuuagguaucuucauucaauccauuguccuaaucuuuguucuaacaaguuaaaacuggagacagccagucaguuaacagucuacauucaccuuguggaaagcacuguagucaaugacauacuacagcuuaggaauucagcaagcuuuucuacuggguuuccuuccuuacagagugugcaccucggccaguauucugaagaacugccagccuuuccuugguaggaauuuuacaccucugguaaagaugaguacuuuaaaaauaguuacuaaaaauagaaaagagacuguuaggaaauaggaaggagccaugaagagggugagaggcucuaucuugggguaguauaaauaaaguuuaagugucuuacacacacgugugauguuagcaauauacacaaaugagcagcaguugagcuuaaaaaguggugaaccaucauagugaagagggcaggcugggucacuggaacuguaucugguggugaggacaguagugauucuccacacagccagcagagacucuguagaaagagcuauccacuucccaauuacaauucauaaucggaauuuagcaguuuaaaacaauguuuccuaguuuauagguaauuuuuaauaauuucaguauccccaguaucugauuaagauccacagugauuuguuuucuaaaagcaguuauaugaauguaauaagaaauauccacaaaggcaauacaggcagaauccuuuuuuuuuuuuaauuuauuuauuuuugguuuuucgagacaggguuucucuguguagcucuggcuguccuggaacucauucuguagacuaggcuggccucgaacugagaaauccaccugccucugccucccaagugcugggauuaaaggcgugcaccaccacugcccagccugcagauucauuuuuaaacaguauucuguuaacaguuuaauguaauguggucauuauauuucauggcuuccaguaccuuuacagagcagaugucucuuaauucagucauucguuuuaaauuuauuuuuauuuuaugugugugaguguuuuugcauauaugucuaucuguguaucaugugcaugccugguaccugagaaggucagaaaagggcauuggaucccuuggaacuggaguuuuagguguuaugggggaauugaacccagaccucuguccuuaaccucugagccaucuccacagucccaccucuaaauuugaagcaaaugauuaauuuaaagcaaaaguuaauuugggaaaggauacuaauauuuuagauuuccuuucuguuuuggauacuuugagaguuuaaguauuuugauacucuucuagcuuuugaagagauuaauaguuauaccauuugccuuaaguaacagguaauucuaacaauauaaggcucaugguguaaaaauguaaguaacaggcuguuuuuacacuguugggugggugggcugugagauggcucagucuuuaaagcacuugccaugcaagcaagcaugagguccugaguuugauuuccccguauggaaaaagccggugcuguggagguggggguggcaggccagccagucuggcagaauuggauagcucccaucccagaaaauaagguggagguuaaagagcacaccugaccucuaccucugcccccucacacacaauuugggugaggguuacaguuuauugauaaauuguuugucuaauugcaaaacccugaaucugauccauaacacaacacacacagagacacacauacacagacaggauagacagacagacagacagacagacagacagucugucuacacguacuguauauguguaguuauaguauguucccuaguagcagcuaguaaggaauuauagcuauuuuuuucugauagcuacuaaauaucuauguuuguaaacaauauguauaagcuguuauucuuugacuuguagaacuucucccuacuucuauuccaccauucuuccaauacagucaugguacaauuuuuggcuguauuacuauuugauaucuaaguuauuaaaacuacuuauuugcagcucaguauagaaguguguuaugacugucuauggaccuuuaguuuuuagguuuuuuuuuuuuuuuuagguuacuacuugcuuugaguuuauauuugcuuaauuuuacugugguuauuauauuacuguguuuacaaacuuacaaaaggccaguaugauaguauaccucuauaguuccgugcuuacgagauagaagcagaagaaccaaaaauucagaaucauacuuaacugcauaauaaggccagccugggcuacaugagauucugucucaaaacaaaacaauguaaacaaccagagauuuaaaaggcaauaaucugaacuguuuguggugguugcauuauauuuguuuuccugguuuucuccuuucaguccuaggagccgauuuuaggccucacacgugccguguuuuauuucugagcuauauccagcccuaauauucuaccucaaggcacccauagggggucagugaacaggaauugggaagaacugcacacagucaguucuccuggaccagcuaaagcaucccuuggagcugccucucaugcccacaguggaacuguaggacaaguucccucugcuuguaguguguuaaguuuucucugucuuaagcugacagguuuguucuucaccuuuguucucuuccuuuuagguuuaugagaauguuuaauaggccuugggacuaagcagcuucagaguugaaguagguacagacagaagcuuaugaggcccugugcugauuucugggcccugauuagacaggaaaaagaaaagguuauacaauccaggauggagagaggcuuguggcucuccaugagaggcauggagggcucugggugccuuaauguguuugugagucccucaagaguaacuccaggcuuccuucuggagugugaguuucaucuccuggucagugggcccccgccacacuucccuggcugacaugauuaccaguguuggcacgucaguguccacacuacucaaggcaagacuaagagggcagugucagcggcugcuguggaauucucucacagaguuccgaguuccacuucugcugacuggggccuuggcucccccaaccucugcuccucucguuugagaaggccuggucugugcuaaccugcaggaucuggugagcgagccauuccccgagguaucuccaguuuaauuggggcacugugugacaccugguguuggcauuuuguguagcaaugccauuuugauaaccaugcccccacuguaagcguaggcuagauggccagacacuucucucccuugcccacagguggugccgcucugagcugggguguccaggucauucuaaggguucccuucacuuuuacagcuuuuucuucucuuguauuaguucuggguuaagauuacgcagcccugcauucuaccaucauuuguuaaaaagucauuucuucuaggugugugaaacauaccuuuaacaccccacccccaauauuugggaggcagaggcagguggaucccaaaauuugaggccaauguggucuacauaauaaguuauaggccagauaguguuacauagugagauccugucuucaggagguccucggguuucuaguucauuuggggccucuccuaacuauucagcuuuucucucuccuuaaaacucuccuuguucauuuuuaauggaaauuugguagguaucacaaacaacuucucaaaucacuaguugaaccacaaguccaaaauaacacuugagacuuuaguaauuuaggguuuuauaugucaauaaguagcccuaugaacugcagagaaaagcauucuccacuugugaccaaguacuuggcacuugaggacaggguggguugugagauggcucaguggguaaagugcuugccauaagauugugaggaccagaccucagguccccagcacucaggugaaaaagcagguaagugugguggccucacaugggaugaacacgagaugacuagcuagauuagcgggguugguaagcucuggcuucaaguggcagucucugcuucaguguaugcgauggggagcaacugaggaagacaccaggcaucaaccucuggguuucacaugcauacauaccuacauacauguaugugcaccugugcacaugugagaacacucuugggaaacauauacacacaugcacacacacauguacauacacacacauacaugcaugcugcauccauguuaagcaaauaaggaagaaagaguuauuuuagcuccuggcuccagagguuuugauccaugguugcuuggcucugucauuuuacaccgugguugcacagaaugucauggggaaacaaacaagccuggucacuucaugguccaaaccacaagagacagggaaucuuauccaaggguaugccgaauggccuaccuccuccaacccagcccgaccuacugaagaccaccuuccuaauaauggcaaacacccuugagcaauugggucucugggcaguuuucuucagcuuuguacuccagcagccuagacuugcccugcuuccgauagcuggccacauccuguucucugugaaguucagcaaauccaguaguugaucuaagcacugcaaagagaaagcugggaaauaccuuucuuuccauuuaaaauuaaagaaaggaaaaaaaaauuaaagaaaggaauguuuccugcuauggugugaugccuaaguuucacagauuuagggccaguuuuucuccauaagucuggcugugaaaacuuagcugugaucauuuccggaucugaaguuaauuaagccuucagaaaggaguuguuucuuaaaguauggccuguguagaccucuguaauucagggucguacuccauacacggagucagucuagaaugcuguguggccagcccuggagaaagacugugagugaccuccauagcaggcuccaggcugagggccacuguccugcaccaugggcuccuguguuagcugcuguucagccuguuuguuuuccuuugguuuugcuuacauugcccugugcuguaaauuuccuccugccuguaugguuaaaaaauccccaguuagccauuuuuaagauucacagauuacuucuccugcacgccuaauucugaacuucauguuuucccauagagcugagaagaccgaaguccucagugaagaucugcuacagguaacaaaauauaucucccccuaacuagggaucccaucccaagcuccaugcgugcugggcgaauguucuacaacaaggccuuacugcauugcccaggcuggccucgaacuugcucuguagcccuuccaagccuugaacucacagucuuccugcucuagcccucccugagcuggacuuucacaucugugccucuaguugucuuaaaacaauaucucuaaagauguggacugaaaacaaauaguaaaucugggguuggccccaacucugguaaagcgcccucuaccacacacgagcucuguguucagagcccaacacgggagaccacgcaggacagauaugggcacuaggguggggcagacaggggagacuuggagcuuguaaggcauuucacuugcucuuuccuugguggaacagcguaacugaauuagcaugggcuuguaugggggaaagagaugcaugaugggauugcgagaggaaggggaucugaaacuucgugucacguuauggaguacagaugucgcuuggcucgcucgcuaguccugcucucaagugccaggugcuggguggguggggccuggucaguccccagcacuguggccugcuuacaggcccugggcaggcuggcacucugauacucugcugugaugcuacccuugcugggacagguccugcccacucacugcucagaggccccaguggcuccagccuagagcucugacgucucuccugcucaugcaguuucucccuaacucugggcugcuugggucuuuggaagcuuaggcuuguaguaauggggcaaauguagcacaagaaaccagaggccugggacacuuuguggccucagcucagaccuugcuuccuuuuccucccagggccacucugcuccgucugucaugaaguuucccugacuuuggucuuagagaagacacugggacuuuauaugcuucaucucugcucauguccccacccacugcaaaaggcugagggagggcgaaccuggcugcacggagccuuuguuaagcaguguggccugccugccugccuugugcuuccuuaaccuauacagcagucugucuagucaagugcagcucuaaagaccaaaaguuuggcccuaggacucuguccauuccuuccuguggaaaggggagcuggcauaagucagaaaaggguuucccuccaucgcagccugccaacugucuugaguugcuucagccaccugcaggcagaauguagucacuuugguuuccauggacagauuuguucuagauauacaaacagugcaguguuggaauuuagcuugcacacauccuuucgauagcaucuaucuuuauuuauuuauuuauuuauuuauucauucacucauuuauuuauuugcuuacuguuguggugcugaaaaccaaacccaggccuuugcacauaguaggaagcggucugcccccgagccucagccagccucaucuguacuguaacucccucucuguucuucacggugucgagcacaauauuaguuccaugugaugguccucaugcuggguuguuuagggaacgaaaagugugcauggaacgugcucuuacguguuauggaugcccaaaaccauggcuauggggggugguugaucuggguuuuggugcuggggguugaaccaagagcagucuaagcuuguauucugcuuugagccacacauacuguccaguauauuuuuaaaagcuuuuuuuuuuuuuuuuuuuuuuaaaaggcaggcagauucuaaguucagggccagccuacaaaauaaaaaaagauuuguuaaggaauugcauucuugacacuucuuuguuuggggcacauauuuuaaauucauuuacuuccugaauacuguuuaugcacuucagcuucagcuagguuuucauguguuuuaugccaccugccccaauacuuacaugaucacauuuaaucuuugacauucugaguugagauccuuguaguuggaggagagcugucuguauugccugugggguaugaaagccuugcccccucugggacacccuaauuugauaaugcaaacuuuucuuugcugucauaagugccacagaucucucucucucucucucucucucucucucucucucucucucucucaaucucucucccucccccucucccucucucucucuuucccucucucccucuuucuccccuccccuucccccucucccucucucucucucucucucuuucuuccuccuuguuucuaacuugaagaaaacaacaacccccccccccccccccccccccccccgcacaacagugguuccuggggcuaccucuacugccagggcugagccuguggccucccucgaguugaguuaauccccagugccucaguuuccacuccagugaggaugcugccagucugcuccauggggagagacaaaugggagaauggaccaaaugguggugaguccugacaguggagccugagagaaagguuuguuugauucugcucugaucucuaguguaggccaccagguucguguugcuggccugucucugagguggugcugccucucucaucucucucugccagagcugccuuuuauuuuacuggcauaguguugcaccaggagacugugaacuguagcagagaccagaugucuuuucuguugcuuuucuaauauuaggcauacuugguacuugucuagcauagucaaaaguagagaccuucugauccugugagagacacugggccaggcacuucgggggccagugaacaaaacagacagggcucuuguccuccuggggcugacguguugaugaaaagcccagggauccuggguaaucauuugcucuaaugaauggcacauggagacuguucuaguuuucuaacgcucugcaaugaggccacugucgauggggaagugcucccccaaguaucaacuugccugauggucauaguccugaugacugggguuuggaucugaagagccacuccuguguccaaguaccuuugagaaacaggcacaaagcaacuaaggggcaaaauguauucugcuuugaauuugcugauuuuucauuaaaauagaaagcaucccugagggcuugcucucacucuuccugagucaucagagcacacauuuuuggcguuccuucuguaacgagcagcgagcagcccucuuugccauaaacagcuauaucucaacagucuuauuuugggaggcuguucaggaugugugcggcccuaggccaguauucccuacugcuggguauucauucugcugugggguccucucuaaaacagaaacaaaaaccuacccaaacuuagcauggaagguuuuuauacuaucuugugcuacuugcgaucuuguuuggguugugcugcguggauuuugggucuguuucucugugugaggaagacccaguugccugggcuucugcugugccucuugacuugucccaugugcaguuugauuggaccggaccuuugccggugcucuagcuggugagcugacugccacuacucugccucauagauacaggcacaauugucccuuagccugaacagauuucgcuuuggaggagucuagacuauucagugcaaggagguuagcagugagcucucccggaggugacagguuggggcguggagggcuacuugcuucaaguaggcagaggccagagcugccacugaacacaccgcaguguacagaacaaccucuuacaacccaggacugucgagugucagcagugagaaccgugcugugagugacuagaugcugucuguccacacccaagagcugagcaguugcacugcagcuugcucccuccaugcucucaccacacauggaagaagcuggauuucuucuuaagcccugaaaauggcucuucugucucuucuuuggcagauugaacgucgccuggacacugugcguucaaugugccaccauucacauaagcguuugauagccugcuuccaaggucagcauggcacugaugccgagaggagacaugugaguaucagauucgucucagucucagccacaucacuaagacacauccugaagcuaggguuugcugcuuuguuaaucaccagacagcaaguaagagcuaguaugcaaauagcugugucacccuuuugaguucccacaguuaauuacagggcaccugaccacaaaguuuucccuccauugcauaaaaguuaagauucugcaguuguguaaaucuagugggcauuugcauacaccuauguguccaggaaugcuugcuuuggucuuucccucugagacagaugucauugauucuguccccacuauuccugcucuagccuggcuucugcgcugcugacuuuccacccuuaucuuaguccuccugcagcugucuugcuggucagcccugugguucucauugugggugucuuuaaauuccucaccccugccucauuucuacuucuccuucaggugagaccugguugucauaaauaccugagcugucugggcucuccuccuguuucccuucugaaccgcauuuccugccucuaguuuccguccuuccuagucaguccucagucugauugccaagagucaguugccaaggugggaagaugcugcauguucuguggugcuggcggcagagcugggcacaaggagccacccaaaaaaacuggugggaccucuuaaggagcucugcaggcugccagugccuggaauacaguucaaacucuuagcauaaccuaaacccuuuguaucuuauccccuuuuaccccagcaggauucuuuguucccugcuuccucucauucccacugugguccagacacauaauacccagcagucccuaaauacaacacuguuccuuaagaagccaugcauguucuguuguuucuguuguuugcuuugagauacugcuccacugucacaccucuucuuuaaaaacaagcugaauuuguaucagauaccuacuguguuugagugcaagauaaagagugcgcauggcccaguugggggaugggugccaccaguagauaauuagacugcugcauggugaagaaaaccaugcauaggaugcugugagagggagggcugagaacagagagcaaagucaggugggcuuccuggaggagggcucagugccugcgccguagauaggagagucgcugguggugggaacaugccagcaguaggagcgagggcuucauccuaguuucagaaaugucugaugacuuaguuuuccuuuaaaaccucaagcaaaugugccaaagaaaagucucugaagagagacaagaagaguugccaugacaguguugagaaagauuagguguccucaggagagcauaugacaugcaaaggggcuccaagaaacacagguagcgcuccaagggcacagcaauagcucuaccccgugggaagaagcaaggaagggugggaagagagacagagcagcagcuuucucagcucugagagccuccaugcacuagagcaggucuuuaagagagcccagcuggccugucuguguaguuuggcacauaugucaccaguggagagcuuuucagcuccuccuuaugauggaagagcuggucacccaggagcugggucuuuccuuguggaguuucaguguggacagguacauguuuguuaacacgcucauuuguuuaguaggcuuuccuuguuuauaugccuggaaacagggucaaggcuaucaggggugaaaaccacaacugagaucaugaguggcacucauuaaaauagguucuuugugauuuccccacagagacucauggaguucuagaauugcagggagucucucucgauuacugugucuaucuuacauuucaucucugaaagggcucuccugggcugugaccuaccuucaguuaugcucagaucuuucuguucugaaagcaugaagccagcuguggucuccuucugagcgcugggaaugaaacccagguccucuggaagaguagcaaguacuuuuaacugcugagccaucucuccagccugauggaucgcgucaauucagaguguacaaaagaacacaagugaaguuugucccagacccucucccuccaaagccaccacuguugguacuuuccuauauagaagucccccacguggcacaagccagcgcaugcaggcaagucagguggggucugacauaagagucccuuacacugaggagacagaaugacacgguuuuuuagaaugaaagcaucguguugcgagcacugggucauuagaaguguccucacuguuacucuucaccagggacucugagauaaugccagccacugguauauaggugcugacuaguauugcuccacugauauauaggugcugacuaguauugcuccacugauauauaggugcugacuaguauugcucauucguaccaaggucugcacuucugcccucuuugaggcucuaagccagucacuucaccucugagucugaguucccugguuagaugauccuguuguugguuaagaacaaaucucugauaggaaaaugauuggcuuccugcuuuaaaacaccacaaaacuugcuuaguauuuuuagguguuuaaaacuacauuuuaggauuauagccaaaucaagacucaguuuaagaauguucuagccaacauuuugcaguugagcauuuauuacaauuauuuaugaugauuuuuagagagcaugguauauucaugaaacacaaucagaaacucuggaauccagaggcuggggcucuagcccugguaguguuggccuggcaugcacaaagcccugguuucaguccccaacaccacacagaccaagugugacaguaccugcccauaauucuagcacucagaauguggaaacaguaaagucacccuugacuacaaauggugaguucaaggccagcuugggauacaugagacccugucucaagaacacacauggcuggcagggugacucagcgcagauaaagguguuugccaucaugcugaugaccugagcugaauuccagaagccuacaggguagaaggagagaacugacccacaaguugaacucuggcuuccacauuugcacugguauaggugcucccugcccccaguaaaugaauuauuuuuaauaauuuuaaguuuuaaguaaaaauuaaaacaaaaucuaaaauccaaaauugucugaaauuggagacuuuuugaaugcagacuuuggaccauuacauguuuuggauuuucaaguuagggauacucagucaguaaagacagugcaccuauuccaagucuaaaaaucugaaacacugucccaagauuucacacaagcacacuuagucucuguucaccugauuaauuaguaacaaccucagcagcaacaguagcagcuguuggaccccuggggagcacacccuguguugggggacaccccaccaccaccaugugcacgaggcaccugaaguucauuuaguuaaaggacagccacagggacaacucuuccuggugcaauugccuggagggcaaggguacccagaguggccugaagcagaccagugagaaugacugagaaacuacccauacgaauugaccuugucuuugccuucuagaaaaagcuuccucugacagcucuugcccagaacaugcaggaggcuucagcccagcuggaagagucucucuugggguaaguggugcuucugagagcccuuggccuggagccuggagaacuggguagcugugguaucuggcugccaccagagcaauugggagcacaauaguggaggcucuugcaucagggagcagcuuagaccuuggggacagauaccuaaaggcugugaugccagggaggaucgucucuacuaagagcuuagccaggcacaagggucagucuguguuccucuaugcuuggacaugaacgugcauacccccccaugccaguguguaggcucagaguuaguacugaccaguccuucagugucccucacuaccaggguggccaccaaagcauggaagguaguguucucuaaugaguacauuuccugaauuauuuggcucauguggugauuguaugaacuucaaaguguuaggccuacuuuacuuucuuuuuaaauauguuuuuauuuaauugacccauauauaauuguauauuuaugaaucuaagauaugauuauaaugauuguaucuagguaauuggaaugcuuaucucucucucucucucucucucucucucucacacacacacacacacacacacacacacacacacgcucacacguuaagguuuuucucagaaacccacacagguuuccaucuuugcuuccuuguacuaagucauuuuccucaaugacaucacaacagugaugcuguguacuagcccaaugcugaaugcucucuaaguacucgcucucuuggccuucagaacaaccucggcauugggcaggacgaauccuuguguucauacuugaggcagggaaaagggugagggagcugccugagcacagagccuucuucagcuucuucagcuucgaucugauaggacagccaccucucaccacaccacacccucuccacggagaacuggaggggcgcuguggaaaagaaggucuagagggugggcggagccuguggagucacacauuugcgcauguauuugggguuacaucagcugugugcuuaaggaaaaugagaaggaagucugcuguucaguagcacagugcuuguggcacggaaguguuagucagccuccucaucugcccucgagaacccuguuuuaugaugcuggggaggaacccacaucggugcaugggaagcuggagacccaguuucuguguugacucuggagaaggcaccucuaaggcuacacucacucagauacaaaaccacauguaaggagugaccuuugcacaugcuaagguuuuucuggguauuuugagaacacuccucucaccuaacuugagaaccuaauucuuguuuaaguuaugaucucacucuucauacuuuauuuccucccacauuucauacaugccagagacaguccgucccuccuucccuucagcuuccuguucgcagguuggaaccucgggccucguacgcucuguaucuucagugaaccaccuuucugucuccauucauuucacuuuauaagcccaaagcuggacuuguauuuuaggugauagcacacaugcaaagcauuguaaaaguuuuguugaguagugcucugcuguguuccugucauggcagaaugcaaccacaugacagcuuaguuuaaugagugcauggcuauuguuugguaucuuguuccuaaaggaagaugcuggagaccuguggggacgcugagaaccagcuggcucuugaacucucacaacaugaagucuuuguggagaaggagaucauggacccucucuacggcauagcagaggugggugcuugugcugcccagccuggcagagaccagguaguaaacagcuagaguguuccuauaggacacuaaucagcggcuuuaauguagaccuauuuggggaaguaaaggaaguuugugucuaaaagaaaacuuuuguaaagagguaauugcuguuugaagaauucagcuaaaauguccagauuuaucucuuguggucuguuuuuccuuccagguggagauucccaauauccagaagcaaaggaagcagcuugcuagauugguguuggacugggauucagucagagcgagguaagguuaccgguaagagaguagagaagaaugcagaauguuguccuaugaucaggauucaagccugucagagucgagcacugaccagaccacagccugugcaugccccuuuaacccuacuccuuccaaguguguccgggggcugcugcuagagcauccugaacuaagugagccaccaaggaaagggagcagagagaagcacuaggaaaauggauaacuaggaaagagguggggcugacaguuccacgaucacaguucucaaaauguuggaguugagggaugauagagcugugguccuuacagcuuauaagaaccucaccagauagcugucucgguaugaggcuaugccagugccuggcaaauacagaaguggaugcucacagucaucuauaagauggaacacagagcccccaauggagaagcuagagaaaguacccaaggagcugagggggucugcaacccuauagguggaacaacaauaugaacuaaccaguacccccggagcuugugucucuaguugcauauguagcagaagauggccuagucggcuaucacugggaagagaggccccuugguauugcaaacuuuauaugccccaguacaagggaaugccagggccaagaagcaggaguggguggguaggggagcagggcggggggaggguauagggaacuuuuggaauagcauuugaaauuugaaauguauauaaagaaaacaucuaauaaaaaaauaaagcacauguaauauucaaaaaccaaccaaccaaacaaaaaaacaacaaagaaaaaaccucacugggucuuaaucccuccauggucaagaaagggaaggacucacaggaccccagagaaccagugccacaggcugucgguccauucgaggaauguuacaguggagccccuaugaucccggcaggccugcugccccagcucugcccuuuuuuuggccagaauguacaugcuuuacccuauugugugugggaacagaaacagaaaggaccuauagcccaguccuuucucuuacugcaucacaguggccagcaaaccccuauaaaaggccaggcagugaguaugguuaacuugcaccccagauuuguucaguguaacccaccucacucuccugucacagcacaaagcagcugugacccaaaguaagccuuugccugccugucacgcagagaacccagauuccauccccagcacugcaacaaugacugaguuacuaugugagaggcagugcaggcauccuccagugaaaccucacagacagacccagucuuggugacuuccucugggcccacgguccugugggaugagaggaucucggccgcagcacagugcccuggagaacagcuccugcucuggggcacggccuguggcgcugcugcauuucuuuugucccucagacaccaccgagccaucucugaaucagcacccacucacaggggcgugggugaaggagaaaaaaaugucagcccauuaaauguauaaaucaguggcucaguauucgguuuaacacucugguuuaagaaaugauaagagguacaguugucaagccagugugacaucuggcaugccaggcgucagucuucauacacuguuugauucuccaaccgaucucccucugucuccuccucuuuauuuucagcaaauacugcuugcuucccacuuagcacagagguccuuugcagucaacuggaaaggccaggcuggagcugguacaaacgcccugugcuucugugaagagaacuguuucauaaacgggcugggaccccauuugcuggcuguaugauagacuccauauccuagagagagcaggugcugggacuaguaccugacagaggcuucugcugugugcuuguauaaaugugugucuagaacccugcaugacaggcagaccagggaguaugcccuaauacuugcauuuuucuuagaagaaagaaugugaacugguuaauuuggugagggcguguguuccccucacugugcuugguuaaacaaaauacagauauguaucaggcaucauugucucaaacacaggauauccagcauggacucuuaccauauggccagaaucauacuugcuaaguuaaccaaagaaguggguguuggagagacugcagugguugcauguuccucguuugcuuguucuuguuccuguggcucuguuuccuugaaggaaaaugguggcuucaaacucagagaucagcuugccucugccgccugaguccugugugccgccaccaugcucaccugcucaaccccuccuuuacuuucuguccuaguucuacaagguagacaguguccgucagcuucaccuaacagaugagacaacuaggcaguaaucagacuccagaucacacagcucuguaacauggaacugcucuucauauagaugucacacuccaaagucuguguucuucucagauucagcaccagcuguuugcuucuugggaaacguucugugcaucacacucagaguggggaaaagguggcaacugcggggcaggcaacaggcuacuaguuuucaugcugcaucugcauaguaucuguguuuacauuuucagugaguccagacaucugcauucaaacagaagcauauugaaaaacaaaacuaauguuacauaugcauuauucucauuugccccgccacuauugcuauguguaucugaaguguugccauagcugcagugaaauacuagcuuuuacugcuagaagcagucuuaggucuuaagagauagaaagguguaucaggaggugcauccagaucaagccaggaggaggaugcuucauagcaauaauuccacaauugggcccugaaaaucagguuucucaggggucccauuguguucuggcagugguguuugcaugacacaaggugugcuugguuaugcuauccccaguacugcaggauuucugccuuguggagaaaauaguaccugucuuugccuacuucuauucuaaagccuaaacauaaguguaaaaagaaagaaagaaaaaaaaaaggccuccuggauucgaaucagccaccaucccaagggaguaggaguuuuugcagcuccuccucagucugcucuuucuguuuugcagauggaaccaagcacacaagucuucaggaaccaacuuucaggggcuuccauccaaaauagauacccuaaaggaagagauggaugaagcugggaauaaaguugaacagugcaagguaugggaaccccugucuggguagacuuucaccugccugcuguguccuguacagugaguaaaaagccaguuauaaguuugccaguguuuugccuacuucauaucagaauauuaugaaugauauugaaaaguaguuuuauuuucuaauacuauagaucauuuuauaauaaaaaaaaauaacaguuuaaaaaauucaagugggggcuagagagauggcucagugguuaagagcacugacugcucuuccuagaggucacgaguugaauucccagcaaccacaugguggcucacaaccauuuguaaugggaucugauucccucuucuggugugcaugaagacagagcaguauaauaguauagguuuucuaguuauaaacaucauaucaucauaugauaucauaucaaucagucauaguuacuuuaguaaggaaaggguuuuguuguuuugguuuuggauuuuggguuuugagacagggucuuauuuuguagcccuggcuauccuagaacucacuguauagaucaggcuggccuucaaacucacaaagaucucugccugccucuuaaucccaaauacuacuauuaaaaucgugcuuuaccaugccaggcaggaaggauuuuucuuuuacauuucuacaacaguuggcuuauaaaucccauacuaaucagaugguugaaugauacuguucuccucggguuaaccguguagauagaggagcacuuacucugaugcuuugggaagugguuaagaagcaagcccuuggggaagcuugggaucuuuaacucuuuuuuuuccugcugauccuugguuuuuccaaaaauguucuuuuccucuuagauguguugggccucuuuugguuuguucagaccauauuauauucccucccuuacgauagcaauuaaugcucucuaaacuguuauuaaauacugaauauaguugguaagacgggaaacauaccucacagaauugcauuguagcuuuuguguucauaaaggaucauguuuagcuuagaaagcacaaugcuggccggggaugcacagagcucugggcucagucccggaaccacacaggcugggguauuaacgcuaacgcuugagaacuggaaagcaagaggaucagacguucaagggcacguuuggcuacaggcuugaggcuacuguaggcuacaugaaacuaacucagagagagagaaacaaaaaauauauggaaaaaaucauauuuaaaugacacuaguagaagcuagagagauggcucagugguuaagagcacuuacuguucuuccagagaacccagguucaaauuccagcaccuucauggcagaucacaacuguuuguaacuccaagaucagacugacauccucacacauacaugcaggaaaccacaaauacauauaaaaauaaauaaguaaaauuuuuuuaaaaaaauaaguaaaugacacuagcaguuugguauguuuagaguggcauguguccaugaacacaaccaaggggaggcacuugucucuggggcccuggagacgaggggagagcgccuuacagacaguguucuuuccuaaacucagcccaggccacacucacugcucaguucuuuccauguacugaugaccgaacucacugaaaucuuccccuuuguuggcauaucauuccuuagagacacuguucuuaagugcguugggcaugguaguagacgccuuuagucccagcucucuagagucaaaggaggaugaguuugaggccagccuggucuacauagugagucccaaggcaacugagcuacauagucagauccugucuccaaagaaagagagagaggagagggagaggaaagggaaggaaaagaaaggaaggagaagaagaaagaugcgccaugcacaguggguuucuuguuuuguuuugguuuguuuuuugagacaggguuucucuguguagcccuggcuguccuggaacucacucuguaggucaggauggccucgaacucagaaaaauccaccugccucugccucccaagugcugggauuaaaggcaugcgccaccaaccgcccggcgcacaguggguuucuaguucucccuuaaaucaacaaauucuaugcuuacagcuuucugacacaacucccacaucccaacacgcuggacagcacaguuguccccaacuuuaguuucuguuuuguauuugacuguucuuuuuuuuucccccucuuuuuuuguucggagcaaggugagagcuuaugaaauccgcuuucuuguuuucucauuuauucuaaaaagauauuugcuguuccuaaugugcauuucugaauaagagaguacucauguuaguuuguguaccuugguaggaaaaauagaagauaguauauuaaaaagcuuacucgagauauauauauaguuuucuaauauauauguuuccuguauaagauuucuauacacacauauuuuaaaauguguauauucaaaugccgaaucugucccuuaaauuuauguccuaaugguacaagcccaucccagcuacuugagaggguaaggcaaaaagauuacaaguucagggccagccuaggacuuuugugacacuuugucuaaaaguaaaaaguagaacaugggcucagcgguagagaucuaaccuagaacacucaaggccugagauucaacccaguacugcaagauacuagaauuuuuacauaauugauuaguuuauguuaguucacauauuuaaaaaaugucagcaggaaguggucuuuguucugucuuucucucuuugcucagcauauacugcugcuaacagaaaacuacugucucuaguaucuugcuuuuuuuccauacacacuuucauauguauaugauaagaggaguaugaccuuuccccuccuuuuuguuacccagagccaaguaguaauaaaugacaaaacauguucaguacuuuggcuuucuaaaagguaugccaguauauaucuuaguaucuuuuuuuuucccucuuaugguaguaaaauccucuagcaaaagcaacuuaagggagagagggcuuauuccguccuuuucaagguauagucugucauggugucaaagucaagauggcaggcguuuguagcuacuaaucccuugcguccacguuaggagcagagaaugaagacuugcuaccuagaugacccuuuaaccccggacauguugccucccacucuuagggugggucucucaccucagccuagugaaccuaauccuucacagacacuccuagaguuugcaggguuucuggcuuccagggugggauugggguagggugcuuggcugccucucucgucugucuaucuuuuuucuaugugugaggaggucagaggauaccuuugccuguugguccuucccuuccacuugucugaggcagauucuguuguuuaccacuguguacccaaagcuggccacaagcgucuggcgauucuucucucuaggcuaccaucuugcuguaggaaugcugaaccuacagauguaugcacagugcccacuugcccucaguccucauacauguguggccaugucccugucaggaagcuuucuguguuucagugugcacaguugucacuuggucagcaggcauuucaccuguggcucucguccucccuuucauuuaucuaggaaaucccagagguuguucucagggucuaguuucacguuacugaugcaucuucuccccaggaucaacuugcagcagacauguacaacuucauggccaaagaaggggaguauggcaaguucuucgugacgguaagcaccuucccuuggcugacacguuauaaaagcugaaucauucaagcuuuaugaaugaguucauuuucaguuuugcucaaccacuaugucuguguccauucaaugcuaacguuacuuuuguuuuugaaugugggucuguucucaguuauuagaagcccaagcagauuaccauagaaaagcauuagcagucuuagaaaaggcccuucccgaaaugcgcgcccaucaagguaauguaacccucgcgucuguugacgccuccucucucucugcccccucugccucuguucucuucacccuggcuccuuugcaugccuuuccuugggacaaagccucucugcuuagcauuucccaguauaauuccaucuuucuugcugcguucucuaauuucuuccaaacucaaauuaacacacuaauggagccuuccaacaccuuccauugaagagaaauagccucucugcuucuuccacagguuugcccucuaauuacccuuuccagucagucccacagggagcauccaucucuucuagagauaguauuccagacuuagcaaggaaggauuugacaggccagcccuugauuccauaucagucacugugaucggaucacaaggccguggcggccucucucuaaccuuccaugguuauagucccugcucuuaccagcuccgcugaagcacauagcccuuuuguccaccagugcuguuuacuuuuaaguuggauauuuaaagccucccccagucucagcucuugcuauugcugcucuauaguauaccuuagaauaguuaucagcagacgugggcacaaguuguugacucugucuucuuuggguuggacugcauuugucccuuggugucugugagggauuggcuuuccagaacaaaagucccagacuuccaagucccuuauguaaagcaacauaauguuugucaacacccuccauacacacccguauguuuuuaaucucuaaaugacuuuuaaugucuauuauaauaacucaagugcuauaugaaguucuuagcuugcauuguuugugaaauaauaacaagaaaaugaaggucuccacauauucaguacagaucagccuuuuccagugucuuuuucccugcaguucugggauggaacacaaggucuuguaucuaugaggcaggugcucuguauucccacagccuuuccagauacuuuuagucugcaguuguugacuguuugccuacagguagagagagcugacucuaguuuuguuugguguauagagcugacauuuggagcuuacguucccuguaggguuuguaaagcaggggggucugaccagguggugaguguagcaaggugaguguggcaaaucuguguguucacccucgugugggcagcugguccacuagagaauuccgugccuugaccuaaguuucaggaagcccugaugaguuagucugugugccuggaugcauugcacuguagaguuagagcuccucuggccugacugacugaguagggucuugagcagucgcaaguguagugcagugccucaucacugggccauucuuugcaugacaggcugcccuuguuuccuaaaucacccaguuucccaguuccuggaugauagauuguggcucagcagcaagugcucaucuuuccaagggacaaacugucgcugucaaguucagagcacugaggacaugugauauggccccugcugguggggcccuguaugggacaagaugcaccugucauucucgucuuugaauggugagagcuguguugggaagaguugaauguuaacauaagcaagaaguuggaguucuuagucacccucauucaguguucuuccccagagaaacagaaagucgugggagcaaagaggaguuuagucuggaagagggaccacuggggugugaggaguguagcuuugugcugucuuucucagaccacacccacucuggcugcaggcugucucccugccuccaccugucugcguacuuaccucucuuuucuuuucuguuuuuuuagauuuauuuauuauauguaaguacacaguagcugucuucagacaccagaagaggaugucagaucccauuauggaugguugugagccaccaugugguugcugggauuugaacucaggaucucugaaagagcagucagugcucuuagcugcugagccaucucuccagcucacuuaccucucuuuuggcccugccuugucuuugguagcugucucucagaaagucucagcauaucagaaaaauauccagugggaccgcccugaccccgugccuggggaccacaguccaccuugagacagcugcuggcucagcccuuccugugcugggcucaugcucaucuaauucgggcucccccgguuucugagggaugcugagugacuuuucaccuucuugucuaccuuuccacccuuagaccuuugcaguuuugcuucugugcccacucagcuauuaaaggagauuacaauucucuaaagagcagcaaccuguuuuuuccaaauauugguguuagacacagcccaggccagcacucugcugaugcugucuuccucauucaguuaggauccgagucugagucauucuccucagcgcugagucagcauuuucugaguccguccucacuccucucucugcuccccucccucccucaucccuuuucucuggaaagcccucauccugccgccuuccccagcaccagcagcagcacugccuuagaaccaguugguucccugggucugggcuuccaugcacuugacagaucucagacagcgugagaggccuccuggcccagcugccuuucccugcuugucuuccagugcugccuuucuucacaugagcugugaagccugggugccggacggacagcacuugucucccgacaucccuguggcuagguucuggguaguuggcccugagcuccaacuguccuucccuucccuaccagucucuuccccucccuguugagacuauucaaggucuaugauugaacucaucacugucugucaagaugcuuugcccccucccccaacacacacucucucauuuccgugugucucagugcuguucccagccaacucccucauaugugcuugucugcuucuugaugccuaugaguccugccuugcucacuuccuuugagaagccuucucuaaccacugcugccacuuugucucugaauugcugucacauugauggucuauaccagaagucgcaaacagccauagcucauuaagauuuacuuuaaaaauuaguugccaccauugaaaaaucagacacuuuuuaauagugcugaccucuggcuucucuuggacguuucaaagaucucagcacagcauacuuccccccugcagaaaccuccauccagcucccagagugcugcagccuuaugcucuccagccugguccacagacuugucacccccaacaacuguguuugcgacccuugucuauaccauugauccccacaucuuagcagucuguccuggcucgccaauggccguucugugcucguguguguguguauauuauguguucaucauaguccaguugcucuuauugugaaaguggggaguccuuaagaguuuugugugccugcuaugugacacauauaggccuuuugcuuaaaggccagcucuggagcuggaacuugccuuuggaacuguguauaggccagaagcucucgcauguuucccucugugguuaucacuuuaaagugagugguaagccauacucugcuugguguuacgagaacauuccaagagaagacuggagcauggucaucucucagugauaccggggacuccacucuugccuucucaugggggagugagagacacgagaagcuuaagcagaaguuuauuuagcaagacaagcacuacagagagaaacugcagugggcugccccaaaggcugaagacagcacagugggcucugugucacugauuuuaaagucuucauaaauguuuaugagguggauacauauuuaugcagaaagcuagucauuuucucaucccgaauccuaguggauuggaucucccuuuuaggguucuuugugugaucuucuggacagguucacagaggggcagagaugcagacccuuuguugguucaugagugcagggagaugucccagccuccugguguucgcuguagcaguaaagaccccugugcagcuucaaggacauuucaccacggggcauucugccuggucagacacagccaccaaaacgcugcugugguuuccuugguuaccucacaucuaacgcccuguugagauuauucagagucuaugauugaacucauaacugucuuaaaaaguaagacuuuuuuuuaagcaugagggcagggaccaugguuuuacaguggacugcacaaacagcaaacaggacuuggggaggguguuaagcuucugccucccagcuuguguuuauuuucuguuugacaucagcaucucagaguuggacauguuguagaggcaauuagguacaaacccaaguacccgccauguauccacgaagagaaugaucacaggcuauuuugagcaagguugaccauaaucgcuuuagguagaagggacagagcagucuagguaagggcucaacuucaagagaacuauuacagaccugcuugugguauaggacagguccuucagagucaaggguaggacauggccggggggugaagagcugagaguagcagaugcugagguccaugucuguccacucucuucugucccuacaccuuucucucaucuucccacacucccacuugcugucauuuuaaacuuuucauuauuuuuuuggccuguggauccauggcauuuguuuuucuuucuuccucucugaauggggguaaggagcaccacacugcacagggaggugaggggggaguaccacuggacagcccuguccagauccagcccucuaacagcaguguggugacaggagggccguccgucagacuggggaggaucuauacucuucuuuagcugaacaggaucauguauugguuucuguauacuucccaggaaacacuagaucucugcaguauccacagacgggccagaccauccaagcaacucauuaucuaauuuagcauguccauguuccagauucuccccacugcuuuacuguacacauuucuggggagcugccucagaucuguaguguaagaagcaggggcuguggccuaaaagucauaagaaaaacugcugccgccaucaggacagccuuugaccuaagcuacuugggaaccccagauaccuccguuuuucuauuuaggguuuuuuauuuaacuagauauagguuggugggcaguauuguguguuacaggguggcaccugcuuuguguucacauuguccucauuuggucuugacaccccuguuuggaaugccaacaauuuuccuguuucgugugauggagucuuuuucuuguccucuacccaugaggcagugcuucuuugcaaggcuagaguaaauuucuuuuugguaaagccagugugcucagauguagccugcauuuuaaugcaagaccucuggcuccacauguguugguagcauguaguagcauccaaggccagcaucagcaucaacucuggacaaguugcaccauguggcaugcuuagggccugucuuagucaggguuucuauuccugcacaaacaucaugaccaagaagcgaguuggggaggaaaggguuuauucagguuacacuuccauacugcuguucaucaccaaaggaagucaggacuggaacuuaagcaggucaggaaacaggagcugaugcagaggcuauggagggauuuuacuuacuggcuugcuucccuugacuugcucagcuugcuuucuuauagaaccuaagacuaccccccagagauggucccacccacaaggggcucucccacuuugaucacuaauugagaaaaugccccacagcuggaucucauggaagcaucuccucaccuauagcuccuuucucugugauaauuccagcuugugucaaguugacuuaaaaccagccaguauagggccucuauccaccagugacugucccagauugacacaucugugcucccauaguugcuaaauaacaaaagcucaccagaugucuggguguuucucuucucccugagucucagccacccuuagucuucuagggaguccuugggugcuauggaaaggaaauguucagaauucauaagcuguccaaaagucuuaccaacuguuuacuccuguagauaagugggcagagaagccagccuucggcacaccucuggaggaacaccugaagaggagugggcgugagaucgcccugccuauugaggccugugucauguuguugcuggagacuggcaugaaagaggaggugaggggcaccccagguccuaccugccaaauccuuugacccuuccucuguccagaucaccaccgucacacauuuucauuuaacagccacuguggagguauagaccaguggcuuucaaaccuuugucccccaugacccacauauuccaaugagucuguggaccuuuauucaauaacuaaaguggggccucagaacaauggguacuuguucugcuugcaguguacucugaccuuuaaucauacucucucuuuccuuucaagcucuguuuaugauuugggacaaugcucugguggccaagaguguccaugaucucuuguucaugacagucuugaauugugugcacugugcagugguuuuaauggguacauugauguauugcauaagauccauaccaaaauuacccacaagaaccaagcagggcagcucuuaguccuauuuacauagagguaagcaugcaaggaauucaugcuaggacacagccagauucaaaaugcaauauucuuuauccuuuaaaguaucuuguuacagucucagauauacagaagaacagaggcucuguaggugaacaacacagcaaaauuuucacagauacaauuuuggcaucuauuccagcccaaaucaagaacaucuagaaacucucaugauggcuucuggugcccaaacucaacuuuuaauagcuccagugcgugcuucuccacgggucugcucuugcuuuccaggagagcaguggcacuguugguugucauuggcacugccaccgccccuccucaucugcagugaagagucacuggguguguaaagugcugagaagccugcugguuucuugucugagccuaaguccccucaguucuggcccacugcccuuuacgugcuucucuugguugccucuccguguccacauuuaugccagugaaugugacgggcaaucuggucugcucucccugagacgucagguuucuaaaauaacuagauuuauaaaauacguaguagucaauacucagugcugugaaagagaaagcuuucaauagaucaagaacuggcaucaagaaggucuguguccugccugucaccauauacuagguacauacacacucuucguuccuuggaaugggguugugagauggguaguguggcucucacaagcaagaugaacuuccccagggugaggcucagcucugacuggcuacugguguuuuguuucuguagggccuuuuucggauuggagcuggagccuccaaguugaagaagcugaaagcugcucucgacugcuccacaucgcaucuggaugaauucuauucugauccccaugcugucgcaggugagcuccaaggacugucugcaaguccuagcucaggucaccagcugaaagaacaguugucaugugaggaaugagcgguccaaugaaagacuccgcugacuaagucuccuaacacacugugugugccugugcaugugucccugucuucucucugaguuuucuccuucccccacucccaguccuuguuacaagcaaaggugaagcuagcaugcauguguguauuguggagauuacuugaaaucuccuuucugucucacauauggccuguuugccuagagaaaguauguauguuagcagaauuaccuuacagcuaacuuuauuuucuguggcucccucaguguauuuuugcaaggaacugaauuucuuuucugagguuucauucucuuaagcauggcugcccaauuguaauuuguuuuguucagcuuggaagauuguacaugagauacucucauuuguaaaccggugcagcuuguggcccuacugcaaacucagaguguguucaugguuucaggugcuuuaaaguccuaucugcgggaguugccugagcccuuaaugacuuucagucuguaugaagaauggacacaaguugcaagguaacuauaaaguguugagagucuuaaaaguccaugaauuguaaaugaagaaaauaaucuaaugaaaaaagugacacugcccuacuuguaaguaacuguacugucaggagucaucauacuaggacacugagcuagcauguguagggaugugucccuguucuaccugcauccagagggaacaugcucgguauuguuagcacagagagcuggugcggcuucaucagcauuagcggguuggcuaguucaaaccccgccguggugaaaauaguucugcgagugaggcuuugugggguaaguaucugugcugcugcuuggaggcucagcugucagcaauaggacgggagccuuacuugcuguaauaguguuuuccugguguccacugugugcuagagugagcacauugcccccaccacuaccauucuucccccccaacuuauuuauuuauguuuacauuccaaacacuguucccucucccugucccucccucacugagucccuuacccccagccccguccucccuccccuucuuagacgguaagacccaccuggguauccccccagccuggcacaucaagucucugccagauuagauguauccucuuccacugaggccaaacagagcagccauggagacugagcuaccugucugcuccauaugugccuggggccuuguuccagccuguguaugcucuuuaguugauugcucagauucugagagcucccggggguccagauuuguuggcucuguuggucuucguguggaguucccaucugcuucugagucuuagauccuuuccccaacucuuccauaggugucccugaccuccauccaaugucuggcugugggugucugcuucugcuucuguccacugcuagguggagccacucagagcacaguuauucuaggcuccuguuugcaagcauaaaagaguaucauuaauaaugucagagauuaguguuugcccaugggauagguuucgaguugggcugguuauagguuggccuuuccuuugucucugcucaaucccuacauuucuuuuagacaggacaaauuuugggucaaaaguuuagugggggguuuggugucccuauccuuccacugggguccagcgugacuacaagagguggucucuacagguuccaugucccuacuguuaggcaucucagcuaaggucacccacauugacuccugggagccuccccuaucccaggucucugggacuuccuagagauucucccguauccccuaccccuaccccagcagcugcagguuucuauucauucuccuggcccacugggucucucuccugucucuccccacaccugauguggauccccauuucccuccuccucccuuaucaccccccccccaguuuucucccucccucugccuccugugaccuuuuuauuuccccuucugaguguuacucaagcauccuggcuucauccuuagcauccagcauccagaacaggcacauguucuuguuacuucaucacagauacaggaacugggagcgagagcaagcauuugucagagcugguauccauauggagacugagcuucuccgaaggcuccacccauuguuugaucuuuuccucacugccuauuccucucugcccacaaccccauccccagcuuccaugugguggguaacaaggcaguguguuucaaaugcuaucagcuucuccuuggccaguccagugaucuucuugcccaggacugaagaauuagacaauuaagagagaaagugagaaggucauuucucucuuaauugucuaauucuucaguccugggcaaggaaggaccagucuccacuccacuguugccccuccccuuuaguucauccuuuguggaucacggugcuccuuucagggaucugcagucaaugugagcuugcagucaguguccucugggagcuugacagcugcucugugacuaggcugucuuuaugguaaggaaagcuagaccucauaaugcuccuaaugaaauacaaauccauacauuugcggauuccuagacagaauuuugaguggcagguucacaggguucugccucuugagcucauucaacagaaucaacguuaggugacauggaauacccacuccccgucaaguaguaugaagcuggaauuugacuccaaaccuacugauuuugaagaugagugcuaucuuccaguuuugaaaacagacaagugucauuguuuauaaagaacauauguuugcuuucugcucuaagaaacaguggccguuagcuuaaaggagggcagguuuauuauggcuuggacucagaaguucagguccuguugcuuuagacuguggcugccccauacauuaugaggguagaagaagccucuuuaccucgugcugggaaguagagaagcagguagggccuggccuccuaacaccuccccuaccauccaaguccucugacuaagcccuaccucagaaaggaccuccugaaagcaccacagacugaaaaccaagccuuuauuagcacaugagccuugaagagauauuucagcucugagcuauaauagcacauuaauauggguaguaauaaugugcuuuuauauacucuuguguauauuuuuuuccuagugugcaggaucaagacaaaaaacuucaauauuuauggacaacaugucagaaguugccgccacaaaauuuuguuaacuuuagguauguauuugaguuuguuuuucuguugcugugauaaacauaauuaaaagcuacuuagggugggaaaggguauauuuggcuuacagguuauagucugucauugagggaagccacggcagaaacucagggcgagaaccuggaggcauaagaaccaacgacuauggaaaaacacuuguuuucuggcuuagucccagguuuacuacuuagcucucuuacacagccugggccaaccuaccuagggaugcuacugucuacaguagguuaggcccuccuacaucaaucgugaaucaagaaaaaucaccacagacauauccacaggcuaguucgauagaugcacugccuaaguugagggucccucuugccaggugugucaaguugacaucagauuagccaucacaguguauaugguucucuaaaggaaguuucggugacccuggaguggauaugguuccuccgaggugacccugacucuagcaggcuugacacauuuagaaggcuuugcacaguaauauggagcugcugggaugggaugggcaugcaugcacugcuggucauuaauaugugggggauguugguaaauagaaauguagauucucugaucauuuugacccugcagcuguuagcaaaaacacugcuguggaaagcuuugguggauguauguuguauuuggaauccaagcucuccuagacgugaaugcaguuaauaaguaguuacuguaccugugcucauucauagaaaauagugcccaaaucacuguacaguggagauuauauuucaauauguuauuaaauaugucucuaagaaaacuucucgugggacaaacuucuaggacuaauccuuccauuggauuucuucugugcuuggaagaagcacagaugaaagguagccccagggaauugucaguuaaaaccaagcaaaggguucagcaaggugacuccguaagcagaggcccuuaccuuaccgcugagccugagaagcuacgcugagaauuaacuccuucaagauguguccuucugucuucucccucuguccccacuucucuuucucucugaacacauuggaauaaauguaauuaaaauuuaaaaacaaacucuuaaaaucagacuuuuuuucuuaagcgauucauuuaaaauccagucuccaggugauuuguaugacauguuuccugaccauaaacuuggucuuggccuuuaucucagccacaucagauacugccugugcacauguaaaggacuggcucguccuugugaguuaacucuucucugugacaacccucauugauugcaagccuggcucagaacggcagguuauuaaauucugucugugugauguggugggaacucaguuacagaacuuaguguguugcgguuugcucuuucagcuugcaucuuuuucucuguaacuuuuacuaauuauuuuuuaaauaauggacauucugaugguuucaagcucaaaagauacacauugaaaaaccucuugucucuggccaccucauuugucugagauaggauauugacaauuucuucagugucuaucuacaagagcuucugugugagugagugugugugugugugugugugugugugcgugcgcgcgcgcguguguguguguguauguaugugugugagugaguguguguaugugugugugagugugucugugugugugcauguguguguguauguaugugugugaguaugugagugugugugaguauguguguguaugugaguguguaugugaguguguaugugugugugaguguguaugugugugugugaguaugugagugugugugugaguacgugagaguguguguguguaugugaguguguguguguaugugugaguaugugaguguguguguguaugugugagugugugaguauguguguaugugagugugugugugugugugugugugugugugcgcucauaugcauguaugugcacgggcacaugaagugcauucauacauauuuuucucccguuguccacuuuuuaaaaauaauauuuuaacuuuuugagaauuucauauguguacagcacauugugauucuaucuaccccauuuacagcccaucuuccccgcacccuuugauucuagccagaaugauguguaaaguuuauaugucauucuccuuugccugcuuggugccauaucuuugcugaauacaucuuggagacuuuucugaaucacaacaugauuuuuuuggucacauagaucaagauagacuauaauuuaccuaacuaguuccuuguuaauagguaacuugguuauucauguaucguuuuuuauacuacuuauacauaacaacacaugucuauguaauaaaucaaauauuuucauaauuaaaaugaagguuuucaaauacaguuucuugaggaguucgagagaggacugaaggagcugaaggaguuugccaccccuuaggaagaacaauaauagcaaccaaccagaccccacccccaccacccagagcucccagggauuaaaccaccaaccauaguauacacauggagggucccauggcuccaucuguauauguaguagaggauagccuuguuggacaugaaugggaggagaggcucuugguccugugaaggcucgaugccccaguguaggggauugccaggguggguggguaaucacccucauagaagcaggggagggggaggggauagaggguuuccagaggggaaacuggaaaaggggauaacauuugaaauguaaauaaagaaaauauccaauaaaaggaaaaaaaccuaccuuuuuauuaaacauauauugggccuacuauuaaucagauuaauuaauguaggggcaaaauaaauagauuauaaagggaaaauguagaacuagguaagguuaaaucaguguggugauguugguccugcuuucuccuuccaacccuucgguuucuguuuugaauaaagugcaugaggagugugggcagcacuccacaugaguugggucccagucagugccagccugucggaagugccugagccauguguggcccgcacagaggcaguggaggggacaggccacagugcuccagagaugcuccuggccuucuguuuugucuuacagguauuuaaucaaguuccuugcaaagcuugcccagaccagugacguuaauaaaaugacuccuagcaacauagccauuguccugggcccuaaccuccugugggccaaacaagaaggguaaguggcuccucccaccucaugcguaagcuucuccuuccugugguuagcuugggucgugacagauuucaagggacauagucaagugcaggugacuucccauccagcucauguuuggaagccacagaaacacaggagauauuaucaucccuaccuaagagacacagaaacacaggagauauuaucaucccuaccuaagagagccuccaggccugaguucugaguagacaggcagcuuggcagccccuguaugaugacaagcucgacacacaucucuguguggguaccacagggauagagccaugccccaagcccuuaagugucuguagcuaugccuaagaauuuaacugacauaagcaaauugacaagagaaaaaccuguagguuuuugcaaguccaugggaaaaugaaggcacaaagaaacauuuguaaagaaacaaauguugcucuaccugggcaguguaugugagcauguggcaagauggccuugggcuggacaguugaguguagacauguuaggaaaacgaggacuguccaacaguuuauuuauuuguagagacuguccucaucauccugucauggcagaaaagaguguuucuuuucuccaguguggggaaggugucuuucacaaggucaccuccugcccucaggaacccccucugcccccugcuaucuucacaugcuuuuaccucagcauagcccugucccacugggcacacauuggggugugcuguugugcuccuucugugcugacaguguagguaagagggggcuguggagcgcccuccucugggaguaacacuugcuaacuuucgugaaugaagaguuuccugcccuuggcacugaaaccagagaagucacccuagugaggcacagcuuagauucugcccuuugaggacaguaugcauggcccuggacaacuggaagaugccuugacagacagagguaggcugugaagguccuuguauauauggcuaacuuguuuggaacuuacucuccuggguccuaugggaaucaucaaggcuccuguuccauuauuaauauaaaaugccucucauacgaacgaccauguuucaaacaucuguuucccaggucauggucuuguuuugugggguugagcuauugagaaguggggccugcuuuggaggcagguuuuuagggguugucuuugaaggugaugccuggccccugcuuuaccuccauaagaaaauccuucacaaaaguauccugcugcugugacaguccuuucaccuguaugguagaaaccaugagcccaaacgaaucuuugcuuccuugagucaguuugccauaacagugugaaagucacuaauacuguccuaagcagaauggcuucgcacugcugccuuuaggaggccugugcuggcauugaaccguguggguuaaguugcagagguagacacaaggggucagcugcgcagcaagugcucaucugagggagcugagucugagaagaaccagcaauuugcccagggcugcguggcaggccagugguggguuauaagcgcaggccacaaaguccauauccucaccugucacuccgucauugcugcugaucagcuuuaacgaaucagucauucaguugcuuguguaugcccaguuuuguuucagaaaauaguugcaagcauacaaugucauaaagcaaaguuacaguuaaguaggaagaugggcuaagugcauagaucauauagcaaauaaacccugaccaaaaauacccacauagaaaguaaugcgaguuuuuaguuguggggacaagaagagucuucaaaggaaacagacaaaauucaaaaaucaguauggauuagcugauuaaaaaucagaauauuuaacaguaguagacacagcuuuuuauaaugcccagaaauuugucaggaagcaccauagaucaaagcuaggaagaagaugcuccaaaagucugugagauacccaaaagaaagcuuucugaaucaccagcaguguguuuuuuuaagugagcaugggagcugauccgaauccucacauguggaagggcagaagggcacuuugccaggaaagcuugugucaugcuggaaugugaaggagcuagacggucugcugaggcacagugacacuaggaccagggacauugguuugaggccaucagagcugaaugugaaggcuccuaggaauccagugauuucuaaaucacgucccuugugccccagacuucaugaugugacagguacaugagagaacagcuuaaaaguaggaaguguuuauguaagccucgggugucaucuggcugaguggcugugagcaucugacaagggagacucucauggcagcaggagcagguggcagaaguguuaaaucagagagccagagaggaaagggccagagaccuuuaaaggucuuuagaggcaccaccaguaaaauuccuucccacagaugugaagcagcaucugucccuucuuccaaggucccaaccaaaaccugaggcaugauucugccaaaguucaguggggaaccaauaaauuauuugguuuccuuuuagaaacuuggggauggggagugauuauagggcugugaccacucccucuguagccagcugcauuagaagagggcgucccccaaagccacauagauaaagcucccacucuagucucacucagccuguaugcugcauccccucagcccacaccaggccaccucaggcaguuccacucugcugcggaaggauugauaauacuggguaauucuuccucuugggcuguuacuggcaaacucauaggauagggccuugugggugaucuuuuuguaucuguuguaaauauuuuauccauuagcaauuaucgagaugcccugacagcuugcagagaugugaggcugccaaggugaagcauuuuaauugugugaacuucuugcagaacgcuggcugaaauagcggcugccacaucgguccacgugguugcagugauugagcccaucauccagcaugcagauugguucuucccuggagguacucauggguccaggcuuacggaugcugaagcugugccacaguaguacaccacauuuuuuaaaggaagaaaacauguugcugguuauguaauugguuuuucuuccucacacuucacuucagauuucguucauguacauucauauuuugauauggugauaauuauauuauuuuccgauucccuuaguuucacuaaaauaugcuugcauaguauguauugaauuccggcuaguggcuaugguuguauacugucugcucugaaggaacuuggauuccccgaaaaggcaaccauauaaacagaucaguuauaaaauuaucaaguggcagauuagaauguuggauagagaaagauuugacaagcuuaguugcugagaaaagagagccaaggucugcuuuuuaggagugaugcugccagcacaggggcccuucacuuagcacagguuuuguggugagcguagacaguuguuuggacuaucaaaaguagaaaauaaagcaggcaaggcuagggcugguuggagcugguuugugaaggucagaggauuaggguuuuauucuguagcuagugaauuuuccaguuucucuuguugugaucaugggauccacagagguucccauggccuccuccucaggagcugguuguauggauguuguguccccagguguugccccugcuuuucucaguacagcccagcugccucgugcacugcagugugagcuccugaugccugaugcagggcugggcucaguucuuuucugucuuccuguccucgaaucaaucauugcugcugcuuagcaaaaauggguaggagagagaucuauuguccuugagcuccuccuguggacuaccgaggcucuccucccacuggggcauuggagacccccccccccccccccgugccaagucucacauuuguuucucuucugacagagguagaauucaauguaucagaagcauuugugccacuugcuaccccgaauucuaaucacucaucccauacuggaaaugacucugacucggggacucuggagaggaagcgaccugccagcauggcagugauggaaggggacuuggugaagaaggagagguacgugcagagcuggucacuuccacagaaauaauaggugucauguaggaggacacucaaccaugcaucugguacuggcuuaauggccuccuuugugaccgugaccuacagagucuagauaauucaagaaccacauuguccaacucuacaggcauuaaucugugcacaaaguagggggcguagccugucuguuaacaucugcaccuugugcaccagccuuuacuugauggccuauuugugcccacgguaaaaagagugcugucacacacacuaaauccacuuacaugugucuugaguguuaaggaaacauaguuaacguguggauuuuuggcugagaaucauaugaagacaaccacauuucccagugagcuguggagaaacauauuuuuggccuugauauauuugcuaacugcugagagaagccccagaauuugacaguccuggaugggagaaaauguauguuuuaaacuucgaggcaguauauuuccauccuauugucuaugggcacuuuaugagauguucaguucuaauuaagacuaugauuccugccuucaucgggcaacguagcccuuaagugaggaaaaugcuagcaagugacaguuucuccaaguaagaugaagccgugugaagcagcucgcugcccucauacccuggcagacugcucaccgugggcuucucuuguucagagaaagcuucgcuuccauagaggcuuucccugagauucaccgucauccuuuguaauugacuacugugaccugaaccucacucaguccuugccaucguccccugguggccuauuagagcaguuacucuucugaauuuaaguuacaugagguguuauuagucucauuagcccaugacacaccauucuuagcugucugcucugcuuauucuccagaaaacaucaguuaaugggguccaggcucucaauguuccaaacuuaagaaaagaaaauuagggggcuggagagguggcucagcgguuaagagcacugacugcucuccugaagauccuaaguucaaaucccagcaaccacaugguggcucacaaccauccauaaugagaucugacacccucuuuugugucugaagacagcuacaguguacuuacauauaauaauaaauaaaucuuaaaaaaaaaaaaaaagaaaauuagguuuggcaaugcagacccuaaugcucugaaugaagaguguguuccuucugccccauccuccagacgccauccuaccagaaaccaacuguuuuuuccagcuauccauagcuuucagccaaaugcacacauacacacaguugcgucugugucuccugcaagcucaggggcagugguguggccuugcacagccacuggugugcuuauggauguggcuuccaccuccucacaugugagaugggaacucgaucgaucgaucggcacagaacugugucacucgacaugaggcugccugcuugcucucagcugcacacaccaccugcucaggggcaucuguugaucagugugugagguuggcuuugcuaggguucaaagccagaaccaggugcuugcuuugguaacugggaugaccgcugacaugucuugccacuuaccugcaugcugggcaacgugggcggcgucccuucagugguuuuaacagugagaaccugcgggcuucugucucucuagucggcaugugugguguguugacuguuucuucucucuguguagcuuuggugugaagcuaauggacuuccaggcccaccggcgggguggcacucuaaauagaaagcacauagcccccgcuuuccagccgccacucccgcccacggauggcaacgccuuggcuccagcaggcccagagcccccuucucagagcucuagggcugacagcagcucagggggugggccugucuucucuucuacgggcauauuggagcaggggcugagcccaggugacagcagguaaggagcccacuucugcuggcagacaaggcuggaugccccugccuacuuccaaguggccaucuuuggcguggcggcagagagcaaaccaaaguugcuuucacuccuuugguuagugggggagagagauugcaaauugcuuguuugcuuagcagcacauguuggugugcuuuggugcuggaaaguagagacuaacaggugucuaauggugugcucggccucuaccuguucaguguguagcucucaguguucacguacccuuugccugggcgcuagcugagucacaggauucuugccauuugucauccguuugcucauuuaauaauuacauucaguugcacagaguugccaaauagcugcuguugcaccaggcugccagcacacugggugacuaagggucccuccaccccuuaggcacacggguccaagaaagaaaguaagguggcauguguucugaaaaggcuuguucauuugcuugaacuuugacacgaugcugggagcugggcuucacagggauuaccuuacgaggccuucaggcuggagauuucugcucuguaccacccaguucuccacugaucaagcagaggccacugcaggacugaucucugcuucagaucugguggcucuacaggagaugagcccugcccaagugcugauguuucaguugucauuguuuuaguccuugucuuuggacagccacacagugccccauggucacaaaugcacaaaugugcauaugugugcaguacaugugcacaaagcaaagccuguuuaccaugugugguuuaucacacagauggguuuccuugcggaacucugauugcaucuuuuuggugguuagcccauaaucccaguuacuuggaaggaagaauaauuacaaguucaaggccagucuggguaacagugagaccuugucucaaaguaaaaacuaaagcauagggcugaggauguagcucaggucggagcacuugcaagguaugucaguagacgucagagagagcacaggacucuuguuuuaucgccguagcuggacucagugcuuauguucauccaugaguccuguaaucuagggaaguccaucuuucagucaagaagucuuggcugugcuuuaggaaugugcuggagguaccaugcugucagugaccacuccgacaugcgggccuugguuuuagaguaaaugguuuuuguuuguccaagugauaagccaauuuccuuaugacaugcaguuuguuuaaccaaagcugaauauuuaaggaaguagucagccgucugcagaaagaggagugugugucagccaucagucugccuucuaguuucuauacuugaaauaucuuugugcacacuucaauggcaucugcccuuuggugaccuugacaaaaugugaucuuugguauagaaagcugugagccgggaaguaggaggccugaauuggcugucagcuuuaggcugucaucgggcagcuccucagagcuccucaguccagguaacugauggcagaguugcuuuauguuuguuacuuuuguacaacagcuaggaaaaaguccccaagccucauuugcuuaaaauaacacccaauuuaaggacaugcaaaacagaacaugaggcuuacuguggaugcucugagaugcuuggccuuaaucucuguggcaaaggagcugaaacuuagucuguuacagggaaucucaaugccuagucucugaguaagaucuacuuaucugcccaauccgagcucuuuaaaaugucagauaaucuucaucucucuggguuccgaugauuucucaaacucucucuguagggcuggagagauggcucagugcuuaaaauacccgaugcucuuccagaggaccagacuucaauucccagcacccacaggcuugcauccaccuguaacucuaguccuccucuaacgucugugcauaccugcacacauguagcacacacacagaucuuaaaaacaaaaccccauuguguuagacacuguuuuguuuugucugccauucuccagacgguacagcauacccggcauuccgguagcuucuccacugucuugguuguuaugagagguggcucaggaagguguugacaguuagguucuaaugccauuuuguauacagggcugccacagccuugacuuuugguaucuguaagaaguccuggaacuucacauucccaaccccccuacaaggaugagcuagauuuuaugugcuuagcuucuaccagggaaugccugaccucugacuuguaacuucacguuuacccuucucaguccuccaaaacccaaagacuccgugucugcagcugucccugcagcaggaaggaacagcaaccagaugaccacggucccaaaccaggcucagacagguggcaacucccaucagcucucaguaagcacaccucacagugcagccggucccagcccgcacacucugcgucgggguaagugucccacauuccuugugcucggggaaaguauaagaacuucugggagcuacugcaaagggucaggagggaagacucugagaagucuuuuucaugccuguuaacaaguaacaagcaggaaaauccgucaucaaagaggaaaaagcauugacgaaaacugaaagcauagagaaaagaaaugcagaacuguaaaggucaacagccgaaaugaauucugcagucacuucuggguuucuaggagguugguguuccaagucguugcuguuuaggagccaccguagccucugauacuaaacuucgugagccagacuugcagggucaggguuuucugguuuuggaguaauauaaucuaaacagcucccaccugucuccuuugcucuccucaacccagcagccaggcuguugcucuaaaacucaaagaagccaugucaccaaucccaucucucccacaggcacaaggcauuucugucaugccacucuuugggguuuuugucagagcauuuauuuuucuuucuucuguaauuauucccaaccccugugccauggugcacauguagggucaaaagacagccuggguuuuguccucaccuuccaccuguuuuuccacugcauucuggguccccugcccagggcaauucuggggcuucucucguguccaccucccaucucuccauuggagcacaucccaggugugcucccaugccugccuuuccaugggugcugcuccucacacucgaauaccaagugcuuaaccugccugaggcauuguguccgacugcugagugucuuucuugaccugaauguguaaauuuguuuaguucauuaucauucuccccaagaucuuagugagcuucucucucucuuuuuuuuucccugagccaggguuucucuguauaacccuggcuauccugaaacucacucuguagaccaggcuggccucgaacucagaaaucugccugccucugccucccaagugcugggauuaaaggcgugugccaccaaugcccggccuuauuugucucuugcuuaacauuuuacccacaugugugccugccagagauagcacucagaaagcucaugaggucuagagcucugggugccucagagaucuggaaaaacugggacuaacuuuaucccuaccuuagucaguauuguauugcugugaggagacaccauguuaaagacagcucuuacagaagaaggcauuucauugagggguuuguuuacaguuucaaaggguuacguuaguccaugaguguccuggcaggaaacagacaggugcugcuggaacgguagcugagaaagagcuuuacagccugcucuguaggaagcaggcaagcagacacugggccuggggugggccuuggaagccucagagccaacuccauugacacaccuccuccaacaaggccaccucucccauuccuacaaacuuccacuaacuaccacaauccccaacucugaaccuuuguugauuucuggagauuuuuuuuugguugucaaaaagggcaggaggugacaacaguuaggaaacagaggcaaguauucuauaagcaauggcggugugcagcacagcugcuagugcugcucaaguggagaggccauggucuaaagagggucguguuccaacaaagaugcaugaggaaagccacgccucuuacugccgguccagccaguuaaaguccauguggaccagguugcccuguguucccaacuguguuuacuaaugugugaaagauccucgccucaaagugucucaucauuuugguugcuugagaaucggugaauuuaacauagcaagggcacauguauucaggaacgugucaaguuuauauucuuuuccaucucucugaaauuaagacuggggaaagacaguccuuuaccauuggaaaacuuccagguaggaaugaggaggauauggcuacaaugcugcagagaagucacacgaagacuguccgacuuauaaagggauuuauaguccuggaggcugggaaauccaagggucauuugguguccaucuuacggugaaaccuuaugcugcuucaacuccugaugcaaagcagaaguuaaaggggccgcaggagagcccgagagccaaaggcaggaaugaucaugagacuuccuucaggccucccacugagaguugcgguuccaacacacaaaacuuggggcagggaacuuaaaucacaccacgaagcacguaacaguaguacagacuucugcacacugcuuccaggagugcacagugacccucggggagaggugggcuaagagaagaguagacacgagcagacuuuggaaagcugcagcgcguucuccaggaucagcacuuagagcagcucauggcagacugugaggccucuucucaacuaguguagaugacaaguguguccagcccaagagaugcucacacucagccgugugggcugcaagggcuccagggacaggacucaggccacccccuugcuugcucugcacccuuucuuucuggccaugcucuagucauuagauucucaugaguccugaccccgugcuauaauggggacgugagaggcacuuacugauggccugugggaggcaucaggcucuaguaagaauggggaguggcuugaaaagguuguucagcuuucaccacaaaaccagcugaacaaucaagcugccugggauggggcagggagaggguaggcaggcaggccacaggcggugucgucagaaaggaccagaguguguugcagugaccacaggagaggaauccaggagaucugaccuauauccuugaugccacucuuaauaugagggcauuguagaagaugaaaaagacccugaacuccacaguauguguuuuggcuuuagccuaaagguauacacugcuuacaggaugcuaacuugaccuuuuccaaugugucccacauguauauaggggaaauaaauauacaaggagaggcaaaaaaugaaggagcauuguauuaaauucacuguuggauuuuuuuuuuuuuuuugagacaggaucucacuguguagcccaggcuagccucgcacacucaaaguauuccaaccucagccuccugagcacuaguauuacaaacuugugccccucccccuucucuguaguguaugugcucuuucuaaagcacucuacaaacacuaaugaacauuaaugcacguuuuaagcaggaagguaaacugaguucugguauggucacaggccccuuauugcucuccuguucuguacucucagucuaccugucuguagucucccugcaguccagcucagcuguagcucagcuauagcucuacuuuuggagagauggcuccccagaacccacaaggcccuacaggacaaguuuuauucugccuuccuacaccucagcauccccaccccuccguccuggccccagacacgcccuguguuucuccaucccagcugcccugugugcuguucucuggcuuccucaccugaggucgucuucauuguaaauaucaggcaugaguucaucuccagugugaguuuacaguuaauacugcuuagagcagaaaaccagacuucucccccuccccuucuuuuucucuucuucuuuuucuucuuuuuccuccuccuccuccuccucuuccucacagcuuacaucagccagaguguggcuaauauuccaaagagcuuuuccuuuguaagcugacuguuguuucuguagggaaagauuuuaugagucggugggcucagaguucuaggccaguauaucagagcaaacaccauguaaccccucuugcugggcccugugaguaggaagaaaaacagugugggaaggaagaggaggaaaaggaauucugggagaccacaugagauggguuugaaucuguuccaucgccucuuagcuaugcaauuuuuagaaaauaaccugccagauugcacucucugggucagucccacagugaccuagugagauggacagauggaaauagaggccugguuugcagaugaguggugacugcuuauuucuguccucugauuccuccugucucggguucucagugugaccucaggagggauggaaauguguucaaacugcuccucuuugcccccaucauccucucuuuaccaccagauucuguucagaucuaagcuggccgcagagcaaggauugugauucaucucauuuuagggaaacagaugcaggcuuguuuguaauugauucuaucuagaauguauccagaauugguagaauuuccaugagucaaaaccaaagucgguccgaggggaggauguagcccagugguagagugcaugccuagcauggagggacccuagguuuaguccccaguggcuacccuuccccacaccgaccucagacccugcaggaaaugcuugggcaacugugaauggaggugggcugccucuguucuucccuccuggguuuguucccauacuuuaaaguccaagugcguagggacucuggaaaagagccacaaagcaacccucgauuuucuguuuuguguggguauguagccucucuuaaacugaguuuucuuccuuuugaacuuguaaaaugacaggucacuaaagaccuguauauauaucaugcacuuaacuuuuuacauaaauugcuuauauuggacuaguuuaaguuuacaguucuguucccauuaugccugcuaccccaguguuacugucuggcuuuaucaccccacauuugucauaggcgaaacaccagugucauuaucauuaauuccacacuggauuuagcucuuccauuuguccagaguucccaucuugccuucuacuuccugcccaagagacaccuuagcacaagaguucuccuggcuccuuaguguccucagguugggaagggcucuguuuuuccuugguuucugugacuuucuguuugccaaauguacuugggaguggacgggucuagagcuggggguccauacagcaggcccccuccugauacaucuguaccccuccacaaccacacccaguccuaaccccugcucucacugacccugucuuucucuucuuugcagcugugaagaaaccugcccccgcaccccccaaaccaggaaaccuaccuccuggccacccuggaggacagagcucuccuggcacaggcacauccccaaagccaagcgcccgaagcccaucaccgccucagcagcagcagcagcagcaacaacagcagcaacaacagcagcagcagcagaccccaggcaugcgccgcugcuccagcagccugccucccauccaggcacccagccacccaccaccacagccccccacacagccucgguugggugaacagggaccagagccaggccccacgccaccucaaacccccacaccaccuagcaccccaccccuggccaagcagaauccaucgcaaagugagaccacacagcugcacggaacccucccaagaccacggccagugcccaagccccgcaaccggccuagcgugccaccacccccacauccaccuggcacccacacgguggaugguggccuuacauccucagugcccacagccuccagaaucgucacuggugaguagcaagugcucuaguguucgcuugggccucccuugagggcagucaacaccaagccagaucaggcauguacaugcugggagcacagccacacuugcucccuuugagccguuuguggcugcuuuuauaucaagacagcaaagaugaauacccuggcacagaucauaaagccuguaguagucuucuagguguaagacuaucuucauuuacauucuguagagucagaugccuuuaaguccagguggaagguaugguacagcauggacagggaguucuucucaaaagcugggcauaguggccaauaccuggggacaggagccuuauccacaaagcaaguuccaggccacgcuggacuuauuuuaaaaguaaaaaaugcacauacuaagugcagaauuucagaaaacaccaucugugcuaacucgaaugcucugcgaaggcagaucuucugagcagaucauaucacugugcuagccucacauggcuuagggggagcgagcggagauuuucccaucauucccauggaucugcccuaggcaugagguugauuguacauuguagagcugccuugugggauauuuuaauagauaguccuauaaagcaugaucauauaauuuaaucaaaggaagaauguuucuaccuggguacuagacuuucuauuaaguuugaaaaauaauggguucuuuaguguuuuuaauggucaucugggcuaugcaucauuucuuaucagcagcuugcuuuuaauuacugcaaccuugcuguggguuguccuauaugggagcaugcuaguagaagccacugagcuguuccucuggcucuccagcccucacaagugacuucucagcagaugauaacccaaugcuaaacccaaaguaauaaguuaacuaacuacaaaaugauuuuuuuccaggacuauagugcauaguuuaacguauguuacccguaauuaauaacuguuucuaugacagcaggcuguuuauuugaauagcacaaagccacauugguuucuuugcuguguguuucccacuagaugcccuucccggugcccucacagguggggaagguuuccagaacuaaggucuguaacuccagcagcuugaccugcagcugcaagugccccugcuuagccauguccugugugugcuuuugacuuugugcucagaauggccaucagucagccauccauccugcagcguauagcugugccuuuugucccaucagucagccauccauccuacagcguauagcugugccuuuugucccaucagaagaauguugagcuuuggauuugcuccaaaucuaagacauggcugucacaggaugagcucucaguguggagcccucagauaagaugcuguauuguuccauuuuuucuuuggguaaaccccucccaguguuccacucuccucaguacauuugccugucacuggcucaucaguauccuggucucagaagaggaccagggcaccagcaacacagaaaauuaggcaucccuguguuuugugcuuuaauuuuuaauuuuguauccuaagugcaagguaacugcauggagcuucuuaauugaugucuaaagcucucagccccuccaaacuucccagauaauccuccccugaggucccuuuaugcccuuugcauccagcaugcuuacauuuugcuuuccuaagcuguaugagcuuuuaaaagacacauggaggcucaccugaacauacauuugggcauuuauugggcagcaaaaggcucccaugggguacaguugcuuuauucagugcccuuggccuucuauaagauauauaguguaaguguucacagcuuaguucaagcuugaaaugguggaggacacagacauucauccgcuuuccucaggaccugguaguuaauccguuaguugagugacuaaaccuuagguaaggcugagccuuuuaacacuuuaauacuuaggacaccaaaauuuuccucaguucuuuuaucuagauuagagaacucugcaaaccagaaauacuccuguuuuguaauaccauggacacccacacccauaguauugccauacauguguguuuauugccaaaagauugucuuaauugauuuaucagucacuauacuuuauagugaggugaaauuuuacauuuaaaaauuaucuaaggugucaccugguuuuuuaaaucuuugcuaaaaauuuucuuagcccaagaaauccagggucccuguaauuuccuuuauauuguagcauuaaccugaaguaucuuaaggcccccagccuacacacacuuggaaauguauagaaggccagcauguggaauuuaggaaccuccuagcauggauccugcuguuaguggcucuucuuagauagaguccucggauuuucagauaaaguaggcagcacagccguuuauuguggcucuaacuugggaaacuuuggaaagauuccugaaaacagcucaccauuugcaucauuuaacuuaaagcuucaggcguuaggaaugagugaacacuugugggcagggcacacugccaagcugacuugguagcucgcuccccucuuccaagcucagucucagagcucuggagaagaggaauucuggaccauccuaaaugucaggcucucauuguaacuguagagcaguagaaguuuagcaaagaguauucuaauuuaaacauuuuauuaaaugauuuagauguaugaccugccauauucaguaagaacugaaauuggaaugauuaaugguaaggaaaaggcaacugauuggccaaagcauuuuugcuacuuuaugaucguauuuguguacuaauggcugccacuaaccaagucacccuaaccuugccugcccgcaccccuacuaauagugcauguacuaaggagagcucgcuguguccaugccugcuccucauugcucacggacuuuaacagguggucacugggcuggccuugguacuccuucauuugcauuccuuccucuucuagcaggcuugagauguaguagacagggcaugugcuauagcauggggaaggcacaaccugguugaugugucaagggcccacauuaggcacaacgaguaaagggauuaaaucagaugaaauaagaaaggcucuaacggcccauaauagcagggggugagcgaacgacaguuaucuguuaccauguuacaugccaaacuaggccuuguaggacccagagagagacaagaggucacaggcaccacuuagguauucagaucuuuauuuucuaguugcagaagucugcuucuagccugccuuuaaaggcugucucgcccuguuuucugaaggcagggaaguacgagaucucacuugcccugugugacuuuuaucccagcauuaggcuuuuccguugcauucagugccaucacccacauaggaauauagacccacuguuucaucagguaccugugcuguuacuacuuguagcuggacauuuacuggguuucugcuucuaauugcaguuucauauguagauggcauauucaucggaagucagacauucagugagauugaauccugucuuuuuuagcuagagcagugguucucaaccugugaauugcagcaccaaaaaaaaucaaaaaaccccacaaauuuuuacaucacaguugauaguaguagcagaauuacaguuaugaaguagcaaugaaaauaauuuuaugguugagggucaccacaagugaaggacuguauuaaagggucccaguaguaggaagguugagaaccgcuggucacucuguuguucacagaccagacuugcuaagggauccggggcuuucagaccugagagaggcugggugggugacagugauguucagggcuuuacuuugcauuggguugcuuuccaggguguguuuagauuuggugcuuauauaaguugacaucaaaauagcauuuuugaagaaaaguguugcaaccugaagcauauaaucaaaauuauuggagugaaaauucuucuaagcccauaccuuaaacucuauagagugccaguccugccccuuggaggccuguuccaaaaaagaauguuccauuugucaggaucccagguccaucucacuguccucccugugucugaggccaagcaaggccuguuaccugaugcucuuuucugcgcuucuuguuaucaucuuuaaauuaucuuuaauacgaacuucuuggagauguguagaaucauuaaaagaggaaaaaagaaggcuugagugacacuuuucuuauugccgugaaccagguguucacgacuucagccauuaucuccucagacagugucuucuccuuugggagcucacagaggaugcacaugguccucugggaggugggaaacacagugcaguccagagaguccagacaugucuuugcuuuguguaugaccugugcuggcaugucaccuugauauaguggugccccugaucuccacgguagagcuaaugcugguauaguguguacagcagcucacugacauggucugacagucgcuguggaaugcaugugucuucauuuugcaguagaugcauagcuguccuuccagaaguugacccugcacacagugcagccuaucuuuccaucuuaccacucugcacacgcuccauuguuugcugucacaaaacaguuucuuacucuuaggagaauaagagagacuggggaggacagauuggacagacaggaggcagaggagagccaugucccuuuuaccucaccacauugguuuuguccuaaauguauuauuguuuucaucauaaguagagaauuucagaaaaguacaaauuaagaaaugauauauauucgaggcaguggugacacauuuaaucccagcacuugggaggcagaagcaggcggaucugaguucaaggccagccuggucuacagagcaaguuccagaauacccagggcuacacagagaagcccuaucuuuaaaaaaaagaaauuaauuaaaaaaaauguaucuagauugauuuaggaaaagaagagccaauuuguccucugugacagcuggcacacaagcagagaugucaacaaguagacaucugguuacuaggcauuuucacucagcauguucaugucugucccuuaguccuugugaacucccugggcuagcaguggcaucugugguagguaggguuauaggggcagagacugagucugcgaugauuuucuuguucauugcugccuugagucauggccaccucucugccugaggcuaugaaaagggaggguuggcaagguguuugcacuagcccacuguuuaucuguccaucuacuacccagcuuuauagggucugcuuugugccagucauggcuguaagcacugaacaagacagauaugcccuugcccugugugagccacaagucugagauguccuuaguucuguguauacagacugcuuuugauugucugugaacuuggacccuuuaacuccuuggcaccuccauaaucuaaaaauuuccccuaguuaggguacaaggacaaguuucuugaccuaggaaaagguaaacuuacagcucagaacuauacggagagagaccaggaggggcucugaggaaggggaagaaaccagucuccuggcuuaccuauggguuuccacaaggcucgucugucucguuuacuaguguauccucagcagcagagcagcagugagcaugugguagucuagaagagaauguggugaaugaggaggggcuugugagcauggaggggaggggcuuaaggccuguauauuuuccaucguacugaaggaauuuucaaucaacccacgaagacauagauuucaguguauuaguguuagaaaaauaguauuuagagauuuggggucuacugaaguuguucacaagaggugaauguaucccacgggggacacuuaacagugccuggagacauuucagguugucucucuggaggucaguaugcuguaugccaccagcauuuuguugguaaaagcugccagacuacccaguauccuacagugcagagaacaguucccuacaacucagaauaacucaauccaagcuuugauucagugcagguugaggucacagcuuuaucgcccagagguaaaugccugcagccucagaaaagaguucuucccagggcaaucguccccagcagcauagaagcuguuaggaacccucagugcaauggaggccuaggugagaguagaauugcccucacucaaagcaagcauccuucaagggucacaucccuccggcugcccagucucucuggauucucaguaggcugugguaggcaacugcugacuagggucucaaggccuugaaaccucuggaaagggcuguguuugugcaugggcugucuuggaucuucuagccuccuccucagugcauugguggcauuuggaccucacucuuacuaauguuuuuucauguuuuuuguccagacaccaauucuaggguuucugaaucacuucgcagcaucuuuccugaaauacauucagacuuggcaagcaaagaagugccuggccacauccugcuggacauagacaaugacacagaaaguacugcauugugaagaaagccacuugucagccuuuggcccuccaucccagugaacggaacugggucaggcaagccucugucucugcagaccaaacagugagaagcuuuuagugggggaaggaaggucugacuacgaaggacuagacucccacggcccaaggagaaggugagggccaguccucaaagcugaaugaccugugucguaaagaaguuggcuugcuuuaucuaggaugaaaaucaugccaaaaaugaucaggacaaagaaauaccgacagcaggaguauuacugcugagagguguaugggaagcuguugccagagcugucagcucagacagcucugauugugacuaagaagagacuuaccuaucuauuuaauaaaacauuaauuaugcaaguugccuacuuccugcuacuuggacuuugguucucacauaccagaaggagcuuccauuccuucagacuugcugcagaaucauuuuguauuaaauagucugucuccuccaacccccagaaccucgagcauuggcgacugcuggcucugucgccucagcagaauggaugcaagucgugccuuguggauugccagaauauggagagaaauauaccguucuuuuuaaaaaaaaaaacaaaacaaaacaaaacuauaauugcuacuugauaaagagcgaauguuauucuaguuucauguuuaauuugaauuaaauauauucugugguuuauaugaaaacuugcuaauucuuagaggcaaauucugggauauauacauuuguguuugugcauauaugugcaugugugagcuugccuguguguuugucuauaggaauuugaaacaauaaagagaugcuagcauggua

SEQ ID NO: 4078 - RNA, 23100 nt, Mus musculus
ccgcgaggaagccucgcacggaccccggucgcgagcggcgcaugcguggccgcggcucccagcgccccccgcgcucugcgcuggcggagcugacagggcagcgcgccagccguucgccgccccccgcgaggccuagccucaucccgcagcuucuuccccucuggccgagguucucggcauccucgugcggaggaaccccgagcgcugcaggcgccgcugcgaguccggacauuccugcgcucgcgccccuggugggcaccugcagcggccuggaccuggaccaggaccccagggcuggccgcgccucgcggacacacccccucccgaucggcgccuccgcccagcaucaguccccuggguccccuuccagccuagcuucuaaccuaaggucuuuccgaccuugcaccuuaaagaaccucaugggagggggcgcaucuugauuggauaagaggccggguuugcagacuuuggggugggugcacauucacccuuucaagagccuuguacaaauuugauuaaucagccuggaguuccuugucccagcuaacugcugucuuuuaugucucuacggucccauauuuccaagggcauuaaguggagggcacucggaagcuucucugggcccugacuuggagcuagaccuguuggccccauuggaucauggcuacugucaugaacccucagaucgacguggaaguugaggagugccucauaaugaaaguggaaaaggacuccgaguggguaucggagcccauucuggaaagaucaggcagcacugaaugugaguccuuccguaaaugcuucaggcaguucuguuaugaggaugugacaggaccccaugaagcuuucaguaaacucugggaacucugcugucgguggcugaagccagaaaugcguuccaaggaacagauccucgagcagcugguaaucgaacaguuucucaccauucugccugagaagauucagaccugggcgcagaagcaauguccagaaagcggagaggaggcgguggcccuaguagugcauuuggagaaagagaccagaagacuucgaaagcaggugagcgaggauuuuaaagggauguggugggaaaggcaggugggcagggcuacauuucuggaagaagagcucauuauagaaauaaaugggacuuuuaaaagauccggaaaccaaauuccccaaaaagcagauuugaaauucauacuaaauggaggagagaauuuugguugaacuaugaucuugcaaauuaaacuaaaaguaugguuuguuuguucuaauccucaguauaauguuucuaccaaaacgauagagacaguauuaaauagcuaaugccucacaggguuuggugggagagggagaucucauggaucuccagagcccucccuaacccuuaccauuccagcagguguccugugaaauacucucugugccgugcuccuccgcgcucauccaguuuaacggccagaucaucauuuuucuaugucccugcuugccggucuguaguuauucucagcgcccucuuguuaaccgugugaaguccucagugucugacagguuuacagucucaccuugcacagggugugcucaggaguugauuuugugauucuucacuucacuaguguucugauuaguucucugugcaccugauauauaagaggacuuuguaguaaugaccccucaaaaaaauacacaaauaaagagcgcucuccuuuucccauauucccaaaugacugugagcccgcuuccguccguggagauccucuccccccucaguucuccugcccuuuaacgucucuguugggacugcaauuccuuuccuccgauuuucuuuguugauguugacuuuguuuugcaggucaguagcccucugccuucagagaagcaagccccaccuagaacugugugggaaguagcugacuuugagccagagcaacuggagacccagcacaggguuguuucucuggaggaagcuggaagccuccacucaggacaccaagaacagcugaaccaaaaaagggaacauaggccauuaccuaagaaugguaaggacucagaguacaccaggucagagaccguguaguuuauacuguaucccuaacacuauggcucacucaguagaggucccuucaauauccauuugacaaguaaauugaauauuugaaguaaauuuuucaucuauuucaagaaucagaauuauuuacuaccaaaauaaaaugggaucauaaagauggaaauuaugcaaacuuagauuguccagggaaaccuugaaucuuauuguuauuuuaaaaugcccauucaauguucaguuugugucuuuaguuaugcuauauguaugugugcucuugaaaaacuauuaagaaauggaaacggggcauuuuuauuccaaaacuugacucauaagaacaggcaucccagcaugauguaugagagggauaaaaggugagacucccaaacaagggacagugugcuguugugaauagguguggugcccacagacucauguguuugaaugcuuggcccauagggaguggcacuguuaggagguguggucuugcuggaggaagugugccacuguggggggcaggcuuugagguuuccuaugcuuaagcuacucucaguguggcacacagucuccucacugcccgcagaucagauauagaacucucuucuccagcaucaugucugccugcacgcugccauucuugguuccaugaugauaauggaccaaaccucugaaacucuacgccagccccaauuaaauguuuucuuuuauaagacuuucccugcucauggugucucuucacagcaguaaaauacuaagacaaccagcauucagaucugcccauaugaauacagaaagucaaauaugggggaaagagauguucuguccuucccaguccagguuccuguccaucuccugaaguguggcuucaucccaggccagaagcgaguugagggaggauccuaucugaaggcuucauucacaucgugucuuccccaagacuaugaucuugggcaagaagcaugaaaacaaggauuaauaccuagagguuaagaucuuaggcuggaagaggcaaacagaccugaguucacaacccagcucccccauuuuuacuuucuccgaaacugucaaaauuauucuuaaacuucaacucugacucaaaaaauuggaaauauucgcaauggcucuacugccauugcugaauccaacccuaaauaaaagaauguguugcaaauauuaguggauucugaauuagccagggcguuccugagcauccuagcucccuguauuguauggguuagauaguucuaaaugacuuuagcugauaaacucaauguggcagcagauggguauuuauaaugucuuauccucauuggcaucugugaugauaaaaagguuuuuuagcuuguugaagacugaggaauggagauccgaaaucugagggcuagauuucccagaaagaugacuagcucuaaaggaaugugauuccagccauaugcuuuucagagacuauguuguuuccaagaaaauuauuugggagcugguaagauggcucagcagguaaaaaugcuuccugccaagacuaaugaccugaguucagucccgaggacccacgugguggaaagagaggaccaacuccugggagcuguccuccagcauccauacacaaguaauggcgcgcgcgcacucgagcacuggagcacauacacauauucaaaauacucagauaaaauguaauuucuagccgggcaugguggcgcaugccuuuaaucccagcauucgggaggcagaggcaggcggauuucugaguucgaggccagccuggucuacaaagugaguuucaggacagccggggcuauacagagaaaccugucucggaaaaaaaaaaaguaauuuuuagaaauaagcuggguuuuguuuguuuguuuguuuguuuguuuguuguuuuuaaucucuauagaaaguagguagcucaagauucugaggucugcucacaaguaagguacacuugucagcuucccuggugaacucugagcaggagauagaccaccgggacugcuguauaaaacguucacuuuucuccuacccugagggggcuuuuuuaaauguuugcugugcccauggcuguacuguuugcuguguuggcaggacuuaaguaaguucuugguucugaaacugucaacuucugugagggaugacaaacugauaaccuguacaccaaaugggacuuguuauaguuuaccuacaaagaauuguuguuugggauuuggaggauuugcucuuuguacuuaagauuuucaauuugagauuuuacagaagucccagguuucuggugucuuacuuaggguuucuauugcugugauaaacaccauggccaaaagcgacgcagaaaggaaagaguugauuucacuuccacuuccacaucaaaggaagucaggacugaaauguugagacgggagcugauacggagaccgugaggggacucugcuuaccaacuaguccuucaugacuugcucagccuacuuuaucccaucucugccuaccuacccaggagcaacacuguccacaacuggcugggcccucucagaucagucaucaaucaagaaaauaccucacaggcuugucuacaggcuuguagucugguggagauguaggggugcauuuucucaauagaggcucccucuucccaggugacuagcuuaugccaaguuuacauaaaaacuagccagcccaucuggcuucucuuggaaaagucagaaaugaugagucuccaaguaccacagucucacacugaaacaucaucauagacugugcccuucaguucccagucccaacccucuccuuaugcacuuuaccugcuuguuccugaaccauuugacucgugagcccagcguuaggauaagguagacuugcucugaacucacugaaaagcauuucuaugugucgguuuuaauaucuuuuuauuucuuaaaaggagaaacagcugccgggugugguggcacacaccuuuaaucccagcacucaggagguagugacaguugacucccugaguuccaggucagccuggccuucagaaugaguucaggacagccagggcuacacagauccugaccccauguguucucguguucguucucucucucucucucucucucucucucucucucucucucucacacacacacacacacacacacacacacacacacacacacacacuucagaauacuauacacaauaauuguuucuucucuuuuucuagcucacucuucugucuggguuccugucccuagugaugaguggaaugcucucgaugaggaagugacaacccagguaauguacucccaggugaaguguaauuguccucccugccuuccuucuagggaguucagucagguauuuccugugcuagccuacauuguuuauacuucuuccaagagacuuuuccuucauuucuuuuguagaagagguuggacucagucgucucaguaacggagcaccuugcuggaucagcucuuucacugucucauccuaauucuuuacuguaucuuccucuugacuugauacaugauacacacguguuugcuuaacucaguucuucuuuagggcucuucucugauucauccauggcugaucacccuucagagaccccugcaggugucuugguagucacugguguuaguguuguuacaggaaccaauaagagauguccacacagagagaagcuuuuccuacaaaaaaaguguacagcaaguuccggcgcacagaggucucuaccacgaaaucaggaaggaaagugcagggagcaugguuucccuggguaagcauuauuuccuuuaaaauaauagaccagcagauuucauauauguuaauucuuacuggugauuaauaguuguaaauguuauugcuuaaagcagcaauucucaaccuguggguugaagccccuuuggcaaaccuguuaaucuccaaaaauauucucauuacaauucacaagcacaguuguggaguagcgacaaaaagaacuuuuugguugggggucaucagaacaugagaaacuguauuaaauaaaggguugcuggauuaggaagguugagaagcccuggcuuaacagauucccacggaucacccaguggagcuacauaucuguucccuuuccuuuuucaugugcucuuucuaguaagaauaucagaacaguaauuggagcaccgaacaggaguuagauaugaguaccauauuuauacuacaggaaaugcaaacucacauccaucagcugaaugccugugaagucaccaggucuuuguacagcuuguuucuauuuaaucauaaugaccucaacaccuagcauagagcugccuaacagguuuguuggauggguagaaaucuuaauaaauaaaaaguaauuuaaauucaauaaccuugguagcacauugugaauuauuuaaauagacaagugcacaggcacacgugaccacuggagugucacucuauaagccgauuaucagaggcugucuccgucugcuuuaacaggagcgauaagugugauccauucccgugggagcuuuuauucagaagucagacugguguaauauuauaggccgaggcuggggaagcagcucagucaguaacucacuugcaagcauggagacacgggcuugccauuuaaagcccacaguuuuaaaagccaggcgugguggcauguuguaaacccaagauggggaggcagaggccggcagaucccaggagcucacugcccaguguagccuacccaacagugaaacacuugaucccccaacauacaaaaagguggauaagcuggagagauugcucaguucguaaagugcuuacaugagaaccugaauucaauccucagaacccauuucagagacagagacagaaaacuugauauagugcuauguucuuaaaauccugguccugggagcagagcagagacaggugggaucgaucccuagggcucacuggcaagccagcccagccuacuggaugacuuacaagucagugagagaacuucuguaaaaauacaaaacaaaaugugccugcacauuuaggcacacaagugcaacucuacacacauacacaaaguuggacuguggcugaagaacaccugugguuacccucugauucacacauacauacaaguuauucacacauacauacaaguuauucacacauacaugcaaguuauucacacauacauacaaguuauucacacauacauacaaguuauucacacauacaugcaaguuauucacacauacauacaaguuauucacacauacauacaaguuauucgcacauacaugcaaguuauucacacauacauacaaguuauucacacauacauacaaguuauucacacauacauacaaguuauugacacauacauacaaguuauucacacacacauacaagcuauauguauguaugcacugauaccaguuuauaaccaauggauauaaaacaaguauuacaaauaccauaauacuguauguaugucuggugaguaauuucuggccaaacuuuuucaguuugggcuaggcaaugguggugugcaucuuuauugccugcacuugggaggcaaaggcaggcagaucucugaguucaaggccagccugauugacaagagagaguuccagagcagccagggcuaacuacacaaaaaaaccuugucucaaaaaaacauugaguuugggacuggcaagagcgcucauugauaauaacacuggcuucucuuccagaagauuugaguuuguuuccuagcacccacaugguggugcacaaccucauguaacuccaauuccaggagaucccagcacccucuuccagccuccaaaggcacuguacauacauuguauacauacucuuuaaaccaaacugacucacauuguuuauuugauaugccuucaucaaaguuuuuguuugaacaucuguuucuucugccaaaucuuuucagacuuacuguuuauauuauaaauaaaauuuuauguaauuaaaaugugcaauuuuauuauuuuauauacauuucauaauaaugaccacaauuaacacacccaucacucaauaucauuaacaggaaaaacacuuaaaaucuacucucagccagcaagaggucugaaguacacuauucuaagguacagacgucacuagauucccagaauguauccugcuuaaugcugaaauacauucuuuauauauguccauauugccuacuucagacccuuuggaaaccaauguucuguuccucuguacacugaggguuuuuuaaaaaagauucuacauaaagcugagguggcaugacguuugucuuucaccauccggcuuguuucacuugauauaaugcuacccagguccuaagucuuuaaaacauuaggauugccucuuuguauaauuuuuauguuccauuuuauaaauuuuuccauauuuucacauauccuguauuuucauuuuuuuuaauuuuaugugcaugaguauuuugccuaaauguaugucugugcacacaugugugccugaugcucagggaggccacaagagagcaucagauccccuggaacuguaauuauaagcaguugugagccaccauguagguuauagaaucaaacccagguccucuggaagagcaguuaguacuguuuaccacugagccacuuuuaaauauucuuuagucauccauugauaaauauuuggacauuuuuucuauaccuuagauacuguaaaugauguuccaguaaaugucagagagcuagugccuccacagugauuugguuuucuuuacaaauauaucuagaagugggagagcuggaacgcgugguaguugugguuuuuaauguuuucaagucaccucccuacuguuuucacaauggguagaugcguucccauucagcagugcaugggguucacacucucuaccuccucaccagugccucuuaucucugaugcuaaccacuauaacagaugugcgcuaauucgugguuuugauuuguuuucccuguuaaugguguugagccuguuggccauuugcacaucagauucuuugcccauuuuuaucagauuuuuuuagaauaauuguaugaucccuuguacauuuuuaauuuuagcuucuuaaaauauauaugguuuuaaguauuuuugccuggacucuaggcuauuacuuugcuuugauuauuuuccuuguugugcuuaagcuuuuauugccucuacuuugguuguuauaucaaaggaaauaaccauuuccaagacuagugucaauuccccuuucccugcacuuucuucuagggacuuuaugguuucaggacccacauuuaggucucacauauaugcaugcauggggguggugcagauggaagccggcagucagugucuggucuuccucaauucucuuccaucacauuuucugagacauuaucucucacugaaccuggagauccuuuugcugcaauuacaagcacuugucaccaugccugccuuucauggauguuggggaucaaacucaaguccuugugcuuauauggcaagcacuuugccaacugagcauccuccccagccccauaugucgguauuuaaauuacuucaagcuaaucuuugugagugguauaagcugauagucaguuucacucuucugcacauagagacucacuuuucccagcgcuguucauugaauauacucuccucuucccuugucaaagauuaguugaccauauaugaaugguuuuauuucagauuacuaugucuauauuaugucuauucuauuuucuuuguucuaugccaauaccauucugugugauuaauacaacuuaauaaaaauucuuuacuuuuuuaauagcuccagaggguggguguguguguguguguguguguguguguguguguguguguguguguguguguacacugagacaaggaaggauuuggggcauguaaauagaaguaaaugaaauaaauacugaguuagcugugguggcucaggacuugcauccuaacacuuggaaacugaagcagacagauuguuagaaguuugaagccaucauagugaguuccaggcuagccagggcuacaguaugauacaguaucauccaaaacaaagggucaaaaguaaugaaacauuucuugcgcuugagggcacuucugaaagaacuggauagauggaaacaguacauauaugggagaagaugaugccauuucuagauuucugugccaaagaagucauuuaaaugacuacagugugcaugguccuggcugaggaaggcuuugguguaaacaaauaauccaggagaacauguuuaaacaggaggcuagggugugucgcaaugacauuguacccacugugaaauauauuucucuuacuguaggagacucugugucugcaccuaacaaaauagcccaguuggaacaaaaaaaggaaccauggagcguaggucuucauuccucaaacaagaggaauaguguccugcaaagcaacuacaucaaagagaagucgguccaugcuguucagaucccagcuaggaaugcagggaaaguguggcgagagcagcaacagugggguuuggaagaugaaaagauugcaggugugcacuggagcuaugaagaaaccaagacuuuucuugcaauucucaaggaaucucgcuuuuaugaaacacuccaggcuuguccccgaaauagccagguauauggugcuguggcugaaugguugcgagaauguggcuuccuccgaacaccagagcagugccggaccaaguucaaaagucuucagaagaguuaucgaaaagugagaaauggccacaugcuagaacccugugccuucuuugaggacauggaugccuuguuaaacccugcagcccacacuucaucuacugagaggccaaagguugugaucucucucccacuaaagagaacugcuauuagugcuaaagagcaggucaguuugguggaggaggaggaaggugcugaagacuccgauggugaugaagugggcauugaguuuauacgcaagucugaaauccgugcugccccugucuuauuucaaaaccuaagugguaagaauuguauuguucucccaaccccacccacaggcuugguaugaagauagaaguguacucuuggggggaaagcauuacauuagacuaauccuggaaagggcucucauacuccaggcugcuuucaaaaugaugccccaaaaacugaaagggcacuagggcgauugcugcuguccccaguguagccugaguacaacucucaggagccuucaggcucuuuuucagguuagagugaagcaugguuuuuaaacauuugggagucgggguagagagaugacucaguuguuaagagcccuggcugcucuuacagaagauccaagcucaguucccagcaucaacaugggaguucauaaccaucugucacuccaguuccagugauuccaacaccuucuggccucuggguaccaggcacacauacuauacauacauagcugcaggcuuucauauacacauauauaauaaaucauauucauuauaguccuucauauagaagggaaguaaguggagcauaagaguuccaagugucgacuauuauuuaaggauuacuagaaucuguuauauuauaauaagugaaggaggcauuauuaguccauacaguauagccaauaacaaacaguagaaaggaguagagaaaaugaaacuuuuuucugcccaauuuaaaauacaagaaaggagaguaaacagaacaaagaacagucacuuaaaaacaaaaguaagagccaugccugguggcauacaaccguaaagccaaaaauugggaaguagaaacaucaagaguuugaagguaacauggacuaauagcagaaccccuucucuaaauacacaaauacagaaacuagaugucuuaguuaacuuuucuauuacacugaagagauaccaugaccaagacaacuuacagaaaguguguugggguucacaguuccaaaggguuagaaucuauggccaacauggcaguggauaagcaggcaugaagcuggagcaguagcugagagcuuauauccuuaucagcaaguagaaggcaaaaggagggaggaagggaagacaggggagagagggaagauggaggggggaggggaauugugggcuucugaaaccucagaaccuuccccagugaaauaccuucuccaacaaagccacacccuucccaaacaguuccaccaaccaaggaccaaguacuuaaauaugagagccuaugggggccauuuucauucaauccacuacacccuacuccuuggccccccacaggcuuguuguaaaauaauaaaauucauuuaguccaacuuuaaaagucaccauaaucuuucagucucaagaguguuuaaaaguucauagucucuucugagagucaaugcaguuucuuaguuguaacuaccuguaaaauaaaaaaagaaaaaagaaaauuacauacuuccaacauaaaauaacacaucuuuaaaggaguaaauggggcauagugaggaaauacuggaccaaaagaagaccaaaacccagcagggcaaacuccaaauccuguaguucugugucugaucucagaagccuuugauggcucgucucuuccagcauugcuaacuguuacacacuucucucaagcugauuucacuuccuacaugcagcucuccuuggcaaacaucccaaggcuugggugccuccaacauccuagcgucuccaacacauucugggcuucacuuucacagccucacauuggccuuucuggacaauacaagaacuacccugccgcaugccuguccccaguggcuuugcuuaacuggcgaggaaguucccacaaccccuuuacuccuauauucuuuaugacgaaagccagaauccuguugcugaaguugccaaguacugcaagcuuggagugagugaagucuggcccucuccuagauucgcauuuacauaagcuccgauuugucgcuuucguuuguuuuagaaacagaagacuccucggcauuuccuuuuuauaaguuggaaacuuagcugaaugggaugcuauccugaggacacgacucauuucauuucacaucagacaccggucuuuaaaguucucaucucuuugaacacaagauuuuucuucagcauucaauuuccugguacuuuuuuuucuccucaaauaguacaacuuauauuucuuucugccugcuuguccuuuuucaucauagucccacguuaaaaguaaucacuaauaagcacaugauacauucagcauuagucuguccugaaaucuccucugcuagcaaauaguccaaaacuugaaguuagccucaggcagauucuuaggacaaggucaaaaagcagacacauuccuuaccaaaauaucaccagaaugcuuucuacccaacggucucuagcuaauaauuguuccccugggaaaccucuuaagcuaagccuccacaguaugcauagcucucaccacuguuguucuccauguuccuccucaauugcccauuaagccgcacugagagcauucaaucacuucccuauccgaagaguuccacacucccccaaagaaccaucguggucaggccugucacaucagucccuauuucugguaccaacuuuugucuuaauaccaccagcugggaaacaggccuucaaugugugagccuguagggaccaaucucauucaaaccaccacacgagaguaagauaguagagauaaaucuaaacauaucacuaauuacaaauuuacuaaaccaagauuaacauacuuuuauaaaaaaaagacugcauauuccucaucauaggagaugcaccccagauaaaagacaggcauuaaaaugcagagagacuaggccuggugcugcaaaccuguaaacccagcccucgggaccuagcaagaggacugugagauugagacaagcuugacugcacagcaagaucuuaccaaaaaauagaauagauauucuaugcaaaucuguugaauauuugggaaccaagacauaccgaauuaaacagccaauuaauaacuaugugacuguagaagcaucauguaacuacauugggcuuaauuuucucaugugaaauauaugauuaagaauucacaggauuagcugggcaaugguggcacaugccuuuaauccugaggcagaggcugguggagcuaugugaguucaaagccagccugguguacagcaugaacuccaggacagagcuacacagagaaacccugucucaaaaauaauauauauauaucaaacccauaguuacuuggacauagcucucagucucaaggaaaacugguaaaaauaaguaauaagaauuuucagucuauucuuuugggguuguaguccauuugucugaacuacuugggaaagacacuuauagguagcuaaguccuuuaguuaguuuccauagcaguggcaguaugggagacuacauggacucuuccaagucaacccuuuuggaauuggaauuuuggcuaauuauuuaaaaauugguguuugugcagguugaaucuuuguacccagaagcagaacaucuaauuuuuucaaguuauuuuaauguguuuaaauaaauaacuguagauuuuuaacauagauuuuucugcuuuuuacaaagcuuguuucuggauauuccuuauuuccuguugcuaucaugaauagaacuuuuacucauaauuuuuuuuauccuugagaaguuuguaaauguauacaaugaaauauuaucauauacacucaccaauuaccuccaacuccccgaaacaaguccccaucccaacuucauguguuuuuuaucuauuuguuuguuuacuaacccacuaaauacaauuagugcugcccauauguguauggauaugggaccauccccugaagcauagguaaucuaccaguaggaacuuccucaaaaaagaacaauucucucucuuccaaaaacugucaagugguagggacuugagaacacgcacacacacaugcucucacacacaccuaugcuacaauuuugacugacuguguaggucuucuucuacaaauagccaucccugcugugaguucaugagugcaguagccugucauguccagaagacaguguuccacagugcuauucccugaauaagacuuguauucuauuacacuauagaauguguguaauagaaaaguuccagacugcuuuuuuuauauuuuuaaacuuuauccuugaauggcaggugugcauuggggcuaugaagaaaccaagacuuuucuugauauccuucaagagacccgauuuuaugaagcacuucaagccugccaucggaagagcaaauuguauggagucguggcugaacaacuucgagaauguggcuuucuccggacaccagagcaaugccgaaccaaguucaaaagccuucagaagaguuaccgaaaagugaagaauggccauguacuggaguccugugcauuuuacaaggagauggaugcccugguuaacugccguccauccucccuuuccaccaacaccucagaagaagucccaucccucucaaggcaggaaaggggacauauugagguugaaccccgagagccuacaaccugggaaccuguggagaccccacaggaagcaguguuagaagauucuggcagugagagacugagugaggaggaaaugauagaagagccagaacuugaaggaccuucaggccugcugcaaagcccagcugguaagggucacggggcuucuggucaaggggaggagaaagugggacugcuugaaaaucaguacaccuggcccacagcucauguacauuuauucauucagaagauauuugagugcuguuugcuguuagaggaagagggaaauggaacuaaguaaaauggucccuguucucaugguacuucccugucagguaccaugcuugaggcucagcugcucacauucuguugguucagacucugggacuuuagccuugguuucugucuuggugggucagacaguguuuugcuucuggaaaaacuauagagaagaaugugagauucuacaucgaaaaaauacuugaaggaggaggguggucaguaagguccaaugagaaccaucuggcugcuguguguguggugugugagaaaaaggaaggcagggaccaggugggaggcuuuacucugcuccugggcuucagcagcuugcccgccacuguccacugaguugcuuguuggcagcuaaacuacuagcuuaagcauagacauaccuaaaacccacagguguccuguaaagaccauuuuaaugccuccucacucagcauuuaugcccagguagaagacauggcuugcugaguagaaagucaccucuaccugccagcuuccacugccauagccccuguucuaguccuucuguccuucucuguuucuugccuaaacuguaaaagucugaaaaacaaauuuucucacccguacuuuuuuuuuagagaaagaaagagagagagaggccagaaacuguugcucaggcuggccuugaacucgugauccuccugcuaucucacuugagcgcugggauugcaggcaugugccauccugcccagcuucucaccuggguuuuguuaagcggugcuuacucuaugcucauccuauccuucaaggccuguaugcuacuguuuucuuucucuaggcuacuuggaaauaaaacuccuugcuguguucuacaugcaccuuaaguucucucauaucuaagccauggcucaugaugccugccaaauuccacaccuugaacaaauuuggcucuaugcaucugugggcauuuugccuucauguaugucuggguaaggugucuaugucuggggcccacggaggcuagaagaggauuuuaguucccuggaacuggaguuacagauaguugaaagccauaaacccaaguacucugaaaaagcaacccauucuuuaacuagugagccaucuuucugaucccagcuuccuuuuaauaacuauaaaaagagucccggugaauauguuuagguuaccuccagaacguaaucaaauuaucaguuauugucagaucaacuuaauaggcuaugacuuccucugaaucccagaacaauguuggauccaaugcgaaaaccucuuuuccugcauccucaccaacaugugcugucaccugaauuuuuuaucuuagccauucugauugguguaagguggaaucucagggucauuuugauuuucauuucccugaucacuaagaacuuugaacauuacuuuaagugcuucucagccauucaagauucgucugcugugaauucucuguuuaguucuacaccccauuuuuugauuggguuguuuggguuuuuucgagguuaacuucucgaguucuuuauauauuuuggauauuagcccuuuaucagaugugggguuagugaaggcuuuuucccaaucuaaagguugccgauuugcccuauugacuguguccauugcuguacagaagcuuuucaguuucaugaggucccauuuaucaauuuuugaucuuagagccugagccauuggaguucugauuaggaaaucgccucccccaugccaaugaguuugaggcucuuucccacuuucucuucaauuagauucagugugucuaguuuauguugagguccuugauccacuuggacuugagcuuugugcaaggugaagaauaugggucuauuuucauuuuucuguguacagacugcuaguuagaccagcaccacuuauugaagaugcuuucuuuuuuccacuguauauuuuugguuuuuugucaagaucaagugucuguaagugugugguuuuuauuucugggucuucaguucuguuccauugauuaaccugucugucucuguaccaauaccaugcaguuuuuaucacuauuguuccauaguguagcuugaggucagggauggugauucccccagaagaucuuuuauuguuaagaauuguuuucucuauucuggauuauuuguuuuuccagaugaauuugaaacuucauuaaucauaaauagaucauuguuaaagguaaguaaguaguucauggaaguuccuuuuuuuucaauuuuuuauuagauauuuucuucauuuacacuucaaaugcuaaccccaaaguucccuauacccucccccugcccugcuccccuaccuacccacucccacuucuuggcccuggcauuccccuguacuggagcauauaaaauaugcaagacaaaggggccucucuucccauugauggccaacuaggccaucuucugcuacauaugcagcuagaaacacaagcucuggggguagugguuaguucauauuguuguuccaccuauaggguuucagaucccuucagcuccuuggguacuuucucuagcuucuccauugaguucccaguguuccauccaauagaugacuaugagcauccacuucuguauuugccaggcacugguauagccucacaagagacagcuauaucagaguccagucagcaaagucuuucuggcauaugcaauagugucuggguuuggugguuguauaugggauggguccccgaguggggcagucucuggauggucuuuccuuccaucuuagcuccgaacuuugucucuguaacuccuuccacagguauuuuguuccccauucuaagaaggagugaaguaaccacacuuuggucuuccuucuugaguuucauguguuuugcaaauuguaucuuggauagucuaaguuucugggcuaauaaccacuuaucagugagugcauaccauguguguucuuuugugauuggguuaccucacucaggaugauauccuccagaugcauccauuugccuaagaauuucacaaauucauuguuuuuaauagcugaguaguacuccauuguguaaauauaccacauuuucuguauccauuccucuguugagggacaucuggguucuuuccagcuucuggcuauuauaaauaaggcugcuaugaacauaguggagcaaguguccuuauuacaaguuggaacaucuucuggguauaugcccaggagaggaauugcuggaucuuccgguaguacugaguucaauuuucugaggaaccaccagacugauuuccagaguggcuguaccaacuugcaaucccaccaacaacggagaagugucccucucucuccacauccucgccagcaucuauggaaguucuuuauacauauuauacuguuuauucuucucuguguaugaauuucacauaauuaaaaauugauaucaaaaacagaauuaacaagugaccagaauguugccagaaccauacuaugucauuccaaaguuucuuccccauggggcauaugucauucauacuucccauaaaacuccacagagaagcugaauccaagaugcaccuuacagugaaugcgguguaaugaaagaguaaaaaauuccagcuuuugaaacaguaaaacaguauuuguauuauugugguccaugaggugacaaaaaaaaaaaaaaaagcuacaagaugguaugagaaaaacaguacucuaaaguagaaccugacuagcuauugaacaguugagaaguaugaggaauuuagaauugccuauuaguugucuauuaaaugagguauaguacaauauuuagaauaauguaaagaauaaaagcagaaugagcuacuucaaggagauaaaccuaguuauuguuaaguuaaucaggauacaaguagagacuaguaucuugauauacaauucaguucaaaaaacacaauuugaggccuuuuuauagaaccgaaagaggguaaagcaugguggcucagucaagucacaguguguggccgugaacauuagaggaucauaugcauugugggccugguuaauuguuuuguuaauauuggaauuuugugaaauucuauugucuuuuccuuuuccagguuuugaaauuggaacuauuauuaaggaagacccaacacagguaauguuuaaggacacagagccccauaggguauuaauggaaaaaccuaaaagacuuguuucccagaauacuaaccccaguaaauacuguaaaagggaguacuucucaggaagacacugugaaaaccuucaaggaguuagacagggaaagcugaugucucaaccuagagauacagggaaggcuguggugcaucagaggccuuguguggggaggagaccauauagacuucucaaauauggggaaaacuuuggaaggagugcccgucuugugugcaggaugacccaccagaaggagaauccuuuuaaguguggugucugugggaagugcuuugguaggagcaggagccuuaucagacaccaaagaauccacacuggggaaaagccuuucaaauguccugacugugggaaaagcuuuaaugacuccucaaauuuuggagcccaccagagaguccauacuggagagaagccguacagaugcagggagugugggaaaugcuucagccagagcucaagucuuaucauccaucagagaacccacacuggugagaagcccuaucagugugaagagugugggaaaagcuucaccaacaguucucacuucagugcccaccgcagaauccauacugaagagaaucccuacaaauguggggacugugagaagagcuucaauaacugcgcaagguuccgagaacaccagcgaauccacaauggagagaagcccuacacaugugcccaguguggcaaacauuucaauaagagcucuuuccucacuaaacaccgggaaguccacaugagagaaaagcugcugccauacucccccucuguguacuccccagagaaccuacugaaaggcaagagugccgagcucaggaagaccuuuugacagugagcuugccuuuccacucacccuguuagccaucugauccuaguucugcucuuggaagcagucuucuuagcuauaaauuacaguucccaagacaggccugagaaucgaaguaaacuaaaccucucaucuggucucaccucauagucugacaugcucagucugccucucuccugugagucuuggaaguuucaauaaaugagauaauaagauuuuuuaaauucaaaauaaaauucucacuagaauguugaggcuaaugcuauuucccagcaaauuucaaaacuuuugcacauggauuaauccauauauuuucaaauauaugaaugguguaaaguuuuuaugguguuaucuaucacccuuaugagaccuuggcagcaacuugacaauggauuuucauaucuggguagaacuuuuaggaguuugauaagaacuguaucagauccaucuugguuuugaggguacaaaaggagaguggagguuuauagcuuccuucagaagucuguaucaagaaguugacccaaauagcuaaggucuaauuuccuguguuguuacagaaaucauguugcuaauacuuuguccuccaccaagauaagcaaaugcucacccuuuaucucccuuuuuguuccucaagacuuaacuccaguggcugcugcuucuccagugacacaugauccuuguauuauuuaucacaagucuauacuuaccucuuaauuguucugggugcucuugucugacucuucugggcugccugacccacucagaugggagaggaugcacaguagugcugucucauuaagagacaaucagauuccaacucuacuucuaccccaucauuucucugacucuuaacuuagagcaagaccuaugguauguagguauauuucaaauugccuagcucuguauuucaauguaauauaauaguguuucuaaaaguuuaaggcuauaaggaagaagauaaggccugugaaguauuuaacugacucuuuaggccuguuuuagauggaagagcuaccucaguccagacuacacuuccaggguugacugcuacacuacuagucucugguucugaagcuuaguuugugagaucauaaaccugacuguaaaguccuaaauaauaacaccacucuauaguucacucagugaaagugaaauuacuuacaaacuuccacucuaccaccuuauuuuccccguuguccuauucugggaagaaaaaaaaaaacuuuaaccaaguauaaucugucagaaaguuucugguggagaaauaauuaacuuguauagaauuacagaugaaauucagaaguuugaucuucccaaaacaguuacuugaaguagaggccugugguguucauaccuuuaguacauagguagccccguguagcuuugcuuuggggagggagaagucccaauagggaaggagagccauagucggguguuucuagguucuccugucagaugcucucauuugaaaacaucuagagaugauauuuuuuaugugaauauauuugaaucuuuugagaccuauucagcaaaguaucaaagaggguagacauuguauaaagaaaagugcuuuauggugccaacauaggauagccuguuggaaggcaagugacucagguaaaugcugauaacuguuugugauguguguuuguuggaaauguuaucauuguugacaacuauaacaguagcuaauuuccuguguauugucugaaauagagacuccuaaugguacaugcagcgucauguugguauugugccuagagcaguaagauugugugaugccaguggacuugugcuuauaauuacguagaugcucuggaauuccagcucuagaaaagaugcacauuagucuaaauugccacuuaguaacauguacacaggauugauacuuauauggaagcaugauucagaacuguuauguauaaggccaugguuuguuuggguuuuuucuuaauuuuauuuaaucuuuuuuuuacacucgaaauuuuauccccuuccugguccacccacugacuguuccacaucccauaccuccucaccccacccccaucuccacaaggauguccccaccccacuccuacccccaaccccaccagaccuccccacucccuaggacaucaagucucuugagaguuaggugcaucuucuaugacugaacucagacccaguacuccucuguugaauauguguugggggccucauaucagcugguguaugcugccugguuggugauccagugucugagagauaucagggguccagguuaguugagaccgaugguccuucuacagggucaccuuccuccucagcuucugccagcuuuuc

SEQ ID NO: 4079 - RNA, 1514 nt, Mus musculus
caugaaagaggaauacaacgugauggugcugggcaccggccugacagaauguauccugucggggauaaugucaauaaauggaaagaagguucuuuauaugggucagaauucauacuauggaggagaaagugcaucuauaacaccgcuggaagauuuauauaaaagauguaaauuaccagaacaacggccagcaucaauggggagaggaagagacuggaauguuaaccuaauucccaaguuccuuauggccaauggucaguuggugaagaugcugcuuuucacagaggucacucguuauauggacuucagagugauugaaggaagcuuugucuacaagggaggaaaaaucuacaagguuccuuccacugaagcagaagcccuggcguguagcuuaaugggacuguuggagaaacgcugcuucgggaaguuccugguuuauguugucaacuuugaugaaaaagauccuagaacuuucgaagguguugauccuaagaagaccuccaugagagauguguauaagaaguuugauuugggccaagauguuauagacuuuacuggccauucucuugcgcuguacagaacagguggcuacuuagaucagccguguugugaaaccauuaacagaauuaaacguugcagcgagucuuuggcaagauaugguaaaagcccauaccucuauccgcuuaauggucuuggagaauugcugcaaggauuugcaagguuaagugcgauauauggagguaccuacauguugaauaaaccaguugaagaaaucauugugcaaaauggaaaagugguuaguguaaaaucugaaggagagauugcucgcuguaaauagcucaucugugaucccagcuauguaaaagaucggguugaaaaagugggccagguagucagagugaucuguauccuuagccacccuaucaagaacaccaaugaugcuaaauccugccagaucgucauuccacagaagcaagucaaccgcaagucagauaucuaugucuucaugaucuccuuugcacauaaugugacagcaaagggcaaguauauugccauuguaaguacaaccuuggagaccaaggaaccagagaaagaaaucagacuggcuuuggagcucuuggaaccaauugaacaggaauuugucagcaucagugaccucuuugugccuaaagauuuggggacagauagaucuucauuucccaugccuaugaugcuaccucacacuuugagacaaccugugaugacauuaaagauaucuacaagaggaugacaggaucugaguuugacuuugaagaaaugaagcacaagaagaaugacauuuauggagaagacuaacagcaguacagauuauguaauaacuaggacaaacuuaaaauuuagcaaauaauguauauuguaugaaaucaauauuguaagcccugcuuuuaugaucgaaauggagauagaagagugcuauaccagugaaugcuccuucacuuuucuaauaucacguauuaacuuguuuucguggaauu

SEQ ID NO: 4080 - RNA, 27357 nt, Mus musculus
cgugggguggggcaugcaaauaagccagcgaucaggcaaaguccggaggacugcgggugaaaaugagcugggugaggggcggggcauguaaaugaccgugcacgggguggggcgucgcauguaaauaagggacaccaggcggcguaggaagcggggcgagguccuucucgcaggaaagccccgcgcggcgcguggagccugaacucgcagguaggaacgggcgguggggaagccuggggaccgggcagugguggcuacagaaccgaucuggccugaaaccagagcccgcggaaccuggggugggcauggggcugcugggcuccucgcucagccagggucggcugccuucgggcgcgggucaagcaaguagacaacucacgcgcuagaacucagggagccucggcgguccgguccccacaaagacguccuagggaucuuuguguagaagcccggacuaccaggcuccucccagguuccgguucaguaacccagaaaccugacuauuguggcaaacuggacguuguauaagccagcuagucugugauuccgucugcccccaagccagcacuccuggguccugcccuucuccagcccuuugggaggugugaggcucaauguggccuuccuucuacagguggucuuuugagagucugggggcauuugcugggacauuugucccauccuaaagucuuauggggaaacugagacuugagaauauguuuggccagaagagaguaaugggauuccacaguccugguaaggccucuaggaaucagccagggaagucaugaccgcuuaaggggacauugaggcagagaggggaggugaccacuguguguguguuccccagcucgucugugcucugcuugcuguuuuaggcugugcucucugacugagggauagacacacaagacagggaguguauugggcaagcagggcaccucuuccuugggcaguacagcuccugagucaguuuggggugugggagaacacuuuggcaggucgagaaucagagacaagagaaggcaugcugaacuguggguacagcaugggcaaaaacuagaaggugggacggcuccgugugccaccucgcugacauaagaggggcuagauauguggaaagggagacagcgcugcaggagccccugaauuccuugcuuugaggcucagggaagucguaggaaggauucguaguccuggcccugcuccuggaucuucaggguaaggauggggaaacccaagugagucgcccaaaugaucacacacugguaauugggcaagguugugaccaucugaggguuugcaguauuugggcugugcuggggucuuaauacagugccaucccagacuggggagggccagguggccagggagacugucccugaggcaggcacaaugacugccacaaucggggaugaaagaagagaaugcuugcauucacccacgccacacccuacuuuucugccuuugggggcuggggcugggaccuagcugggguacacacucacacuuggcauguguacaaaggagcuugccacgguccccauggcacaggaggcccacauggcaagugaggcguggagguugaaagccagagcuccugaccaagcaaaggcuugauuuguuccuuguguguuccuucaucagagacugacagaggcaggggcaccaccgugagugugccugccgugacaggacacuguuggguauuccucggguugagccucugagaccagccuggauggagaccagccuagcuguguauggcuggauucccagcuucaugaggcuugccugggugggcacagacucacagugacccagauucagacacccagcauggaucagaguccguuguuccaguucucagaaccagaggcagggaauggggcuagaacugaagaugggaggcaggggggcagaucugcguucggaucuguuuggaucucaagaaaaaucacuccacauccccacaccucccguuugucagagguaucugggaugaaaauguucaugaaauggcuuuucuaaaccauugcucauggacaggcaaggcaguugauugucuccucccacuuaggauggcauugcuuugccaagcugccccuagcgcuucuuggcucugagggacgaggagugccaggugcuguaucaggccaaagaugagguguuugacaaaguccuuguaguucagacucccugagaggagaagacucucacaccagauucacagccaugcuccgcugucccgaagaguagacaggggucaugcuguagaccacccuugcugcugacugaagggugaugccaacccagaugggucaugaguagcaucccguacagugagguaagauagugugucuaaccuucuggggucucacaggcacuacuggucagcgacaggaccaggcaggggaggaacaaaggucagcaggagccucuuggggugaugacacagggcuccccccgcccagccugcguucagucucuugagcacagucuuucuaagaagcgcugaugucaagcaguucuaagugcugccaccagugacucacacugccguuggggcccacugccucuuggagauggcgaagcuuaaaguugggggcccagcugagggacuucaguuucaugagguucgugggaagguggggggcucugggacugaggcccuccaguccccagaaguaguuauagaaugaagggcaauaaucauguguguugggcgccaaccaauaggccggggucaaaacccugagugacacagcaguaaagagcccccccucccccucaggaaguccugaggaggaggugacuccaaggacuuagccuuggaguugagaccccaaguagagagagcagauacaaaggcucugggcagagaacagguuccuuguguuuuacccacaucaaggaaacagugggauugguugggacugagggaccagggagggacaggaguagaagucaggggugggggugggggcugacaccuguauuaucuuaguuuguuuaagcccugggaggcaagggcuguaagacacucaaguuuucuggaugaagugacauagaaguucagucacuuauuuagggucacaugucaaaccucccaucuucaccacugguuauaaagaaugaaauucggucacaaggugagcuaccacaaggucaccucuuuacuugacugugcucugcccaguaaucuugggaaaacugccaggacuccaugcaaucaguuugcagguuauuguuaggugaaccccuuccuugcaguuucagagaguaaggaaggucugaagggaggggaggaaggucacguacauaagggcccaagcguugguuggguugagcuccuguccccaaggaagaaaacagacuaguguagagaccagccacgugacacucugacaccacucacccacacgcuucauuucugcccaagcuccccgacugaagaggagaguuuaaaagcaccagagugucuugguuggauccgggaagcauuguucacagguccauuuuggagaacuugggcugccugagguuuccuggaguggccagaggggugucugccuuuuuaaaagaggaagugaggccuugggaggaggagagcaagggccacggcucucaaccacagagccccagucucuugcccaauugccucugggaaaacaagguccuacugugugcucacucuggggaugaucucugagacuggcuuuccagggaccucaagcuccuggcuuuaguucagcccccugggagguaccgacugucccuccacucuaguccucgaguucaggcuguucugcuacagucauucuaggcgcucccucuaccuuuggcggcuucugaguucagucugucuucagacuugacuugauuugggguccuguuagaaccgagggagacuuucgccuccuuguaucauucuggagugcaucguaucucaugccguucguagucguaguuugugagagcagugguugagcugaagccugccgucucucucuucagugugucuucccaucugaaaugucuagguugagguuacaguuguuuucagucguucuuguuuuccaguguacuuuuggcuaacuaagucugagcuggccaucgaucugucacugccagagaugugcucauuucuugugucugcugcaggagcuuuuggaaguggugugugguuuugaaggguuuugagguggguggaauuuucuguuaucucuguugcuggauucuaacucuggcuguucaggcuguugugguaggcacguguggcuucugucucagugguagaaaauuuauugcccuuucaaaaagaguuuaacaauugguuugguuuggucuuccuggauguuuguucugauguauuugaaggauguguguguguguaugcaaacaugcaugugcaaauccaccuuguaugcacagucaggcuuaucccccagaguuuagucucucuaccuggccugacuuggggauccucugucucugcuuuccugguguugggauuauaggaggguuacuccauccacccagccuucacauggguccuggggcccaaacuuuaguccucauguuugcaucucaagcacuuuaacuaccgagcuaucucaagcaccaaugaaauaugcaguugaaguucaccacauauaccuguaauccuagaacuugguaggcugaggcaggaggggccugaguucaaggccaauguggaugacguagcaaauaagccuguguuuuuaaaacguguguuuucuauugagagcgaagcccuagaaaacucagcuguuggugugagcccucuaacucaccagcugcuuucuguuugugugggcucugccccacccccacacagacaccccgacucaacgcucuccuuuggugucucugggucuuguccuagauuuugaagccgaguagugagacgcacagccagcaggcacaacagaccuuggcugucaccuccccucccucuaugugaauccgccugaguuccucccugucacacuugaacugcccuauucucugccagucacacuugcuuuuccccuggugacuucgugucaguuugcuuccagcagacuagcacugcauucugcucaggaaccaggauucugagcauguugcuuugcuggucauacagugggcuacggcuugcccugccugccugugguagggauguagcucugugguagagcacuuaucuccagugugugcuuaugggccuggguugggucccuagcaugacaggaaaguaaaugcgauacugaagaagucaggcauugcaggcaucauagaugugucccuccucagguguaagcuccuuggcugguauugcaggcagugaggcucacacaggccaaggcccgauagugggaaagcaccuggccgggaugaauguuaugagauagcauaugacuccagucuggcugccuccuccuguguggauaugagacauggacccugagggaccuuccguggagaauuagcacagaacuagcaaagcucaucgagugggagggaaagggcuggugaaacuguggaagguagacugaugugggaguggacucgcccagggcgguggagcagcaguggugaggaggucugagcuggggaaggagagugggaagugaaggagacaguguaggugacccagcgagccggucugcccaagguguacguggggaccugauaggggaauauaggcugacaaggacagaauauaggcuccucaucugcccagcguggaagaugguagugagggcuguagacauucuagaaucuucucuggcuccuugaugagcaggugaggaagcaucuccaacccaccucccaucccaucaccaugguacccaguauugggccgugguaguagucauaggaacaaagaggauggacuuuccccgguggggccaguucuggaguggggacccccuugugccguucuuuuccucuuucuggggucuccuagcaucucaggucugcuccuucccacuggauaccagcuaaugauggcagccacauggggaccacaagcuuaaucuaauuauuuauuaguuauuucuuuauugucgggcauaaagucaggcacaggcuaggcaagguuguuuacagauggagagagcaggcaaucucuuaggucagccugggguucucaggcaugguggggugacuguggaguguaagaggccuguguaaaugcuugagggaccuaggcaacacuaaagggacuuagggaccccacaggccaagcaccuugcucugugggcuuuguaggcugacccuggagaaucauguguuauucuucacuuugcccauuucuaugagauaacucuaaccaugggguuuaggcuggccuugaacuccugucucaggcuggccucguggcuagcuucagggcauccccaccccaacagccuuuuugucagcucccugcaaacaaaacccuggcuaguaaugcagccugcaccuccauagcaggccaccccaucuccccaggacaugguccugacugcucacccugagauucaugccccaucccaggcugugugccguggaauuggagaucccgugcuucuaagcccauguuucacagugggaaggaagcuugcgccccugagacuuauuccuguugucauggcaacuauccuuguguauccuuguggguuuuuuuguuuguuuguuuguuuuuuguuuuuuuuuaucuuagacuuuucugaguggauagaagcaagccuuucucacuacucugugaacccugucccagaccauggucaguuuccuuguuuucuuggaacugcccacugaaacaaggaaaucuguucccacuucccagagaaggaaauugcauucugagaggaggaccucagccugcaggucuugggcugucgagguggagcugcacuuuuucugagagucgugaccuauaucuuagguacucuggggucccugcccacuugggaggcccucacugccaaggcucacaacaauacagggucgagacagcaggaagaauguagacgagugccccuugcccucacuacauuugucuguagcuggcacccaguguugacugcggagggugucagggaggggcagaaagucccagucaccacuagacaaguuuccuguugaaggcuaugaagacaauggaagagucugaaccuugguucaaccacuccuugaaccucucugccaggcaucagaccaagaauuacacaauccaaggccuggguucagaucucagccacagcagucaccaacuuacugugcauccuuagucagguucagaaccucucugggccagguugcuccaucucuaaaguggggcugauacaccuauauugacaaucuucuccauuggugucagaguucaggggggucccuaagagggagggaagcuguccccaccucucgagaggugggagaacuggguacgugcagaagcgauggugcuggcuucugcagaucucuggcaggagucugguggaguccaguccacacuagauaguauuuaaucagugcucaggagccuugcauccuguuucuggaacaguaaguaauuaccacagcgaugcuugaucacagcuggcuggccucugcccaaagccuugcuguaggccagagacagaaaguucuaggagaggauggggcaucaugcaucaacgugucuccauggaaacccuucauucccacuccagauguccagacagggugauacagcggugaugcaguggucguccuggcugcugugggcugccgugcaacagggccaguguggcacagagguaccaucggaguucacgaggaaaagggcucugcagggauaaucagccagaguaggugcugagaggagcuggaccuagaugcucucuugggcuuccagaauuuuccauaggcugggcuucagggaucccauggaacuaccugaaggccucccugagggcacugccgccuuguguguucucaagugucaaguaacacuugcauuugguaacuuugucuccacaaugguuuuccuuuucaggggcuuggagcccuggcccacaaagggagcccaggauaccccugucccuucugaagaggcucuaggcaucacacagccuccugggcuuuagccucucucucaagcaagcucaacugucuccaagccacuagaacaucgccccuggggccuuggaauaguguccacaguucaugccauuccuguggcucuucaguggcaaggugccugaggacacucaucucugcaccagacaucaggucugcagagcccugcucuuucuccaguaccaacagggccugcuucuuccacuucuuuagaguccucaguggcucccuauugcccccagacagccccagucucuccagacugguagauggugcugccaccuggacuugccaaccucucuguuauugccaaccacacccgcaucucagcccagccaagcacucagcugcagacaggaagcaugccaggcccucccuacugccuagugggucagugcccuucccuccuggccuccuugagaguuuucaggcugcaucacgggcguggaauugcgcugccuucacagagagcugacuuggcucacagcaaucugccugcuucugcuucugaggcuggggccgaagcccugugccaccacagccggccuuuguguuagcgauucccgauggggagggccucaauccuuugucccccauucucucuuuacucuagugugagcuuggagccuuuugcuggccgugugcaguggccugcuaccuggccugacauucaucccuggcuccuagauccuacacagcaucagccggcuauagcaucauccccaaaaucucauguugacuucaaacucuccaguaucuucuugucucccucgggcacuuguuaaaagaaucaaggcuuguagccagcugguggugcgugccuguagcucaucaagaguaagacagaggaucccaauuuuaagccuugccuggguuacaaaaugaacuucaaagccagacucggucauguaguaaggcccugucucaaaauaauacauauucacauacacaugacugggccuuagcugagagugcuugcuuagcaugcaccggaccuugggcucaguccccuguacuagagaaagaaagagcaagaaaggaugugaacagagguauuuacagcugugggagguggcacacaguaggugcuuugaaguacuugugacaagaaagaguacacagaaaggcaggugacaucuaugggcuucucucuccacuauaggaguaggcugugccagccccucccuggccugcccugccucccuaucugagcuggggcuguugacguggccaccguuucugggaaccccaguggcugcugccuaagagcaauguguccuuggcucccagccagcccagcccagcugucuugaagacggaaggaaguugcaggccuacuuagacuggaaucuaggguccaucgauucagaagcgaccacaccccguugacccuugaccuuucucccucugcacguacagcuugucauauuuccauuugcccuguguuuagagugcauuucaagaagcagcacgguggucaagcccacagauugugggucccauccuagcaaugggaccacagcaggcauccuuccaauuuugugcuucagcauccuugucuguggaaaggcaccugccucguagggcaucugcgaguuaagccaggguagcaguugccgucauguacagcuguguaggcagaggcucagccaaagguccgugcuuagauuguugaauuuguucuuggcuaauuuucaccgcucacccuguaacagaugguuacugaacacccacuccauaauauaccaggccguguucugggcacuagggacaaaguaaugacgagggcagacacgaaccuggcuucuuuaggcuaacgcucaugagaacagacccuuaacucuggugacaaaugcaugauuuaaaugaccagugccuucuucagggaggcauuaagggucucacuguguuaugcuggcuguccuugaauguagaaucccccugccuccacccccgagaugcugggauuacaggcauuuaccgccaugccuggccacagguuaucccuuacacuuccauuucuuaaaaaaccaggagcauccuaaagggguuccacgucuuccuucugucccaacuuuuuuguuaagccauucguacacuucuuuuucucaaagcaguggcacgcgggcuuguagggucuuuguguauuaacgcuauuagccauuuguauguugguugcuucuucuggucuuguuuuuauucuuucccuuugcauggcuggggauggaacuuagggcccuaaguuccagcaugaguuuuaccaucgagccauguccucagccccauucuuuguucuuuuccuagucucucucucucuccaccaccagugcuggagccagagacauuuuuguuuagcuccugagucaggguggaggcugugcccagcugaggcaggggugauugcucugguaacagggccaggagaacccucagcacaugaugagggccagauguggcucacuggaguguuuuggggcugucaaugagaagggagauggcguccuggaggcuuguggguccucgggagggugaguggagucccagaggcgacaucacaggggacuuggaauuuguuuuuucuuucucucucaauuuaauuuuauuuccaaauaauugaggauuuagugcaguuuuaaaaacaauagagaaguagagaggacucccucagcucuagggaggagauuuccacccagcuuucccccaccacacugcugcccccaccucccuguaccagacauggauugaguccuuauaacuauguagcaagugcuuuucccacugagcaucuccucagcuccucccuguguugcuuucuuacacauuuguagagaguuacaggcaggguacuggcccugguacugguucucaggucacuccuggcaucuccauuuccuuagagacuugcucauaucuaggcuucaggcaugugggacacaauagagaccaaggacaucccucagcacgggaccccuugugacuccuucaccagcagucuugggccuccugccuacccucauggcccaagcacccaauucuaacauaugauuuuaagagcaguguguacagagucuuuuaacauuccccuguugcaggugccuggacaugauucuguuagcuaggcugcucugaggagcuggagguacguggccccggguggagcugguguggucugggcuguugagggaagugaugguaccuggccucauuccucuuguaggaaugacuccagccacagaguguggaggguggcccaguccacaucagcagcccaagacaucuugcagcuccagaaugaguuuucaaaacugagccuauuaaagacccuugauggaugucauucccuauaggagggggucuuuacuacuguguccacaccugggggucagaggaccccuaaaauggaauggaaaacaaagugucugccuugcucacgagggcuuggcuuguacccaugcucacaugagucugugacccuucugacaguaaggauuugggcuucuggaagucaggggcuccaccaugagaacaaauucaaaucccagggccaccuauacagcugugcaaccuccggcaagucacucaaccucccugugccuuugucccuucaucugaaaaugagggaacugacuguaccuccaugauaaagcuggguuaaguggugggaagggacagagggagagaugaucagaagaaaacuuagcauggcguuaauagcagugcuagugaggauugccagagggcagagguccuccgggacaucaggccaccagaguguucuccaagagaugcacagguuccacuugggcgaugucacccccugguccuggggcucggauucuguuaauaggaccaugaagaccacuguuccuaaacaauugcucugccaucagccaccucuuccucccucccucccucccuccccccucccucccuucuucuucucucucucucucucucucucucucucucucucucucucuuucuuagucuagaauagaguuuauuaagggcauggggaaggaagcuaagaagguaguagaggcagagagagagagaagagagaaguagagggguagaggcaggccaugagcacaugaagagagagggggaagggaauggggagaggggaaggggugaggggacagagugggagcaagaaggcaagaaaccaagagagaaacaagagggcaagaggcucgaagcccuuucuuggccuucccacagcuuagccaggcuucagugcgucacacaggcuguugacauuugaaguugacagguacaaggguuauuuucauggcucauuuuauuucauuguuagguucuggcuggacuucucgaagcugaggagaagcagagggaccuggcuucugauuuuggaucugcgugcuugcugguucuggcgccugcuggucuuguuccuguaaccuaggacucggggcuugcacaugcuuuuuuuuugaaguugcuggagagggagcccaggaccuugugcaggugagccagguauccugacacugcaggauuguucauggcaugagacacugguggcuggaacuggaugcguguaugacuggguguccaccuugggcauuacuuccucucugcagcucugccgggcccagccugacagacagguccacgaagcagaaggaggcagaacuccagaggcugaagaacccagcuguagacucacagcugcucggaggcaaaaugggucugggacugacccauuuagauacagccuccagauaaugaggggagcgggggacugaggacugacccauugcaggggggucacugaggacugacccauugcugcaggggggggguacuggggucugacccauugcugcaggggucacuggggauugucccacugcugcggguggggcacuggggacugacccauugcuuugggaaggcacuugggacugacccacugcuguucauagaguagcacacagcuccccauuugcagggcuucucucucucccauccucccucccaauuucuuuucuuugcuuugauccucuuccucccgaaugcuggggguuggaacccaggaccuggaacauaccaggcaagccuacugaauuuguguguucauuuaagcuuccagaaccucuaagauggggcugucaguggauggccacuuagcagacagggaaacugaggcccuggguacagcuugcucagguucacagcugguaugggagggagccaggauuugaacuugagaaaguuaugaauguaugccacagcucuccugggacaggcgaauagagguaugcucgcgugcucugugugcagagggcacagagacaugggggagggaggccaugacacaaaugaaauggaccccgcugacccaggaucagcaucugcccacucuucuuucugcaggcaccuuuuguguccccaauggggcggcuuugcaccaaguuccugaccucugugggcugucugauuuugcuguuggugacuggaucugguaagucacucauucauucaucaaccacuaaugacaugucaagguccugcaguccucacggaauagaacaaagcucuuguggggauugggggggaggggggaggaagcagccgaugacaaaucaccaugacuaaguuauuuucauugacacuaauucaaauuggaaauuggggcuguccgggaauugaguagaaaauaauuugaguuauaugccaaagguuaucaaaagauggugggaaaacgcagcucaggacugaguaagggaggcuugggggagggguggagagggagagggcauugcacuuuaaagcagggugcacagggacacuggugucaacuuagaggaaggcaggggagggcacacagugucuguggugugucuuuggugaggcccccagggagggccugccuggcauggguugggaggacgugucgcagggucauugagucagaagaccuugcagagucugaucagaggaauugagugaaggccagggucgcucagugaucuggaaagagaguuucuagaucaaucuagaaggucagcaugaagacacgugggaauugaccugaagguuucucauccauguggccagguguggcuuacaccugucagccuagcacuugggagacugaggcaggaggauugugaguuugagcccagccugggcuacaaguuacuguaaaaaaacaaaacaaaagaaaaaaacaaaaaaaaaaaaaaccaaauggacacacaaauucuaccccaagcccagacaaggguggauuauucuguaugacgggaaaacccaggguagcuguugaaggagaggguucaggagguuagaauuuuguuugcuguaugaaaacuuccugcaugguggaccacacccgcuggcauguguauugugacuuugucuggacaguggccauguagggcuugggucaaaaagcucuugagggucccacacucacuggcuguuacacacacacacacacacacacacacacacacacauacucacacacacaccacaucugaauuccuggcagggagcugauggguaagugucuguccccuccuccuucccuucccucuuuccugcucuuccauuggcuaagccucuuggguaccaaagggucagagccugagccugagccguacagauugcagagucaaucucuugccucaguggagaagggagguagggaaggagaugugggaguggggggcgggaugggggguggggcgcgguggacaacacuguaggacacugccccuuccucccugugcuuuaacguggugcuucugagggagaguggcaccuagguaggugugugcgugugcaggcaugugugucaugauccugaugcacuagccucccucugaccuuaguggugggagccccugaccaugccaccacugaucuggccguucugucucugcagggagcaucaagguccugggugagcccaccugcuucucugacuacauccgcacuuccacgugugagugguuccuggauagcgcuguggacugcaguucucagcucugccuacacuacaggcugauguucuucgaguucucugaguaagugggguagggaggcagcaccccaaggucuguccaggccuuugcuauuccaggugaacgccagucuauguugugcuguaugcuuguggcagcuuacugaguggugucugaggcggagccaggucugggauaauguauccagcgugauacuacaguugagcagaacuuggagcuugguggugcagauggugagguaggaggaucaugaguucaaggcccaccugggcaauuuagugagauucugucucaaaacuaaaaagugaaaggccugcgggugcagcucagugguagaguguuugucugauggaugacccugcguucuguuaccagcccuccaaccccuccccacccccacucccaaccccacccccaggauacggaggacacucugagacucuggaucacugucccuguguccuaugguuucaauguuggacuggaucagcauuucucuaacuuuugcaccuaaguuagccagggcuagagcuacauccugucucaaagaaaucacaaauacaguuggcaagauggcucagacaauaaaggcauguaucugagggcuugaguuuaauccucaagauccacguguuagacagagagaaccaugcgaccauuugacuggugaccccugagcaugcucaaccaugggacaagacuaaguggaauuuguggugaaggugccagguuggcguccagggauugcucuggggcauucccuggcaucuaggugcucugugaguacugugccuagggcaaaaccaagucugcagauccagugcucaggagcauccagagaugcacaacacugcccuaaugccuguggggugguccuccauccuccuauugccucaagacaagugagcgggacuuuugcacauuggcacagaccaggcacugacaaauuguggaccucacgucaacuagccacuacuuguuuuguguguguguguguguguguguguguguguguguguguguguguguguuuguguguguguguguguguuuuguuuuguuuuguuaagauaaggucucucuacguagcccugguugucuugaaacaugcuauguagaccagacugggcucacacucacagagaucugccuaccucugccugugcuggaauaaaagaugugcccaaccacagcaggcagacuacugcuuuuaugaauaacauuuuauuagcauacgccauugcauucauuuaugucuugucuauggcugcuuuggagcuacauccgcaguuuguuguagacagaaacuauauuuuugucaaaagccuucagcuuccuaucuggcauuuuauagaaauggagcuuuggcccuugguguggucugugaguuguggguggccugucuaagugguccuuuggcaaaauuauauccugauguguacagggcaggagccugugggggaagugugcuagggcuuaucacaguccccuguaaaccaagggaugcuggaacaccaugaauuacuuuaugcuccauccuggggugaacuaagucaugggucugagaaccacagccagaauagcaguguccagaaugaaguaggcaaggucuguggccagcgagaugcuaaccaagucauuuccucucgugguccugauugcuuuggucuuccugucaggucggggguaaccugggaaguugugggggucccaggggagucgguaacuauggguggucguucuguaacagaguuucuaugucugcagaaaccucacaugcaucccgaggaacagugccagcacugugugugugugccacauggaaaugaauaggccgguccaaucagacagauaccagauggaacugugggcugagcacagacagcuguggcagggcuccuucagccccagugguaaugguaagacuugccugggugcuccagugcgggaggugggguacacauugacugcaggucagcugcugguuugucauaugcccuuacucuaccuggagucccugcaccggucucuaccacaaacuugcuccacauagcuuuguuuuguuuuguguuuuuguuuguuuguuuguuuguuuguauuauugaggacggaacccaggacuccccagaugcuaggcaaaugcucuaccacugagccaaaucuccaugcaaguguagugauaacaggaguugaaagcaagaauuuguugcucugugaccaagggcaaaucgcauuccucaucugaacaucaguuuccaaaagaaacugauuauucuuauuuuguagaucagagaaggcaagcaguuugccucaagucacacagcuucucagugccagaggcagaauugaagaccacauaucugagacaagagcucaugguuuucggucugugguuagaacugcugcucaggccacugggcaccuacaagauacuagaauuaacccuugaaugaguuuaaagucaucgucacauugaccuuaacguacacucugcuaucguggucucauguguaugauugccucagaagugaugagcccggugagucggcacacuccuggaaucccagcauucaggagucuaggaaggagggucaggaguucaaggaggugaaguuguuaauagggacaucaaagcaaaacagaucucagggaucaagccucucacccaggugcccuuccuccccagugaagccccuagcuccagacaaccucacacuccacaccaauguguccgacgaauggcugcugaccuggaauaaccuguacccaucgaacaacuuacuguacaaagaccucaucuccauggucaacaucuccagagaggacaacccugcagaagugagugggcgccacggaucccugcccuugccugggcacaggcugggaaggaugcuccgucuuuggaguagggugcuugggaggggguauagugaacuagagagcucacucucggccaggcucugccccaggcauguccguccccuuccuggcccugaauuugcaguguguagcuguguuggccaguguucuguagcuuagacaaagugccgagaaaaaucagcgguaggaggaaacgucuacuugaaugccugguuuccuagagaucagucuguggucucauggccccauuacucuggguauaguguugaggccaagcgucguagcagaagcaugguggagcagagcugcucagcucaugguggccaggaagcagacacagacagauagacagacagacaggcacacacgagcauauguccacuuucguaauauucccugagaacauucuccugacucccuguccacacacuagguuccgccauuucacaguagcuccacucuaggaagcaagccuuuaccacauggaccugagggaacagucugaguccagaccacagcaucaggaagaagacucaucccugccaucuuaacucagaaagggggcuuuugggccacaccugcuucccagccagagacacaugagauuauguguggcagaguagucacuucacucuuggucacauuugcuauuguguguuguucauggcgacccgucguaagugcauagauaggaguagaauugagcuggguuuaguggcccaugccugcaaucacagcucucaagagauugaggcagggggaugggaaguucuugacuagccuggguuacauagacccuuucaaacaacaacaauaacaaacaaaauccuucuaccuuccuuccccccccaaaaaauaauuucuacacagcaggugucaucagauagacgaagucaggugccgauaguggcugccuggucccugcuuuagaaacaggcagaggucauuuccugcuaugcuugucuuccuccccuccuuccuagcauucccucugcugggaugaccgggaaccagagugaccccucugaggucacuuacucaaucucacacagcguagucuuacuuuaugauauguucaaacccagcuuaacccacuuguccagauaauaguugcuaccagucauuggagaagucaggggagggcugacaaccuccaucucauucuccccuuagcaguggcagggaugugggaaugaucccauuuccagcacugagggaguacccagggcagcagccaggcugggaaccgacacacgugucugccagcucuguauucauaugucccugucuuccuucaguucauagucuauaaugugaccuacaaggaacccaggcugagcuucccgaucaacauccugaugucaggggucuacuauacggcgcgugugagggucagaucccagauacucacuggcaccuggagugaguggaguccuagcaucacgugguacaaccgugaguaucagggucguaggcugugaggaucucuacagccguguauauucucuguucagaaauucccucuggcugaccguggcguuuuccguucuaggaugccucuaacuauacaucccuguggcugugguguggugauccgagggcugcacuaacacacagauuucugugguugucacuguucagggccacagaaugacugagucuucuuucuauacaguaugcaguagcuggauagucaggacuggggaagguugugugagguugacucggugguaccgcugaggaggaaaagggcuuguccagagcaggcgugauguacagcgcacauuguuuuuuucagcaaguaaugaaaaucugugacugagugaccuugggggcugcgguggugaggagagcucacgggaauccuggagcaguguagcuggcgugucaaaagcagaaacgcaggagaugggucagugcgccgaggcccggaguuuaaauccccagagcccacguaaaagccuugcgcaguagcacgcaugcguaauccugauggagcaauuaggagaagccgguggccggcuagccugugcagacugugaaaacagagcaucugaagcugugugaaaggcuagcucgccugugcuccucagauccugacauacgccaucucgagcaaaagauuaacaaucgauuaaaacccacacaugaaaacaaagaaaccaguuagcuccagauaaaagcaaaugccaggaaggaaaggaggcagagggcagggguggaggagcaggugggagaggaugacgucagagaaaucucaguggccgugaacaaggaagauauuccagggcuuguucugaaugugugaucuuuuaaaccauguggcccucuuagccugugagaaaaguccauuucuagcccugcugaacagagaagcccaggggagcaaccaacuggccuucggucacucagcaaggaccuaguagaggcuggcuuugaacuugagcccuccagggcacuugaccucugagcuuugggaaaacaagcgaggcagcuucacgcuguugugaucuggacuuggaucagggccagugaggacagggacagggaugggugugauaaggacuugguguguaagagggagaguuggggagacaggugggagggcuaucuguagccagguaaccaagggucccaggggaacccccaguguggacgcggacugcacaugacacagggcggccuccccauucaugacuguuuuucuccuugcagacuuccagcugccccugauacagcgccuuccacugggggucaccaucuccugccucugcaucccguuguuuugccuguucuguuacuucagcauuaccaagugaguuccugcuuuggcuggugucucuggcuggcccuucagcagugcucucagaggucacagucauugugcuggcugagaaaaggcuggaagucugccucgaagggcagggcagggcagccuguggcuggaggcuucuccacaguggcugugcucuggaauaaagagagcuagguugggggacaguaaugguggcugcucuggagagaaggagcuggcuuggggcuagggagggguuguuuggggcauagagaagaugggagcucugucccucucaaugcccaugguauggucccggcacugggcaugugguaggagcagaggaauuugagcagaugcugugaauauaguaggguuugagugagacccggaaguggcgcuugcuggcagguagcuggucagcuaccugggcuccucugugggcucagagugaccaugagaacaagaccuccagaggagucugggcagagccgguagagggggaagauucacuucuggugaguucuaccuuggagucucagacccagagccauguucuuuuagaagugagauuagaagucacuucgaauuagggcugugcagguacccgguacccgccgccuggcuaagugcagggagugccagagccucuccucuccguggcuugccacucauaaccucgucagucacccggggcuaggcacugcuguucugaugcagaguuucucuguguccuguugcccuucccuucucccacgugaugccccugcaccccgcagcccgcaguucucaaaggcacauggcacguucuuccauagagucuuagccaugcccccacccuaaacguucugccccuucacuuuucugggcuguucccugcaacccccaacucugcuucucucuccuaccuuccucucuuauacauuguggucuucuuguuugucuuuuuaauuguuuugaaacccagggucuuacacaugccacccuaucucugagcuccacucuagccuccugcuuacuuuugcuuggagacagggucuugccaaguuaccuaggcuggucuccaacucuccucagcucaggaaggucuggcacuuugacucuuccugcccugucuccugaguggcagggaugauuuccggucaccaucccuggcugugguuuuugcucaucagcacuuaugguggugaaugagugucaugugaucaugccugcauuugcuucuuguuucucuugaaggcgacccacaggggcuucuccacuggcuguuuuucuggcuuagucccuguggcccuaguaccuugaugcucagaaaauacuaugggaagacggaagagugaaagucauaggggccaguuagcccaggaagaaaggaaaugcccgcuuccacacggccccugaccucucaagccuguuaaagccagcauggucaaaagggacuuuugagggagcgggauccuugcuguauagcuugaggcuuugguaguguggauaggucaagcagcccugccagcaucaggcucucccugggcaccucucccaauucagaaugguaguggugauggacaguuaggaccaagauuguuccauauccaaaaugggaucaguguggccuucgugcccugggaggagugacggccaggacacuuggaagagcaccuuggccacuguacauucggagaccaaccuacuuccuuuccacccucaggauuaagaagauauggugggaccagauucccaccccagcacgcagucccuugguggccaucaucauucaggaugcacagguaagaggguacaggcguugcauagugugacucccagccauggguagggugggugggugcgaggagcaaacggccagggguaagcaggguggugcacgggugguaacaaagcccaugcccacaucugugugggcuugguauuauuccugccauguucugcuagucacagugaaguccuguguccagaucagagaguccaagauggcaccggcaagcuggagcaucugagggcauuugcuaucucugaugcccuuucacugguguggggggcagggagggcagaggcugagacucccagagcucuguggggccuguguggaucucagcucucuaggcaugguugcugucugugaaaacacugagccuucugugacuggguugugcuggcaccccccacccccacugauuggcugucuauuuuaggugccccucugggauaagcagacccgaagccaggagucaaccaaguacccguauguaucugaacuugaacuugggucauaguuuuuguggguuugugugagaaugugauaguuacucggcugguggcaaucaauuccccuuccuugccccccccccccacacacaauugccuucucucuuccuggccccaaggggggagaagggggcaaucauggguggcugagucuccauucugcagcaagaacaggcuaaguguugauuuuaagagucagaaccacaucuauaacaccccaauaucaauacagggugauuccgugugggauucuaaaggaugaauaguuuuuuaaauguggcaaaacuuaacccucagcuuuaccucugcaggcacuggaaaacuugucuagacaagcugcugccuugcuugcugaagcacagaguaaagaagaagacagacuucccgaaggcugccccaaccaagucucuccagaguccuggaaaggcaggcuggugucccauggaggucagcaggaccguccucuggccagagaauguuagugucaguguggugcgcuguauggagcuguuugaggccccaguacagaauguggaggaggaagaagaugagauagucaaagaggaccugagcaugucaccugagaacagcggaggcugcggcuuccaggagagccaggcagacaucauggcucggcucacugagaaccuguuuuccgacuuguuggaggcugagaaugggggccuuggccagucagccuuggcagagucaugcuccccucugccuucaggaagugggcaggcuucuguauccugggccugccuccccauggggcccagugaggaggccacaugccaggucacagagcagccuucacacccaggcccucuuucaggcagcccagcccagagugcaccuacucuggcuugcacgcaggucccacuuguccuugcagacaauccugccuaccggaguuuuagugacugcuguagcccggccccaaauccuggagagcuggcuccagagcagcagcaggcugaucaucuggaagaagaggagccuccaagcccggcugacccccauucuucagggccaccaaugcagccaguggagagcugggagcagauccuucacaugaguguccugcagcauggggcagcugcuggcuccaccccagccccugccgguggcuaccaggaguuugugcaggcagugaagcagggugccgcccaggauccuggggugccuggugucaggccuucuggagaccccgguuacaaggccuucucgagccugcucagcagcaauggcauccgcggggacacagcagcagcggggacugacgaugggcauggaggcuacaagcccuuccagaauccuguuccuaaccaguccccuagcuccgugcccuuauuuacuuucggacuagacacggagcugucacccaguccucugaacucagacccacccaaaagccccccagaaugccuuggucuggagcuggggcucaaaggaggugacugggugaaggccccuccuccugcagaucaggugcccaagcccuuuggggaugaccugggcuuugguauuguguacucgucccucacuugccacuuguguggccaccugaagcaacaccacagccaggaggaagguggccagagccccaucguugcuagcccuggcuguggcugcugcuacgaugacagaucaccaucccuggggagccucucgggggccuuggaaagcuguccugagggaauaccaccagaagccaaccucaugucagcacccaagacacccucaaacuugucaggggagggcaagggcccuggucacucuccuguucccagccagacgaccgaggugccugugggcgcccugggcauugcuguuucuuaggugagugagugugcuguuguugcugaggucugugcugaggccaggguuccuccaagccagggaaguacuuccugggagacagcccagcuggcagguuucccagaaauccagagaauggugaauugaagauguaaacuuggccugacccuggacgcucggagccuggcugucuccucuuccacuggccugggcucuccucccucccaagggauacaggggcucacugugcuuggucccacagcagugcugacguuccuaaguccugggcuuuccuagcugauguuguccuaccuacucagucccauuuuguccaccgaauagaccugucacucaaggcucucagcgguccugccauagcugcuggacgcucccagcuggaagcugggccuagaaacucacagauggccuggcaguggcaugggaggcccuaaaaauuaguggaaauuuugagagaggacagguauugccccacagaggccauucauugaacagccaggacugggacuagaggcagagccugcuguccuccgcucaguuguagaaagcaacaaggacacaaacuugauugcccaaagucacugccaguuacccacauaugaccagaagccagggcuccugggauguggaagauaaacaaacacaguugccggguggcagggcccagcgggcacgauaacuggcagucaaggcgauaccucgagggaacuguggggcugguccugguugguggucaggugguagggauagcagauggcagacuuuggugagugagugagucugacuguguucuggaagaugggaccgggcucagcacugucugcucacguccccacuguugcaacaccuagucuguuugcaaggaggacaggacaggucacauggagcuuuaugucaauaaagucuuuaucuugucagguuuccuuuacuauacacacgccgagcccacagugcacgaaagcugaaaugugcaggcaggggguuggggaaguggggagacaaggccccagcaguugguuuaagggaaugacuugggaauggggcagagcuguggcuacuccaucucucauccuuacccuccugcuaccacagcuugugcccaugugugccugcucaggggagggguccuccucuuucccucuccuuuaggcagagugcuagagguguuggaugcuccuuagcacgcagagggcgugacacuggcugcuaaguguuguugaaugugucaaggcauugacaucaguaggccccacaucuuaggcaggggauuugggguguggcaaccugccaggccagcagagaacuugaauaugauguucagaaggaaagacagagacaggucacuuagggaggcuugaaggaggccacuuuugagaugagcccgugguaucugcaaaaaagccuggaagaacucagaacaugcagcagauggcucaugucugaaguuugaggcacagggaucugguguggucacagcaucagagagaaggguccuggcaugauggggacuggugugcaguuggauacugguauucugccuuaguucugccucuugagaggugguccaguagaagccagccucagacuuucacaucucagaacagucuuuucaaagacaaggucucaguguggcucagacgggccucuagcaucacucggucuccugagugcugggaucacaggugugugcuacuacacccagcuucccagagcagucuuaccacagccccuaagcaggggaggagaggaaacggagccauccaagaucuaccuccugugggcaucccuccugccuggcugaaggagaagucuggguuuaaaauccccauugcucagauuuguauccuggagggaagugacucccacaggaaugaacugacugucccaggaaauucuucccgcugugccuuuagaacuuccucuguaaaguaccucccuucagcugguggugccugucuuuaacaguggcugacagccagggaguuugaggcuagccuaggcuuugacagugagauccuguucaauaaacgcagcuucccaguccggcacuugaccuucaagcucugaccucuggauuagcccaggauuucuucacugguccuccaccuuccacccccuuccacugcuuauacccgcucccaucauuuccaacccaggaagcugcuaagaucuaugugguagcccuggcuccauuaccacccucuccccaucuccugggugacugagggaacuaagguacaagcccgaggaacuugggauucccugcccugcuguuaccuugccuccugucugccaucauuaacauaggaggugccagccugugccguccuggcucccauacucacuaccuaaggcuaccuguugggaauuccaacccucaccagucccaucucuucauucuauuaaaauuacuuaucaagcaac

SEQ ID NO: 4081 - RNA, 6253 nt, Mus musculus
ucauugacacuaauucaaauuggaaauuggggcuguccgggaauugaguagaaaauaauuugaguuauaugccaaagguuaucaaaagauggugggaaaacgcagcucaggacugaguaagggaggcuugggggagggguggagagggagagggcauugcacuuuaaagcagggugcacagggacacuggugucaacuuagaggaaggcaggggagggcacacagugucuguggugugucuuuggugaggcccccagggagggccugccuggcauggguugggaggacgugucgcagggucauugagucagaagaccuugcagagucugaucagaggaauugagugaaggccagggucgcucagugaucuggaaagagaguuucuagaucaaucuagaaggucagcaugaagacacgugggaauugaccugaagguuucucauccauguggccagguguggcuuacaccugucagccuagcacuugggagacugaggcaggaggauugugaguuugagcccagccugggcuacaaguuacuguaaaaaaacaaaacaaaagaaaaaaacaaaaaaaaaaaaaaccaaauggacacacaaauucuaccccaagcccagacaaggguggauuauucuguaugacgggaaaacccaggguagcuguugaaggagaggguucaggagguuagaauuuuguuugcuguaugaaaacuuccugcaugguggaccacacccgcuggcauguguauugugacuuugucuggacaguggccauguagggcuugggucaaaaagcucuugagggucccacacucacuggcuguuacacacacacacacacacacacacacacacacacauacucacacacacaccacaucugaauuccuggcagggagcugauggguaagugucuguccccuccuccuucccuucccucuuuccugcucuuccauuggcuaagccucuuggguaccaaagggucagagccugagccugagccguacagauugcagagucaaucucuugccucaguggagaagggagguagggaaggagaugugggaguggggggcgggaugggggguggggcgcgguggacaacacuguaggacacugccccuuccucccugugcuuuaacguggugcuucugagggagaguggcaccuagguaggugugugcgugugcaggcaugugugucaugauccugaugcacuagccucccucugaccuuaguggugggagccccugaccaugccaccacugaucuggccguucugucucugcagggagcaucaagguccugggugagcccaccugcuucucugacuacauccgcacuuccacgugugagugguuccuggauagcgcuguggacugcaguucucagcucugccuacacuacaggcugauguucuucgaguucucugaguaagugggguagggaggcagcaccccaaggucuguccaggccuuugcuauuccaggugaacgccagucuauguugugcuguaugcuuguggcagcuuacugaguggugucugaggcggagccaggucugggauaauguauccagcgugauacuacaguugagcagaacuuggagcuugguggugcagauggugagguaggaggaucaugaguucaaggcccaccugggcaauuuagugagauucugucucaaaacuaaaaagugaaaggccugcgggugcagcucagugguagaguguuugucugauggaugacccugcguucuguuaccagcccuccaaccccuccccacccccacucccaaccccacccccaggauacggaggacacucugagacucuggaucacugucccuguguccuaugguuucaauguuggacuggaucagcauuucucuaacuuuugcaccuaaguuagccagggcuagagcuacauccugucucaaagaaaucacaaauacaguuggcaagauggcucagacaauaaaggcauguaucugagggcuugaguuuaauccucaagauccacguguuagacagagagaaccaugcgaccauuugacuggugaccccugagcaugcucaaccaugggacaagacuaaguggaauuuguggugaaggugccagguuggcguccagggauugcucuggggcauucccuggcaucuaggugcucugugaguacugugccuagggcaaaaccaagucugcagauccagugcucaggagcauccagagaugcacaacacugcccuaaugccuguggggugguccuccauccuccuauugccucaagacaagugagcgggacuuuugcacauuggcacagaccaggcacugacaaauuguggaccucacgucaacuagccacuacuuguuuuguguguguguguguguguguguguguguguguguguguguguguguguuuguguguguguguguguguuuuguuuuguuuuguuaagauaaggucucucuacguagcccugguugucuugaaacaugcuauguagaccagacugggcucacacucacagagaucugccuaccucugccugugcuggaauaaaagaugugcccaaccacagcaggcagacuacugcuuuuaugaauaacauuuuauuagcauacgccauugcauucauuuaugucuugucuauggcugcuuuggagcuacauccgcaguuuguuguagacagaaacuauauuuuugucaaaagccuucagcuuccuaucuggcauuuuauagaaauggagcuuuggcccuugguguggucugugaguuguggguggccugucuaagugguccuuuggcaaaauuauauccugauguguacagggcaggagccugugggggaagugugcuagggcuuaucacaguccccuguaaaccaagggaugcuggaacaccaugaauuacuuuaugcuccauccuggggugaacuaagucaugggucugagaaccacagccagaauagcaguguccagaaugaaguaggcaaggucuguggccagcgagaugcuaaccaagucauuuccucucgugguccugauugcuuuggucuuccugucaggucggggguaaccugggaaguugugggggucccaggggagucgguaacuauggguggucguucuguaacagaguuucuaugucugcagaaaccucacaugcaucccgaggaacagugccagcacugugugugugugccacauggaaaugaauaggccgguccaaucagacagauaccagauggaacugugggcugagcacagacagcuguggcagggcuccuucagccccagugguaaugguaagacuugccugggugcuccagugcgggaggugggguacacauugacugcaggucagcugcugguuugucauaugcccuuacucuaccuggagucccugcaccggucucuaccacaaacuugcuccacauagcuuuguuuuguuuuguguuuuuguuuguuuguuuguuuguuuguauuauugaggacggaacccaggacuccccagaugcuaggcaaaugcucuaccacugagccaaaucuccaugcaaguguagugauaacaggaguugaaagcaagaauuuguugcucugugaccaagggcaaaucgcauuccucaucugaacaucaguuuccaaaagaaacugauuauucuuauuuuguagaucagagaaggcaagcaguuugccucaagucacacagcuucucagugccagaggcagaauugaagaccacauaucugagacaagagcucaugguuuucggucugugguuagaacugcugcucaggccacugggcaccuacaagauacuagaauuaacccuugaaugaguuuaaagucaucgucacauugaccuuaacguacacucugcuaucguggucucauguguaugauugccucagaagugaugagcccggugagucggcacacuccuggaaucccagcauucaggagucuaggaaggagggucaggaguucaaggaggugaaguuguuaauagggacaucaaagcaaaacagaucucagggaucaagccucucacccaggugcccuuccuccccagugaagccccuagcuccagacaaccucacacuccacaccaauguguccgacgaauggcugcugaccuggaauaaccuguacccaucgaacaacuuacuguacaaagaccucaucuccauggucaacaucuccagagaggacaacccugcagaagugagugggcgccacggaucccugcccuugccugggcacaggcugggaaggaugcuccgucuuuggaguagggugcuugggaggggguauagugaacuagagagcucacucucggccaggcucugccccaggcauguccguccccuuccuggcccugaauuugcaguguguagcuguguuggccaguguucuguagcuuagacaaagugccgagaaaaaucagcgguaggaggaaacgucuacuugaaugccugguuuccuagagaucagucuguggucucauggccccauuacucuggguauaguguugaggccaagcgucguagcagaagcaugguggagcagagcugcucagcucaugguggccaggaagcagacacagacagauagacagacagacaggcacacacgagcauauguccacuuucguaauauucccugagaacauucuccugacucccuguccacacacuagguuccgccauuucacaguagcuccacucuaggaagcaagccuuuaccacauggaccugagggaacagucugaguccagaccacagcaucaggaagaagacucaucccugccaucuuaacucagaaagggggcuuuugggccacaccugcuucccagccagagacacaugagauuauguguggcagaguagucacuucacucuuggucacauuugcuauuguguguuguucauggcgacccgucguaagugcauagauaggaguagaauugagcuggguuuaguggcccaugccugcaaucacagcucucaagagauugaggcagggggaugggaaguucuugacuagccuggguuacauagacccuuucaaacaacaacaauaacaaacaaaauccuucuaccuuccuuccccccccaaaaaauaauuucuacacagcaggugucaucagauagacgaagucaggugccgauaguggcugccuggucccugcuuuagaaacaggcagaggucauuuccugcuaugcuugucuuccuccccuccuuccuagcauucccucugcugggaugaccgggaaccagagugaccccucugaggucacuuacucaaucucacacagcguagucuuacuuuaugauauguucaaacccagcuuaacccacuuguccagauaauaguugcuaccagucauuggagaagucaggggagggcugacaaccuccaucucauucuccccuuagcaguggcagggaugugggaaugaucccauuuccagcacugagggaguacccagggcagcagccaggcugggaaccgacacacgugucugccagcucuguauucauaugucccugucuuccuucaguucauagucuauaaugugaccuacaaggaacccaggcugagcuucccgaucaacauccugaugucaggggucuacuauacggcgcgugugagggucagaucccagauacucacuggcaccuggagugaguggaguccuagcaucacgugguacaaccgugaguaucagggucguaggcugugaggaucucuacagccguguauauucucuguucagaaauucccucuggcugaccguggcguuuuccguucuaggaugccucuaacuauacaucccuguggcugugguguggugauccgagggcugcacuaacacacagauuucugugguugucacuguucagggccacagaaugacugagucuucuuucuauacaguaugcaguagcuggauagucaggacuggggaagguugugugagguugacucggugguaccgcugaggaggaaaagggcuuguccagagcaggcgugauguacagcgcacauuguuuuuuucagcaaguaaugaaaaucugugacugagugaccuugggggcugcgguggugaggagagcucacgggaauccuggagcaguguagcuggcgugucaaaagcagaaacgcaggagaugggucagugcgccgaggcccggaguuuaaauccccagagcccacguaaaagccuugcgcaguagcacgcaugc

SEQ ID NO: 4082 - RNA, 108559 nt, Mus musculus
ugauuccggauugguccgguuccagcgccgcagcaggccgcgggcugaggggccgccuggugcucgccacuuccggcgcguugggcuguuggcagaggguggccgcgaggggcgagccgcggcuacugguggcgcgcagggaugcggagggagcccgccgcgaggacagagguggcgaggacagcaagggcccgcgggccucucuccugagccggccgcgccgcccaggcccaggcagccucugccccuucagucucggcugaggcccgucgccgccucgggccgcggaggccggggagucccugccugggcccgcagccucccucucgggggucgggcccaggcggggggccucguguagccgccucugaaccccauuuucugcuuuugcguuuccccggggugggccgaggucuggaugaaucgcuucgggggguccccgaaggggcccgugugcuccuuuuaaaggugccggcggggcccggguagggaaccgguugucuuugcaugggcgggggacuccccgagccugccgggaccaugaccugaacugugcgagcgggacacgacggaucccaagagcuagcucaccugagccauccccuucccggccagcauggugaguggguccagggaccggguuggagggguggcagugggccucagagcagcugagccaucucuucuucccugaggcggggagaggcgcgugcgagccuggccggugacacaugcgugcagggugugcaaccggcuguacgcucccauugcccccacccccacccccacuggaugucuugaguagcgccacggauacaacccccugccucacuguuggcugugcccuugugcagcaagucgugauuaucaguaucauuuauuuauugauggcauacugugugucauuuccuuugcuaagucagugguauguauuuuguuaguauaucaacccccugauuggaaaugggggauacuugaggcaagaagcaguuaauuacucugcccaaggucaguugacucuuuuggguuaguagcacuauuugaacauaagcaaucuguuauagaacuggcuggauuuuuggagaccaucuguccagcgguagguuugcguuugcagaaaucuaaaguaguauuuguagagguuacugguuacggauacagacgauggcagagucagcaguggggucuuuggacaucuugguugcuguucuuuuuguuuucugcucuggccuuuuccuuggaaaacuaugcauacuuucaggucccacuaaaaaaaaccucucugaaaggaaaauaccuccucuucuugcaggcuuuuuagcuuuuccauaguccuugggguuuguguacucagagcaguugguugagugcuugucuuuugccauuuuaauguuucugagccuuaucugcccaucacaguaggcaaggugaaguuaguccucugauucuuuaucugccucaguuuggcaucuagcccaugaugagugagugcccagccuggguuugagcacugaucccccccccccccccccacacacacacacacauugccuggcgauuagagguguauugagauguggcuggugcaccuuuuuaaugcacacaucagaccagacugucaaacucuuaaggggugggagggugggugggguacauaaaguccugguuaguggaaagagguuguucuaaggcacucacuuuguccuccuggguuuacaaccaagcuggguaaaauacaccauuaaagcugagcagcaugguaugauuugugcuauauaugguguguguguuuguguacauacuagacaaggugacagauuuguugaacuucaguuuguuuccugaucuauacaauguacagacaagaauuuuccaaaaguaauuuaaagauaggaaacauauaugaaucccaccccuucauuauaauuuuaugaaauguuugaauuuaaauauccccacuccccccagacagggucuuccuguguaguugucucuggcuguucugcacucaguacauagacccgccugucucugucuccugagugcuggcauuaaaggugugggccacuguacccagcugaaaguuugaauuuuugaauugugauaagguacacuuaaggacuuagacuaauuuucaguuuucugacauguacauuucuguuguguagcucucaugguuuauuuacaucgccacggaauuucaucuccccaaacuaaaacaugguaucaugacauacugaccuuggucccuccuuuagcaguuccucuccuguccccuggucuccagugugucucccuuucugucucuauccuucugaucuaaucuuccuacuuuuuuuuuuuuuaaagauugauuuauuuauguauaugaguacacacuguagcuguacagaugguugugaaccuucauaugguuguugguuguugggauuugaacucaggaccuuugaaagcgcagucaguccucuuaccugcugagccaucucuccccccccccccccuuuuuuuuuuuuuugguagaagagucuucucuccuaugacuggcacauuucacuuaaugaagugucuucaagacccaugcacgguguuggugugcaggcuuuccuugcagucuucgagugugugugccauguuugcuuguccacccauccaucccuuggugcuugcuuuguuugugucccccuuugucaguugugaguaaucugcggugagaaauagaguguacaaauccuuaaauccuuuggcuggcuggcuuucuuucuuucuuucuuucuuuccuccuccuccuccuccuccuccuccuccuucuucuccuucuccuucuucuucuuuuuuuuuuuuuuuuuuuuuuuuuuuugguuuuuugaaacaggguuucucuguguagccuuggcuguccuggaacucacucuguagacuaggcuggccuugaacucagaaauucaccuacuucugccucccaagugcugggauuaaaggcaugcaccaccacugccuggcuuugguuaguuuucuauagccuucauacucuacacccuagagaauguagauaugagauacacagauaguguccugcccucagggaacuuagcuuguugcugggauagaguuuucuguacgguagagcuaucaagucauucaugugcuuaguuucaucuaguuggcaguaauuagggcauuacaagcaugauuaccuucgaggaauuaauugugaagcuuuugauuuuguauguagaccucaacuuaagcaugcaggggauaguuacugugggugugagacugauaggaucuucugucaagacccuaaugguucuucuguuguuguuucaggggaggaaggucaagagauugggugccaucuuuguuugcuaagucaggaaacuauugccugacuugugucugacaggacgagggccuuucuuggggaucacagcccuuuacuucaauaauucuuuuccucuucauuuuuacaacuccaaaaccugucggggcuugaagggugguuguguacuagucaggccuuugaacuaaauugcccagauuggcuuagaacuccuguccccuuugccuucuguggggauuauagaccugugucaccaggccuggcuacauuuggacuuaggguaauuguugaucuaaauguaaguguuugaaaugucuuuuuuuuuuaauaguagacuggcauaacagguaaaaacuacaucucugaccagguguggcccuagcaccaaaaagagaagaacaaaaaaguuacucuuuaggaguaauguuaucugcuugccuuggaggggagugaguuuaguggggagaugagucacggucagauaacuagagauggugauaagauuaaguguaaaagauugcugggugcaaaaagcauuugcccaaagaaugacugauugagauuaagggaacugggagaagggaggcuuccuagaggguguguuuggaucucgaggauaagggaagagaaaggccuuccaaguaaaagugcuuguggggaauggacaccuggguccuuggacuuucuaggcuuugagcauuaccuacaugcagcacaguaauacaccauuucuuucaucuuuaagaccauuuuuucccuuuuugagaugguccaaaaagccuaaauuggccucagacucccaauccucucugccuuguccucccaaaugcagggauucuuggagucuaucaccaugcucaaccuggcuaacauaugucauguuaaggaagcaucagcuagacugauugucuuaugguacugacuucugugagguagcuggagagagugauguauaggaucuuccuugcuaguugggggaaaguuucuaguacuguuaccguagaauaacugagauuucccuugaaggaaaauaacccaucugcugugccaagauuucauuggugagagaaccaauagauuaacacugucuguagggugugucaaaggccugcucuugaaugugcaguucagaguggcccagaauuuacuauggagaccaggcuagccucagucugccugcuuccugagugcuagguuuaaaaaggugugugcuaccaugcccugugagaauugucauuuuaaaaccucuuaaaugauuacagaauuaaucagugaagaaagguaaaaagcaaaauugauuugggaagccuuuaacauggagacugggaauaauuacaagcuugaaucaguuagcgauuuggauugcuagccaugaaagguuaaaaaaauaguugacagauuggccucauacugacaaauacuggauuuagcuguguuuguaaggaggcggggaagcugauuggcaccuuggaauacaaggucgacuugaagauuuuuagauaauugaacuauggugugcacauuaaguuacggagagcuugcugguauagguagaggugagagggaguuacucaaauguaacugcuucuuugcuuuuuuucuuccaccgugaggauugaacuccgcuucaggcacauuaggcaaccacuaccauauaguggagcuacacuccauacucugccucuguuuauuuuagacuuccacucgcuauuucuacaucauucauuguauaacccauugcacauugacuuauaaaggcauucuuaguauuuuauuuuguccaagguucuugaaaagcaauuauuguacauauuuauuggguacagugugauacuguguucaguuagcauguuaccucauaauuaccauuucuuuguaaugagaauauucaaaauccuauucuguagugauuugaaaucaauacaucaauaaauuguuagucagcaggcagacuacuuuuuaagaccaccuauaauuguaguguguuggguucaauguaaauaucucaauggcacgucuguagucugaagaggcugaggcaggagucuugaguuugaggccagcuugggcuacauacuauucuguuuaaaagcaaaaaauagacaccacaacuuguuuuuagucuuuaugcuuuucaacuacuugugguccuugguaucugcugucuccuuuccuuuucuuuuuuucuuuuuuuuuuuuuuuuuuagacagaguuacucuguguagcccuggcuguccuggaacucacucuguagaccaggcuggccucaaacucagaaauccaccugccucugccucccaagugcugggauuaaaggugugcaccaccacugcccagcuuccuuuucuugaaguaauuuuuuuuuguguggcucccuuguaucuaugugucuuucuccuuuuuauuagaaaauauuuauuuuuaaggcuuguguuugugugcaugugagugcgggugcacuuggaggccagagguuuuggaucuuucaggagguauggagguugccagccucaguauggauguugagaaucaggucuucuggaagagcggugcaugcucuuaacugcugagccaucuguccagcuuugcuauuacuuucuugauuuagucucccuugcuuuuuccugccuaugacuguaguugugaccuguguaucauagaaacuaaaccuucuuuggacauggaugugcaccuuagcgugcugugggcaucaguuaauaccaucuaaaccaucucugucaucucuccuucaggguaaugcucuuuccccauggccuaguucucuuaaugaugaccucauucauccacugugcaugcuuaauguugagucauaguuaacuuccucuucugcuguaccuguugaugguauugccaauauguuugugucccaauucuggccuucucaucuuguuugguugggucagguccucagucucuguuuuguuuuuuuuuuuuugauuuuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagccccucuguuuuguuuuguuuuuaauauuuuuuguauuuuauuuuuuaaagauuuauuuauuuauuuuauguauacgaguacacuguaccuguacagaugguugugagccuuuaugugguuguugggaauugaauuuuaggaccucugcucacuccggucgaucccacucauuccaguccuaagauuuauuuauuguuauauuaaauacauaacaaagauauuguagcugaauucagaugcaccagaagagggcaucagaucucacuaugggugguuaugagccaccaggugguugcugggauuugaacucaggaccuucagaagaacagucagugcucuuaccugcugagccaucucgucagcccuguuuuuuuuuuuuuuuuuguuuguuuguuuuuuuaaagauaggaacuuggagugcuggcuggacucaaacucaggauccucaugcaugagugcuggguuuacaggugcucacccccacaccagcuuugugauagugcuaaauuggcaacuuaucacacuugagagucacccgggaagagucucuggacaaaccugaacagaccugggauuguuuagaucaagcuggucaguggacauaucugggcggugauuguccagccugcugugccguuccuggguuuguguccuccaguguccuccagggaaagggaacugagcaaaaggagcaugggugcguucauuucgucucuucuugacugugugugugugacuagcugcuuugugcuucuguccugacuacucugaauuagaaaccaaaugccccagaugcuuuagucagguuuuuagucacugcuacagaaaugaaguaggguagcuguuccagcucccagguucuccuuccaucagucugccuaaauccauuuugcuacaaccacucagccaacuauaaggugccuccugacauaauucagagcagugcugagggagguucccuugguucuggguuuuuaguugggcaggguaguuggaagcacaugggcuuuggauugauucccacagguaguuugacuuucgacuucucaguaggggagaggaugauguauuagaugcuaaaagugauggaccuagaaugucuuuuagacuucacaaaucauacgucauucucuccucauagccucccaccaucagucgcagaacccuuggcacacacuggccuuuccuuccuucucucucaugcugccucuguuucucuuugacauuuucuuuuuuuuuucaagguaagaccaugaucgauaccaccauaaaguaccaccuuuuugagguuuucuaggucauuaguuuaauaucugucaccuuugauuuuaguggguuuuuugcuuuuauuucuuuccuauguacuaguuaaaaggcuguagccuugcaguaagugucaacaguugagaagguuggagccuccuugccacuccuuucuguugcugugucuaguaagguucagcauauuuggacacuugaaugaggagugguaguuuguaagcuuuugcccugggcagguggacaugugcaggacaugagugaggggaguuagaacuagugcguuguggaucaugugcugaagcacuggcagccagagugaggguagacagggaaggggacagguuuagaggaagagaauagcuucuuuuucuuuuucuuuuuuuuuugguuuuucgagacaggguuuuucuguauagcccuggcuguccuggagcucacuuuguagaccaggcuggccucgaacucagaaauccgccugccucugccucccaagugcugggauuaaaggugugugccaccauggcuggcuaaaaucauuguuuguauuuuuuuuuuuuaaagauuuaugggcuggugagauggcucaguggguuagagcacccgacugcucuuccgaagguccaggguucaagucccagcaaccacaugguggcuaacaaccauccguaacaagaucugacucccucuucuggagugucugaagacagcuacaguguacuuacauauaauaaauaaauaaaucuuuaaaaaaaaaaaaaaagauuuauuuauuauuauaucuaaguacacuguagcugucuucagacgcaccagaagagacgcgcgucagaucuuauuaaggaugguugugagccaccaugugguugcuggguuugaacucaugaccuuuggaaggguuaagugcucuuacccgcugagccaucucuccagcccuagcuuauuucuuacuuauauuuggugauagccauuguguagggcucuacugccuccucauuuaaucucucugucuuuguucuguguaacuauuacuguucccaauuuacaguugaaaaagauaagggccuuggcucagggagaguaagguuaauagcuugucuacaguuacauggugauugacagagccagguuucagagcugguuccaacccccacagccaugcuguacacaagauugcuagauuucuauaguacacauuuccugaaaauguagacuguucuagaaaaacagugcaucuugccagcugaacuuaaaaccugagaacauucucucuccauaguggcuagguugagauggucaaaucuuccagcaucuugucucuggcuauccuauaacaugggauugaggaagugugagcacugaggaccccauggugcacauaauggauguucacagggagagacaggugcuugccuucaaguuuuaguucagauaagcuuauuaggcuuagcauguacaguaguaguuugccuccucucccucccucccucuuccuuuuuugagacaaggucuuuuuguauaggcacaguuagcuggaauucauuguugcaccagcuggcuucaaacuuggaucaguucuccugcccuccccucucaaugccacuguguuggauuugguaggcucauuuucacaguuaacagugaccagcagcccuggugcagggcucuagcuaaagguagccaagggauguuuugugguuugaaugaagguagaacaaaagaucagugcuuuguaaauuggcuaaccaguccugggaagcuuucucucuucuugucucaguuauuguuuuauugccaugaagagaaaccccgacuaaggcaacuuuuaaaagaaaacauuuaguuggggcuuauaguuucagaggguuaguccaugguauggcgcuggagcaguagcugaguaauugguuuacuucccaauucacaggcacugggcagagagaaagugagagacggaggcugguaugagccucuaaaaucucugaguccaccuccuucaccaaggccaugccuccuaaguccuucccaaacaguuccaucaacugcugaucaaacauucaagcauaagagccuaugggggccacucucucauccaaaccaccacuucccucuuuucuuucuauuagagugucagcuguauacauuccuuaaagugaccacaugcucauuaaaacgaaaacuccaggaaguaucaaaaaguacaaagaagguagcaaaaaaaggagaguaaguaccuaaaaucaguauuuuuguuuaaaaagugguagugauaguuuucgcucuuguuuucugugcuugucauuuguucuuauguagggaugcaugugugccccugcauaugguaggcagaggacaaccuugggcacuguucucagggacccuucucccacuuacuuguuuggaacucaucuuggccaggucggcuaucuugcuauuagggacccacuugucugcuugcccauguuguaauuaaacaugugugccacaagcaugccuugcuucuugugugccuguguguucugacaauugaacucaggucuucuaaauaagcuaucuuccuaaucugcuucugauuuuuuuuuuaauaguauagaauagaguuuauuaagggcauggggaggggaguuaagaggguaguagagguagagaaaggcagagaaaggagggguaggagaaggggagggggagaagugaagagaaguagaggauuagaugccagucaugagcacugggagagagagcgggaagggaguggggagagggugggagcaggaagggaagggcaagagcaaaagaagagcagagagcaggagcaaccuccugcuuuugagacagagccuuauuauguauaauaaugaggcugccuuucagcuaggccuccugccuugucucucaugucauuaucauacagaguauguuaccaugccuagauauguugacuuuugggggagagcauuauaauaguuaaaagauacugccacuuggguuaaaaaacaacccuuuauuuugaaacaauugcguguucacaggaaguugcaaaacuggugcaaaaaaccuugugucuacuuuaccaggugccuaggucauguccaaaccaggagauuaguaacauuugauguuuaccaguuauuauuguguauuuguucacuuaucuauucaugggugugcaaguguauacauuuuauguauaugauuguguagaguccagagguugaugcuggguguuuuucuuaauugcuuccaaaucuuauuuuuuugagacagcacgcaccucucauugaacccagggcucacauacuaggcuagucuggcuggccaguagauucuggggaaugcucuuguuuccaccucccacuggugaaaugaaacaugcacguugcugugccuaguguagugauuugaaugagaauggccuccauauacucagauuugaauguuugguucccaauuuguagucuguaagaaagauuagguccuguuggaggaggugugucacuggaggugggcuuugagauuucaaaagccuacaccaggcccacucuuggucucucucugccuccuguuuguggaucagauguaaguucucagcugcuuuguuagcagcaccaugccugccuuccaacugccaugcugucugccaugaugagcauggacucacccucugaaacugaacuagcccccaauuaaaguuuucuuuuauaaguugccuugaucaugguguucacagcaaaagagcaauaauacuaagacaccuggcacugccccccacccccuccuccucuuuaaugugagucuaggugcuggaaugugugaugucuguaauuauuuccuaauaaugaaaguuaagaaguagaccaaguauugucuauggacguuggggauccauuccagcaaggcuguagaaucacacaugcaucuggcuugcagcaguuaauaguggaaggggaaaggugaacagaagcuuugauaauuuuagauuuuccugccaaguuggugccacacaccugugaucacaggauucagaugagguaggguggucuagaguucaaggcuaguugaguucaaagccagccuggcuaaauuggguuuccuaaaagagaugguugcaguuuggauuucugagcagauaugggaaguaucuaggcagagaguuuggggcauuugguugaggcacaugguacagcagguacauguggaguggggagccagacuguuuauugauguucacauuggaugaauggaaguguggaaugaggguuuugcuaggcaguacagguguuguuugagggugugaccugggaagggagcccucauccucaugaauacucagaaaauuauucaucugaguucuucagucugcuuagaagaagaaaauuaagugaucugucaaggauuuguuuauuuuagguauuuuuuuuuugaagauaauuuuagauuuuagaauaguucuaaagucaaugagguuaucugugugcuucuuuauagaguuaccaaaaacaaaaaccaaagcccugcaggaagcacccugagaguugauuugugaccaccucaguuuuugcgccauuuuuauccuaguacugacgggcaguugaagcuggugcugcuuauagacucguaauauccugcuaccccuugauuuugcucaguaguuacucugauugcaaguuauuuugaacucuaaaauaauugauagcuuucuuauuuuauuuuuuaaauaauuuauuuuuauuuuauguguauugguguuuugccuacauguauauuugugugaaagugucagaucuugguguacccaacaguugcgagcugccaugugggugccgggaacugagcugggucuucuggaagagccgccagugcucuuuaccacugagucaucucuccagcccuugauugauaacuauuuaaaaaaaacaagaaauuacuaccuguauguuuguuuccuugucuuauuuucuauuuacuuucugaaugguugccuuugcacuguaaaugcacuuuucccauuaacaguauaguagaaguggguuuucagauuguuaaaugucucccaaguauuuacaaugauuguauagcauugcauugcaugaauucugaggcaguuaagauuuuuuccauaauaaacaaugugugauuaauaucuuugcaaaaagccuuuucugaauauuaggaguugcuuuaggacagauucccagaaaagcucaaggguagggagacucccuccacccuuucucauaaaccuuuuauuuugggauaauucuaaguuuaauaugcacauuuuaaagacacuugauuaugucuuccagaaagguuauggcagcuuauucuuuccagcaguguuuguaaauaucaauggcauugguaaucuuaaggaaguacuacuagcgccgggcagugguggugcacaucuuuaaucccagcaccugggaggcagaggcagguggauuucugaguuccaggccagccuggucuacagagugaguuccaugacagccagggcuauacagagaaacccugucucaaaaaaacaaaacaaaacaaaaccaguacuacuagcaaaggguguaguggcgucuuaacuauuccucaguauugugugcauguaggaaaaguuauuuuggguuagaguuuauuuucuguuauaggaguaguagugcgcucucucucucucucucucucucucucucucucucucucucucguuuuggagauagaucugucaguagcuugggcuagcuuucacaucacaucuuccuguccccuucucaagcgcugacuuacagcuggacauaccaucaugccugucuuaaaacuugacguucuaaagugugccaaauucagugacauaggacaagaagugcagcucacuaguagagcacccauccagcaugcccccaguucaguuuucaauaccacaaaaaaacaacacgugacauuggguacauuugagacguagaguuuucaucacucuagaggaauuccuguaccuacucaguuuugucugucuaucuccuccaagcccuugguuuuugugucuauggauauguuugcuaugaauacuuuauauaaaugaaaccauacaguaugugaccacucagucucuuucucccuccauggggucuugcuuauguugccuagggcaucagcuucccaagcacauagaacuacauaaguauuuuuuuuccuaaaucauguaaaagaugguuuauaagauuacauuugugccagucgguggugcuggcacucaggaggcagaggcaggcagaucucugugauuuggagaauagccugguuuacagaguggguucuaggacaaccaaagcuauacugagaaacccugucucaaaacaacaacagaaaagauuacauugaaucacaccuauguauuauagucagaagauggguaaucucuuugguagcauucuggaauucuggagaauugggcaggcugccucaggcuguaccaugaggaagaaguaguuuuuacaguuaaccaguagaggacuaaugacuguagggucugagauaagaaggaaucugagacaaggacaaagguggcuuuugaaugaaauggcagcacuuuucaugcuggggauaguuaggaaucuugcagauaacaccccugguucuguucacacagaguugugggcaugugcuaccauugauacacuuugucuuuaacaccagucagugacuguaaauuugaagggacugagcauggcucugugaguaaggugccugucacugagcuugacugaguugguaccuaggagugcaugguggaaggagaguggagugccaauaguucaguauuuucuauauugcauaagcuacucugaugucauuaucuugacuugaaagccuuaacagauaugacugagcauuaauagaaauaugaauauuagaucagugcugaguauagucagaggaacaaagugguaacagcuuugggacauugucuucauaaaagugagugacaaggcuggggauguacagugauagagcacuugccugguauauguaaggccuuggauucagacagaugaaauaagaugcaaguguucacaugaaguuuguauaaaagaaaucugugguaagggagagauugguccuaaccaacuuugcacacugagguguacuucugauugucuuucauaucagggugcucuggaagcaugcaggauuuccucagguuaccaggaaucaguggauuggcucuaguuugucuguuuuacugucaugcuucucucucaguggaagcacuggugcucaucaaaccugcugguuuguguagacagcuucuuucuguauccuuuauuuugcuguggucucauuuagggguagccuuuaguaccacaugcuggaggaacaguugaacauauucuucuggccugcuuguccuuugcucaggagugauuucuccuucuggcauacuaaggaaagcaccacaugugggucuacuucugccagguauguaguccugcauccuugcugagguagagcuagcccuuuccccuagccuugcggguggguuaguaaaacaguucagaaugaagaggagcaagaagaggaggaagagguagacagcacugccaauaagaacauuugacuuugacuuguacuuuggaucuugagauagaaagccacuggguagaaaggacgugguuauguaccucaguucacaccagucuguagaccaucuggaggcuucugccaaaaucaggcaggugcuguuuuaguuguucaagugugaugucugguaacaguuuaggaugaaaguugucuuagucaggguuucuauuccugcacaaacaucaugaccaagaagcacuuggggaggaaaggguuuauucagcuuacucuuccacauugcuguugauaaccaaaggaagucagaacuggaacucaagcaggucaggaagcaggagcugaugcagaggccauggagggauguuccuuacuggcuugcuuccucuggcuugcucagccugcucucuuauagaaccaagacuaccagcccagagaugguaccacccacaaugggcccuccccccuugaucacuaauugagaaaauguuccacagcuggaucucauggaggcauuuccccaacugaagcuccuuucucugugauaacuccagccugugucaaguugacacacaaaaaaaacuagccaguauaaaaguguaugggcuuuuacaaaagaggcuugcuguuaggacacuugguaacaacaacugaaauugcuuguacaggagcaauauuguugguagguuuuuuuuugacauacagugugaucugcaucuuuggugaucugcuaagucacauucauuaccugauugcauucagugcagugccagcucauuuaucuucagacacuuggagcagagcacuuguguggaggaaccaucacugugucggagcucuggcauucugcucugggucugacuucacuaauaacuagguaacugugggcgaacagcuuuauuuuccuuuuugcugaugcaagguugcacuugcuguucacuguggcuauuuuuucugucauaagauucuuaucuugcuuuagaauuucuggauagcaucuuuguuucaguauucucagugucauugaaaugacauguugguacacgucugucuucugagauaugcauaugugaaagagaagcagaugugaugaagagaaugccuguuggugaugccuuacuaauuuuggacaguuuucuugcagaauaacuuuuuuaucauucuuuugccuaucuaauugaagcucucugggagacauuuguaauguuuaagcuguguaauccccccccccccaaaaaaaaaaaaacaaaaacaaaaacaaugggugaagauguacuuggcuuggauaaguucaucuuuugucuguuagacuccuuacccuuucucauuugccaagucaucuuggagcagugagaagcaagguggaagauaauggucuacuagaagauuaaaaaccugauuagugggccuggcucagcagauaagaguccugacagcucuuccaaaggaccgggguguuauuuuuagcaccuacaugauggcuuuccaaccaccugaaacuccaauuccagaggaucugauggccucugugggcacugcaugcaugugguacacagacauacauacaggcaaaacacccauacacaugaaauaaaaauaaauaaagcaagcaaacaaaacaccguguuagugcuuguuuuggcaacauauacauuaaaauuggagugauagggagagugucuugacuccugugcaaggaggacauugcauucccagagcauuccauuuaaaacagugccuuuuuaaaggggcuggagagugcuuaucagcucuugcugcuuggucuuccucaggaccccaguucaguuccagcacccacaccagguggcuuacaguugcugaaaauuucaguccuagaggaucugacacccucuucuguucuuagcaggcacucugucuguguguguguauacaaaaacaauaauaguagucuucaaaacaaaacaaaacaucauccuguggacaagaaagauggcucagaguuuaggaauacuugcugcucuuguggaagaaccagguucaguucccggcacucacauagugacucacaaaugccuguaaacucucguuucagaggacucgacacugucuuccggccuuugugggaaccagacacaaauauguacauucauacacggaggcagaacacacaaaaaucaaaaugagucuuaaaaaucaccuugcuaacgcuaggcaugcuugugcacaccuguaauucuaacgcuugggaggcugaugcaggaggaccauguguucuaggccagccuggacugcauagacuaugaaaacaaauucuagcacuagggagacagaagcaggcgaaucucugaguuugaggccagccagggcuacauagugaaacugucuuaaaacaaacacccccagacaaacaaaaugacccuugcuaauuggaaguuauuuccagcuaagagagauugcaaaguaguagauugaaacaagccuguuaacacuuugauguuuguguuaugguuugucuuucucugucugucauaggcacauguauagauaugcuuugacagaggaagauaccugauaacaaucucuugccucaagaaguauaccugugcaucauacacuugaauacacccaugcaucaaacacacacagacacacacacacacacacacacacacacgccucugcaagucacuauuuuagugucaucaguagguccaauguagcugcuuccccuguaguucaggguccaaucuggguucagguguagcauuugcuuauuaugaguuuuuaguccacuuuagguuuguuaauauuauuuuucaaaacauuauucugugcauugguagcuaguuaguugcucuuguuuuuauguauuguucccuaguacauaggcaguuuucccaguagaaaauguauuguucucugucuacaaagauguuuacucuaguuagucccuaugaagauagaauaugcuaccuugacuuuuaucaguccugcagugggacuagugaagcuuucuagcucagacccuuggcauucuuucugcuucuagcuugauucugaucaguagcaaucugaucucuucugaucaggaagagagagacucuaauggggcacuuuguauaaaccuaagaaauacuagagggguguuuugccugcucuugucuuuguggaaguuuaaucugaggcugaagaguggauucagaugggccagaauguuuauuuucauuagauauuaaggauccacgcagauucugucuagucaugucuguaauuguucccaaagggcaaauacuguugagcuuugaacuuuagcuagacaaggagcuuuuccaaggcagaugggucucuuugcucuuugguuucaggugauguucauugugagaugugaacaugcacacaaugcagccuuuguccuggcugcauguuucugaaacugcaacucuguuucaucugccuccuuagaguacuuuucuccucccaguagcuccacccacccuuauccuuguagcuacucuuguugcugugaucuugaacuugacaaaacccauguaaggaaagagaaggguuucuuuuuggcucauagaggaugcagaacaguaugguggggaaagcaugguggcaggagcuugaggaggcagcuggugugcagucaggaaucagugagagguaagugcucaacuagcuuucugccuuuucugcugucugggaccccugccuguggaaugggugcacucauguuugaggugggccuuccaaucucagccuagucuagggaauccuucacagccauggucagagucuuauuucuagauuguaauugucagucagcauucaaaccauacugagugcaauccuuuagagacugagugcgagugacuguuguucugacuacuagggcuagagagaucagcugguuucauugacuugcuuagagagaaacacaagauuuauaguucaacaacauagaggagcagagagaacugaaggaggggcuuugaagggcguguaucucaggauuagaguuuccuuccuguucuuugcuacugucuugcuuucuguuggccuuguagcacuggugugggggaggggcacccucacauugauugccauguguguuacuuuaagcuuuggaucuuauacuaaacccaagaacauuuuuuuuuuuuuggucguuaaaaggguagggaaggaggguucauuugagaguggagacaucuuuggugguggugguaucuuugagagaaaaguuuacuugggacugaauuugcuugcuaauucuguauuuuugaaccuuaguuggcagguaguguggaaucaguaucaauaucagugaggcugugaaccuauaggaaggaugucuguggcccacugggaacacaaguuguagcucccgggaaaggaagcagaaaguuugauaaagacuuucuuuaaagccaagggcuauguugcagagaagauuguuuuaauuucuuuuuacauuucuuuaauuauuuugugaacauauguguuuguguggguguauaucccauggucuacauguggaggucagagggcuguuugcaauaugugggcuucagggaucaaggucagguaaccaggcuugggcuagugucucuaccuaaugagccgccucucugcagccugagaugguuauuuagaggucauuaggugaaacauuacagauuuagucaagguuugagaaaacuuagcuauucauuuugucacaggggcaaaggcucauauagaucaucuauccuaaggguuucuguuaggcuuuguuaaagauauuuuagcaacuauuuacauauuuauuuuucaaaaaaagauuguuguuugugaacagagaucgugcuuacaucuuuuggauaggaaauuaauaucacaugugcaucucugugggaaucaguggugauccucaagagccaaagcgauggcaguaguuuaguagcaacucaccuagaauugcucugagaacugaaauauucagugucuauaacacugacaucaguagccugauuuugagucccuacuuuauggcuggcauuaugcuuauuauaugugcuuuauguaagugaucucauuuaguccuuagaaggauccagugucuuaaaauuuuuacauaggagacaaagguaucuguuaaaagccgggcagugguggcgcacgccuuuaaucccagcaccugggaggcagaggcaggggguuucugaguuugaggcuggccuggucuacagagugaguuccaggacagccagggcuacacagagaaacccugucuggaaaaacaaaaacaaacaaacaaaaaaaaaaccuggccaagguucagguguguuugaauuagagcccggggaaccugauuucauaagauacacucuuuaccuaguagugggguagaagugugcagaacugauuacaagacaaagacaaaggggaaaaacaaaaggagacagagagggguccaggcuauauauaauguuugagaggaauuuaaugaaggcugagcuguaaauuuucucuccugcaguaggucaagguggaaguccccaugaguguucaaaugccacgaugguucuuuuccaggagccuuggaacuagacagccuuaagucuaccccagcccugcagaugucucugcauuccccaggucccaugcgcaagaucccuggcucugggcacugaggcuguccauacagcacugcaguagggugguaaccaucaggcucugcuuucucauuuguagcuucuacucugcacccucaggacccuuuugauccuuucaaaucagggacugucuuauuuaucuuuacaucucaggaguaucaagcucauuugccaaauaaaugacuuaguuucucaaggucauucuagauuuaaaggcuauguaaagcuagaucuagaagaaccgagguugagaugucugccuuuaggggaguuuauauggcuacgaagaacagauugcaucaggguuggaaaaaaguugguaucaaagugaccagcuaaaagaagcuaauuuuacaggcaguaaaauagggaguggaaauugugagggaagauggcacaaagugagaaagcacugggaaacugcaggcucaauggagccagccauagaaaauaggaaaaagucaaagaaaaugucagagucugugaccuuucucuuccuuucaaguuuucuuugaugaggugauucugagccuugauuggcuuugguuccuuaaugagucagaagcacaggucuuugaacugcuuauccagaaacagaaauagacagcagcagaaaucuaggcaggcagcuguguacccauuaacaauucugcagcagaaaauguagguuugucuuagguauaugcauggcucuccuagaggauucuaggacagacauaguucaucaucccauuuugcccaaagauuuuaagugugugugcccuuuucuguugggguuagccaggugagucuuggggaggcacaggcaaaugaaacagcaauauaugacuuugcugugguggcugcuuuggauauauaggcaauagugggacucagguggaaacuguaggugucucuuuacacuguagugaguaguugugcuaacugaugaaaauacuauugaaacucagggucuaaauuuugaagaugcaguuugaaagcucaaagcacauguacauuuucuuggacaauuuauagcuguuacagcaugggacacuccaaccaagaguagaacauucuuagauccaagguaauucuuccccaaagugaccaccguucugacugucacacacaacucauucucaguguuguuuaaguuuuuaguauaaagcauguugggcauaguguuacauaucuugaguuccagcacucaggaggcagagaggcauguggaucucugagucugaggccagccuggucuacuagagaguuccaaaucaaccagggucacacagagcaacauugccccagguguguguguguguguguguguguguaaaacaaauagugaaaggguguguuuugacaucuuucauuuguucauuuauguuuaugagauccuuuguuguugcugcaagacucauucauucaugucguccuauacuuauuuuucuguguguggguguuuugccugugugcuugucugcaccaugugcaugucuggugucugaaagggucagaagaaggcauuggcugucuugggacuggaguuacagauggucguaguguucuuaaaugcuugagcugugucuucagcccagugagucgaacuuugcuauucuggugguuguguaguagccucuaacauuuuaaauuuguauuucucugaggugaacacuuauuuagaucuuucuuguauaaguaacuuuguccaaaggcucuugucuuuucuuuguuaaguuacuuuguacucugaugagaauucugguucccauucaguguuuucucccauucugcagcuuccuugugcucuuugaugagcaguuggguuugcugcucuuucuuuauguuuagugcuuuauuugucccaaccauagaaagaaacuggaaccuuggucauguagagcuuguucuguagaugcucuguuguuuuacuuuucacauuuuguggcuuaaauuuauguuuuuucccucuaauugaucucuguguguaugugucucagugaauuuuauuuauuuauuuuaauacauuugcuuguauguuuauucaggugaacauauacuuauaugcuugccuuuugggagucuguucucuccucagauuggcaggcuuggugucaaggccuuuaccugcugagccauugugagugccccucacuuaguuuuagucuucaagaccugcaacagaaaucucagcagaaguugugaagcuagcagauugaucugaacccugagaugcugacccuuccuguugcaacuuagaguugugggggcuuuccucuauguucuuugucucauuacuugagaguguagugcugugugguguguuaaccuaccagucuggaucuggcuuugccacuugcuugaaacagcuggcaaagguuuccguggccuuccugccgaaggggcuggggaucuccaguauucuuuaacuguuuucaggucucaaauguauccuguuugucuucuacaucuguucugauuguuuacucaggugaacucugggacucuuauuuuuaauaguuuaauguauuuuaauaacaaacuuacagaagacagacgacauuaaaaacacguacuugcauguaggacaacucagaaaaguauagugagugagcggaaucuacuguaugauaaaaaugcuacaaacaccauuuaguuguugucaauaagaaauuuacuuauuuuuuaaaaauccaaaugcuggcauuguacagacaauuuuaacagguuuauuuauaauuguuauaaaguggagcuguugaaauguguucgccgaaacauucugcuugcauuaaugcuuuacaucuugcauuuauauuaaaaauucacacacaaguaaauguagagaaacugccaauaucugauucuguuuucuauguuuccacucgcaaucauauacuuagguacuuuugacuccauggaaaaaauaucuaacauucagaacuacugauaacaggaagaagaggaaaaacaauuuuuuuuuguuuugagaaugaaauguuuucccucauaguggacucuuaagcacuuucucugcauauguggcaugcuagcuggauaucuuuuggcauaauuuuuacacauuuggcaugguuagcacacagguugauaucuucaaaaaggccaaccagauaggccucacuugccuccugcaaagcaccaauagcugcccucaggaagcgcagaucuguuuugaaguccugagcaauuucucaaaccagacucugaaaggggagcuugcagaucagaaguucaguggacuucugauagcgucugauuucucggagugccacaguaccaggccuguaacgauaagguuucuucaccccuccaguagagggcgcacucuugcgagcggcuuuuguagccaguuguuuccuggguucuuuaccaccgguggauuuucgggcagucugcuuuguacgagcaaugguaugggcaccuccuuacuuacccuccuucuccuucggcuggagcuuggcaaaugaggcaaugcuggcguuagagaggggcagcccugggacuccuuuuuuaaccacuguaaaugaacacaauuugaauuuugauauugcugagaagugauagugauucuguuugguacccucugcagacaugaaugaguacaguggaggagaucugacuacuuuuguuuugcaaugcuccugccuguuuuuauuucguaucuaagaccaagucaauaucaguguagccauccuugccuucuuaguuuauccugcgguuuuguauauagaucaccauauuugauccuuguaauauccugugaaacacaguaguguuggaauuauugaagugaucaaaaugucaauagccuggaucugugcuuguuaggaaauagcuggcgcugccucugaugguucugcugcaugugcacguucaugugcugcauugccuuacaguugacggagccucuuggguuguaccuuagccuucugugccggcagugugggaggcacagccuugacuggcaauguuggugguguguguggugcuguucuuguaauuucgcuuauuaggggagauggcugaaguuucugucuccauaguaguaaaugaccggcuagaggcuuccagacuucucagaguucagcaggaaacagguuuaaaagugauccuguugucuuaaaaggcucugcuaucugcuaguaaaggacauuuggggaaaggaaacaguuaggaaaagaauuaagaacuaacuaaaauaacaggaguucucaaguagauaaugccaaugaggguucagacauagcuuguagauguucaacuuuuuugcacacaaacuguauggagugguuuccgauacuauuacuuaaaaauguuuuaugaaaucuggucugcagucuagguuggccuagaacuuguuugccaucuucuugcuucagccuucuuagugcuaagaccacaggaauguggcauuagacuuugcaugggguuuagaaucaagcuuacugguacaugcaucuguucucuugcugagugaaaaggaaguggagaucuaugugcaagagggaacuggggugcacucacagccucgggcuggguuuuuucauuuucuuuuuuuuuucuuuuuugagacaggguuucucuguguagccuuggcuauacuggaacuuacucuguaggccuaaaacuuaagagauccaccuugcucugccucuggaauucugggauuaaagaugugcacuaccaugccugacucaagggccuccuucuuagcuguugucucuucucagucuguccuuuguggaucugcagcagaaguuaaacuuugcgugccugccuaagcuuuguucuuagcuguauacacauucaacuccuggcuguucaugugagauugaaagcugaauguaugcaagacuccugaagcaccuucagaaaccacaagaggccauguggcuuaccuuugccuguauuaauaauuauucaggcaaggggucccagguugucucuggagggccuguaggccucccaggauguuuguucuaccucuucagcccaggccaggacuguucauuugcuuucagcuucacucuauaauuacauuuugaauuacuuguuuuucucuuccuuaacauaaauaauuaaaauuacauggcauguauuuguaggagauacuaaaguuggcuucuaagccagauggaaauuuuccuauuuuucuggcuugcauuaugcauuugaagaauguugaaccaagauguuuugggaagcaaauuacucuuguuguggacaggaguuggaaggcacugagggcagagcaguuacugauuuuucucaaaucccuuugccaggcaucagaagaagccucccucagggcguuggaaagccugaugacggaauuuuuccaugacugcacaaccaaugaaaggaagcgggagauagguaagugggguuuggggaagaaggaacugaucccuugguuggucaaaccuauaugugccccuugaauucuuggcugcuuugcucugguucauguugggcagguagggcuuguaaggcuugcacaccuagcauagugauuggguuucaugcuuuucagucgaggaaaagccucugcuuuguuccugaucucaguaguguuguugaaagaggcucaccauuaauucagaauaagaacaauuuaugaaagugucagaguggucacagugagacacaguggagucugaugagucccuagcuggucgaccucagagacuucucagucauguucucuuccuucucuuccuucucuuccccaccaccauccccauucugugguuuucaugaacaaaggcucuucaacagagaacauggagguguaaguacuuguugucuugggggccuacuuuuuugauuuuuauauucaguaccauaauaauguuaaucaagcacauuagaaagaagauaauuuauucaaguaucauaccugccucagagacaucacccacugugcugcuuaagcagucuuucuccuuugaauccuuucuugaacauucuucugugugugugagagagacugcucaguacucacuguauuguugcuucccuuuccuuaaggucuguccuugccucagaaccuuaaagacucauuucuguuuccauuggcuugacucaguuaaaccuccugguccagucuaaguaccacccaaagucguccccaugggguugagacuuuucaggugucuaggagaucuuugcucuagccugguuuugcuagcuuccuugaagcaucaugucaucugauagcaugcacccuacauaccuuucuuuucugaggaguacacgguagagaaauagaaugugucuagacaaagggcuaggagcgaggcagcgccugccugaggaggagcaccuugcuugcuaugcugguucucugauuacccugauuauccuccugcaccauugugaccuccucuucagguuuaugcuacuaacaugcuuacauuuauagugaaaaugcuagauacaauuuuuaccgaaauagacagaucuugcucuauauuagucuccuauaauuuuccacucugauucuuucgaacucuugucauuguaauagaaaugccuuugguuuuucuuugaacuuuugauuugcucaugaaacuuuguuuacauuugugcauuaauggauugaaaguggaaccuuguauaaaaucuucaugucugaaucaaacuuuuaugcagacuagggcuauagcucaguggaauagaauuuuucaaguggggaugcugugagaucagcguguuuugacagugggggaaugggcgaagaauguagaccaggguguugccaggaucaggcuuagggaucagcugauuugagcccagaaugucauuuccaguuauaacucacauucucugguuuucuugugucuuugaguuacauagaagcuuuuaauuaucaggacaugccaccaucuuucacuuucagacuuuuuuuuuuuuuuuuuuuuuuuugagacaggguuucucuguagcccuggcuguccuggaacucacucuguagaccaggcuggccucaaauucagaaaucugccugccucugccucccaagugcugggauuaaaggcgugcgccaccacgcccggcaagacuuauuuuuuuuaaacaauuuauguaugaguguuuugucugaauguacguuugugugugcauggaggaggucagaagaggguguaggauucccuggaacuggaguuguagaaaguuaggagcuguguugugaauauuggggauugaacccaggucuucauagcccuccuucuguagaauaauguuuagugagacugccgaguuguacuuaggguugcagggagcuggcacaggagucagcugcaguguugucauggcgaccuugcacuggccaggcuugcuggcagggaucauaguuagugcauguaucaagguaguuaauaggcauugugcccacaggcgaugguggguagcuaggcaauuaaugcuugcuaauuuugaguuuuagcugauguugucaggccugagagaaaaagugccauuuucauuugacuggauacauagucugggcugcucuucuaacucuuaggguuuuuacuuuuuaguuuuacuuauuuauuuuguauauguuguauuuuugauuggggcuguagagauggcuugugguugagagcacuggcugcucucccagaggacccagguucaguucccagcacccacgcacaugguagcucacagcuguccaacugucuguagcuccuguucuagaggacccuacacucucacucaguguaagugugggcagaaugccaaugcacaugaaguaaaaauacauaaguuaagaaauguaaaaaaauacuucuauuuuaugaguguaugacuguuuugcuuucacguauaucugugcacccacuuucaugccuggugcucaugaaggccaaaaaaagguguccaauucccuggaacuggagcuacagacaguugucagcugccacauggccgcuuggaauguuaguuuucucuuuuugcuucucuagccuucaugucagugggcauguggauaguauagaugucccugaagaauuauagaauaugaugguguguauugcuuaucucugugggggcuaguuguugucauuuuacauuuuacauuuuggaaaggauugcuaucucacauagaguuuaaauaagagcuugaacaauggucuguguucucaaaagguaucuuuaggaaagcuagcgaccuugauggcaggguccauugccuguguugggucaccccagugucaagaguaucccauaaucccuucagguggguuuugugguugguuuuugaacuauuuguauuauguggggagguugguauguuuuccaaaugguggcagucuggucuuuguauuaauuuuauauauuuuuauagacuuguuuugugcuauuuaacuuuuccagaggagcuucuuaauaacuuugcccagcaaguaggagcuuggagauucugcuuauauuuucuguccagcacaaggaaugacuauguaaugauguacagcuuaacgguuuuugagguaaguuguugugucguuuuauauuccugaaaaucacaguggaauuguacacuauuggcaccagguuuucgcuguaguauauagaugucugagaagcaguagguugacccucccacguggcaccuugugucuggggacaucuuuugagcugugacuccaaaaagaugaggaaggugguugacuuuucuugucugcuggguaggucauaguuggugacuuaccuuuuuccuuugucauuugaaagacaaagauagcuagacacauuggauggaguauuuguauugcuaccaucuuccagccauggaacuacucaugcuaacucucguccaagcuuugucugcugggcaugucacaucaaccucuuuuccacuguccuuucugcuauggucugcaguacucauuaacccauuuguucuuuaugggauagggagugguauuuugguaauuaucucaggcuggcuucagacuuaccacccaccagccucagucucccaugugauuggauuacacaugugugcugucaugucuggcuuguucacuuauauuugaacauuacaguuguuucuguuacuauaugguggccagauggccaauaagacauguuggaaacaaugauauaauagcaaguuuuuauacauacaacuuacuguaucuuaaauuguucaguauaucuuccuagagauaggagagaugagauuguuuuauccuaagaauuucuuuuucuucuucuucuucuucuucuucuucuucuucuucuucuucuucuucuucuucuucuucuuccuccuccuccuccuccuccuccuccuccuccuccuccuuuucuuuucuuuucuuuucuuuucuuuucuuuucuuuucuuuucuuuucuuuucuuuucuuuucuuucuccuccccuccccuccccuccccuccccuccccuccccuccccuccccuccccuccuuucuuuucuuuucuuuuugacaggguuucucucuguagcccuguccuguccuggaacuugcucuguagaguaggcuggccuuaaacucacagaguuccacaugccucugccuuuugaguguugggauuaaaggcaugugcuaccaccguccagcuuguccucagauuuuuuuuuauuggauauuuuauguauuuacauuucaaauguuaucccuuuuccugguuucacuucugaaccccccaccccccaucccauccucucucucccugcuucuaugagggugcuccuccacccacuuacccacucccaccucacugcccuggcacucucuuacacuggagaaucgagccuucacaggaccaagggccucuccuauugaugccagacaaugccauccucugcuacauaugugacuggagccaugaguuucuccuuguguacucugugguuggugguuuagucccugggagcucugaggugggaggagggaccugguugguugguauugcuguucuuccuaugggguugcagaccccuucaguccuuucuguaacuccuccauuggggucccugugcucaguccaaugguuggcuuguccuaagauuuuaauauuuguguuuaucauuuugcuaaauguccuaaacuguuagagcuagguagauguguguguaugugacguuacagguaauuauagaaugaaaaccauucauuuuguguaaagcucauuaauuuaaaagauacguauuuguuuuucagaaucuaaucaauaaaauguggcuuggggucccaucucaggauaagauggaaauccguagcugcuugcccaaacuucucuuggcucaccauaaaaccuuaccuuacuuuauucggaauaaacucugcaaaguuaucguugauauuggacgccaagauuggcccauguucuaccaugacuuuuucacuaacauuuuacagguaaggaucuaccugggggaacugucauauaaauuguucgcagagggauuauaucccuugacuugagggguuuuauaguuauucuuuggggcugcaguaaguaguaaguguuguaggcuggauucauacauugucugucuuuauguucuguagcuuugcauaguggaggagagagggaguggagggagagugagccuaguuacuuccuuagcaccugugaaguuaguucugcucagcaggccucugaaggccuggcuccugauacgauggcgauggcggugaaaggaggguucuagugguuucagaauugucaggaaauaaccacaaacuguaaauagccauugauagaaguauuguggaauguuugcugcugggguguguguuacacagccuugggauugauaaacaggaccaaaccgguuuuagaguaaauuucaucaucaggcggucguauguuagcuaucuaaaguuucuuuggacucaguucuaccuugauccauuggcagucaagaguauauugugauaguugguagggaaucugcaguuuguguugugaucagccuccagcucucugcagguugcuuauaccuuucuaggacauugggaaaggaaguaauaaggugagacugaccaugcuccuccccacccuguagucugugggucagugccccuuuuguaaggucguuccucagauuucugaagucugcugagccaaaccuuuggacacauuuuaccuaaggccagauuacugagaaacaaggguggcuacuucuuccccaauagguauguaauaaaaacggauggcucacuagaaaccuaaauuugaucugcagcucaaagguacuuauugucugcuaagucagaugcagaagcuaaguguguuuagaauuuuaauuauauauuaauugccuuucuggauaaaagaacaauaaaaaugaaaaauuaaauguuuucuccaguuuuuucaaguaaaggauuaugugggggcaauuaaaaaaaaagucuacuauaauuaguuccuuaguuuucucucuuggagacagaauuucaccacugugcuauuuagccgggaaguagcagagaucuaucugccucugucucuguuucccaaugcuggacucaaaggugugugacuccauucuuacuugcuugacacauucucauguuuuagccuuuacuauauuuuagcuucaaaacaaaaccaaaaaacccaaaacugucaacaguaaaauuugcucugaaauguuuccuuagguacuagcuagcuacaacugugucuuggaaacugaaacuccaaauauuuagugaguacagauuagaaguaguucccaaucacccaaagcagcuagaauaacggacaggaaagaagaggcccgagaggcagcugggaaagcagcugcagaggcaguccagcggucuccaggaagugcccuugcuuuagaggaggugggaaggucacacugccacauucaguuaauucauugagcuucaggaaggaagaaguuaaagucagcuuggcuuugguuuguaacccagcugggaaccuuguccuagcuuugaaccuuagaaagguggaaccuuguccuagcuuugacagaaugaggucuaagaucaacccugguuagaggucagggaguuaaaaggcaaacaaccagguccaaacucuuaaggucucagaagugaggaagguucucaaaagcaauagaaagggagcgcagagagugggagagcucugcuagcagaagcuauaaccagacucgcuucugcugagaguccggcuuaagggcaucuggaugaugaagggaagggaacgaauguccucucccuuucucucucuuuucaucagagccugguauccucuauaggggaaguggauuagcuuuugcacuuuauagauuauugugggcgguagcuaggacagugguucagucauucuguuuuguuuuuugagacaggguuucucuauauuccuggcuguccuggaacucucuguagacuaguuuggccuugaauucacagcugucugcuugccuccaucuccugagugcugggguaaaggcaugcaccaccaccuaccacuuauacagucuuaugaugauuuuuaaaaagauuuuuuagugugugcacaugugcccucugaagccagaagagagagaguguuguauccccuggaucuggagguauaggugguggugagccacuaaugugggugcugggaauugagcucagguucucuggaagagcaauaugcucuuuuuaaaaacuuacuauuuuuaauugguguguauuugcauguaucugugagagacugugugaaugcagauacccuuggguguggcaucuucuggaacugguguuguaggcaguuaggagcaucugguauuuguguugggagcugaacuggguccucuacaugagcaguaagugcucuuggacauggagccauuucuccagaccugcuguauauucuuucacugagccaucucccuagccacucuuaggauuuuauugaagauguggccuucuucucugagcuuuuuauuucuucucuguuaguauguuugucaucuacuagcuuuuaugaacuuguggaccaugugcaaaaagagguagguccagaaggucagcaucaucgucaugguguugaggugguacugauggaaaaggccugagugagcaagcucuagugggcauaccaggguguggugcaagaaccagagggcaaggaggccugccaggugaugaugaaaacaauggcaaagaugaggaagauguuacuagauauuuuccaugcuguguaauuaaaacauuuuggcugucucuggcaggucaugagaaacccaugaugguaagggucacugcucagaguugacaaaccgggagaaacuaagaagaaugaugguggccaccugauagaugaucuguuucuuaaaauucaacuugaccagggaacaguagaauggaaguugagccauguaguauuuucaguccugggaaaaggggugaucccaaaucggguaucucuuccaaacuuuggccaugccuuagaaucaggguuuagccucagggauggccauguuagcacaaagggaaccagguaaaauugcuucugaguacacuugagaagacuggggauaugggccagucuugaguguaacaguggugggaaucaugauuauaccugguugcugagaguucucuuugccaagauaaaagcuccaccccacuuacuugggcugcuuccacuggucagggagaggugccucacagcuaagcuacuucaccauucaggagggcagcugaugguauagccacauaaagcucaaagagguaucagaugacaagaaagagcaaggccaggaguagugugaugucuggggcuuugguaccaacuccuccaucucagucuuccggacuggcacagguuaauuucacugcagcuguaagcauuuccgucaaaugugaucauguaagaguuggagcagaguaggcuagccucgaugggcucuguuccugugugagcugcaagggccacauguucucuugguuuuguccucuugccagcucccuccuuuuuccuggagccagggaaccagccacagucaaggaaagcaaagaugacuuacuuccuuuuuauuuuuauuugaaacagggucucauguggcccugguuuguuuggaauucucuauguagaccaggcuggccuuaaaccaguggucucaaccuucucaaugcugugacccuuuaauauaguuuuucauuugguugugaucccaaccaaaaauuauucuuguugcuaauuuagaacuguaauuuugcuacuguuauaaaucacaauguaaaaacaucuguuuucugauggucuuaggcaacuccuaugaaaagggguuucgaccuguugguugagaaccaugauuugaacucauggagaucaaucagcuugucucugccugcagagugcugggguacaaggaaugugcuaccacaccuagcaagagugacuuuauuaugucuuauguccuacguguucagucuuuagcacuaccaaaaaagaaaaaaggucaugaagaaugaauuccuuccuugcuaacuucucccucaggauggaaccuagggccauacagugcuaggcaaaccgucuacuauugagcucuagcucuuguuagauuguuuguuuguuuguuuuuuggagacagggucuugcuguauaguccaggcugcccucaaauuuaugaucuuggugcugccucuguuuuccuagugccuagaugucuaggugugugccaccauuccuagugauggcuuucuuuuuucacuggauuucuuaccugugcuuucuuuccuuugaauaaagaaaggagauuuaagauggauuuucuauauuguagaggaucugaccauaugugaggagcacagaggcauuucauaucuaaaggaaagugaguaacugaguuggagagauggacauggauggcuccuaaaagcacuuacaggagaacaagguucauucaguucccaguauuaucacuggccucagcagucacuuggacacuugugcauauaaauucauauaggugggcacaccugugcacacauaaccacauaacacacacaugcaccacacauauacacaaaccuugaaagugaauguugccaaguagaucauuuggcagaauagguuuauucaacccugaaagauuuaagugcuuaggagcuggggagauggccaguggcuaagaggacuuguugccagaguccauguguuggcucaucacuaucuauaacucuaguuucagaagauuugauuccuuguucuaaucugagaggacacuagguguaugcagugcaggagcugggcaguguuggccacgacuuugaucccacccagcacucgggaggcagaggcaggagcauuucugaguuccaggccagccagggcuacacagagaaacccugucucggaaaacaaaacaaaacagcacauaggcaaaauacucacacccccccaccucacucgcacgcacgcacgcacgcacgcacgcuauucuagugcucaguugaaaauagagaaagaaaagaaaaagguacaaggaaggaaaaaaaaaaucucaggguaggguugacaucccagaaauaauccacacagagagccuuaaagagggugucucuccuacuuuauuuuagccaaaaguuauaccaaggcagacauuauuugaauguguuagaaauaauaaaauuuuguauagaauggagaaaauguggaggguguuuuuagaaguuuuaacuuucaagagagguuguuuuuauagagagcagcucccucccucccuccucuccuuccucuguccuucuuuuuuccuuucucuuuccccuuuuuuuuuuccugauugguucuuggguagacuugugaauucccaccugcagauugcugagauuauagucaacuacuggcuuucuugggcugcuucugaguauauuggaauugcccuugaauuccauuacugaauuuaaaacaugauuugaaugugagaggaaaagagggaaggaggggagauggaauauguaugggcacacagcagaguuuaggcccuguugugguagcuuaacuuccauugugaguuuugaacuuugucuaggucaucugucuuguguggcaagugcuuuuaaaaaaaccaaccaaccaaccaaccaaccaacaccaaaaaccaaaaacugagccaucuuguuauccccugguuguuuuucuuacucuucagggauggauagacauuucuguagucuaugaugggaagagagagcuaacuuucuggggaaaggauaguauaccuuguguugguagaaguaaagaguaugugguuugucuugauaugauuccuaaaugaucucuuuucugaagcuuagaaacgugguguagugcagggaaagcacagcagggaagagccacauuuaaaguugcacaugcuugaagaaagguuuagguguucugaaaaugguuugcuuuuuaauuguggcaaaugcuugucuaccucugaaaaaguaacugcucacuuuuaaugaucuuguugaauuuuuuaaaaacagguaggaugcuauaaguagugucaugcuuuugaaaguguuccuucuccaucucuuggugcagacaguauuacagaggauagaaauaguuacuuaauuuauuacaugaguauuugcaaaacuaacuguagcuaggcaugccuguaaucccagcaucugaggggcugaagcaggaggauggccacaaguacuagaauagcuugggcuaccuaaaaaguuucuaaaacuuaugaccaugguaguugcuuaucacagauguguuguucugccacaugguucuuuucuuuucccuuuuuuuuuuuuagauuuauuuauuuauauguaaguacacuguagcugccuucagacacuccagaagagggagucagaucucguuacagaugguugugagccaccaugugguugcugggauuugaacuccggaccuucggaagagcaguugggugcucuuacccacugagccaucucaccagcccccuuuuuaauuaaaaauuuugagacuacuaugugguccauguugcccuuaaacucuuuuuaaaaaaauuauauugucuuuuuugguaagggaaugguggauaucuuaacauguauguggaagucagagggaaacuuaaaaguuguuugcuucuaccagcugggucccagugaucaaacuuggauugccagccuugguagcaccucugccuacaguuacugugcugucucuuccuuuuuuuguuucuguuuuuuuuuuuccccagacaggguuucucuguauagcccuggcuguccuggaacucacucuguagaccaggcuggccucguacucagaaaucugccagccucugccucccaagugcugggauuaaaggcgugcgccaccacacccagcuagcugucucuuccuuaaauucuugauuugucugccuuggucucugacugcugggauaacaaguuuguuaugccacuuguuaugccacaccuaggcuugccucauguuuaauucuaaacuuucuugaaacaugcuaggucaaaaauguuaagauguagaacuaugaaguugauauaaugugaauguugaaaagauagcacaaaaagauacacugucauuaucauuaguauguaaaauauuuguauuacugccaugcauaucaccaugguguccgugacagggggauguugugaaaagugcaguuagaugacuaccauagaguaugcuugcacacaccugcgugguagauagaaccuauuuuguaccuaggcuguaugguguagcuuguuguuccuccacuacugacuuugcaccagguaucaccauacugaauacuacagguaguugcaacacuauguuaaguuguuaugugucuuaacuauauauaaacauggagaaacuacaggaaaccuacuagaagauaggaauuuuucuuuuuuuuuuuaaucuuuuuuuuuuuuuuaagauuuuuauuuauuuauuauauauaaguacacugucgcugucuucagacacuccagaagagggagucagauuuuguuacggaugguugugagccaccaugugguugcugggauuugaacuccagaccuuuggaagagcagucggaugcucuuacccacugagccaucucaccagccccagauaggaauuuuucaugucuaguguaaucauaaaagaccaguacgucuuuuaaagguccaugcgguuugcuuaugacagaauugucugucauucaguaugaguaucucuucacguaaccaaaacuugguugggaauuuauuuagauuuauacaaaauuuguccuguuuguauaaagacaggguuguuuccagcugcuuuuuaaguuccugcugguagaauaugagaacuugagaauaaaauuugaaggguuaguaaagcaaaguuucauaaaugacccucugaauucuuuuucaaaaguguugcuugagguagucugcucauaugaggcucaacacuucacuuuuaguugaauuuuacuaauccucuuuguagcucauuaguucuauucugcucagcauuugcuuuuuccugucaguugauccaguccccugugacaaccccccuuggacugaucaugcugaagacaacuucggaagagcuagcuuguccacgugaggaccucagcguggcucggaaggaggaguugcggaagcugcugcuggaccaggugcagacagugcuugggcucuugacaggugagugagcgcuuugcuggugccuggagacagguccacugcagagagcucaggucuucuagguauuaucgacucaguguaaaugugggaagaacuuaguucugguuucuagcacucagggccacagucuagugcaugguaaaaccucagaggagauuuauaaguuuauuuucuaagagucuuuuuuuuuuaaauugguccucacucugagguacauauauaggccagguaguaggaaugugauucucaugcugauaguguaauuggcguagguaaguggcaagcucuuuaacauaauuugaauuuaagauuagaaguaggaguagcaagaugaaaaaaauuccucuguagaauagugagacgagucuuacccguugcccuggguuguaguuguauguggcauuucaucucagcuaucugaucagagucugacagugugcaaggggaaggagggggagaagccuaucacacagugaggcaggaagguagcaagaacauccccaaagacuggaauguguuguagaaauuauuuaaucccaacuccaugucucuaccccaccuuugauccuuuaguuccuggauaaaagacauacaacuguuauuauuuaccauaagccuuaaacaacauaagaacagggcagaucuacccucaauguuauucaaauaacuuuuuaauugauaacucugaguuauuauuguguguuauuaucuggacuucucuuaauuccaauuggccagcccucagggccauguuuucuugauuccuugacccauggugucucuuuuucuucuuucaccuuuuucaaucucuugguucuccuccaacccccaagccugggaacccucaacccagccuuugucucuuuugcucagcuacugggcccuugaggugccuggaagccacuacuucuuaaguccguagugggaaggcaugacuuacuccaaguuguuccuuuacuauuuggauauucaggaccuguuuuuauuucuccuuuugugugucuguuuuaggaauuggcaucugguguguccuuuaaaaaauugguuaaaagaaugguugcuguggugaacuuguugugugccacacacgcacucacgcucccccauuucuucucuuaaucccagguggaaacucaagucuuagagcaucuauucauucagaguacacuaaacugaugucaacuggacauuaaguuuauauagucagggacaugucuugugcacuugcccugcauuuuaugccuuuaaaaacauauaagacauucugagaacaggucuaggacaggagcuguacaugcccacuuuaaacuguggcuguucaggggcuuaagugcuuuugaaaguccuacagcuaccuuuaaauccaaaacauuuuuuaucaccucagaaagcaacccugaguccacaagaggucacaguucuucucuccuccaguccccggcaaccacuaaucuacuuuuuguccauagggauuugucuguuuugaaccuuucauauagcuuuauuaucauaucauauauaucauaucaugucauauggcuuucuucacuuaacaggauucucuagguuuauccaugcuauaacaaguauuuggaggggacaguucuuuuguuuguuugcuuuuagacaaagucucacuauguagcucuauccugcauggaauuuacuguguagacuaggauggcuucaaacucaaagagacccacauuccuuuugccugccaaguccugggauuaaaagcuuguaccagcacaccuggccuucaggaauuuuuaugauugucuguugugacgugguaugccagguucuggcugggggcgcaaaggaucaagucccaugcuuugggaguuguaguagauggaccauguggagguaaaacuaagcuguuaggaagacuaccugggaccuaggacagcugaguggaaauggaaaggacagacagguagcagucaguggaaaggacagacagguagcagucaguggaaaggacagacagguagcagucaguggaaaggacagacagguagcagucaguggaaaggacagacaggcagcagucaguggaaaggacagacaggcagcagucaguggaaaggacagacaggcagcagucaguggaaaggacagacaggcagcagucaguggaaaggacagacaggcagcagucaguggaaaggacagacaggcagcagucaguggaaaggacagacaggcagcagucaguggaaaggacagacaggcagcagucaguggaaagggaaggcggagauuuagaagaagggagcagagugguggugaggaaggagguugguguguauugaagacacagcagguggaugugacggucaguauugcagaagacuggaucagguaccguugggaaacagggcauauagaggucaggugccaagaucuaugggcugugcuguuuaccuagugccuuaguuaggguuucauugcugugaaccacaggacagagucuaggcuguuuaaaccucuuuagcccuacacagauucuucagacaagggcaaaaaacagccagccacauucuuuaccaaaaugucacaagagugauuucuaaaauucuuugaaaccucuugagccaggcccccacuguucaauucacccucagcaccagugucuucuauauuccuacuaggauggcccacuaacccccacuugaagcauuccacugcuuuuuuaauccaaacuccccaaauccacguuccucuuaaaaacagacaaacaaacaacaaacaaaaacaaaaagcaaaacuaaaaaacaggccuaucacggcaauacccuagucccugguacuaacuuaugucuuaguuaugguuuuacugcuauguagagacaccaugaccaaggugacucuuaaaaaagaacacuuaauuggggcuggcauucagguucagagguucuguccauuaucauggcaggaagcauggcaauguuuaggccuauauggugcuggagaaggagcugagaguucuacaucuugauucaaggcagcaaggaggagacugacuuccacaauaggcagagccugucccuacagugacacuuucuccaagaagaucacaucuccuaauagugccacuucccaugggccauguauucaaacacacgagucuauggggaccauaccuauucaaaccaccauaacccguaagaaagguguuggggucauugguagauuugcagggguaaaaagcugaguuugggguguguaaaugguuugacucaggaagcauuugacuauacugaucugugacuggauuccuuaccugcuuucauguaacaguugagcuuguauguagagucaaaugaguuuuggacugggagacauuugguugaagccacaacaguagacaguuucuccaguagagagaguaaacuaggagaagaaggucagugaggaaaguagaggaaugauaaacauucuaaauggugacugggcagagggugacaguaacgauggaugacagaggcucagaaccagagaacagcugagagaaaagaaggguuucaguaguguccuagaacaccaagaugacccuugguagauguagugaucacgagcaagguuggaaaaacagugaggagaagccacacugcaaaguccagacggagcaguagccaugcugcacugggacagggcugaaaaacagagcuggagacaugguugaguggcuaaagcacuuggugcacaaaugaggagacuagaguugagauuuccaggacccacacaaaugcuggcugggaaaggggccccaccuguaaucucagccucagcucccagagcaaguucccuagggauaccaggaaagaggcccugcuucaaaagaguaagguggaagagcagucaaggaggagucucagcaucagucuugggccuucacaugcacaugcucauauacacgugaacaugugcaccacacacagagaaagggauaugugaauauugguguuugauuguggggucauguuuuuuaauuuugauuuuuguauguuggaguuaguaucucucaaauuguuucuucuuuuuugguagguaucuuggaaacugucugggacaaacacaguguuacugcugccaccccaccaccauccccgacgucaggagaaagugguauggucugcugccccuaugguauuucuggcuaaaugcagcuagggucucagcugggaauugcaguagcuaaucuagcgaggaugcagcuguucauucuuccuaaucuuuucugccuuucugcuuauguuuucugaggagcuagcuuucuacuguuuucuccugaauauuuguacuuccuaauacaguauuuugaacagcacauuuugcuucuugcuucucugucaugaaggagacaccuuuaauuuugugcuauucacuucuguucugccaauuuauuauuaaaacuuuuuuuuaaauuuauucauuauauguaaguacacuguagcugucuucagacacuccagaagagggagucagaucucgcuucgggugguugugagccaccacgugguugcugggauuugaacuccggaccuuuggaagagcagucgggugcucuuacccacugagccaucucaccggccccuuauuaaaacuuuuuacacuuacuuauuuuguguacaaugcccguguagaggccagaggacaacuuucagaagcagaggaucaaacucagguugccaggcuuggcucaaguaccuucugagcuaucuugccugccccccugcaguuuauaauuaccaacccuucuucuuuguuacaucuuuguucccuggcuguuuuguuuguucugaguuuguuauaugcugggacuugagaugacuauugacugggacaaaggucuuauugccagggcaaauugaggaccagugugcaguguguguugaguuuacauuauucauguaaauaauugaggaaguaagaguaauucaaugaagucucuaaacuguggguaagugaaucuguuuacaccagauggcuacagaaacuuuccagguggagcacagcccggggcuagcacuuuucuuucuguccaguaaaagcuggugugauaauaagagauauuuuugcauuuccccauucucuuuaagaagugagauguugaauuaaaccucuaagcccuaggcuguucaaauagcuuguucuugguuaggguuuuacuguugugaacugacaucaugacuaaggcaagucuuauaaaggacagcauuuacuuggggcuggcuuacagguucagagguucaguccauuaucaucaggaugggagcauggcaguguacaggcagauguggggcugaaggagucacuucuuauucugaaggcagcucugaagacugacuacuaggcagcuaggacaagggucuuaaagcccacauccacagugauaacccugcuccaacaaggccaaaccuccuaagagugccacuccuugggccaagcauauacaaaccaucucaacaugggacuugggauucuuguagacggccuguagaacuaagaacacacuaugguuuugaguuuagggcuauucauagaacgcuacuuuucaaucugcguaucauacucagauuaaaaccauuagucaguuuucacaguacuuagagaauucuagaguauauaucaagccuccaguaaugugugaacuuugugcuuaguggcuaucuuuagguauuuucaguggcucagcagauacacauuuuucaguauuugaaugaguaaggaaaaauuuugcagauguaaagagaagugaaguuuuguaguaagacuuaaauuuaaaaguugaagcuuucagaacagguaaugcacucccuuaugcucggcagccuauagcacucuaaucaucauggugcauguguggccuuguucacuggcgcgugugugccaugaugcacgugugcaggucagaggucagcuuuucacuucccaccuuacucagcgcaugcucucuuguuucugugcugugcugcacauggcaaacuagcuggccccugagcuucuaagugauucucuugucucuaacucugaacuugccauaggagugcuagaauucuagauguguagacugcauauggcucaugugguuucugggaauuacucugagguuguuaggguuccaugggugauucuucuacccacuaaucuauuuccuuaacuuucaguuuuuguuuuguuuuguuugcuuguuuguuuuugguaaacuagcugugccugccucugccucaucagcccagcagacagcuuuguugguucucuccuucuaccauauggaccuuggguauugaacucagauugucaguacuguuaggcuuggcaggaaggacauugacuuuuugagacauugaauccccacuuuguuugucugugugucucucuauuugucucugugucugugucugugucugugucugugucugugucugugucugugucucccucucccucucccucucccucucccucucccucucccucucccucucccucucccucucccucucccucucccucucccucucucacaguguguguguguguguuuaauucccuuucaagccuguucucuucauucccccuuucccaaaacagacaaacauuuaacuguauauaauguguggccucuuugugaaaacugauugguguccauauauuuacuguguaaauaauaugguaguguuguacucugaugcuggucugaccugugccuuuagacacaaacuucugcaagguuguuguaugagguacauguccucaguauuuuguuugucuuuuggcuucacugaggagccuagauugucuccagcugccccuauacgagagccucuaucugucccucauagaguuguaugagaauugcuuugaaauaugcuaggaguugacaggauuccagagggccggauccuguggcagagcugugugaguacuccuguagcuucccuugccccaagugaccguuuggcaguagugcgauuuuucuuuguugcauguuagauugcauuuucuaaugccaagcucgacauaucuucauaagcuagcugaucuuuugcauuucuuuagaaaauuguuucuucauacccaccaccuauuugaguauguagaugcuaccagugguaggcaguaguucuuaauguuugaaacuuuaguucuuguugguguuaggaauugugguugacuucugauaaugcgaugucuucuugguuacauccuuuauaucgauaagaaacuauuauuugaugauauguuguucaacuuauuggcauuuuuuuuguugagauuuguguuuugauuguuuuaauaaaccuucucuuacuguggucagauuuucauguuucauucauuuugucuuaugaaguuuugucuuugguuuaagccuguaacucacuuagucuguaauuuuauauuuggcguuuugguauuaucuuuaguugguauugaauauuaaagcauauugguuuuagguuuugcuuuuauggugacuaaaguguuuugggaaaaggagaauucauugcaguguuucaagagguuugguacgguguguuguaaaagcauguuuugaauuuccaggugauuuacugaguaaccuguugcagaguccuaguucagccaaacugcugcaccagcccauccccauccuggauguggagagugaguaugucuguucccuggccuuggagugccuggcccaccucuucaguuggauuccucugucugccagcaucaccccaucccuccucaccacuaucuuccacuuugcucgauuuggcugcgauacccgggccagaaagauggcaucagugaauggcagcagccagaacuguguuuugggucaggagcguggccgacuuggggucuuggccauguccugcaucaaugaacucauguccaagaacugugugccuauggaauuugaggaauacuuauugcgaauguuucaacaaaccuucuaccuccugcaaaaaaucaccaaggauaacaaugcccacacggugaagagcaggcuagaggaacucgaugagagguaaugagaacaggcgggagucgugcccgggaaagggccuggcugcuugucacaccaugucauguggugucuguaauccccuuugguuucagaauaugggcuacugauaaagauagaaagguagguguuucagaauauucaggcugaacuagaaggacuugggugguuaagggaagugaaccaagugugaaagugcugguguaguguguagaccuguugucucuuuccccauccauccuccuccuguccuguccacgcucugucccccuuccucacugucugcugcaggucucaugugcaggaagugagagugcggcuccuucauaggcaagaacagaagcggucugcagagguacaggguuacaucacccuucucacuugcuacugcuuuuugguuuucacuguuggacuuguccugaguggguaucuugcagaguauaugaacacucuuacuauuuugaguuucacauaaauaauagcuguugauccaagacgggagacaucuucggguagguaugguuuagcggcauagacuugaauugcauugcuugguuacucuugaccuaaaauuccccaggcccauuuuucuugauuacaaaagaugaccuuagugaauuaaguagucugagucaagguuucuuuauuaccauugcaggugauauuaucuguuuaucuugugguuuucugacucuccccuccaccuccagugguccuaggaccuugugucugccaggcaagucuuccugccacacagaacacggagugugcucacgcagcguagaagugaggcuacagcaucuucuuugcaaaaccuggugcuacugcuauauaaagaugaagggcaacuggcagcuugugcuucuaacagucaugugcuguugaagcuucaaagcauuugcgguguauuucauuaguaaauaguuagagacuuccuggugcaaccugauuguuauuaagugauaagugagcuuaguucuuugcuuuguuuagaguaagugugguaggcuguaaagucagcugccccaagucaagauaguuuuuguuguuuuaaaguggggaguucuaaauuuuucugguuaaaaauugaguggaagauugguuugauuugauucauugugaauaagcuuuuuguaacauuuguuuuuuauaguacuuauaauaaguacuaauauacucaguccaauaggaucuuuucuuaauaacauuucuauuuguuacauuuauuuauuuugugguuggguauagguacacucuguguuguguguguagaaaucagaauuacuagaauuggguuuuuuucuaccuugugggucccugggggucaaauuuggauugaucaucaguuuugcuaguaagugccuuuaccugagccaucuuuccuccacccaguaggauuucccccuuauuauuuaguagugccuuucuguuugaauuuaaaugucucacaauucacacaauuucauauccuuucuaguguugcuaaagaaaggccaucugucuucauauguuaauaaaaaugucuauaacugcuuauaccaacuguguuguuuuggcuaguccuggauccgaagugaaagcugagaggugccuggaagcagaaaggugacagaaaccagugugugcuugcuuccuagcucuuggucucuaacuaauucuaaaccagguggucagcuguuuagaagcugcuuaaccggguccuuggcuuuccucuucuuccugcccuugucuaacuuuguucauuagcacauguaccaggagggugggcauggggaaaagugaggugcaagcacaccccuagugucagcauugcaggagccuaguucuuguuuggguggggucccuuucuuuuugggauuugcuguguagcucagcguggccuugaacuuguggcaucccuccuaaccuagcuuuacuggguuucuaggauuaacagcaugaguccccauauauagcuugcauuuuaaaauuucgguugaagauuaaaguaaacuugagaaggcuggguacuuuucuuuuaugguuaacaaguguaauuucuuuaagaucaguaagcuggcuggcuguugccccugaagagccauguaaaaccauggagcaauacauaugcugaguaagaaaugaggacuugcugucugucccccaggagucccugaagguugcagagagaagguccuuuguacuuugcuuucucaagaucgguuuuagugcugggccuguggcucacauuuguaagccccagcacuggggagggagagguaggagagccaggcaggaggaccaccaaugguuugaggccagccuggucuacauaguuccaggccaccuagagcugcauagcaggacccuguuuuaaaacacaaaaaaaucccaaccagauuacuuaauguuuaaugccuuacauuuuacguauuuaaugccagacaucuagagggcaggccggaggguuggccucacuaagggaguaggucccaggaacagcaggagacuguggauuucugggccaguuugguucuucugaaagaugguugucuuuuucccuuuugcuauuucauauaucucugcuuucugcaguuaaugauuucagaauugcuuuuacacaugaggugauauucagcugaggccuagaaugucuagauauuuuugguuucugaagugggaagucauguccaucucacucucuaaucacuuuugguauuggggcuuaaaaugccagguucuguguguuuaguaacagaaaucccuuaccuuguaaccaugacugacucauucagcugugaagugacuuggggauuaugggugaacugaggugcacaggaaaggcacugcacagagauagcauccucugcugggugguggcugagggaucuuggugggucacuucacucuuggaacuucacccacaaaauagaagcaugagacuaauugccuccuuauagccuuccucccuuggaugugcaguucuucaugaguucugggugucaaaggggaggacagaaacuggauugugagccucacuguauuuauguagaugcucuccucucuagauagacuuguucuggcucugcuuagugcauuuuaacuucaugucagcucccaagcaaagaccugauuguucuagguuugccagauuugaagacacucucaucuccccagcaccuuuuaaaggcaacucuuuucccuuaagugggucuuagcacuaguguguaagaacauaugggagcuugaguuuguaucaagcaggggcagauagugucugaggauuaaagcugcuuuucugcuguguuucaggugauaauggaaugaaggguugccugucucguagguaauuguugcaggccuuuguguuuuuaacuggaaauguauguuuguauaguucuguacugagaaagaguuugauugaauuuaacuuuucuucuaaaaagguggcuauauuucuuaugucauccuuuuucuugucuuguguaguuacauugagaaguuuacugacuuccugcggcucuuugugaguguucaccuaagaagaaucgaguccuauucccaguucccggugguggaguucuugacccuucuguucaaguacacguuucaucagguaaagcacucacacugacuuuccuuuccuaaacagaggccuuccuucuuauuucuaggagaaagacucccuuuccuggcauuuauacuggacuuuacuauaggaagaguaauacauucaauucagccuuuguaagagcccugugcuguuacuauuuuuccauauaaucucuauuuuauagguaaagagacugaggcacagagaacaagguucuggggacauauaguucuguguggagccaggcuugaaaucuauagucccaucucauuguugugcuagauaaacaggauagaggaaaagucugagguuagggccuuuaaaauauuaauuuguuuuuugagguuuuaauauaauuacuucauuuuucccauccucuucuuuccuuccauauaccauugcuuguucucuuucaaacucugggcccuuguuccccaaauuaauuguuguugugguugugguuguugguguaugcauuuguguguuccuaaauacauaaaggguuuucuuucuguuaugcagcugcugcuaaaguucuuuaaaaggcuauaguaaagcacucacgaguuaaguuugaaugacacccaauuuuguccccauuuaacaaauguucuuuugaguuccuuuuagauuuuaggagcaagauacauaaccuucuacauagcccagaagggccuuguuugugguaauccuuucagccucagccuccuugaggacuaugaguauacuuauuuauuagccuuucuggcaaaugcuuguuuuuacugauuuugcaccccaguuacccacuacuguguaaacacacauaggguucuaaaacacuuuguugagguacaguuuuacacgccauagaauccucucccuguaucugacgaucucagugaguugaguauucuguugccaucacugcagucugcuuucaauacuccuuuugccuguuuguggucuuuuguuuuugguuuuuugagacagguccuggaacucacuuuguagaccaggcuggccucaaacucagaaauucaccugucucugccucccaagugcugggauuaaaggcgugcgccaccacugccuggcuuguuuguguuuuuaaaacagacguuucauuaaaguaugguaugcaucuuaguuacuguugcaugguagggcacuaugaccaagacuuuaaaaaaaaaaaaaaaaacaaaacguuuaauugggggcuuacuuacaguuuuagaggcgcuugaucauaucagggaacaugauggcagguggguacuggagaaguagcagagagcuuacaucugauucacaaauuguaggcggagagagaacaagagugggcuugaugugggcuuuugaaacaucaaaggcuaccuucagugacacaccuccaacaaggacacucuuccuaauccuuccuaaacaguccgccaacuaggaaacaaauauucaaaucugugagucuauagggaccauucucauuuaaagcaccacagcacacauacacaaaaaaucacaucaaccauacacgcucagcuugaauuuuccccaaauccgugcagccuccagagcgcugcugagugugcuggccaggggaggccucugcacaugggcuucucuucccacuccucugcugccuucucuagaaauaaccccagcuccagcuuaacaagacaggcuaauuuuaccuauucuagaguuucucugaaggaaagcaugucagguauauuuauuggucuggcuucuuugcuugacauuguguuugagguauaacuguugcgugcuggcuuuguucauaaucauuacuagaugggaauucauucugcugauuugggccuuuuugguuuuggggaaccaugaaucauggacuuuguuuuguuuugacuugcuauggagcuaagcauggccuugagcucccugcccccaccuuccuuccuuccuuucuuuuuaaagauuuauuuauuauauguaaguacauuauagcugucuucagacaccccagaaaagggcgucagaucucauuacagaugguugugagccaccaugugguugcugggauuugaacucaggaccuucggaaagagcagucagugcucuuagcugcugagccaccucuccagcccccuuacccccaccuuucaagugcugauacuacaguuguauaccaccauccccauccuuuguuugcuuguuugugagauaagguuuuucuacauauaucagcauggccuugaauuuguggaaaucuucccgcuucagugucucugggacugauuacaguuaagcaccagcccaucugauauagucuugaacauacuuucugauguagucagguagcucuuucuauuaguacaucccuaggauggcacugcuggguaagugaaggaugaugggaaaaaguugacuuuuaaaaaaaaaaaaaguuuuccaguugcaaggguccaggcuaggagugcuaccuggggaagagggaucaaaugucuauucaccccaaauagggcccaauuacagaccaaauuauaguuucaccaaaguuaauuuggugaacugccaaggaccacccucagcuuggagagggguucugaggaagggguaucgggagcugugaaagaagggcucaaagucaaucguggguacaagcugacagccuguguucugcuugagacagcucuccagagauuuccagacagcucagcucucacagaccaaaccccagucuuuuauuuacauauuaauucaaucuucaaccucagguuccuuuugauuauccuaccaaucagcuuuuuuaucuuagccuaggaaaagacggcuagcacuuuuuucuuaacauugcaaaugaauucagugaucugccugccuuuguaagcacagacaauaaguuugcuggguaggauuuguuucugagaucaccauuccuaccacaccugggcuaaauucacuguccuaggcugaccuugaacucaggaaucugccugccuuuguaucuuucuggcaugcugguucauagugcagcuguuucugcucuguugguccaugaagccugccccucauacauuucauuuauuuauuuuuuuuuuaaagauuuauuuauuuauuacauguaaguacauuguagcugucuucagacacuccagaagagggagucagaucucauuacggaugguugugagccaccaugugguugcugggauuugaacuucggaccuucggaagagcagucgggugcucuuacccacugagccaucucaccagccccauacauuucauagugcauccuuguauucugcauaguugagaaauccugcuuauauauuuuugaacucauguuuucagaguucuuuugcacagccuuaagggcagucccgaaggucauagcacguacuuuacaauuuuccuaagaacauagacacacacccuugccuccuggacgauuaucacugagauuaucaccuuggcagagagagcauuccccaauuaccugggcagggagaauaguucccgaaggaggaacaugaaguuuuauacacacacacacacacacacacacacaagccauauaccuagcaacugucaauacucauggaggccugugcccugcuggcucugcuccaaggggcgggagccaugucacagcaucaucccuuucaugaccaugcaggaugcggcagugaaccuauagauuuauugggauugauuacagauuuaugggcaagagguuauuuacaggagugugggugauccuuaaacagcuacaucacuguaaacucccaucccauuauggauagugaccacauggaagcuguaucauagggucccuuuucaguuagcauuuuacuuccaguauagucuagcauguccuaagaucauuugcaauuguuggggaaagaggggacuaaugauaaacuccuaggugagaguucuggacuuuuucccucuaacugcuuaggaaugucuauagcuccauugcuauauauagaucugucugucacuauauucugcucauuaguagcuauggguacuguucuaguuagcuuucugccgcucugauaaacaccaugacuguaacauggagaagaaaggguauguuuguuuuauaguuucuagucuacugaaagaaaaccaaggcaggaacucaagaugagccuuaagccgaaaccccagagaaauaaauguugcuuauuggcuugcucacuuaucuuucuaaacuggcccagucucaccugcuuauggauggcauagcucacagugaacugaguguuucuguaucaguuaacaauaagaaaaugccucacagacguggcuacaggucagucugaucugggcaauucuccauuugggguguucccccuuuccuaagugacuagguuuguguuagguugaccucugaaacuaacugacaacuacuaggcuguguuguccaguuuauuauuauuauuauuauuauuauuauauuuauauuuauauuuuugguguguguuaacuugacacaaacuggaaucgacugagaggaaggaagcucaauugagaaagugccucuaugagauugaucuguaguaggcaagucuguggggcauuuucuugacugguugagauggcagggccuagccuacuguggguggugcugucuggcuagguuguccuagaguguauacaaaguaacugagcagccaggaggagcaagugaggaaguagccuuccuccauggcugcugcuuuagucaguuccugccuccagguuccugcccuaacuucccucagugaauggaggagggugccccgagaacuguauguugaaauagaucuuucccucucuaaguuguuuugucaugguguuuuauuauagcaaaaaaaccccuaacuauggcaugagccaaguuaauuucuacaacaagaugacauaauuaugaugagaguaaaagaacaccguauaacacucacuguacguuaauuaaggccaggcuagagugaaguuuuuggggaguuuuaaaaagaaaagccggcagguauccuuaggagucucaguucuguguucacuaacagugugcucugacuuugucacagccuccuguuuaugaagugggaaaguuucuuuuuguuuagacgauauuguggaguauacuugauaaugucuuuucucagauccauggacauuaugguacuauaaaaccuuuugaaaggaacaguuggacaagacggguaucuuucuucagcugcuucuccuuuucugcuccguccccaccuucuucuuuagucugggcuuugcugcaguccugugacugcuucuuaccauccacuugccuucauugugacucuuuggcugcugugccuccugggguaaaucuguaaggcugagauuucugccuuccagcuccuuaucucacuguauucucaccagaucccucaugauuuugcucauuuccuuuuguuucuuucccaaagcuaaaccugggguggcacaguacauagaucgggcucuggacuggaagcuaaaguucucauucuaucccuaagcugcucugucagcuugggcgggcaacuucacuuuugagcguuggguuucaaaacuguaaaauaugaagaaaccaauguucacuuucuagggcugcuauaaagacugaugcaaaugcgaugcgacugguuagcccuagaaucagaaaaguaaaucugaacauaauuacuuuuaauaaacagauuagagaggguucugaaaaugugagugauuccaaaagucaggucagccuguccucuggaaccaaaggccagcacauaggcagugauuccaucagaugcagaagugauggauagugcuuccagcugugcagggcuagaagggcaccuguuucuagcuguagccauguaucugcacauucuugagugcgcacacaaguacauaaagccauagguugguugguugguuuguuuguagugacuuuuagaaaacauuuccaugugcaucugaucagcauguucuuuugaggagaccagaggguauucucaaacuaagagaagucagugaggugauuuacuugaggggagcucagcaaaucagugcugugauaaggcuguagaauguuguguggacagcuucaaugggccagucuaucaacucuguguuacuuucccaugguucgauaguuaacccugguucucuggguuugguuauggcauggcaguucgggugguguuaggguauccccuuagcuuucuuuauauugugaaguugcugucuguauaguauuuagcaucuuuucucucugguucuggggcuagacuucagagucauaaauagguuagauacgcacuuugcugaacuguaucguaucucuaauggauuauuugaauuuuuuuauauguuacuuuuauuuugauuuaagacaagcucuuauucugaguuucugcugacuuugaaaucuugguaaucuucuugccucagacucaaaggaaagcgaaaacuuauaucuuaaccauaauuuuccugcccgagauuucaguuugguuaccuacucccuguguccugcuuacuuguuucguuuccuuccuuccuuccuuaguuauucuuugagaaaauucuuuaugugucaugaaaaacuuugaauuuccuuguggaucagcaguagaaggagucuuguccuaauuugugucuguugcugugauaaacaccauggcccacagcagccuggggagggaggguuuauuuggcucacagguucccaucacagacuucacugggggaagucagggcaggaacagaggcaggaaccauggaagaacacuucuuacugacuuucuccucaaggaggugacacuguccacaguggccugggcaauuguaugucagucauuaagaaacuaucccaaagauaugcucacagacccagucugauggaggcaguuccucaguugagcaucuuuauucccaguaugugucaguugacaaaaacuacuuaaauuuaauagaaaaagcucauaugcuuucuuuuaaaaaaaauaaauuuuucuuauuuauauauuuauuuauuguguguauguaugugauauguguuuaugugaugugugcgugcaaauagcacaaacauuugaagaucagaggaccauuuuugagaguugguuuucuccuccugcucugggaucgaacuuagguggucauguuuguaccgccaucacuuuuacucugaggcaucucuccaaccucucccucucucucucucuucuuuuuucccucuaacccccucuuccuuucucccucuauccaccugucccccuguguccaccccccacccccccccccacccccgauucugggucccaagguuagaaccuagcacuaggaacaggcacccuucugcauugaauuagaccuuguuuguuuuuuuuuuuuuccuuuuguuuugugauuuauuaucuuuuuuugagaaaggaucauauaacucagacuguucucaaacuugcuauguauugaaggcugaccuuaagguccuucuugguccucuuguucugccucuggagugcuaggcuuauagaaguguaccaucaugccugauuuagggaaugcaaaggauuaaaucuagggccuuaaauauagagggaaaauauuuugcuaaccaacucccaccccaucuucauuuugcauuuugugacagagucuuguuaaguugcccaggcugaccucagucacuuuuuggcucaauaaggcuuugaacuugagaucugucuuuuuccuuagcuuucugauuagcugagauuauaggccuguacuaccagaucuccuuucccuaaauucagggcaugguaagguggucagcuagcagaauugagggacucuuguaggcaaccagaguuugaguuugucuguuagggauuaaugaggaguuggagaggaacauaugcuaaaaggaaagaaagaaucgugguuccuagauguugcaugcauagauucucaagguuauuaagaaauuugcugaggauggcuguccagguacuaagguccaggucuucuccucuuguguuugucuuugucagcuggguugauguugcuguuggccuguuggcaaauagcaugauauccuggggugcuacucaguagcuucuuuucagucuucucuguauagaaagaccugccauuguacuuuucuuauugccaaauauguagacuguugccucggaaggcacucugacuuacauuggguuuuguguuaguuugaaguaaaaaggacacagcuguaacagucagaggagucugcuucuauugaugaccuugaacauuuacucuagagcucaagcuacuuucucagaagucauacaaaguaggugguuuaugagagcucucuccacacagccucuggucuccuugguaccuucuguaagcccuccagagcaguccccucaugaggugucccauggugcccuugucuuguucuauuucacaggguccacuggugaaaaugacugacagaguccuuaguggagguuauaaauaugggacuggaggccuugguuuugccauucugguguguguguguuucuaagcaugacaguugcauuaaauaauuucauugucuggauuucuuuuguaucauagccuacucaugaagguuacuucucuuguuuggauaucuggacacuguuuuuggacuaucugacaaguaaaauuaaaagucgucucggagacaaggaagcaguucucaacagguaaacuucaaaacacugauaaacagauagucauuguugccaguuauucuugugcccugaggggcagccauucuauuucagcucaguagaccugggccaaggaagcugcccagagcagcucucugagcauuuucuuuuuuuuacaaaguaacacacauuuaaaaauuuguauguaugguaaugcuuuugugguuuuuuuuuuaaggucauaguuuuagagacacacguauuuguuagaugaagugauaugacacaugagcuuugcuuuacaacaacccauuggagguguagaguucucugagcgugggaggcauaggcugaccucccagagguggucagaguucauuauguuguucucaaacuugagaugggucacauuuauuuuuucuuuucuuuucuuuuccuuguuuuguuuuguuuuguuuguuuguuuguugcauucaagacagguuuucuuuauguagcucugacuauuguggaaccaggcuggccuuaaacucagagauccacuugccucugucucccaggagcugagauuaaaggugucugccaccaccacucaguguaccagaguuucuuaaauuaguaaauacuugucaugaaacaaauaacuaggaacagagcuggcccagacagagcacgcugguccuagcacuguggagacugaggcagaaggggcacaguuuagugacuuucuccuuggcagcggcgggaaggaaagcugugucaguuugagugggaguggcccccguaagcucauauauuugaauguuuaguucccaguuggugaacuguuuaggaaggauugggaaauguggccuuguuggagaaggugugucacuaguggugggcuuugagguuucagaagcccaugccuggcccagugaugacaugagcucucagccucugcuccagggccgugccugccugcuggaugcucccugccauggucauggacuaacccugggaaacuguaagcaagccccaauuaaauguuuucuuuuaaaaguugccuuggaaucuccucauuacaacuagaacaguaacaaagaugaagguuuagucugguucaguguagggguguguauguauggggugugguugggugggugucacacuugugcuccugcaucaggacaaauggguauuauauccagaggcaggaagcagauagagaaaaugcuauacuaaugcucaguccucuugcucucuuuuauuuagucuggaacucugccccuagcaauuauagucgguuucccuaccucuguuaacccaggugagaaccuuccucauagccaugcauagagguuugucucuugggcgaaucuagauccugucaaggugacagcauuaaaacuacaguuacuuuauuacagcuacuguuuuggugggguuuuuuuugagacagucucaccguauaucucuggcuggucucaacucauagaucugccugccuuugccuuccagcccuaggaauuagagcaugugccaccauguccagccuuuuauuacaguuuuucuaucuguuugcuuuuagacagggucccacuguguagcucuggcugucuuggagcucucucuguagaccaggcuggccuugaacuuacaaugauccacuugcuuuuaauuccugagugcuggaauuaaaaguguguaccacuacauccaauucuuuuuuaagauuuauuuauuuuauacaugugaguacauugguguugucuucagacacaccagaagagggcaucagaucccauuacagaugguugugagccugggaauugaacucaggaccucugguagagcagucagugcucuuaaccucugagccaucucugcagcccccaacucuuuuuuuuuuuuuuuuuaaagauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagccccagcccccaacucuuaauuauuguuuuuaaauacagaaaauggagaguguuuuucuugcuuuacagccagccaacucauuuccuaucuagcauaaugcuugugccaugggucugggaaaagaggagggaaauguaugaguucaguauacuacuagcaaguaauggcaggagccacacacacgaaaggcagcuuuucuuagcauuuuauauauucuccuauguagcucuguucuacuacacauugaguaguuaggcucaaggugggaaccuccuuuuauauuacauuguucauagacccugauucuuauauuuuagcguggucacuaaucugacagauccuuggagacaggguccagcuccaggugcuauuccaguacucaggggagaggaugcaggcugugccuggcuugacuauaacuuuggugucagcacaguacuaaugagagcagucuccgagguuaccacgacauggccucaggaacagcugggcucugaaagcucauucugcaguuuguguuugguuguauuagguaaguuugcucaggaagcuuuuagaaugcuugguauguuguaagugguuaguuaauggugccaguugguugucacugcaguaaagugccuagaggaaagguuuauuuugacuugugaauuccgagguuucgguccauagugguuugcuucuuuuguuucugggcccuggugaggcagaacauguggugggaagcauggguggagcaaggaugaucacaucauagugguuggggaaggugagggccaugaacugguggugggaagaagagaccagggacaagcugcacccuuccuuucaggucaugagacuaguaacuacccagucaccacccuucaauacccuaccucuuaguggcauaucuucuauguguacauuacuucuaaccauaauaguggagguagugaagacccuuccccagaauuaugccaaauugaaggagguagauauuuucuccugggaagagaggauguaguaggucucuaggacucuuuucacugcuaagguuuucuggauuuuuaaauuaaauacuaaaauuucaaguuuaaaauuuuguucuuucauuugcaaacauucuuugauuacagaauaacuucugaguugcuuuacugucaggucaaaugaagucauggcuggagaguguguucaugcagcauaaaccuuaauacagaauaguagguccaguaagguuaccgacuuugacaguugcauuuugaacgugauucuucaaagaaaagcuauuaaaucaaaauuuguuucuuguccuccaaauaggcaugcccugggauuguaccucacucucuuguguucagugauauagauauuuuuuuauauuguagaguuuuggagaaugaaguguaaaagugauuaacaggaaaauagucuuuaaaucacagaacacacaagagguaugggggauguaacaccacaaaggagauugcuaguauuaaaaguacagguuccuggagaguuuguaccaguaggugggacagugauagagggaguuuaaaugccucuucugcuucaaggauuucuuuuggucaggugcaaggcugucaauuuucugcccacacaauggauaucuugcaggaggguuaggauuuuggaagucaugcacauaaaacauggacacaguugagcugaauauuaaacacuaaugcuuacagugaugaugaugaagaaaagaaauaaugaaaugcugcugccacaugguugcugaucauggacagcuaaaggccuuuaccaccugccaucugauaacacaaugcucaggaauucuggcuggcuccuuuaaaugcuaggaaauuuuucucauugauaaacuuaauuuuucauuaaagauauauuuuuauuugugugugugugugugugugugugagagagagagagagagagagagagagagagagaauauuuaauuguaugccauuacaauuacaauuaauuguauggguauagguacccauagaaacuagaagaggguucagauccucccagaacuagaguucccgggaguuguaagccacucuguguuggugcuaggaaacaaaaucaggugcucuucuaagagcagaaccauucuuaacgucugagccauuucucuagacucguugcuuuuuuuuuuuugucauaauuauuuaguuaauauaguaauauaaauuuuggauuuauaaguuuaaaagucucaccaucauuacaaguuucugguuuuaaggucuagaaucucuuuccaauucagagucucuuaacugugagcuccuauaaaauaauaaauaauuugcugauuuuuuuauucugcacauaguagugauuuaauuuuuaaauauuuauauguacacccacccacccacacacacacaccuuuagcaaagcagaaaaaggaaauccucaaagcuggucugauuucuguuaaacgguagccaccuccucggaccuguuuuucguacuuaacucucuucuguaguuaaaggaguguagugaaagaacagccccaagauaguccacguguauguacaaaggaaggacacugacccucacucugugucaguccguacacuauacaucucuacaacagauugugagugcaaagcuucucagugaaggguuugaagguuuaggaaucacuccugccuagugucucagagaugagauguguuacaggaguagcugauaaagaacauuagugcugguaauuauuguacuuauuuuuacugugagcaugaaaugugaucggauguuggucaucuaauaacaacacaggcauacuuuuagaaucacacuugugacuuaagccagaacuucaaaacgacugauugagcuauaggaaguagucagaaauuguuuucuuggugucucaaaugggaaacauaggugugguuaagucacaaagauaguacucaguuccuauccuugugguuuuugaguuuugcaucauuuguuacaacaaaguugcauuguaggguacagacuuugaagcacaaauguacugagauuuauuuguguuucuaggagcuuggaaaugaacauguuggaaacagcauguuucuuguucauugagaauauucaaguuucuggcuaauugcuggugggacuucaggacacagauaaaugccuguauuagaguuguggauggaauugauuguccugcuccucagcuagagguaguagcauugagagcccauaucucaggucccauuuguuccuuuguuuugggagugguuauaucuuccucacacuguggaugaaagcccugagccagcauguggggccuuggcuugcaguuggugcucccugagaaaguucuugcugccuguucaccccuuucucuuucucuucuacggggccaggcauuuguguagaaacuuggguuuuacagaaagaggaagaaaccagugugugaagcaaccuaaguuauugugucauguucugugaacucuuuugucacaagagugcugacugguaagugcugacuacagagcagcucaggaauuugagcaucauuaacuuagacuguuagccaguuagcuccuucagggagguguuuaugcacuaguuauuauuucauggagagggaaacaucauggaggauuuguaucagucccuugcgguuacucaugugaacacugucuagucucugugugcugacucauuuccaugcucuuggcuuuuuuguauuuacuuuuuagaugcuuuaacuuggcuaguuuugucuagcugaguuuaugucgacuagggcuuuucuccauuuuuacauauacacauuguucuaaagguuuuuguguguauuaguguuggucgguuuauaucuucuggaacugaaguuacugacaguuguuaguuacugugugaaugcuggcaacugaaccuggguccuguacaagagcagcaaggccuucuuaacuguugagcugucuccccagcccaacauauguacauucaauacuauaaauuuaccccuaaguccuacuucaaaucuaucaagaauuuucuauauaccaugucacuuaaauuauuaucaaauuucacuuuaaaaccucuuuaucuaaucuccaaauauuugggaguuuuccauauaucuuuguuaguguuuuccaguucaguuuuguguucugccucuaguuguaugauuuucaucaguucuuuaaaauuucucaaggggcuggagagauggcuugacaguuaagaauauugacuauucuuucagaggaccugaguuugcuucccagcacucacaguggcucacaacaaucuauaacuuugguuuuaggacaucugagcucuauucuggccuccucagguaccaggcaugcaggugguagacaacauaaaugcgggcagaauauucaggcauagaaugaaauuaaaccauuugugcucagaggggccucuuuuucaugaggacagcaaugcugcugguuaagaucuaaacucaacccuucuuaccuuucuauagauccagucccaaauaaagucacacugaggcaguucuuuuacauauggguuggggugaggagagacacagcacaguucagcacuuuccaucugaagaaccucacagaggaucgcuucuguaguguuagugacugcugacuaacauggcauuggcaccugcugauugucuuucucaugggaaaggcagcuggagggauuccuuagacagcaggacuccgccagugagcaugagcaguggagaggagaggugagguccuauugccuuaaucaccauuuucuugcugagaagacaccaugaucaaaagcaauguggaggagaaggcuuauuucagcuuauaguuccacaucacaccauaucauggagggaaagcacggcaggagcugaugaagagaaaugcugcuuacuggcuugcucucaugacuuacauagccugcuucuuaugcaccaugaccaccugccuggggugguacuacccaaagugagcugguuuuccuaugucaaucauuaauuaauaaaauacccauagacuuucccuacaggccaguuuggugggaguauuuucucaguuuagguucucucucccaaaugacucuagccugucaaauugacauaaaauuagcuaguauacccaagccaguaguuuccuuuacaggcuuuuugucuccugggaaauguagcugucuucagugcugggguucacuuacucaggguggggagugguuccagggaauagguauagacaagcagcuagggucccuauccaagccacaggccucucuugacgcccaccauacacuuugggagaugaguuaccugugugccuucaggacaguuccugaugggguuuaauuucaaaguauuacaggauguuugcauguggaguuaccaacuggcagugaaguuuuugucucauuuaagaguucuguguagagagucuuggaauuuucuuuuaguuggucagugacaaaauguauguuuucuagugugaaaggaguuuucuuucugugagaauguuuugaucuggcauagcaauuuuuagcaaaacaccuacaauguuauguuacaggcaaagagugcagucuuguggggagggggcaaugccugcccauagguaggaaaugagcucuuguacucaccuaacugaaaugugacagccuaggacuguaggaagucuuagaggaucucuguggcugggaaugcuuaggacuagauggacuguaguugaucuugguuugauucuuucaaguucagcucuuggauuggguggugaauugguuuaggguacuaccaggaaaaugggaaccacauuuauuuuaaccaagaguguaauguagacauuugguuuaauagguguuagacggguaagcaaacaaugagggaggcaacacaguugauaacugcaggaagcagcucgaccuauaagcuaggggcagaggaagggguuaaauaagcuccauguagcuggggaggguuccacucucuaaggaguaggcuauauccuaugucccagggaacccugaggaggucuuggaagcuggcauuuagguucuuucaggaguuccugacccacugagcaugcaugagcuaggugcuguaaauguagagucacguuggaaaggcuguggugcauagcuguugcugggcagcauugccagagaguagcccaugaugaagcucuucaccguucuugcuacuuugcagucuuccucuggcaucccugugacaguuaauaggcccagaagugugcucuagagggcuucagccccagcucacauugcuuacaagugggagccaugucuugacugcucuuagcagcuucucaggaaagacaagcaguuagccagcauaaucuagucuuggaaauaagugguuugaggcccaugugauagcagguauucuguaguaacguggaaucuucugugguagguccuuauuguggaaaggagccagauggagggcuugaggcaugucuuugacaauuaauuuuagauacaaaccagagaguuaagauuucucuaaggccuuuuaaauuuccuuuuaguuucuaaauggucuuaaaauuaauugaagauugaguuuuggguuuggcugaaagccacugguaguuuauguguaaagagaacaugagauuugaguuagggagcccugauuucagaaaagcuagcuuuguugaccuugagcaguuuaauuguaguuuucuuuucaggaaaauaugagugauauccuuuaccucucauugauaccaaaaguguuaaugugggugucguggcacaugccuuuagucccagcacuugaggcagaggcaggugagucuuugaguucaaagccggcuuggucuacaagacuacacagggaaacccugucuugaggcuucccaucucccacucacccgaaaaaaaaaaaaaggugccgcucauugauauucacauacaguaccuguauuccuuagugaaaugaucuuuuuaaaaaacccaaacacuuaacauuuaguaaaauaaaaggagacuuaaaguguugcacuagaaaauagguauuugacacaaagaaggcaguaauugaggaacacauggcagauguaagcuuugcuuuauugauagucauuuguaauucuguuguuaggaagcagagacgggcagaacuaauuuggaaaucuaugauccaauuaccaagaaauaguaagcauaagagcuaaucacagucuuaacuguaaaagagaguccgucacaaacaaugugugauguaaauaguaaagugccugcuucucucuuacauacucaugcaacucaaaaaaagugccagugcuuuagcuguguccagggugaguauuaacuccuggagucccagaguccuggucaaaaucugaugcugaaagcuuucuuugacuugauugacacugaacccuuuucccuagguacgaagaugcucugguccucuugcuuacagagguguugaaucgaauccaguucagauacaaccaggcccaacucgaggagcuggaugaugagacccuggacgacgauguaagaugagcgcgcgcuucuuuccugcugcucuagcucauuguaccgcugcugagaaacgaugcacaggccuuuaccugugugcacuagagagagaauucgagagaccagaugccaugagaaaugcuuuaaugagaauguuguaauccugaucucuguucuccucugccuagcuagauacugacaggacuaguugaauaggaguucaaaugagaagucuggaaugguagucucuuagccauaugcugugagcaggguuuuggauuuuuguuuuuuguuuugauuuuacuuuuguguguguguguguguguguguuuuuugucuuuauuauuauuguucuuguuuuuuguuugucugcuuuguuuuuuggauuuucaagacaggguauccuguguaacccugucuuggaacugacuguagauugugcuagccucaaacucaagauaucugccugcuucugccucccaagugcugggauuaaagacgugugccaccacugccuggcauaagcuguuauuuuuaaacugaaacuugaguauauugguguugguguucucaauuaauaaggaaaauauuuuguggguacaacucucgugguccuuuccuuguaacuacuaacaacucuaaaaugucuagcauuacuguuaugcucagaaucagugaccagugccauggucauugugagccaauucucagaguaagaaaagagaugcucuacuuggagucagacagcuccgauuugaaucucugcagcuuugggcucagaggagaugucguuuuucauuuuuaugagucucgguuuccucguguccacaauaaacauguacugacuuguguugacagcuacaugaggcuaccacaauguggaaaggugaguugugugacugaacuaaggccagggcuuccucaccuuuaacucugggaagagucuuuagaacagcguguugaaaugcauacugacucuggaggucugagaugaaccagaguuugcauugcuggcugucccuggggacacugauguugccucugaaccaugcuuugaauggugcuauugagucagaugcauguaaagaaauggauccugucaguggaauaacagaaaaguucagguagcucucugaacucuaaacuccugugcuuucaggaggaagagugaauugcucucugugaguuauuugauuucugaagaaguaacuuguuagggaaugaaguuauauuaagauaguuaacuggaccuuuucaaaguuccaaaucccugguuucacuuauuuccuguuuucucaagauuugauauuugagaauagaucuaaggcugcaggguggcugaugaugaauaggaugguuuuaccuguccuggaaagcugauaccuuuguuucccccacagcagcagacagaguggcagcgguacuuacgccagagcuuggaggucguggccaaagugauggagcuccuucccacacacgccuucucaacccugguaacucauugugugaaggggaaaucgaguggcuucugacccauagaacagggcuuuuguauuuaccuguccuuucccugugucuguacauuauguacuuaccuuguauuugcauuuauaaauguacgugugugugaucuguauguguguggagguaagccuuauaugauguuucucaguuaucaucuaccuuguuuguuuguuuguuuguuuguuuguuuguuuuuuaaagacaguaccucuuaguggccuguauaacuuaccaaauaagcuaugcugacugcaagccacagagacccucuuugcuuugcuuucccagugcugcaaguauaagagcugugccaccauacacagcuuuauauauuuaaugugaauuuuagggauugcacucauguccucuuguuuguggggcaagcaguuuaccuacugagcuauuucccucgcccuuguuuauuugaauuacuguuuagucuuagacauaguaugcauuuuagaaaugucuuaauguuuuuuauuagaaacgaggaggcagccaggccaacagaaguaaguguuacuugcagaaauugcauugauaaaagacucgucuguguuguucucacuauggacagauugcuaaaucucccugccuguguauaugcuagauuucaucuccuccuuuaaggcaauugaauuacugggucagcucugcauauaacagcugagagccacuaguuggcauucucucacaggaaguggcaguuuacuaugcuagcugcauguuuaagucuugacuuaccuugauggugaguguagaagccuaagaaagaaagggagcacuaugaaguccugucuuuuaaaugagcaagggaaauacacauaaauaacugggccugccuuuucucucagccaugcacauuaauaagaccuaugugauaggguuuuuuuggcaaggucagggaccuuggccuaguucuucaaguugcaagucuuguagaguugaauccccuuucuaggauuguaguagucuugccccagaaucauuugcuaucauuuuuaaagcaaucaaacugacauugauuucuuuauuguucuggcacuauacuagcaggucuuaucuguaagaauugaggagggaauggaaagggagcugugcuuagcaucuguaaagggaaguugucaccccauagccacucaaugcuucaggguuaaaaauaguaucaaaacucgcauuuacaauuuuuguuuuaaacuuuguuucuuuguuuucaguucccaguucuucaggacaauuuagaaguuuauuugggauuacagcaauuuguaguuacuucggggucagguaaauuggucuuuauuuucaauuuuagcuuagcauuaaaaaauugggcuaauaguuaauuauugccaccucugcuauaauaaugugguuugccuuguacagcuuuucuuuacaucucuucaacuccuagacagaagguuuuuaaaauucuugcuacaaagaagcuggggggaguggggggaagcuaaucagggcaaaagcuaaaagcucugaaguguuuuuuacauacccuaaaacagcaagugugcuggaaagaaaaugguuguggccuuucacugggguagugucugccucucuggcuuguggaaugaggcagccagcucuggucauucuggagcucuccugcugugagcggcuuggugaggccuacaggaggcucugcccacagcuggaugccaagacuuguccuagguuggaguggaggguuaacauuuguuacucugcugaugauaauuauagccuguuuguagaauacucaugugccaggcacuauguuguuuacugugucguuccauuuucuccucuacugugagacagaaguauuauugcuauaguuaucuuacuuuacagaagaggacaaugcuuuucagaaauguugauuuacccagggcugcauagcugguuuaugcuaauagcaagauuagguauaaugaggagugguggaaagaugccauaaacugacauucauuuuugccagaugaaaauaccagaaccucagucuaugcuuugcacaucuuccccuuuuaucccaccaugaacugcucgugaaccguuccguaugggccgaccuuaccuguaguuuugccaggccuggcacugagcuuccuccccacagaggguagcuuguucuugggugaacuggucauuuauggcagggccuucauggagucucaugugagacugcccuuucugcguggauuuuuaauccaguucagagaucagcuucccuucauugaaggacagucuuccaccugucuguccucccugaagcccaccuccugcuaguuucagagagcuucucggucauuguugcagugcauauuuuaguguuaaaaccuaaggcuagagaaaucauuauuucuugcuuuaaagugaguuuucuucuccaugaugaagcgucuguccacaccguacguucaaaugaaagcccaugcuuccaaugcaaaaguuuguucucugguccccugauggcuuugcuccccaaaguucccccuguucccugguggguugcagcucuuucuuucuuuucacuuuugguuuaccccuuugcagaguuauuaaucuuucaaucucagguguuggggagcgagguguaguuccccuucauuugacucugacuguuuaugacacuugagugauuaugauugguagcagacccaguagaguugcugugaagcucaggggcguguccccccuccagccugcacauuagacacacuuguuagcauaucugcuacugcugaacuucuuaucaaugcuuccuugguaacaaagcaaggcaaaccugugccuguagcugcugugugccucuugccccuggcaggucaacuuuugaucuuaauguuggucuguccugugugaggacugggccucucuccuuaucuguucuccucacaccuguuuuuguaucuggcuuuugcuguuccucauugagauuuuucccgcagcucucagccagccuuuugauuagucacacaagcguucuugcccaagagauuguuuuguucauuuacaggauagaaaagcuugacauuuaucuugucuguuaugugaagguugauuucugauuuguguauucucucagaguagaauaccuuaaacgcucucauuuauaucuguaucccuucacuucuuggacaaggaagcugcucuuuagccugcuuccugauagcuugguuuauuggggagaggacaguuuaaaagccucugacccuguauguagcaggacuugcaucuaaaggcuguaccucacagacauucuguucugggcuacuggaugaggcuccugugagagaucaggaaaagaugggcuugcagaugguuguagagugacguggggaagauugccaaugaccaaaccuuggucaaauaagaaaagcaugugucacuauacauaguaaguagucccuucccgagugcuacgugugcuucuguggugggggagguaggcuuccuagaggaaugggacagggcuagagaauuuaauuagagauauauccugcuuuuguauuugucugccuugcagauagcucaggaaaguuucaucugcaguuuugauugcuaugaaucuuugcuagaacauguacuagauuggacuagacagaguuaguuuuauucaguccaaaauggucaaaugucagcacuuucauuuuauucaggcccaaaguguaaaauacaugcauuugaauaaaauacuguguagacacauuuuuauucaagaugcuguguauguggcuagacagaccagguaugcugcaaggggaucacaugaugguguuggugaggauccucaguagcagggaaugaaguuguucuuaggcgaccugaguguaggcaaaggugcauacacacccagagcgaaagacuguugauucugacuaguggccauguuggcuguccacacaaaggauuuuauaguuguaaggugaacagauggcagauguuugauagagccaacaccaggggaggagguuagugauagauggugaaagccuggaguggccacgggaggacagauuuggaaagugcuaagggagggugaguuugcagggguccaaggcuagccuuuaacuauucuucccggcuugucaucuccuguguuugagaagcaguuuaucagauuccagucuuucuccagacugacaauccuuucugccuucugguuuugugaguaucugugaagagacagaaugacuaaauuggggauauuuugucaucuuagcaucacauuuaccaaguuuggauguuuguugaaaaguaagaaaguuuuaggccuuagaaaguuucuaguucuuugugacccgugauaauuacaaacuuuaaugaugcccucuguguuguaggguuuaauguaguuaguccuacagugaauuaggugauagcaucgucccuauuuuaaggcugaagagacaagugagggaggaaggguugauggugcucauaguggaaaguguaaggaacucuccacuggaccugagcccuguguccuuuuucuccuuugugcugaccuaacaccuggaauagaaugcauaacacacccaguucauuuuuagcaggguucaaucuucuuucagcuugggagaguucauucugagacagccauaugcaagagugagcuagagccgagcuagagugacugagcucacagaguucagcaguaggaccgugcuggcucuuacuuacuggacucacccauuugcaugccuuuuucauagguugguaaugccauaacuguauaaguauuaaaaggaguuauagcagggauguaccaggcugugucuuuguccugggucccuggagcagcacagauaaaguuguaggcagaagcugugcucagauguccuauucuguacugggaaacaccugaagauuuuuacuguuggagcaggguuuaccccacaugacuuguauuggaaugguuguuuauuacaacuaaagcuuauuuucuggaaaaacugagagauguuguguucuaggacacaggcugaacaucacagcggagaacgacugccggcguuugcacuguucccugcgagacuugagcucccugcugcaggcugugggccgauuagcugaauacuucauuggggauguguuugcugcaagguucaaugaugcucucacaguuguggagagguagguuggcugagucaugcaccucuccuucagaguucagcucuccuuuauauggagguuagcauguagcccauaucauguguccuuuguccuucugccaugcacagguuaauagagagcagacugccauuugcuguacugagcuuuuaagauccucaucagcaaaacagugggaaaguuucuuguagguuuacuaugagaauuaaaggcacuuugugugguguugaacacagaacaaacaguaaacacaagccaagcuguaacuucacugacaaccuuguguguugcuguaaaaaugguuuuaccaggcacagucaagauccuucaaggaagcccuacuggggcugggacaauacuuugcaagugggaccugaguuugaucuucagaacuaacaucaaaaagcagaaaacaaacaagcaaaaagcaguuaaaaacaagacaaaaaucccaggcacagugaugugcauuuguaaucccagcucuggggaaggagauacaggccgaucccugacagccucuccuacucagugggcuucccacugaccaaaaaaaaaaaaaggaaggacgaaaaagaaaguaccugaggaacaacgcacaagguuguccuuuuguccucuacaccaacauaucacucauauccaugaacuuacacguacacauacacacucaugcacagagggaggagaaggggcagguuucacuagacaacaguauucauuuccuugugcgcagcugguguuagaggucuagauuuuucaggguugguucagucccaucagcuccagagaaaguugugcagucuguagucccagcuggaguuuggguucuaggagagaaacugagcuauuugcugggaaauaccucauucaguugcccgauccuuccccuaaagguuuuggacccugaaggacaggugcaaguguugggagcuucaggcaggcgaggauuagauucauagcugcgcaggcacugguaaagcuugaagcgcagagccugcugcuuucauucauagaguggucgcgucacugguaacaugcagggagacagccccaagagcugaguuagcuugcauaccaaauuucuuauuuuguuuauuugagacagggucuuauuguguagccuggcuaaccuggaacuuacuauguagaccaccaggcuggccucuaauucauagagauucacguguuucugccuccacaacccacucauaccaauuuuuuuaaaaaauguacauuuuagcuuaaaacugaaguaacugaggguuuuaaaucccuuaacaacaaaguuaaaauuaacgauagucgauaguuguagugaauaauaguagucuguaguaaucagaaaaguuuaagaguagucugacucugucuuguuucauuuuacuuugagaggugugucaugugauaguggauacuuuguuucgcucauguguuaaugagaaggaacuuaugauuuuaagaguucaaauuccaggcuuuuuccaaacuauggaauuuugaauuccagucuaauuuucuucucuguccugugauaggcccauuuucacuaaugauucaguaaggguagaguacaucuuccugucugaauuagauaaccauuauugaauauggcucaguuagcaauuuagauauguaugucagucugcuuaacuaacacuggugagaugacaucagagagccuuaugcuuacguaucugccuaaaaagcuuagguuugcaaccucagcauuuagaaacaccugcuauuuuguuugcauuaagacuagugugugcaguugguugguagugaucacugccuauaauccuagcaauugggaggcagaggcagguagaucucugaguuugagaccagccuggucuacagaguuagguuccaggauagucaaggcuacacaaagagacucuugucuugaaaaaacgagagagagagagagagagagagagagacagacuaguauaugagagaagacuuuccuauaguuucaugaucugaugacaugaucugaugccagugugauuaccaguguucucuuguaggucacauaaaacuugauaauacaguugcugaacacauaguaaauuacacauuuaauguacacaugauuuaaggcgcuaaacaccagaagacaggaagauauggcuuaguuauauuguagaagacaaggacagaaggcugagacuugcuggccaucagccuggauggguauaucaagagguccuauuucaagagaguaaggugaagaaagcuagaacagaacgcuuagaagccauguggccuaugugcuugcauggcucauauacacagcugugguuuuaacacuugcugugcacagugcuguguugcucacugauaguugcuuucauuccuuuauagcagaacuucuuucuaaggcuuugguuaaugacuuggcucuucacacuugcuuucuugacucuguggaagugcccuucacacuuuucuccagcccucgguccauuuaugguuuccuuuuggaauaaagucaugcauuccauacaucugagaggaauauuuuccagagcacaggcuuccuuucuaaagugcuaagcucuuucaagauggugauuuccacaccccccucucccccucaaccaugccuuggccugggaccaagcagcugccccuguggugaccuccucaguugagagguugccugcaggguuguguggaauuggccagaacuuugcagugcuguucuguucacugagcucggagggccuuccugcauccuaaaggagcgcugcugugccuggugcugcucaccauacacagugguccuugaauaaccuguacgcucaacugcuuaacuucuagaaagauuugcuccccucaucuguuucuuacagcauguuaucaauuuauuaccaacaauuucuaaucuucagagaaguugauaaaauuauaugaggagagaaggagggagacagaggauagauggauaugagccagccaucuagauucuagauucuauagcacauauuuuacccuuuacuauauauugacccauuguaaacauugaaaugauuuuaaguuuaucaucagaucuuuagauaaauugucaaaagagcaggcucgauuucuuaaaguauuuuauuucuuuauaaaauaguauauauagcugggcagagaucauguauauaaucgcugucuuugagaggcugaggcaggaggaaaagaggaccauccugggcuacauggcaauacauugcaaaaaaaguguguacacacgugcacauggcauuagauauucauaauauacaaucuaggaauauagaaaaguagagaggaaacaguaguccauaaucuaccugccuccuccaucccacucuagaguaaacugggcuggcauguucuucuggggaaaacuuuucagccuugccucuguugucugugcacaugugaaucugccucagugugugugugugugugugugugugugugugugugugugucaaaggacaacuugugggaguagguucuauccuacuguguuuguguguguguguguguguguguguguguguguguguguguaggucaaaggacaacuugugggaguagguucuauccuacuauguaggucccagggagcaaacucaggugaacaggcuuggugacaggugccuuuacccuuuacccacugagccauccuaccagauguuguuuuaggcuuuuugauaacauaaaugcuguggugcuuuagaaaaugguuuuguauauaaccuuacuucacaacgcuagcuguuuucuuggaaagaauuggagaucagauuuuuuuuuuuuuuuuuuuuuuuuuuucccugucugaaaauuagcccuuggguuuucuuugauagcuuguccauuuuguuuguuuugggcucuggugcuugcugucauuuuucaccuauugcuuuguuaacagguuggucaaaguuacucuguauggaucucagauaaaacuguacaacauugaaacagcugugccaucaguguugaaacccgaccucauugauguguaaguaaagaguaguaacugugccuucuugagagauguugacccuaccucuagaugaacugcagcaaccaacaguaguggcugccacacauaaagggaaagcucuuuaucugacccuagaaagacagauuguugaguauggugugguaaauguaauugguugaacuaaagagagcaaggaugaggcucuacagggcaggcacugcaggaaacagcagagaagggcugugaaguugagaauuggugagcacuaaagguacgugggaaugguguagaaacaccugaucccugugucucuuacccugcacaggguucacguucacugacaguuggugauagugggaaaccccaaccaucucacacucaaaagcugcaccaacuaggggcaggggauuuccgugcuuuuuccucuaauuaacuccaguucuguuacuacuugguagcaucaugcugaggauuuaauccccacgauaucacgucugcaucugcuuuccagugccagcugcugcuccagcuguguuucuuacgcugcugacugagggcuggaaguugggaugcccgugucuuccucuacagauuuggcuaauuugcuguagugagucucagaacuuggcaggacacagcuccguuuauuagaagagaugaguagaggaagauguaugaggguucucaagagccucccugucgucguugcugagcagacucccucugagaggcucccagcccacauaauccccuggccuuaguauggaagccugacugauggcuuaagucaucagggaauccuuuaguccuuuuacccccuccagaggcugaguguggcuaaagucccaacccuccaagcacauggcugguuccccuggcaguuuggccuuccccccggcaaucuagggacuuuauagaaauugccuugcuuaacauaugcucagguguguuggaaaggguuguuaaaaguaacaaaaaaagacuuggacuauucuaaagcuauuucuggaacugagggcaaagaccaaauguuuucaagcaaaagauguccuuauuugagggaacauuguaaggaccaugggagcuauacuucagcuauugguccaaacccaaaccugacauuuuccuuuagaauuuaaguuugguaggaaggcacagggcccagauguuuguguauuaaauuagaaucucagguuacuuugacauuugacucaagauucucaugcagaguauguagauuggggaaguacauggaaggguuagcaucuggagacuggaaauaaaccuuauucuguuagacugcccaaaagauuugcucaggucuagagcagauacugauaaaccaugacaacccccacccccacccccaccccccuuaucuccacccuaucuuaaaaguagugagaagaggaggaucaagcugcaacaguuaagacccuuuucccuauccuggccgaggcaacaguuaauggaguaguaggggcauuccagugaguaaacagaacaaacagacuucuucauagagacugagaagaagaaagagaagaaugggcugggacaauaagaauaugaugcuuagcacccagcuacuucaggguauccuuuguguaaagauuaagucggaggaaacucaugucuuuugaaacuucccucugggaaacuugacugccaacucuggguuuuugcauuuaacagacagguaagcagcuauguuuuagcuuggagaugagccuuuagcugagucuguuggaacugacagugaaguaugugcaguuucagcaugcuccauuagaacacagccauggacauucauuuacauagcagcuggggccacuuuguacaccacagcuacagcuaaccagcaccagcucagaguguguggucugcaaagccuaaaucuuaaaaaaaaaaaaaaacaacaacaacaacaaaacuuuggucuuuauagaaaaaguguggcuagacaguggugucacacaccuucaauaccagcauucagaagacaaaggcaggagaaucucugugaguucaaggccagccugaucuacagagugaguuccaaacccugucuugaaaaaaccaaccaccaaaaagaaaaaaccucaaaacaaacagaaacggaaaacaaaacaaaaaccuuaaaaaccaaaaaggaaaaagaaggaaagaaaaaauguuauucgcuucugcugaaaauuaaauaaauagaagaaagagacuuauuuacuauagucuuauauuuaaaacacguuacuuuccucuuugagaacuagagaaaucuguguggcaacuccuaagcaagaugcccauuggcucuugaucaggacagcugcacaggcaggguuguaggaggguugcuuuggagcucucuggugugugcaccauagugauugaucuggccuugcuggguuucucaguuugguucuuggacuauaaguaaaagauagacugcucaguggauucugaaugugacaaagaaacuggcuuccuguuaagaccuucuagauuuuccugcuuugugcuuuuuaguuccuuuuuuuuuuucuuaacaaaaagauuuugaaagucuguaaaauauaguuuaaaaagagaaaacaaaacaaagaaacuauagaauagaauaaaauaccuucauuucccuggaguuaugauuuugguucuagggauuuuuuuccccuuuguguuugcauacuuagguccuuuuuguuuguuuuuguuaagcaaguugauacauuguagauaggguguuacuucagguaucuccuagaaacagggcuacuuuauagaacuauauuaccauuauaaucacuuaaaaagcugcaagcuaauaucuaauuuacacacauagcugaagguuugaucaugauccaauauuaagucagucuccuguaaucuagaguagucccuaguuauauaugauuugugagugaguagaggugugucagaaagaaagaggcagacagguaucauggagcccaggccuuaguuuacuguugaaagaauauucuacaguccagauuuaacaagguuuaggcuaaguguuuguaauaagauggcugcauucuaugucuuacaucaugucaguaagcacuuggaucauuguugaugcuguuuaauuugaagugauuccugucuacauccuagcucugaccaugggcagacucuagaaacuggcugccccucauaucuaagaccugcuguuuaacauaauauuuucuccauuaaaaggaaccagaccuccuuuggugcaggauacugcuggagaaugcuguagagucaguaaauaaggaagugguuccugaaugugucuuuaauaggcaagaacacaguggagcuggcuuuaagggauuuuuuuuuucuguuuauacuuagucagaaauaaaacaaaacagugauuacgcuauuuugaguaaaaauccauauagucuuuuuuuuuuuuuuuaauuaagauucaucaguuugcauuaagggaucuucaugguacccaucugauggggaacucuguauuuagaucuugucaggguaucaacucagauugcuugguggugacuguagaaaagcuguauguagccguguugguuaguguuuugaacuagauagacuucugccuugccucuguaagaccuguuuaucaucuuugaugaguugggagcuuuuggaauuguauguguucuguuuuugguuuuguuuuuuguuuuuuuuuuuuuguuuuuguuuuuuuucuguuucuaacugaccuggaauagacuauguagauagaccauguuggcaucaaacucaaaucugcuuguuucugccuccaagaacuaagauaaaagauguaccuggcauguuuugggguuucauuuguuuauuuggcuauuuucaguguuguuuuuaaacacgguuucacuuuguaguugaggcugauuuggaaccuggaguguucucaccucagucucuggaguacaggggucacaagugugccacuaugccugguuucauugugaacuuuaaguguguauuuuauaaaugugugauccagagaagccuuugcagaaacuaaauaccuggaugcucuagguggacagauacuuagaggggaaggugagcuuugaaaucuucugucaaaaauacuguuacuuaccuagaccauaguaaauuuuuaguuuuuaaacuuagcauauuuccccuaauauuuguuaucuucuuaaauaaacuacgugccacagaaagacugagaucugggaaauguuuaggaacugcaguguguguucaucuccagacagugugagcaggugacugacuucccugcugucgcugucuuagaaugcucugcagcgcgcauggaguucuugucuucccccuggagguggagacaagcccacgccaccagacucaccuggcucucccgggucacugcuucuuuccuucccgcaggcacgcucagucacuugcggcucuccaggccuacucccacuggcuggcgcaguacugcggugaagcccaucgacagaacacacagcaguuugugacacucaucucuaccacaauggacgccaucacaccucucaucagcaccaaggucuuaagacagaaaauguugcacuuuuuaccuaacucugacucucucuauaguccuguuuaccacaagaccaaaaugcuauccugacugggugguaacaacuggauuguuucauguucucuuaaguuuuuuuuuuuuuugaauugcauuuauuuguucgugcaugauugccacagcaugccugugggagucagagaagaacugggaggagccgguucucuuuccuaccaugcuuguccuugagguuaaacuuagguucucagguuugugguggugaggaccuuuccccucagccaucuugccagcccucacgugucuuuucaguuguaguccacguaugcucaaguaggacuuuuggguuuuccucauagugaaaguacccacucaguucuauugacuaaaacguuuugcugcuguuugaucucauuccuugaaacaacauugcuuacagucaauacugguggcaauccuuuuagacauguuucugugcuuuuauagacaguuuguagauagcuggaggcacuguuguuguucccugcaugcuuuguucucucuucaguguacagagcaccuugagguuucauagugcccaguguugucuccugacgaggaugugauuuacucuucacugauaggaaggggcccucuuugucuacacuucggcagaugcuagagauccuagagugguugucaagugaaauugcuaaguaaauguuacagcuguauaaaguggauagaaccuaguaguucucuaaccuaguaagacugcuaacuugcaugcugcaugcuuucaggugcucuugcuguccuugcacacacaggcaguggguuccgaugggcgcuguguugacuuucauaaaccuguuguauuuauaauggugauuucuaaaaguucuuaugccccuaaggaguauguuccauaauuucccuagcucuugcuccacuguaagguucauuccacugggggaagugaacugggaauuuagcucaguuaguagagugcuuuccucauauguacgaagcuuugcauaaaaaccugguuugguggugcacaccugaaaucccaacauucaggaaaagaagcagaaccaggccauuugacuacauaguaagucccaggcgucggacugcaugagaccuuguguuucaauucauagauauuuccaaauagacacauuuuaagaauauagcuuuauucuguuauguaauuuccuuagaauaaguagagacuaugguguuaaagguuagaaauauuuugugauucuaggaaauuaccaugauauauccuucauaaauaauucugcagaccuugacucuuuaguguggugguugucuucagucuuacccaucuuugguccauacuauaaaaagcuuuuuuggaugcaggcauggcuauuggggugggaugggguggggugggguggggugggguggagugggggggggagagagaguguguguguguguguguguguguguguguguguguguguguguguguguguguuuaauacaggcaaggccaagaccaguuuccaaccacuccuuuccaagaacuuuuaugguuuggaaauuuccagugauuugaaccaaguuuuuuuuuuaaggcauguugaggugacagaaauagagaccaggagacuagugagauuaaaugcagaaaggaagggcugagugagacccugacuucaugacugcugcuguguuugaaggaaauacuuagacagcauacagugaaggcgcuguauaauagaacagauauaugcaaguugaggggugacugggaagaaggaaaagaaugaugcagacgagggcagcagcuagagauguagacuagacgacaguaauuuuguuugagagucaucuuaggagacacugcagacacauucuucagugaaugguauaguuuaacagucauuaacugcugccaacugagggaacucuccuuuagcagucaaacagaagaugaaguaagccagcaugucacauaucuucuguuucuagguccaagacaaguugcugcugucugcgugccaccuacuggucucacuagccaccaccgugcggccugucuuucugaucaguaucccugcagugcagaagguguucaacagcaucauugaugccucugcccagcgucuaacagauaagguaggacacaucccaguuagcauucuuggagcucuggcugaagaucuggggaagugguggcagaggaggcugauucugauuuuacaucugaguugaaagccacuucaacuucacagacuugcuucugugggguagcauuggcacaacuuaccgguuucucugacucacggccaagaucgauucagaugggaaaacgucccugugcucucauuggcucaggccagucuggcuuauauucucacauacuuuuguucugggguugagaaacuauuugggaggcucagaguaguuuggagcaggaaguggaagagguguguggguuuacagacaaguucuucagaagaccugaaugugagcaagagaguucuuaugagccuguucuuagugcuuauuugugggucagagggcagcaucaaaggccauaccagaaucaauaucuacugagaugucucccuccaugaggcuucgaaugccagauugagcaaggugaacaccagcuaggcuucuuggggcugacccuguacauugagacccagcugugggguuacuucuguguuucuuuuuccugccugggugccuuuagguagagcaugaccaggcuguaagaaagacaccuaggaucugaagcaguguauaggguacuaaaugugugucuauugguuaccagcuuucacuuccuuuugaccuuugauggaugccuuuggguuccuucuaggcgcagguguugguuugccgugcacuuucuaauaccuugcuccuuccauggccaaaucuuccugagagugagcagcaguggccucugcgcucgaucaaccaugccagccucaucucugcacucucccgggacuaccacagccugaagcccagugcuacugccccccagagaaaggugccacuuggugacaguaagucgcuucuguguagacauuugcaccuaaagcccuugaaaugacuuccguugcuucacagaaaaggcucggauaguaagaugcuuauuaauucuaauguacaucugcuggacauacuuccugagugcauuccccugucugcuagcuaaguguuggaaccuaaagaaacccucugugaacugugugcugccuccaucuauuagcccuagggugacugugaaccuauuucagauuccugugugaacugucuucugggugaccuuaaccuuuuccaaauaaaaacauuucagagguuuuagaagaacaugagccuucauauauaauacugaggugugauuguuuauauuaacaaggagaagaaaaugagacaauucuaauucauggaaagaaggaucaaguuucucugaaaauaacaaguacaaaauauuuuuaaaaauagaauacaucuuuucacauuaggaauaaugaaacacuauuagaugguguugcuuguagaagaaugccaacagggaugcuuugugaaaucucacaggugguaguaaagagugcucuuuuuguuagugugagugagguaggucuaacugugcaucucaggcuagcuuagaaugcagauagucaaguugucaucuuucuggcucaccuuuucuucacgguagccugcuguaagcaccauuuuucuuuguuuuuuuuuuuuuuuuuccuuuuuguuuuuuuuuuuuuuuuugagaugauuuuucuagaauucaucacauagacuagguuagcugacuaguggcaaagaagguggaggagguagaagucagaauggcuaagucugagacucuguaccacuucucaaugucucuugcuuucugagaauaaggucuuuaaugucuugguuguuguuuuuauuguuauuauuauuauuauugcuauuaucugagguagauagacucuguacagcucagacuguccuggaaguuuugauauuccugccucugccuccgagugcugaguguacaggcguguccuaucugccuggcuuucaugguuuguaauauacuaucuguggguaggccacagucacacauuuaacagugcuuucaguuuacuuuauguuuugguaaauaaacauugguccuuaaaauuuuuccuugagugucagacagaucugauuuuugucucuacacuccauuguuguagccccaauaccuuguccuuuaugucugguacccuguccuucaugggcuccuagccuuaucacagucucugagcaugcacaaguuugugcuugcuucuuaucagugguguauagugccuuuuguuuguuguugugccucccugugagcagucuucagugauccagccugugaugagucacugccuuccauccauuguccgugaggggucuagucuggccacuguuucagaugaagaaagcagagcucagcaguuagugacacuagaggaacagagcuagcuuugcacgucuccucagcaugccuucuuucugucacacccuccucugauuuaagcuuuagcccacauaggaaccuauggacucugagguucaagacagcgcacaacgcauacuggagguucgagaguggcucucucagcuucaaucuggacuagccuauggagcucaucaaggcugagucugcuaggcuugaacugagucaggcagccuccacucauguaggagaaugaugacagcuuucucuuccuaugucaggugcccugcuaaacuuugccccauaagaaccuaauaaaguugggucucuuggccugacuuggauccuacccaagguauaagcugguuccugacccucugcugcucacuucugauguugacuaguaacugccaacauucucugugcaguauagaaucaugcugugaacucauaugucaguaucuugcuauaguuaaauauguugccacuaauaaaaaauaaguauguauacauuaucagacuauaggccugauaggccaaagauugauaaaguaauuuuuccuaaagccaucacuauuacauugcaugguaggcugugccugugugguuagcagggugggugcugucuguugcugaagagagaugagucuauucuccuguguuaauugccugaucauuuguuucuucagucuucuuaucagcuuauaggguauuugguuggccaguugguguuuuauggagaagcagguguguguaugugugugugugugugugagauugucuccugacaagccuaggcuggccucaaacucagcucugcaguuugaacuucuacuccugucuccugagugauggaauuaaaagguacaccacacccaguuuuugugugauucugaguguugaacccagggccucgugcuuguuaggcaagaacuugagcuauauccccagccuaucaucuauuugauuuauugcuagagguagagggggagaaggcauaagucuaagugugcagacaauaggacaacuggagucuugaagguuaaaaggaagaggagagagauaggacuuggugccuauagggucauauaaugaaagagauaaguucuacuuguuaguaagacuucccuuuugccuuccuggucucuccucugcaagauucccccccccccccccuuguguauauuuccucuaauuauaccguaucucagacaacacauaacugaagcuucaucuugacuuacagccaaagugauuauucaccagacacuuagugucuuggaagauaucguggagaauauuucuggggaauccaccaagucucgacagaucugcuaccagucacugcaggaaucuguucaggucucccuggcccucuuuccagcuuuuauccaucagucagguaagaguuggcucagaggccugccuuauggaugaugguguucacaagggccugcuuagaucuauagagcagcuggccugggcugugcucagugaggccauacacacugacagaggcaaagcuaugacaucuuuggaaagucuggagagaugagcugagcccuuggugucgaccuggugccuguccugugacauggaguugcuugcaggcuccugcuuaguuuucuuuguaaauuaaggugggugggugagagauuaggcaccauaacagacaggaaggagaggaaagaggaacgguggguacugcuuccuuagcaccuggcugauguaaaccacugucagugcugcugucacccuagauaggccuggcucuccugcaagcagucacaguagacuuauuggucuuaggcagcagagccuuuauagcuagaugcacugauuucaucuuguaagcacuuuguguauguaagaaccaaaaugucccaugcgacugacauugugaccuggauauggaaccacacuaaccagaaucaauaaguccauuugguggcccagggcagugugaccugagcacucugucauuaucuacuuuuauccacuuaaccuugaccuacuacagcgaugauuggucuuagagggaaaugccgagguacucagguguugaccuaguuggauaauuucuuggaugugagcauaaagugguucauuuucaccgagagugcugaccaugcuggaugcgggacagugugcugggcuucacgcugagacaacuccauuuccuacugugagcaaucaggcagcuguucccaggaccagagccguguucucagcaggcccuuaaucaucuuccacuuucugucauuggcucugauggugcuggggacauuucuuccaguaggagagauuagagagagaugacagugcagauugcaaaggaaaaccgaugaagccggggcugucuugggucucugugcacaugguguugacuguuggccucgucugugcuugguuuagaugugacugacgagaugcugagcuucuuccucaccuuguuccgaggccuucgaguacagaugggcgugccguucacagagcagaucauacagacuuuccucaacauguuuaccagguaaccacacacccacuguccagggcuucagaggcaggggacaagucugcuacaaaacgcagggcuuccugcuccucucccucgcuugccguaagcauugcuugucaugccgguuccuaaagaaucacugugaguuacucuguggcuuucucuugccugcagagaacaguuggcugagagcauccuccaugaaggcagcacuggcugccgggugguggagaaguuccugaagauccuacaaguggugguucaggagccuggccagguguucaagcccuuccuccccagcauuaucgcgcugugcauggagcaaguguaccccaucauugcugagguacguaggacccgggaggacccuguggugccuccugacugggaggaagggaaagugucuuguguuuuaaaucucauuuaccaguucucucaauacucuuuucauuuuugggguccuuccuccccccagaaauggguacaucaugcacacacauacaugaaaaauuaauaauaaaaauuauuucuggguacuuagggcuuuuaaaugcccauaacucauagcuagagagauggcucagcauucaguacauacugcucuuuugggggaccucucuuccucucccucccaccccccaagaauucccucuacuugguagucuuguuaaaggcagguucuuagcgauaauucagauagagcuuuuaguggucuggaaaaaugaaaggacaggcacugacuguagcaagagcagaguaaguauagacacagauuggauguuacaacaguaguugagggaugggagcugauuuuauagcuuucuccaugaccaaaguccagagcccuggguucugggacacacauggcugugcagcugacagucagaauucugcagcaguguugggaaugauguagcuugugugcuugcugguaacuugaacauuugggcguuaaguuaggaaaucgugcuucagugacgcccugcccucucagaauccugaugcuggcugcaggaaaaggagccaugcacacgggcagcaauuagcacagcauguugccuccacugggagaccuuuagguuucucggauuccuaagugcucuccagacuugcuucucuuggguaauagugcugcuuuuagggcaucuuacugucauuagccucucagguugcauaaagguuagcuagcucacuguuuucaucccagaagagggacggacauaaccugaaggauagggccuaucaaauuggauguauucugaauagaaaauccauauuuucauugucuuugcauguuguagcccuucuuccuaguguuuaaagcugagauacuuguuagaaggagccuccugguacucauccuaaugucucaaguguaggcccgucucucuaagcacuccuggugaacugcccccucaauggcucagggucuucugcacgggaaguggcagaagugugggugggauaugaguacuggcuacugucuggcaccucuuaggcuucugugguggccuccuccaagcugcauggagggaagaugcaguguuguguggauuucucugcagcgcccguccccugaugucaaggcugagcuguuugagcuccucuuucgaacgcuccaucacaacuggcgguacuucuucaaguccacuguccucgcuagcgugcagaggggcaucgcugaggagcagauggagaaugagccccaguucagugccaucaugcagguaagguggagugcuuacuugugaagcugcaaugugcccugagaauauggggaccuuguuccugggcgccaccugcauucuuagcccauguccccuggguucuuuuugagcauguggcccccuucuuugaaccuggcccuacagcaaguguggggucacacugagcucugacccuguuaguauuuaaguuagucucuuggugcuugaaucucuucaucuguaaaguggaguuaguacuguuaguuccuaggugcauugugagauaaaugagaaugccaccaaguacacggcgugggcagaugugugccacauacccauucccuuccucuaacagcauguaaggaggagccuuugauggguguggugacacauguaguuccaguccauguggacugcagagugagacacugucugaccagagaggcgguguguguguuuaugugugugugugugcgugagugcacaccagccaucugccugagagcuaugugguucuuccuuauaggacacugaccagcuaggagucucuggagagcccaggaaucugcauuuggaaggggcauucuggcuccuaccaugcugccccauucagggcuuggguuugguguauucuaguuuuggcagacuucuuugacugagcuauggucucuuaugugaggcuuaaaaaagucacguugaacagaguuucauaguuuggcaguuucuuacaauguuacauauauggcugaacguaugcucuagcagucuaagguaaaugacaacguguguuuacacagcccguacagaugcuugccucuguucucaugauugcccucggcuggaaacaguccacauauuuacuagcucugagugggugaacccucugguccaggugggccauuccuuagaaauaaggaauauaguggagaugaacauauguugugcuagauggaaaaagacagacccaaaggcuuugccccagcccagcuucaguaacccugacuuuaugagauaaaucccauuacuauagcagcaauggcaagauuccuugcacagccaacagcccugggguagaguagccacucuguagaggaaggauucauguagucugcuagcuccucuugucucugauuaguuaaauuggaucgaggaauuuuguguguuuuguggauugaggaauuaugucuuucaauuuucuuuugagcuagugacuuucacuccuagacauuuuacucuaagguaguuuacacauaugcucaacccaaagcagauggaaugauugagaaggaaccucugaggacuuguagccugugaggcaugggcacuaaggagcaggagagucucugcagggauugucuagguaggcaagugggcuaugcugucugcucagauugcucaaggauuuggcuauuaguauggguaucuuacuucaaagauggguucuugaaaagauuuuagagcagggguucucaaccucccuaaugcugugaccguuuaauacaguuccucauguuguggugaucucuaaacauaaaauuacuuuuguugcuucuucauaacuauaauuuugcuacuguuaugaauuguaauguaaguaucugauaugagaccccuguggagguugugaccuacagguugagaacuacuauuguaaaguuuccuuuuaaaagguguaaaugagacugaaauggguccaugggaagacuugggugcugagacacuagagaugugaugcagaggucugcccuaacagacagaauugagacaggugacucgcccuagccuuccagugugcugcauaguguugugucuggcauaagguagaggcccuggagggauugugucugaggaagcuuaaaugcugcuuauuaaauaguaguuucauuccucaggcuuuuggacaguccuuucuucagccugacauccaccuguucaaacaaaaucucuucuacuuggagacucugaacacgaagcagaaacuauaccacaaaguaagugcccuccuuuccuggaaggaucccuccucgaguaggaauugugagccaagucugagucccuugagucugcggggaguacuuuggggaccacauugagccugggcggccccagggacccaagugagccugcugccccaugcaccugcuccucugcuugcagaagaucuuccggaccaccaugcuguuccaguucgugaacgugcugcuccagguccugguucauaagucucaugaccuucugcaggaggagaucggcauugccauuuacaacauggcuucugucgacuuugauggcuucuuugcagccuuucuuccagaguuccugacuagcugugaugguguggaugccaaucagaaaaacguucuggggcggaauuucaagauggaucgggugaggaaaaaaaaaaaccaggcuacgggaaacacaugugugagcucuugagcuugcugccauuuagugagaggcccaucugggucugggcgugguuaucccuaauaguagguugucaucaauaccucaguaacuuucugcugggguuggguguggagggugcacucuuucuuccucagggacuuggcuucuguggcucacauguucucugucucagccacugaggccccagguccuggccucagcaggccgcacguugucaagacuuuuguucauuuuacccucucaacaugcaucucuuaauggucuagaagauaccacgcugccccucugugcuuucaggcaggcuaaaagauugauauaacuuugggcccccaaggugguccuguugcuuggcugcccuggacuuuauguagcucuucacagcccagcacuggcacagcucaacuugguuaaaggagccucguaacauugacccucuauguauaaacacugaucccccccagggugaggucacaaggggugcacuuggagucaccgaugccccaugcugucaggcuguguaucugcuuuuucuguguuguguggccauagcucuuccugcugcucuguguguauuaggccuucuuuugaacaaggucuuugagaaguuuuuuuuuuggacaaguacugcuccccuuguccccuucuguggguguugagaaugugcucgcugcugggucucuuggugcucuuuauuucuaugcuggagcacuguucuaagcucagguuucuggccucucuccccccucauuuggcauguguucuuuugugucuuagaguugucuuuucuuugggagucugucuuguuuucucuucagccacuugaguuguuuuuucuugguuuccuggagaccaacuccuaauaucucaugguuguuuugcagugccaucaguauuggucaaugucuugguuaauacauuggguucuaaaucugguuaccccuaggaggcauauugaaaauggagaggcgugcuuggcuccaccaagggaguuucagguuugguguuugggagcugcugacugaaaacaugcugcuuggucaguuuuuggcuugguuugguuugauuauucugaguugaggucgcuuuguagccuuugcugaacuugguuugugaucuuucuucccucugccucuuauaugcaugugcuacccaccccuuuucugcccccccccccccccgccagggucuuuggccugaaacguaccauauagaccagguuggccucaaguuuguagagauucuucugucucugccucccaagugcuaggauuaaaggugaccaaccaggcccugugcuauuccucaggauggacaggaucacuuccccugaggucuggcauugauucaccugcuuccaugcaugcuuuuguggagacaggcuguguggugaauuuuugggucacacuguuccugguauuuccugcucuugcaaccaccuucuaaagagcgacucuucucuccauuuuagauggccuaggcuuagaagggcuccggguaguggaacaggaucccagcuguguauucuggccggagagcguucgacaugaucgaucugagggcacuuugaaaguucaacacaggugcugaccaggccagcuaaggcaaggcaggcagugucuggcgauggggacagguuugagcugaguccagaagaaggaggugggagacgcagaaguagugucagcuguuugauguggcugaguuuugcacagggaucaccuugguagccaagguaggauguuaguugugucugugacagugugcauaguguugacacucuucacaucuggaccugcacaacagguucuccaauguuucacacuaagcagugugggaaacuguggagcaguuucagcaucugggugcucccagcagggcggcucuguggcuaggcaguauguucagaugccaugugacuuguaggcauuuguggaacucaugaggaaggacucagaugugagccgucaaaggcuggccucugggaaggggagaacuaaccgggcugcuggagcucuuccucccuuccugucugaccuguaagagccugcacuacaggcugugggaucguccugaauugcuuucagcaggcccauggagcccugaauuuuugcaugugccccugacccaacuuggaaucguauuaaauguuugcauagagccaaaagcacagguguggggcagcucaugaguuuggcagauggguagccuaggcuauuagggucuggaggaccuucaagagccaggcuucagcuuuccccugccuuucaggaccuaccaucguucacccagaaugugcacaggcugguaaaugaucuccguuacuaccgacucugcaaugacagccugcccccuggcaccgugaagcucuaggagugccugcuugccuuccuggcugcucacugccccagggaugugccugcugccaccaccaccuacaccaccugcaccugugccacggaagucugugacaagccuugaccacucucuggauuggugugcccugagcaaguggccugccucugcccucuccugcugccuccagcacagcagguuuuggaguucauuugacacugguagaguuucuacacauuuggagcaggcagagggaccuauggccagaugccagggagguacccagagaccccacagcgugguucaugcagaucguguguaucaguccugagucaaaauggccaaggaccucugacaacagugccaccuucucaccauuccaccuccccuccgcuccuggcccagccagcccaggagaaauucgacauuggaacuguuucugucgauccuccugccccuccaauggccuugaagucucugcucuuugucagagauucacgaagacuuuuuuuguuguuuucucaucauuccauugugauacuaaggagcuuaaugacuaaauaaaaugcuuaaguuguuguuauauaaacacuagugauggggcaucuuuguaccugagccuccuuaaggccgguuaccacggagccagcaggggaacucugugugaugcccguguugucuugggagaguagugagaggaggcccaacugcuguggacaugcugcguuucccucacacuaccuaaagaaacaugcccaaggcuuggggagcugcucucuaugacagugagcccgcggcagaggcaggagguaucgucccaaggccgucuugcugcuggauucauauuccuuucucccagcugagaugugugggacucugggacguggcucaccagugacuggccuuagggaaggagagagcacgggcacccaggcagcagguggguaucaaggcccagggccagacucaucuaaguggagcagaccucagaggguuggauaggcagaggggugacagaaucucuaggcugaaaguacugugaagcugagcgaagauaaugucagggagcaggcagcuuugguggggucaugagugggucuugucacccccaaccccuuacuacacuaguaaguagacauucucuaggacagcauucuauguuggggccugucaccuuugucacaugagacaaccccgagcuggcuuggugucauccagaauuggugacaucccuucucucuggagcaguguggguggggcuagguagguugugacaggcaggguagugugcuaugcauugagcauguuuggggagugugcuuuggccacugagucugguuugacagucucaguugcucuguucuguucuccucucaugcaaaccauguguccuucugagcccuccucucuccucucucgucuguucccugugucaguggugcugggguauucacacuaacaggagaaguugaagaugagggcggccuguguccccagcaugaugcaggcaaguguggagcaagggccucaaacuguugugugggugaagauuucucagacuuuuccacauggcgcguuccccacaggaagcggcgacggagccuccugacuaacccucggcauaaugaagcauccuugguaugguggccucaccuuucugagcuccucagggagggcgcucaagugccccucuucacugacugaaggagcaccugcucaagggcucucccuuucuuccugucucucagcacuuggaacuaccuuuaaaaggccuuguuaauuaauugaggccuuuggaauuggggaggcguugauggaucuaggaaagcuagcuccagaauccacugcaggcgcccaugggacgggaguuuagguagagugugaacucuaaagucagugauuuaaaugacucacucuggagugcagguccucccuggagugcagguccucccugggcaggcauuuuagaaauugguagguuuuguuuuaaaaaauaagccucauuuuuauuucuccuguuuucaguauggaaauaauauguuuguagauaaaggagaauggaaaugagcuucaagcuuugaccuuugguccuccugccucggccuccuccaagugcugggguuacagguguguuccaccaugccugcucuccaggggcccuuaacacaaauauaccaccaugcauucucuucuggucccaaaguugaaggaaagaaauuaaagcuuacuuaacuacccuuaugucagguauccuuccagcuggagggcaaucaugcagaucuggccuccagcccacuggcugucuaccacucucuagcuguccucugguagaggccagagcuggauacuguugauauccuuggaacuuuuuuuuuuuaaagauuuauuuauuuauuuauuuauuuauuuauuaauuaauuaauuauauguaaguacacuguagcugucuucagacacuccagaagaggacgucagaucuuguuacagaugguugugagccaccaugugguugcugggauuugaacucuggaccuuccgaagagcagucgggugcucuuacccacugagccaucucaccagcccgauauccuuggaacuugggguggcagaguucccauguugcaaggcuauagcccacccacaccgccuccucugcuucaggccuugugcacugugauggggugaggccugaucucugggugaccuuguuccaucaaggacaagugacucaacccaugaagcaagcuaugcucagcucagcaucagugugcccaaagguuccaaaccccuuacccgggacacuagcccaggggucugccucuuguagaugguagcuucugaggagucccugccuguggaucugagcacuuacaguagaggaaauggaagcuugggaagaggagugaugugcccaaggccacacagacagucacuagcuaagcuugagucauucugggccucagccuugcugugccagcauugguucguuuccuuugcuccaauggggaagccaggaccuuucucggucucagggccugagauguucaucugcugucuccagucauuuauagauaccaucuuuggugauugaaaaggcuggggugugcugagaugugacuacuccucuguccuuuccuugucuuggcuggaguaccacuggcuaaugacuauccaggguucuccuggcaacacugcagggauucuagggcuaggccuggcugaaggaagaagaggaagcagaagcccuuugggcuccaguuuggccacacuuaguuucgugcuguucuuacugggcuacauccucgagucauggagcuagagugcacaugcugcuaacugcuucccggugccuggcagggcucggagucagcuauuccugcugcuugcucuggugacuuggagaaugguuugcaaguggcccaggcagacuguccuuuggagaggacuuggcacaguguagggucccugggccucgucugcaguugagcuggguuucccuuuggaaaucagcugugggcaucugaccuugcauuuccugagacucugaccaguguuagaucaagaaugagguagucaugggcagaggcaagacgaagucccuggccucaggugggaaugaucacaggaaguacccuaccauugagacacacccccaacucagacuucauaagauacaguaggcagccacacugugacgugugcucacuaauggccacaugaagaugucugggucccccggguuccucagcuggagcucugcacaagcaaggugggucccagcacagggagcaggcacggcuucuugggaccaugaucuaucucucucgguuccaggccccugccucuggggaugcugaggcacuugagaauuuggagacacacacaggaggccugaucacaagucagccuccagcagauauggguucgaguguagacacgguaguuucccaggcccucagcucuggagaacauggcgccaguguuccacuccauccagagucauuccaaauacgagugguaacugcccagcugugccacuguguaagcacaaccgcagccuucaggcaaguugcguaggcccaguucucagauguacuguggagucaggacagcaccucugagugaggugacagguguguuuccugguugccaccauugcucauuccugaaaacuagcuggcuuuacuacaagcucagggguauauaacccauagccaguggcccugcaucagucaagguaaccacaagauucaggagacacuugaucuuuuuauuguugucuuaaugugagugcgcacccacacaccuaccugcuuuauucaaugcuagaaauugaacccagugcuucaugcaugcgaggcaagcacuuuuaucaacugagccguauucucagcagauucuuggccugaaaaaggcuggaguuggcuugagugaggugcuuuugacccugagacaggucacaagagagaagccugccucaggcuggacuccaggacuuagcucuugccuucccuuaagucucucauacaucuacggacuuagcacuuuggagaagauaguuuccauucagaggaagugacucagagaccacuggcuagaagcuuacucagccccauagcugaaugcagcugaccugacagcuaggcuucaaaggaggacuggucacuguggcugugggaugaguggauaugggaacugauggccuuaguggcccagauccaggagaccuggcaagggagcacuauugagcaguacugagugacugcaccaaggugugaacaggaaucacccuuaguucuuaagcauucagagacacggaguugcggguguagaucagugauggaggaugugcugcccugcguuugaccucuagcaucccagagacaccauauggggaggucaggagcagugccgcccauccucccaucaugccgugcucuacaggaaacaggacaagagcauguggcuguugcuagcgcugccuguuggugcccacaacuggcugacacacacacacacacacacacacacacuguggcuguugcuagcgcugcguguuggugcccacaacuggcugacacacacacacacacacacacacacacacacuguggcuguugcuagcgcugcguguuggugcccacaacuggcugacacacacacacacacacacacacacacacacacacuguggcuguugcuagcgcugcguguuggugcccacaacuggcugacacacacacacacacacacacacacacacacaccccgucuucuucgugccaugagagagggcuugaaguggauaugcagugugcaugucaccagccucugaggacacugccuggacuucucucaggacaagacaucaggagaucauccacccuugugagcaagagguuggguucccuugcuguggcagcugccucacccucaucugaugugaacaauucaaggccguuucagagggccagucccuugucacuuggcuccgugugacuugaggaugugaugacaauaggaucacagcauucaccucaucaccaacaggaagcagagcacaggauaggaaguggccagggacacuguacucccaaagacuuccccggugaugugcuuccuccagcuuggcuccaccggcuccacuuucagagauacccacgauggagccugauucugugucaggaccaagcacacauguaacaggucccuguugcguaaucgacuugagaagguacuuguuuuagaauacuccagaaaaggggcuggggagaugguuuaaccauugaaagcgcuaacuguccuacagaggagccacguuugauucucagcauucauaggguugcucacaaccgucuguaacucaguuuaggggauuugcugaaguacugcaaugucgcagcucccuagccagugagagcuagacugcagccacucuauucucgccagcccacagcccucacacccgugcucucacuugggcuuugacauuugcuguccccuccuuuccaggccgccgguggcucaccgccaugcuuccccucuuccuuaaggucugaguguaggucgacauagacagccccugugcuucaacaugcacagcuuugggcuuaauccugaccagggcaauggagaguaaagagacaacagaugacacacacacagaaaagcugggauccagugggccagguggagccacacuagcagcugccuggaaacucaaugggguuuaacuacucuuagucaggagucucuagugggacggucauccuggaggaggaaacugccuucgaagaagcugcaaagaaguggguaccuucccuugugcacaccgccagcaucccauacuuggaucaagagaaggccugccauucucaaagguuugaggaauccucggcauggcuguguucaugugucguuacacacaaaggagaggcccguugggcucauaguucaauuucagucccugcuugcuugccuuggucuguggcagcacagacucuuguggcagaagcaugugguaguggcgacuaguuaccucuuguuggcugggaagugcaaacauaggaagagauugcggucccaacguccccuccaggacaugcauauccugacaugauuuccucugcuagguaucauuccuuggugguaccacaggcuagggaccaacucuuaauaccucuagaagauaguuaagagccaaagggaaccaacucuuuugcacaggaagcucuugcaggauuaaauugaaggcuagcucccuccugcaaauagguuuccuucccagaauccauguuugaccuuguuuaaaaggagucuggagaugaagucaucuuguaacauggaguuugcuuccaggcuaagaacaggugucuccccagagagucacauggggcuggggaugaagcucagcugguagagcaucugcaugguuagcaccaagacucccuagcugaggccuuaugggacagaugcuucaccugaggucaggggccaggcucuaggcugaggggucaccagagaggccaauuguaggucucuagugcugguuagugugggugccagagcaauagagaagguguuaccacgauagguaauaguggcugaggccacuuccugcagagaacugcaugugugaaguuauagacucagugaggguacauccugggguaaggaguugcagugugagggaacuccggagcacacuggggugaauuuagcaugggggugggggugguaguggugguaaggcccaaagacaugcgauauggccaggaauagaaaugagcagaauauaucuggggugagacaauaggaugugguggggacuguggugccaacaaacaaauccacagcacucauucaccagcugucacauguggccccaucagcccgugugguagacauggcuggacugucagcaaggacuggcuggcugggcagugguggcacacgccuuuaaucccagcacuugggaggcagaggcaggcagauuucugagcucgaagucagccuggucuacagagugagcuccaggacagccagggcuacacagagaaauccugucuugaaaaaugucaaaaaaaaaaaaaaaaaaaaaaaaaggaaaagaaaaagaaaaaagaaaaaaaaaaaaaaaaaagaaaaaaggacgggcugugguggucuuaaguuacagggacagaaagguggcauuccuggagggacauacagcuaugugggcccuucuuggccaauaaucagcuggcuggggacacucccauaucugacacaaacacugucacccaugcuugccuuggaggcaucuuguuguggagagaccuuguauaaaaaggugcagcugccaccugcccgcguccucggcacugggaggcccagggacugggccugucaggcaaagcagccuugcaaauccuaucguuuagccagccccgugcugagggauuugcucuuaaugaaucugccuuguuuuucugguguugacaaacucuuucucgucauaaaacuuucauggcucaauuuagcacuggggaauagacucucacuuccccgccccaugccaugcuuggucuagucccaagaacucacccuggcucugagagauccccagaacagugacuccccuacuggccgguagggaacuggcagagaccuuucuuggucuucuccagacccugguucuuaguaaaggugagugggggcuccccuggagcauggggacaccuguccaaguaccacugguccuguagaccaucuaagccaccagagggcugcggccagagacugaaccaugugagagaaggcgggguauccagccugcccgaagacucaugggaaauucuuuuugcgaaguuugucacacagcuccugucauagcccucccucucucagucuuggucgugacauuuaggggcaacuggucccauacacaguuccgggugguguccuccucacuguucuauugcugugagaagacaccgguaccagguaacuuauaaaagaaaauuggagguuugaguacacuucuaaaggguuaaucugggacugucaugguggggagcuuggcugcuggcaggcagacguggugcuggaguaguaguuaccuucugagagcuuaccuucugagccauaggccuagagagcgaaacugagccuggcgaggguuacaugcccacccccagugacacaccuccuccaacaaggccacgccuccuaauccuaaagggucugggauccaaccuucaaaucccuacagggaccauucuccuuuaauccaccacaagaagauuuugaccugugggggugggggcagucagaauaucucguuuucucccugugcacagggagacuuagggaaccauuugcugggacaucugagaaagagacauuaccaccaucuaucuaggaggaggugugggagggacugugaugucaguaagggaggcagcugccucaucacagcaagaggaggagcagaggaugaacaacacugaagagcuaaagccagagagcugggagcaucccaguccuugauguauccgugugagcuggaccaagccugucuagagacugccacugagcuggcuuaaaccagcccucaacagugcuccaccuuccacguuguuuuguuuagcagcuggaccucuaaacagagcccaugagagcaucgcuucugugaaaagcuaaguaaguuaguuaccagcagcugaagacuuuguucaucaguuuggggaugucacucaguugugacaggucugccaugugucacuuauuucugcugacuaggguggcuucaguucaaagacacccaugguuccugucuccuguugucauugcucagaacccuuuucuccauacagggcaaggauaacccacgagcagggccagccugugugcaugcaugccccgugugcaucucagcucagccuugaaauggugagaucagacucuuauuggucugagagguugguguccucagacccuguggcucguuaucugggguccaggagaacacaccaaacagggucugagaaucacuuggauguagucaaguuacggaugggggagggccugguuuaaccagguccagaaacugcagggugggagguaaguaagacugccugauuuucagacccccaggcuccagggggucuuaugggagugggcuguuuucuggaauuucauggguggcaggucucucucucucucccuuccuuuucuuuuuuccuuuccuuuccuuuccuuuuucuucuuccucuuccuuuuucuuuuucuuuuucuuuuuuuucuuucuuucuucuuuuuugguuuuucaagacagaguuucucuguauagcccuggcuguccuggaacucacuuuguagaccaggcuggccucaaacucagaaauccgccugccucugccucccgacugcugugauuuaaggugugugccaccaugcccugcugguggcagguuucuuaaagggcuuauuuuauggcccugguuucaggguggugggauccuuuggaaaugaaugugugacauuugaggcuaggcaaacccuuaaccuggcuuuuaagacaacugggaaacagacaggccugugagcugccuuaugugggugcugaacuagaacucgggcccucugcaaaagcagaguucucaacaauugagccauguuuccaucaccagacugguccaucagggaguggagcagaaagccaagugauuauaaauguagcugcugcccccucuaggucuccuacaccccccugccugcccuucuucaccauaugacccucaccagaagccgagcagacgcugaccccuccggaguguaaaccaaaauaaaccuuuguuuguua

SEQ ID NO: 4083 - RNA, 574 nt, Mus musculus
aguguaagaauuuuuuuuucacaguccuggugcugguauuuuauuucuuuguguccauuaggccaugaauucguauggaaugggcuccaacagcucaggcucuuuuccguuaguccucacaaagugugcuucucuggguggcgcaggcuggugcuucagcugcacccaggugcccuucucuuuggcuuccuuuuucuucugguuguucuccuucacccgcuucaggaagcugucucugcucuuugagugcuugaugugcucaauccgcacauugauccucuuggccagaauuuugcccuuaaccugcuuguugacaaugaugcccacggcaugcugggugacacuguagacucuuccgguuuugccgugguagcacuuauggggcauuccuuuuugaacagugcccauucccuugaugucuacaauaucacccuucuuguagauucgcauguauguggccaaaggaacaacgccauguuuccuaaaaggccuagagaacauguaccgggugccucuccucuuucccuuuguguucgucauuuuggcgaguuacuggaagauggcugccagaaua

SEQ ID NO: 4084 - RNA, 574 nt, Mus musculus
uauucuggcagccaucuuccaguaacucgccaaaaugacgaacacaaagggaaagaggagaggcacccgguacauguucucuaggccuuuuaggaaacauggcguuguuccuuuggccacauacaugcgaaucuacaagaagggugauauuguagacaucaagggaaugggcacuguucaaaaaggaaugccccauaagugcuaccacggcaaaaccggaagagucuacagugucacccagcaugccgugggcaucauugucaacaagcagguuaagggcaaaauucuggccaagaggaucaaugugcggauugagcacaucaagcacucaaagagcagagacagcuuccugaagcgggugaaggagaacaaccagaagaaaaaggaagccaaagagaagggcaccugggugcagcugaagcaccagccugcgccacccagagaagcacacuuugugaggacuaacggaaaagagccugagcuguuggagcccauuccauacgaauucauggccuaauggacacaaagaaauaaaauaccagcaccaggacugugaaaaaaaaauucuuacacu

SEQ ID NO: 4085 - RNA, 7955 nt, Mus musculus
gucaggagucugauuacaaauuuuauuccauuacaaauagcaccaaaccccuugggcuguccuaguagagaggacaccccuuccccguuucuggacucccaucucuucccugggcugcccauguagugucugggagcugggagauaucccagggcuuccuucuuggaccugggccuggugagggcuucugccugggaaccgucuugggugggcccaaggcccagcugcgaugcaucaguggccggguaagcaccggcuccucagaugagcacgcuggacacggggacucggguagaacggccucgcugagguacuacaauccggucaucugagggcccagacucaugcaacagaccugcgagaaaggggucagagccaaggccaguaagauaagagccagcaaggggacacaggcagcaaggggacacaggcagaggggcccagaugaggcagcauggagagcccucagaacugcacacagacagagcccaauccacuuccagacagacccaaagcuaagcuggaugagccugggaugcugggacucuugcccccagcugguggcaugaauggaugggcuagucugaguggagggagaacuguagaguacauacgcggagacagacagacaggcaggugguacugugaagguggaccuacagugacccucacucacccugcacguggaguugagcccgccggcggucaucuucaaugaacauggcggugcccaggaaggccgcaccacccagugccccaacgaaagcacagagcaugagcgagaacugcagagcccggaacucggacaggaaggaagggggccagcuccgucggaggcggucagagaucugcagggagaaaagagucagagaccuggggggugcagagcacugaccaagaaaacagaggcugggaaggggaauauuugggucauagggugagacccacagccuaacgggcaaaaccuuccuauggcuuccuuccuauacaccagaggaccaaaggggagaugcgccauaggcaucuauugccuaaucuuggccagacucaugccaccagucaggguagggaguuccagguccccaaaaccauuccaucccagccaaggauagcacuuacuagaccaaugagguaagggcucccugcaucuccuagcaagugggacagcacuaucuggaaggccucagccguggaccgucgaguugggaucaccacguacugggggugggaagggaagaacucaguagguucccagagaaaccaaggccaaagcccacuguagguccaugacaaauuuucacucagguuaagggcuggcagacaugaggugggccaagcccagcggucccucuguggcgggacucaaguauacguaggguugacguuugaaggggaaaagccagacuccagauuaaacgcuaccucccgaccccgucccugcucccaucagccucuggauuaaccuguaucugcccuacucaccaacaggaugucagccacaauggcccaguucauggacaacagggucuccccaauaaagauaaaaaucuggguggcagaaguggaagagaaucacgcggcaaccaggcuuacccaguaacucaguccccauugcaccccacgaggcaggugccagcccucaguaccacuucccacccgaggaaagagcaaggucaugcucacuggccagugucacccagcugggaaggcccagagcugagguuugaaaggaggcauuccaccuccggucuguucucaaccacuuugcuggcugacccugcacaugacguugguugcuagugaccauccccagugaacauggcgguacccaggaaggccacgcugcccugcugcccccacguaaagacaccacccaccagacuccaguaucccacucacauagguggccacgaugcuaccucgggcacaggccagggccaggaagaggaaaggcgccgaacccaggaggccagcugcacagacgagugggucagcccgaggguugaagcggcgaaggcggcggcugaucuccacucccaggcccacacccaggacuccagucaggcaagugaugaguccaaagaugagacuaggggugggguagaggcaugggagcuauuccuucugcaagguccccugacccagagagggcaguccaucccaccugcccucgacccgaaucccuacagcacagaacuccaggcccauguguuaaccucaucacaugauuucuuagaggcuccuaagagugaagguagcggguacagucaggauuuacacucuccuggccugagugugaacucccuucacgagcccccuacgugcagucacccacccagccccucacaaguaccugucagaggaagagcaugaaucuccagggagacagggcggagucucucccagaacaacccgggagcgcagcaggaacgcuggggcccagagagccagggagcccgugacaaaggccacagaggugaagccaagggaagacaggacgaaacuaggacugcagacauugagaggaagucagaccccacagccguguccuccucucccucccuuagucuauugucagacgguggauguggucugugccugcaucccuggcccuagauacauggucuccuagcaggacagaacacuuggcccugcugagccucagagauggaaagggugaacucacuuucgugccagugccuucagaucugcccaccaagagguggggcucagggguggugaaccugaguggcgcuccacggcuccucuugggggcuccuggaccaccaggaacagcagcaggacagccagcacuccuagaccuggugucaccugggaaaagugcaagcuuugggacacgggcagggguacacugauugaggggugugaacuuagcucccaacggcuuaagcauccauaaguucugagacgcugggguugagggcuucagaggguuugccucuggggacauccuaauuuuauaagccugacauugcugcuucuuuggugggugacaggacccugauuguucuggggaccccuacccaaguucucacuucgaaugguucaaauuagaucuaagaccuaaccaaaaggaagguuaaucucuagcccucaguaacugaguauguaacgggcacgugacccagucacgugacccaggaucauccaaucagauaccaucaucucaugacuagaguucggggaucugagguacccaaguuguucggcugaaaggugaucacuugggacuccuggacgcaugaggauaaagucaacacaggggaagggaaagcugaaauaaaacugagugaguccagggacggcacgggagucccagcucagcuucacucagagccuuacagcagggcugcugucaccugcaagcggaacuucuggcucccuguugaggaccaggcuugcuacaggcucagcggagcaagcacugccacaaaaaacugacggaguacacaagacuagcgaccuggcuuagugaguaaagagccaagccagaugauccaaguuccaucuccaggacccucgagucaaggagaaaaaucaaacuucccaaaguugaccaucaggcgcacacacacacacacacacacacacacacacacacacauuuuaggagaguuaaagggcauaucucaagguuagagggagauccuuaagaaugcggcuggcuccccacacuaucaucagacucacccguagagcccagugccagucuccagccacgucuuucacuuuggagccagcaauguaaccuagaccacugugggaagggaggcaaggggaacacgcagucagugagacgcccaccaaacccuugccccacgucaggccggcggcccacucaccugcccacagggauggcaaaguagaagauacugagcauccgacuccgcuggucugccacgaagaggucggcgaucagggugggcgcaaugguggaguaacuggccuccccgacccccaccaggccccgggucaggagaagcagccagaaaugcuagggaaggagacauggggggagguggcaccccacccuggagccagccucccaggagaccucuccagcuagugcuggagaaacggcagaggcagugagggaggccuggguuuggagucacacagaccuggcuggaauccuggcuccauuuacuagcugugacuuugagaaaauagcuuaaccucucugagccucacuuuccucaucuguaaaaggggaacaacaaccguuuguucacaacacugugaggacuuugcacucaagaggugcaaaauaaaucuaccuucccucccaccuaagaccacccaaugaugaauacugaacuuagcuggggauaaucugcuuaccaaagauaccuggagcuaaggaaggcuacaugaccgccugagggcacuagggccuggggcugggggcagcagauaggggaagguuucaaagucacaacaaaagcauuagccagagaaacugcaacaugcgguaucauguguuuucagaguuuuuuuggaagggagaagugggucacugugucagaggcuccccugagaucuaccaagaauggggccucaugaagcaaccaggagaacauguguccacagagccaaccgagcaacaggggcagcacauggggaugggugagcugaggaagugcaggccaggugacagcugaccccggcugcccucucacccacacuagcaccaggcucaggaggaacccaacaccaggaagggagaggacaauggcugucugcacagagaucagagggggaaggaaaacccgugugcccgggugugcagggagacagcugggggacaagccauguggcgaguggaagaagguucuagaagaaaagggaacaggguagagugggcaggguaaugugggcaauggaagauggcacagaucaaggagguuccccgacucucaauccaaaaugacugcagagaacaacagcaaauacugaugggaaguggggagggaguucagggccucaccucucuggggaugaaggaugaucccagugucaccagggaccagaaggcaaugcccccgcacaugagguacuuucgauuguaccugucacccagguagccaaacacuggugccaacaccauguaacuggagaugaacacuggggggaagcagagagucacagcccaguccaggucccucagcaacccccuaacacacacacacuccucuaguuagagagcaaaguacaaaacugccuaaccagcgauuugccacccuccuccucacugaugucgcaccauccccagcccagcccuguagcccaucagggccagagggaugauccaggcccaaggucacgacuuuccaaaacuuccuuuauagaauggaucaucagucccucccuucuacccagccugaaaccaaauccaccccuuacacccucuacaauguccgaucuaacccaccuccuuccuuucccccuucucugcaucuucaaggcaacugccaagaccacacacauuaggguucagcacccacaucccgucuaucugggacauuuucauuucucucccgagcgucacaaaaacccaacugcuucaaauucuaacucagacacaaccagauugucauuuucuuuucuuuuccuucugggguuggggaggagagaaagucucacuguguacauaaggcugccuaagcucacagcaacccuccagccuuuugccucccaagugcugggauuaaaggagugugccaacacaccuggcucuacccuucuuuuacaaaagccuuauccaucugaaaaauuauuccauuuuaauuaacccccucaggcacagcagggugucagcuccugggugggccaggucugcaucuccuuuaauucauaaccuagcauaaaacacguguccaaugaacgaguguugaauccacaccauguggaccuuugaccucguucucuuuucugcacacuuaaugcuucuacccaguuccucucuggccuggaguaggaaaaacaaauacuugaaaaccuuguuucaaauucucauucaccucuuugcuuaugugacccugggcaaaucuuagcucuucugauaaaaauacagguagcucucccaguacaaauaggaaaggcaaugaaugcuacuccucagcugacagaacuauaggcaagaauaccuggccaacguccuuguagggccccuaccacuucuagggcgcacuacuaggaccuagcacauaauaggcucucagaaauggagacuuuccccccacagcagugccaagcacuccugccauuguauccuggugcccacuaugugccacacacaaggcaugaccuaguccucacaccagucuaaagaacuagcccauuuuauuacuagcuucauucuacagaccagaaaaaugaggcuuaaaguggaugaguguguugccuaccgacucauaauaacuagcuggcucccucugugcgaugucccagcucaaguggacagcccaagagcagccacggccauugccuccaagagcccuggccacuaaagcuucacuaggcaaaccugcauguauguaggccuacuugaggcaauuaagaacgagggguugugugggcaguagccucacucaccagucuggaugaggccaguacuaccaucuccgauguuaaagaacugcucgaugucuguaagaaccccuggaaagaaaaaacaaagaaugagcgccaagaggcgacccuauccuggggaacuucucccuugccuauaucccuucuucggagcaucagugcguaccugccacggugaagcgguccauguaguucaggagguuaauguagcacagaaccaccacuaugagggucgaauggccccgagauaagccagugaugcgcuguagccccucacagucugggaccucgaguuccccggacuuuggauuccccauggguccuggcaaccccggauggccgggcgcuggcccgucaucaggaucaucugcuuggcugaggaagggcgccgugucggacccggccauggucccuggggaaucgcaaccgcccacgcuucgguccuaccuccgacggaaggagguuggagagaggacugcgagaagacuugcccacuaucgccuaggagcgugguccgaugcacagugcaccacugcgaaaagcccugggcuucgucauucccucugguuccgacagaggagagcacacaggaggugcaggugacgcugggacaggagcaggaagaccaggacccagucccucuucucacgcugacgcacuccaaagcccgggaaggagcgcgccacacucgcuguugcucaguccaagcucagcaacacaacugccgccauguugcccaagagcaggucaugugacaccggagcccuaccggagaaagucacccggugcaaggauugaacacgugaccugccaccgccuacggaagccuccaggguuucuagggcuccuccgcuaugguaacccgacgcucguuccuacuuccaccaguagccuccagggggccucgcaagcugguguaaucaaucgccuagauggaauacccauuuauccgauuucacgagauaguggauuauuuggaaauauuacaucucuacagaugcuagugaguuguuuccucuuuucuucuucagugacuggcugauggcuucauugcucaguaauuguuggaugaauagcggcgagcagcugccuccuuuuguuuaccaaucaugagcuuucacuguggacauuuagauuccuauagagucgggcguaguagcgcauaccuuuagucccaggagaaggcagaaggacggagaucuuugcaauuucaaggacagccugguuuacauagcgaguuccaggucagccagggcuacauacugagugagacccugccuccaagaaaagaugcuagaguuuaggaggaagaggauguuuugucuauggccucgaguuuuucu

SEQ ID NO: 4086 - RNA, 1890 nt, Mus musculus
ugaguugugaaaaggcaagggguuuauuaagacauuagaaggauuagcauaugcacaaccaugguacugacaguacuuacauuuuuuucaguuaauuuccacaugcaugagugaaugccagcaggguauugaccagcagacaaacauuaaaccaucaaagaccucucagaauucagaccuuucugaguuuugaaguuguauuguuucccaaacgagcuaagugugcauagcauguugcuggaaagcgcagcuagcucccagucagucuacaaucacgagcaugaacccuggugcucuguaguacauugugcagauaagcggcagcaaggccuuuaucaagaguaaccccgcuguaaaccgagaagcauucauauuucaaugaucaggaaagaggagccagaaggaagccucuuuucuuugcaacagggaaguaagucucuuauuuuaauuuguaauugucuuaaaaaguguuucugaguugugcugugcuaugacauauauuguuuugauauuguguuuguagaguauuucagaggugacaugcaugaagguguuuaguguggaauggaacuccugccacacagagguugaggacacaaaaggaauccacagcccaagaucuucagcuucuaaccuuaguuccacaaggcuuuuucuguggcuuccgagaaugaggacuacaauucccaggaugcgccagucuuucaccaaccaggaaaauggauuucucuaaugggcgggcccuggggaaggcugggucaggaggaaauuuagccaauggaugaacuguacagaaucgaaaccuuuuuugauuguaccaaagagauuggaaucuuuggcgccuuuguuuuaguggaggguaggugauagacagguaaguagaccaaugagaacguggauaggcggauccagagcgugugggcgggaagagaugaugaccggcaggcuguucguccaaugaaagggacagacgcuaauacggugggccggugacuguguagaggccgguguuuguggaagcagugugggagauggcggaaccacugaggggacgugguccgaggucccgcgguggccgaggcgcucggagagcccgaggcgcccguggccgguguccucgcgcccggcagucuccggcuaggcucauuccagacaccgugcuuguggacuuggucagugacagcgacgaagaggucuuggaagucgcagacccaguagaggugccggucgcccgccuccccgcgccggcuaaaccugagcaggacagcgacagugacagugaaggggcggccgaggggccugcgggagccccgcguacauuggugcgacggcggcggcggcggcugcuggaucccggagaggcgccgguggucccaguguacuccgggaaggugcagcaagguccccaaggaggguuguugggggagugcuaagacuggcguggcggguuuggcuuggggcagugugugugugugaugaauacuuuuagauuggagauacgagggggucgguaauguuagauguauggaguuaucugggauuguaucuucggguagagggaggcugagagagaucgagggacgaucgagggaagcuggccuucuagaugcgcuucagggauuggaguccuuagagaagacaagugcuggaaucgagggaagagccauucuugucuuaaguaggguuggcaggaugugagacccaccuccucuucccccuuuugucuucguagguacagagcagccucaaccucauuccagauaauucaucccucuugaaacugugcccuucagagccugaagaugguaagaguggguuugucgggaguacccugcacuggcuucucugagacuuccuagaguuuacaucccuguagucagugauaucucc

SEQ ID NO: 4087 - RNA, 6444 nt, Mus musculus
auuagaaaguauaaaggcagauuuauugagagcagcacuugaguagguucacaggucccaaggaugcaggagggagcagggaaauggcacaccugggcgaagguaaagggggguuucaggucuuaggcaaggggugaugauguguaaacucagagcugggguggugucuacauauggucagaagcugaacccccugagcaggcacucagguaguguugccagaaacucgaaggugaggguacuggccuguuagccuggagcaggcaggauuaaaagagaggcagacaguguuucccaguuugugcagggugagcagggauggguuacaaccaaacagucugcuagucccaucacugucucucccuugugggacaccauggaauguagcggcuggacauauuugcaucacuggauguuagguggcuaaaugccaggccaugggaaggcuagagccaggauguacucagaccucaguucuccuuccucugggugacucagggcuggauucaaccccaucuucccuuccuaucccacacaagggccggcuucagagaauuugaguggcuaauuggguuuauuuggggaaagcaaagggucaaaaggaagcuuugcuugaacaugcauaugagugugugugugucagcaugcacacauccugaucaaggucauuucacugacugacaccaucugggaucuccagauuucagaaucagaugugguucuugggaccuaacgaaguccaggcuacauaaaaaaacaaacaaacaagcaaaguaugagaugacgucuaggcccuauccacuggacccagaaaacccuuccccuuucucuccccagcagccagggcugcauuaccauccucauuuaucccucucuuccuccccucucccaggggcagcguccagcucaccuagucacuugggagucacgugguuccccaaguccccauguggcccucuccuucccaugcugguucuaggucgucagacuuauccauguuuucauaagagucugcaucuggauaagaccaggaaaaggaaaguguaaauuggaugaaaaggaugcugggguagagugggggagggagggggagggggguguccagaggacaacgagaaacagugcagaaacacccaccuucuucaugacugggaccggacugaauugaguggagcugaggagcugcauagaggaucccucucauaucuucauaggacugggacccuguuuaggcaugggauggaagauuagagacccagaaauucugcuggggcuugggggaagggaaguccugccuacccacgggagaggagcuaggcaagaagucgaaguuccuaaugucaaacuaggacugauuugucagcaucaagauccuacuugguucuaagauggccaaggccaaaggaagggucaagaacagaauugggaggagucaaagucaagcucacaggaaaugauacagacaguuggggucaagguugaaguccacuuuaaacuggggugaggugaaggccaaacucuaagagagaagguauugaggucaaugcuucagucgguuggcugaguguguuucguuacauuuuuuguuacaaagcuucagccuaggcuagccuggaauucacaaaguaccccagacuagccuuaagcccaugaccaucuuucugccuuaacuuucccacaaguuggaauucuagacaugaacaguuaugucagguucauuuugggucaagauuggucuucaagguuagaaauggcagaaacacggggaaacgggauagagguggaguugggaauaaggucuaagaccacuguuaggcuuggacuuggagaucagagcugaguuuauaucaucugaaauugacccuagaaggaugcccuaagcacucucaccaagcgaggaugcuucccggcuggggucccacgcagacccaugggggcucaggaagucuggaacaagaaaagagacaaagauaucacuuuuuuuccuggucuccagcuucuuccaagagugacagcccucgcucacucaaauacacacccaucauccugccaacugguugggccagcuccucaucugcauuuucauaagacucagcuguggaagagagagcgcaggaguugcucaggcaguaggagcccugcagcaccaagcacguuuuccuagccaccaacccuacaaggacaccacauuaccauuggagaaggagucuucuuccucuggacccaugggcucauccucgggguucucauagccacucccaucuguuagagaaugagggcaucuuuagcaaagguugucagccaucagccuacuguugaagugucaggaccagggagaauggggacucacccugggaaaccugguccugcccaagguuggagucguucucauagaauucagagcccuccucgcugucuggcucuucauaggccuccccuucuucuuccaguccugaauuugggaccaguguggagagcugagcgguaucucucuuccuccacccacaguccacuaaucccaccacaggcugcuccgacacucucaaggugaggaacaacccuuaaaucugaccuguuucauggcucugagcuccaguauccuggacuugaaugcguggauuuccauaggacccagggacacucccuaggccagcagcccaacgcugagcaugggcuggugaaaagagagauuuaagaugcccaucagagggaaaggagacaaugcuucagaaagccucugugugccugcauaaccggccuugagccauggggaagggaucaaaaucugagccuuggccucaaguucuaggacaaggcuggcucuggccaagguccaguggcuagacuuggcugaucuguugagauuugguccugggcucugcucuggggaagguucugcucugagaagauuggagaaaugaggacaaggcauagcuggcuagugccggagagaagggugcgacuugaaagccuuucaaggcaguggucccucacccuggccagagguagauguaggaagggagagcacauucccguacugguucugggucccguuucccgagggaggcgucacuuugaagaaucuggagggagaaaggguugguguaccuuaaggcucaaccauguagggaugcccagcugcagucuauucugggaguuaaguguguagggaugccuacccaaagaguuugggaccaugccaagggaggugauuuugaagguggcuuccagacuugggcaguauuucaaccaagagagauggcaccaaggcccaccccacgugacagaggacaguguaaagcuuauagcggaagggcgggcauuugcuacuuuaccuccuggcggggucagucauucgcuuccuuuuccuucucaggauaaaggcuggugggauuuaaagagauggaucaggagagggguuggcaggcaggaggugaauuugggggacacgggggaggucacuugggucaauagaggggaugguuguacaaauaccagggaccccaggaaguaugagagacaguaaaggagggaugaggcuguggggugcauuagauuggccaguaugggcuuguccuaagaaagaugggguagaauucggggaagcucaggggcaugacuuaccucuuugacaauagagaaaagccaccagagaaaccauacagaagaugacauauacuaaagucaccacugggacuauccauccaccaguucucaacagccagagccacacugcuaagaggaaagugcuuugagacaaggaccccacaaugcagcuuacuccccaaccccucaaggggcauacggcugagagcccagagcaggacacagaccucaagccuuaaucucuccagggggcucuucucccguccacuaaggaagaaccaguuguucccaggagcacaaggauugagccacggagcacaagacaguaacuaaccgcauauaaagcacggccauccuagcaaggugaggacuagggagucaauuccgcaguuagggguaaucauggucaaaauguagggcauuuugugagucuaccaagucagagcugagauucaacacauguugggaucacguuuagaguggaagcugaggucguagcacuuaacaguuguggucaggauagcaugguagcauuguauuaaggagaagcauaggcgagguguuguggcaaauuugauggauggagugaggaaaaagaagauagucaagcuccuaacuugggcaaauggacccauguauauucuucugggugcuccauuugugcaaagccacccaaagaguauaugugggcaagauguucauuucacuuuauauaucaagccugaaaugucccugaggcaugaaauggccaucccaggagaugacuggguauggggaguauagugcccagggaagguauaaggcaugguaaccuaggaaccacgggagugaagaaugccaaacaagacgaggguguggauaggagcgaguacaaggcccagggcuccauccaacagggagcggugguggaggaagcagucagcagagcggugguggaggaagcagucagcaaagcucacaggagacccagaaaaacgaguucucagaagcgaugaacaaaaagcuggaguuaggauucagugaacaaacuggagucuugagacugguccuggugccagcuccaagucuggcuuaguacuuaguacuuguacucacgccucagccucccaaguucuaggguuacauuuauacacuaucaguccuugucugucugucugucugucugucagucugucugucugccuuccuuucugucugucucuacacacagagacuucuagggguggaaacagagccucauccaugcuaaacacacacucgaccacagaaccacaccccuaacucuuccaauucuuccaguagcuccacacagagucccagaauuggaagaaacccuaccugaccuugcaaugaccuucacgugccucucgauggucagguuuccucggagacaauaauaggugccuucaucuaaagcuguggcuuggggcagaagcagaagagacccccaaacccacaucucucugaccgggugcucucccccaaggcuuaggcucaguagugaaacauuaggucuccuaggaugcacauggguccaggagauggagccuuuggccacugggacaggggguaccccacaggacagccaaaguguggagccgggugccacagugagaucuaaggcagggagagaagagguaaggaaaauacaaucaucucccccaacccccgaguucccagcacccucccuauccuugagcccccacuucccagcauccacacagcacuguccccuuaccuugguugauuagacucugauucaaacugcucccccgaggggcacauacaggcuuuguuccccagaccuuaggauggucuuuagcccacacauacagcugggaaccagaaguggaccuguggcucccagaggaccuguuccuuaggucacaguccaggucccugacgucugaagcauuccaccggaacaucuccccugggaagagaccccagacuagauacagaccaggagaagggggagauacaaaggcugggaagagcagagccagagauacagggagaaagcaacuaugacuaacagacaagcgagacagagauacggaguagcucagagcaguuaccaaaccauaggaaguaggugccuagaacuaauuccuucuucgccgcugcagcccugccagaccaaagaacuuccucuguccauggagagcuccucuuuaccuccacaacccagccccaccaggcacucaccacuauccuccacguucacuguccaggcaggcugccagauguccuugaaagggggccucuucuggcacagguagaagccccccauauggucugagacauugacaaucacuagcaagaugcccagggaccccacgugcaaucccaggccaggggacccggggcucagcuccaggaaggguguugacugguuaccucgauaccaagccagcuucucagaagagacaggugaggaguccgggaggcauggcagcacaacauugccucccucuguggggagaggaaaaggggagccccagccccucuucccuccucauaaaucaaaggaccccagaaguccaccauauggaagcucuaagggucuuucugacuccucccaguuuacaaguaagaaaauggaggcuccaagaaggccaguuacucaacucagaacccagacuuucaacccuagcuccuuccccccagacguacagacagauagauagacauaccuucuaccuccaccaguaaggacuucuggggccugccuccuacuaagguaagaaagaggaggaaggagacagggagaggagauggcaugguagccaggcucccuggggcacccggcuucugcguggcugcgcagaggaugcu

SEQ ID NO: 4088 - RNA, 584 nt, Mus musculus
cagguucaaagucuuuuauagaaaaccgguuuggaggcagggggacccaggcucuguacuuguuugaauugcugugacucuccaaagcgagaggucauacauaaugagagauugacccagacccaggcugaaagauuuacagcccugggaguggagaaagagauuugcaggaagccauaugaaaaugggauuggagacacguagauuucgcaccucugccacugacugcgccaagcuucagaacgccaacccagcccuggcccgcggggcggagaugcugggcgggccgggcacacuucgcaguaacgcgagucggguuacggcggaagggcggccgggcggagggaaggaggaggccgcgcgcagcguccucuaggacuaagaccaggcguuccaggagguggccucgaguggagccucagcagauccucagcaccagagaagacuaccgcagacccgaagcccucggagcuuccagggagcgcgggagcgcgggggcggucccacgaggcugcaagaaaggcgggauccaggccgcgcguccacucgagugcagucggcgucucuugaccaucccgcccucc

SEQ ID NO: 4089 - RNA, 3379 nt, Mus musculus
cggaagugaucugcagucccaagugcccguccuucccugcacgcgcgggccccgggugccuaguucccggucccggucaccgaguacuaccacaauggcggcagccacucuauugcgagcgacgccccgcuucagcggugagggggcggguuggacgcaggcagcccggaguugcgaggggcgcggaggguagcuggguucggaucccugacucccaagugccuuuccccgcaggucucugcgccagcccgaccccauuucugcaaggucggcugcggccgcugaaggcucccgcaucacccuucuugugucgcggccuagcuguggaggccaagaagacuuauguacgcgacaagccccaugugaauguggguaccaucggacauguggaccauggcaagaccacccugacugcagccaucacgaaaagugaguaggguuggguuggguuggaggcgucgggcaauguccugucagcuggaagagucagaacuagagcguagggugggugucuuguaguccgcugaacuuuagcauggcuccaagagacacuugggacgaaggcuggugggaagaugcaggagacagguuucccuguacaggaagagcucugugaggcauaaaaugaaaacugugaaugguuuccauccaguguagaguggucuguaaagagaugcugucagcgaagaauuggaagcgucugugaugagcacacaccuuaggaaauucucucacugucuuacaaaguuaucuuuccuagaauuacauuugagauuuccuagaauugagauuuaacagagauuuauccuuccagauuguuucuguaugagggguucaggcgugugccccgagccuugucuguagcucugacccugaguugagagguguguucucuuccuccgguaguucuagccgagggagguggagcuaaguucaagaaguacgaggagauagacaaugccccagaggagcgagcucggggcaucaccaucaaugcagcccauguggaguauagcacugcugcccgacacuaugcccacacagacuguccuggucaugcagauuauguuaaggugaggguugcuggggacagccagcaccugcuuccguucaguggaggugugagggggggagguuauaaaauaguggcgguguuugaauauaagaacaaggauuuguggcuguggguggugaagacauggcagagagauggagaucuucacagcuacuucucauuagaggaugcauguugaagaggucccugaacuaagcugaccuucuuccucuuccacccagaauaugaucacaggcacugccccccuggauggcuguauccuggugguggcagcuaaugauggccccaugccccagacccgagagcacuuacugcuagcuaaacagguacuggggucugagugggauggacauccgugagacgucagauggcucaggagaguugcucagucucuugucuugccugcagauugggguagaacauguugugguguacgugaacaaggcagacgcuguccaggacucagagaugguggaguuagucgagcuggagauccgggagcugcucaccgaguuuggcuauaaaggagaggaaacuccagucaucguaggcucggcucucugugcccuugaggugagcacagcacaggcuccuguugguagaggacgggguagagcuuugcucuguaccuggaaacuuagcauccugugauaggaacagaaguuucaaggucuugucaugucuccaacagcaacgugacccugagcuaggcgugaagucagugcagaagcuccuggaugcuguggacaccuacaucccagugcccacccgggaccuggacaagcccuuccugcucccuguagagucagucuacucuauuccuggugaggcccgugcucacguacaccacuccucauaggggucaucugacccugggugaccaauaacccauccuguuucuuuccaggccggggcacaguggugacagguacauuagagcguggcauuuugaagaaaggagaugagugugaguugcugggacauaacaagaacauccgcacuguggugacagguaugagaagauuucagauccaaggacguggucagaauggucccuucccauguagcucuuauaccuucauucugccucagacccucuucucuccugucuucuuccuuguaggcauugagauguuccacaagagccuggagagggcugaggcaggggauaaccugggugcucugguccgaggcuuaaagcgcgaagauuugaggcguggcuuggucauggucaagccaggcuccauccaaccccaccagaagguggaggcccaggugagggcuccagugcugagugguuucccuugcuuagaagcaggacuuguagcuaagccauuccauccuuacugcuucucuccucuagguuuauauccucagcaaggaggaagguggccgccacaaacccuuuguaucucauuucaugcccgucauguucucccugaccugggacauggccugucgagucaucuugccuccagggaagguauguugaggcugggggggauauaaaaggaauagaacugggcugugguagcccaugacuuuaaucuuagcagcuggaaggcagaggcaugugaaucucuugaguucaaggcugguguaguuaguauacagagcuaguuccagggcaguuagggguacacagcgaaauccugucucaaacacaagaagggcucaggaaaauccuguugacuaaaacugcguaauaccaaauucccgauuauggucccuuuacuuuuuccaugcuguuugcgugugccuagcaacuaaaugaaacgucccagauucuucaaccuguugagcuuucccaugauuuugagccccaugggugucagcgguugaagguacacagugaagguauccugauugccuugcgcuucuccuucuauuaggaacuugccaugccuggagaggacuugaagcuuagucuaaucuugcggcagcccaugaucuuagagaaaggccaacguuucaccuugagggauggcaacaagaccauuggcacuggccuuguuacugauguaccagccaugacugaggaggacaagaacaucaaguggagcugagucuggacuucugcucagguuauugagcuucaggcugcccuggucagcguucccacugugggcauaaggcugcccuggucagcauucccacugugggcauaaggcugcccuggucagcguucccacuguggacacaggcuguauccaggcagaguacaccucuggacauuucuccugcucacaaugaguggccugucaggagagggaggcaaauaaaacugucccauggauaacucag

SEQ ID NO: 4090 - RNA, 3379 nt, Mus musculus
cugaguuauccaugggacaguuuuauuugccucccucuccugacaggccacucauugugagcaggagaaauguccagagguguacucugccuggauacagccuguguccacagugggaacgcugaccagggcagccuuaugcccacagugggaaugcugaccagggcagccuuaugcccacagugggaacgcugaccagggcagccugaagcucaauaaccugagcagaaguccagacucagcuccacuugauguucuuguccuccucagucauggcugguacaucaguaacaaggccagugccaauggucuuguugccaucccucaaggugaaacguuggccuuucucuaagaucaugggcugccgcaagauuagacuaagcuucaaguccucuccaggcauggcaaguuccuaauagaaggagaagcgcaaggcaaucaggauaccuucacuguguaccuucaaccgcugacacccauggggcucaaaaucaugggaaagcucaacagguugaagaaucugggacguuucauuuaguugcuaggcacacgcaaacagcauggaaaaaguaaagggaccauaaucgggaauuugguauuacgcaguuuuagucaacaggauuuuccugagcccuucuuguguuugagacaggauuucgcuguguaccccuaacugcccuggaacuagcucuguauacuaacuacaccagccuugaacucaagagauucacaugccucugccuuccagcugcuaagauuaaagucaugggcuaccacagcccaguucuauuccuuuuauaucccccccagccucaacauaccuucccuggaggcaagaugacucgacaggccaugucccaggucagggagaacaugacgggcaugaaaugagauacaaaggguuuguggcggccaccuuccuccuugcugaggauauaaaccuagaggagagaagcaguaaggauggaauggcuuagcuacaaguccugcuucuaagcaagggaaaccacucagcacuggagcccucaccugggccuccaccuucuggugggguuggauggagccuggcuugaccaugaccaagccacgccucaaaucuucgcgcuuuaagccucggaccagagcacccagguuauccccugccucagcccucuccaggcucuuguggaacaucucaaugccuacaaggaagaagacaggagagaagagggucugaggcagaaugaagguauaagagcuacaugggaagggaccauucugaccacguccuuggaucugaaaucuucucauaccugucaccacagugcggauguucuuguuaugucccagcaacucacacucaucuccuuucuucaaaaugccacgcucuaauguaccugucaccacugugccccggccuggaaagaaacaggauggguuauuggucacccagggucagaugaccccuaugaggagugguguacgugagcacgggccucaccaggaauagaguagacugacucuacagggagcaggaagggcuuguccaggucccgggugggcacugggauguagguguccacagcauccaggagcuucugcacugacuucacgccuagcucagggucacguugcuguuggagacaugacaagaccuugaaacuucuguuccuaucacaggaugcuaaguuuccagguacagagcaaagcucuaccccguccucuaccaacaggagccugugcugugcucaccucaagggcacagagagccgagccuacgaugacuggaguuuccucuccuuuauagccaaacucggugagcagcucccggaucuccagcucgacuaacuccaccaucucugaguccuggacagcgucugccuuguucacguacaccacaacauguucuaccccaaucugcaggcaagacaagagacugagcaacucuccugagccaucugacgucucacggauguccaucccacucagaccccaguaccuguuuagcuagcaguaagugcucucgggucuggggcauggggccaucauuagcugccaccaccaggauacagccauccaggggggcagugccugugaucauauucuggguggaagaggaagaaggucagcuuaguucagggaccucuucaacaugcauccucuaaugagaaguagcugugaagaucuccaucucucugccaugucuucaccacccacagccacaaauccuuguucuuauauucaaacaccgccacuauuuuauaaccucccccccucacaccuccacugaacggaagcaggugcuggcuguccccagcaacccucaccuuaacauaaucugcaugaccaggacagucugugugggcauagugucgggcagcagugcuauacuccacaugggcugcauugauggugaugccccgagcucgcuccucuggggcauugucuaucuccucguacuucuugaacuuagcuccaccucccucggcuagaacuaccggaggaagagaacacaccucucaacucagggucagagcuacagacaaggcucggggcacacgccugaaccccucauacagaaacaaucuggaaggauaaaucucuguuaaaucucaauucuaggaaaucucaaauguaauucuaggaaagauaacuuuguaagacagugagagaauuuccuaaggugugugcucaucacagacgcuuccaauucuucgcugacagcaucucuuuacagaccacucuacacuggauggaaaccauucacaguuuucauuuuaugccucacagagcucuuccuguacagggaaaccugucuccugcaucuucccaccagccuucgucccaagugucucuuggagccaugcuaaaguucagcggacuacaagacacccacccuacgcucuaguucugacucuuccagcugacaggacauugcccgacgccuccaacccaacccaacccuacucacuuuucgugauggcugcagucaggguggucuugccaugguccacauguccgaugguacccacauucacauggggcuugucgcguacauaagucuucuuggccuccacagcuaggccgcgacacaagaagggugaugcgggagccuucagcggccgcagccgaccuugcagaaauggggucgggcuggcgcagagaccugcggggaaaggcacuugggagucagggauccgaacccagcuacccuccgcgccccucgcaacuccgggcugccugcguccaacccgcccccucaccgcugaagcggggcgucgcucgcaauagaguggcugccgccauugugguaguacucggugaccgggaccgggaacuaggcacccggggcccgcgcgugcagggaaggacgggcacuugggacugcagaucacuuccg

SEQ ID NO: 4091 - RNA, 1731 nt, Mus musculus
cagaaagucuccgcgguggugugaggugucacgucguagcgugagguucuuccgccacugggugaccggugggcggagucucgggagcaagagaaaaaaaaaaaucccuaggacuggaaaaaccuaguacagguaacuuaaggcagguggguuuuuaaaggugcugcucuccaucuuaacugcuuuaaaauauuaaugagcgucagaaugacuauucugagcauaugugcaucccaacaaaugugcccaauucuaaauugaaauucagugauucuuucagggagagcgacccccugaacaguagcaauacaagccgucugaaagccagacugacuaagaguauauuacagaauccagcugcauagcaagacacgguuagaaaaccgugguauagugcuugccuauuaaggcagcccucauucaaaauuagggcagcuauggugcuucagaacuuuaauuccaguacuaggaagggaagguaggaggaucaaaaguuugaggcuauccugcauuguauaauaaauaucaggucagcugggcagacccuguuucaaaaggaaaaguugauggaaaaguccaugcuuuggguaacuaagccacucaaagcucaagcuaguggaagauuuauauaauuugagcaaagguacuugguaaaacacagagggcaggaaaauggauuucuauacagacgaaauggaucugacaggacauacgaaaaaauggagcuugauuggagccugaaauccucacucuauagcuguagcuggcuuuuaacuccuuguguauaccaugguggucuuaaaacucacagagaucugucugccuucugagugcuaugauucagacauaaaucagcacagccagacuuugucauggaauguuaaccuaaaaucccuuuauugauaacauaauccaaaaauuaaaucuaggauuggguagacacuaagaaauugaauauagcaguacagaugaguccaaaucuacacuucagauuaauaacccaucauaagcggaaaaauggaauuaauuuaaagucauccucaaauauuuagucugaggccagugggucaggugagagucggcauacacuuccuaaaaaguauaggagcaggggaaagauaaauaggucauuugguagcaguguacaaaauaaaaauguaugugugggugguuugccuugcagguauguugguguagaguguguguguguguguauguguguuggucuugaaggccagaagcagguauccggucccagggacuggaguuaacagugauaagaagccaugcaauuguguugcugagaaucaaagccaaguccucuggaacugagccaucucuccagcucccagauuuuuaaauuuuaucguaggcaugugugugcuugagugcauuaugcauaccauguagguugcuaguggaaaacugacuuccaggcagcuagggugagggucuuaaagcccacacccacagugacuauuccaccuauuccaacaaggccacaccuccaaauagugccacucccugggccaagcauauucaaaccaugacaaauguguauuguuuuccagagaaccuggguucaauucccagaacccaugucagacagcucauaauugccugcaacucaagcgccagaggguuuacugccucuguuuuuuauagguaccuacaaacuuggcaucaacucacacagacagacacauggaugauugaaaauaaaaucuuaaa

SEQ ID NO: 4092 - RNA, 973 nt, Mus musculus
caacggaaaaccucuccuccuccucgguaccgaggacgccgagggcucccccagcucgcugcgagagcuccuuucucagacgcgcccagcccauggcuccgcucgcccacccgagcccccgcagcccgccaaacccguccccuccgcgcccccagcucacuguuugccguaguucccggagaccgguuuggugacgagcuccuccccggacagggacgacuccgacucacuguccgagccgguggugaagaaucgcgacauggcgacggcgcugaagggcugaggcgcucgcggccggaaccugaggaaacccgcggcgucaggguuugggggcaaccgcggcuaccaucucccgacccggacccccguucccgccugcacggccucccccuugcccuccacggagcacgaggcccaagagacacgaaccagcuaagcugccgagucccucugagcaggugagacaggcacgacgccggaagaggaaaagguugggggggcgucacuucccggaagcaccaaagaaugcgcuaaauaacuacaauucccaguggccuuugcgcuauacacggccugggacgaauuaguagccgagguucuaaaucuuaucuaaacuaagacugacuggcugcucacuaggaccgcccggacuaggcugcaagacugacaauauagaauuuaguaaccgccccauggugcacgucuguaauucccuacacuagaaagggugaagcaggaggaucauggguucaaggccagacugggccaaaaaaaaagaaaaaaaaaaaaaaaaaaaaaaaaagcuaagcucugaagccugcggagguggcucaacaccuuuaaucccagcgcucaggaggcagaaacaaguggaucucugaguucgaggccagccuggucuccagagcgaguuccaggacagccaagagaaacuaugucucgaaaaaaaaaacaaaaaacaaaaaaaaaaaac

SEQ ID NO: 4093 - RNA, 8748 nt, Mus musculus
cggcucauuguuccagagguuuuaauccauaucacuuuggucccauagcuagaagucaagagggcaugagaaggaggccuccacguuaacagcuuaggggcagagauaacgccugggcuggcuucuuucuucuuccccaucgucaugggucugagagguggaaagagcaggauauauaccacuuuuggaaggagaugccgggcugcugcuuccccuacgagccccuucugagccuacggagaagcugcugcccgaguuccgggugggucuccucccuuggcuaauuuugugaaaacauccucacacaugcucacagguguauuucaccaaacuccuagguacuaccacuuaagccaaucaagcugucagaauuaaccauuauacuggucaaggugugacugugauauccagcucugacccuuucggcaaguaccaccucucugcugcccaugaugcagauagaugggucuacccucucaccucuccccugccucccagaaccccgagaugcccauggccuucacgauauggcgaucguucuggauacugcugcucuacuaccuggggcugcucccuuuugucuccaucccugagaaguuuuucuucuguuuccugcccaccaucaucaacagguacugguggugagauggggcuuaagaccucucugcucaggcaacauugcccaggauuuguguggcaaugacccaggacccccaguuuccuaauuuccucagaguccucuuuaaauauuuguguguguguauauguauauaccacaugugugcaguucccuauagaggucagaagaaggugucagauacccugguuuagaguuacagguagcugagaaucacccgacaugaauacuuagaaccaaauucagguucucuaaaagaggagcaaguuuuuaaccacugagccauuucuccaaucccaaagccgcccuuuaaagaagauagugacuuccuuuuuauuuuguuuugcuuuacugagacagaauuucauguaucuuaagcuggccugaaacgaaguagcugagauagacauugaauuuuuaauccuccugcuucuacuauuuuauucagugcuagaggcugaacccagaguuuuguguaugcuggggacacuaccaacugggucaccaccuguuuuauuuuuuuuaauuuguuauaggaguguguguguguguguguguguguguguguauggaggggagcauuggagagagaaauggcauauauaugaaugccagagacagcauucuuucugccuuuagguagguuccagggauuggcaaggaccuuuauccacuaagccacuggcucucaaccugucggucaagaccccgggggaggggggacaaccuuuucacagggguugucuaagaccacuggaaaacacaauacuuacaguuccuaacagccacaaaauuauaguugugaauuaacaaugacaauaauuuuaugguuggagggucaccacaauguaagaacuguaugaaagggucacagcauaggacguuugagaaccacugcacuaagccauggagaaggcgugacuuuaguuuuugagacaaggaccucauauauuggcuucaaacucucaacccuccugcuucaaccuucccggugcuggaaucaugggccggcacaacuaugguucuugccuggcauucaugagcacuaaggugacaccacccaacuugcaagcuaauauauaucacgaugccguuuuagaagaaauucauccaaacccuugauggaaaaccccucuggucagcgccauugugauaggacaauaaugaggguuggucggccuaguaaagaaaccugaggugccugggucagguccucuggggagcaaccaggcucucucacucucaggugagucagcccacacugcacuaagcccuguuaacaaaguggcuguaggaggguagauuaggagcuugauaguuucuuagcuugggccugccuccucccuuuccuuucugacaacuucuccaggacuguccccaaagcccugguucuacuacuaugugauucuuaggagagcuaaccagccccacagccccgcuccaaagcuuugugucugcaguauuuuacacaggguuaaagguuuucacauaaugugggguauuuaaccuuuaucuuacacugcccuucccagaugguagagccaugaucuuucccccauuaacaucagagaugcaggguuucugugauuugcccaauguagccaaccuaguaagcacugucucaucugaagaagcgggccaaauuuaggcaccauggcacacaccuguaaucccagcacugagaggaugaggccagaggguugcaaguucuggaccaaccuccgcuauucuuaaaaacagacccuuggcggggcagugguggugcacgccuuuaaucccagcauucaggaggcagaggcaggaggaucucuuaaguuugagaguuccaagacagccagggcuacacaaagagacccugucuugaaaagccaaaaaaauaaaaaacuuagaaaaaccucacccagacucaaccaggaggacgucugugauaucuagcucuggaaucaagcuggucccaggccugucauggauaugauuuugaccuccagugacuaagcucaguucccuguccuuaggaugguaagagagacaagcucuaaaaccaagaacuccaggaugcagucagcucucacuaaggguugcagugucccucuagggacuuacggagcuucuucaggcccggccugggugaaggagucauuaccaccacaccccugugacagacagacagacagacagacagacagacacacacacacacacacacacacacacacguggggggagggagagagagaagacgaagaccaaggagcugacuccgcccuuucucuccacaggacuuacuucccauuucgcuguggauggaugaaccaacugucggcuaccauuacaaaauggugaggugggcagggcugcuggguggagaguccacacggggacuugccaccgcccuucuccuuuguccccucucaucacuaugucaucgccuuugacguccccuccgcccccaggaucaucaugagaaaaagucugauccgacacuugcaggaccgaggggugcaggugaggacucagcucugccccagcgaggagcuggcucacaguguacgccugggagcagaguuuccgccauucugugacaccucugagugucgguuacuuugccuauaaaaugcagagaauaaguaucugcagaucuuuuggcuguguaccugguacuuaaucagagauugguaagcauuagcacuggucaccaugcuuguggccagcugggaacaugcuggaaagccaggcccagcccaccuggugcucggccuugauugugguccauggaaauagugaaggcauucggauuuguuuugguguuuuuuuuuuuaauuuuuuuuauuuuuuuuauguguaauaaauguuuugccugcauucuaucuggccuggggcugaggccagaggguaguuucagauccagaauucugagcugccguguagauauugggauuaaaucugguuccucuggaagagcaacaaguuuuuaacugcugacagcccccucuguuguuguuuugcucucuugcucucucucucucucucucucucucucucucucucucucucucucuguguguguguguguguguguguguguguguguguguguguguguguguguauagccuugacuguccuggaacuugcucuauagaccaggcuggccuauuacucacauugauccuccugcgucugucucucuaaaggcuugcaccaucauugcuugguugucuuuuuuuuuuucuucuucuucugcuuuuguuuuguuuugucugaggcagggucucaccauauaacucuugcuauauaggccaagcuguccgcauggagagcuaccugucucugucucuuaaaugcuggggacaaggucaugugccacuaugccugaccaugguuuucuuugguugguuucuuuuuauuuuuauugucuuauuuuauguguauaggugucuuauauagauguaugucuguguaccacauaugugugccuggucuccauaaagguuagguaucagaguguuguaagccauuaugugggagcugggaauugaaguaucaucuucugggagaguaaccagugcuuuuaaccacugagccaucucuccagccccugguuuuuuacacaggcuagacuaaccucaaacuccugguaauccuccugccccugccucccuaaugguagaauuacaggcauaaaccacugugccuggcuuuggaccuuggacuuuuaaaaaaaauuuauaauuuuauuuuauauacauuggucugcauguuugucugugggaaggugucagaucuuggaguuacagauaguuaguuguaagcugccaauaugggugcuaggauuugaacccaggucuucuggaagagcaaccagugcuuuuagccacugagccaucgccucagccccagacuuaagauauuuucuaaucagcaugccuuacugagagggcuccagacauuuaccuggaacgagagcuuucuaucaaauauggggaaagaaagaagccuguuagccccacgugugcugugauguugcagccaaggacaggagccagaauugucagccacggacggagggggaugggauuagucaugagaauggagggacaaauuuggcucuugaggagggggacagcaucauaggcaggcaucugcgggggauagcaggggcgggggugggagggcgcuacaguuuggaggagcaagaggcugggcucugagaaacuggguggauucucuaggcugagggcaguggaggucaguuaggcccacuggccucaugucuaauaggaucgugaccuuccggaagggaagcuuuugaaagucuaccacaggaaacccaauccagauaaauucacugaauaaagucauuugguguauaacauggagacuguguggugguggguaaacaguguccuuuaagagccugauacuggccggguggugguggcgcucaccuuuauucccagcacuugggaggcagaggcaggcggauuucugaguucgaggccagccuggucuacaaagugaguuccaggacagccagggcuauacagagaaacccugucuugaaaaaaacaaaaacaaaaaaagccugauacugccauggacaggagccagacuugggugacagcaguggggacagauggaaggguuaacucagagaggcucugccuacugccugugucuggcuccgaugaggcaccuugccugcccucucacaccucugaucugcacauguuuaaagacugaacccucauuuguucaacuaaggcauccagagacccaaugccaggcaugguuguuugaauaugccugguccaggggaaguggcaugauuaggggggguggccuuguuggaggaagucagcaccauggaguugggcuuugagguccuaugcucaagcucugcccaguguggaagacagacccuugaugauaaugggcugaaccucugaaacuguaagccagccucaaugagauguuuuccuuuauguugccucggccauggugucucuucacagcaauagaaacacaaacugagauaccaugucagccaggugcagcagcccauacaacuugggaaacagagguaggaagauggugaguucuaaaacaacagagagaaaacaaacaaggaaggcaguaaagugauucaguggcuaaaggcuucugccaucacccugaugaccuaagagcuguccucuagccuacacacuuggugugaugugcauccgcccccucauaaauaaauaaauaaaauaaaauuguuaaaaaauagaaaccaauggcuggggauguggcucauuugguagaggacuugccuagcagccccaaagcccuggguucagucaccggcacucaaaaaaaaaaaaaaaaaaaaaaaaaguaaugggaugggagcaauggcucagcaauuaagagcauuugcuguucuucuagaggguccaaguuugguucccagcacccauaaucacugucuuacaaucauucauaacaccaguuccagggguucagacggcuguuggcaucagacauauaugugguaaacaaacauauaugcagacaaauacauuuuuuaaauuuuaaaauaaaugcaaauaaauugaaaaaaagaacagcaaaggaaaaagaaauuuaaaaacaaaaaaacaaaaaaacagguauaguggaacauacccgaaaccugagcaccagagauggaaacaggacagaaguccaagguccaagagucugaggccaacuugguuacaugagacccuaacaagagaagagaagagagaguaggagaagagaggggaggagagggaagggaaaggagaccauaaauuauaaaauaaucagugaugggcuuuucaguaucuaacuuaaaacauauauuacauguauuggggggggcacaccccacacuuccugucgaggucacagggugugguugcaggacucaguccucuccuuccauccugugguuccuggggaucuagcgcagcuccucaggugacuuuaccugcugagucaugucacuggccccuguguguguuuguguuugauuuguuuuguaguacugggaaucaaacccagggcuuugcacauaagaggccaggguuaaaccauugagcaacagccccagcucuuggauuguuugucacaggucucauacagcccaggcuggcccuugaacucccuguguaacacaagguaucuuugcauuccuuucccuucuaucucggugcuauaaaaacaaacauuguaccaccacacuaagagcuuuacuuuuguuuuuauugaauuccuuguuuguuuugagacaauguuucacugucaacucuggcuggccuaaaacuuacuauauagaccuggccuaaaacuugcagagauccaccuaccucugcauccugaguucugagacuguucaacugcaaguucauguaauuacaugguuuauguauuuguuuuugaggcagaggcuuacuagcuaaccccagcgggcugcuacucuguguagcccagauggccucccaagugcagaguuacaaacaugcauggccacacuuggcuccaagauccuauaccuaaguuuugacaggagcuguguuuaauaaccaauuuggaaauuucuaaaaaagauaaccaucagcuccaggacacccgguucugggaggucugugcagaaggaggggcugccaccuccuggacgcgaaaggaagcuugggguugguguuuggaaacuaacuuguuuucuuccucuguucaggugcuauuuuggugccuuaaugaagaaucggauuuugaaguggccuucagcuugggagccaauggcgucaugaccgauuaccccacagcccugagacacuaccuggacaagcaggaagaagagacccagccuccucagccugaggcccuguccugucuuucucuuaaaaaauaaauauuuucuugucaguaacauaguucauggaacaagggguuggagggucgauucgggaggcuaaaaagauggcauuagcggcuggggauggaaguuggugguagaaggcuugcauaccaugaaugcagcucagaguuuacugcaagcaagugcacauagcaucuuaggagagaucaagaaagccuguggugagcuaggccuaggcuuuaaccucaguacuuggaaggcagaggcagguggauuucugugaguuauaaugccagggcuacaaagugagacucugcccacugacaccccugcaaauaaaagccugggggugucaguaggcuggcccacuuguuccacuacauuccagacccagcagaguggcaccacacccugugccagcuuggccuccacucuaaagcaugcuagcccaagcguccuggaccuagacucuagagauucagagaugagugguuguccugaaaccauuaagagacccaggcauaugcaagggacggaauuuccucauguuacugauguugggcaccuuaugugcugagcuguacugcagcaggcaggcauggauuagcucgcaggcucucccacaguaccugcuguccacuuucugaucuccaacauuggaguucauuuaauaaauauucccagugcagcacuuuucaagccugccugguuccugggacucugcagugaacacaagucuaaguauaccagacacacgauuaaacagacauuuucacuggggucagaccuacagaaaccucgaggucaggcauaccagagaaugccuggagcagaugaugcucagcaguagagauuuuuaaagcguugguuccugggagucuaauagaaggacaccuuuaguucccuucuaacaaucuguuccacgugcuugggaaaagugugaauuccaacuuugacucuuaccaucuggauaaucucuggagaggaucucuucuccaagccucaggaaacuggucaaauggagacaguggucuguggauaaacgaagacaauuacgacuauuucccagggguuugcauacagauaacacgcucuuauuagccccaugccggguuaggauccuugucucugagcacccgagauagcagagcagcagaggugcaaucacgcccggguuagccucuggguuaggcugcaagucguagccgcauuuccgggcgagacg

SEQ ID NO: 4094 - RNA, 3563 nt, Mus musculus
ucccgccgcagccgcggcagcagcuggucucgguguaaacaagucgaggcggcugugaaccgggccgggggggacggcgcccaucaggagcgccccccacucccaggccaggccaccccgcggaccgggcccuccacgcgcccaggcgaggugaggccuggaccgacgucucugcgcguugccccgcgcccccgccccgcaagcgaggacugccccuucccccgcgcacgcccccauccccucgccccaggugagccccggggucucagguaaggcuuggcgaugcagguaagauuccccucggcggagaugaggcucagcgccugcagguaaaaaccccuccucucucuaggggacccucuuccuuuggggaggccugccuccuccaggugagagacccuuuccccaagcgaacuccauauaccccacauuugcccuaucacuaguccaacuagggucccaaggaccagucaguuucugccccccccccccauuccucaaaacugaaaacuggcagcccauccacucugaagccccuucuucacguuucagaugccaguucagaugccagcucagcaggggugaggccagaagcuggugggugacucaccuagagcuccuccuagccucaguuuacccgcugaugcaaccugaggccuccucagugagucaaaacugagaugacucuggucccuggugagacugcuggcucuagggaaaggagagagcagccaagugugacagaguccccauaguucugggcuugucuacauguguguggccuuaguccugaucguccaccucuccuuccuggcaggcacugggcucccucugcuccccgugggccgcuccccgcguggggccacugcccuuggcccccgccauggugcggauuucaaagcccaagacguuucaggccuacuuggaugacugucaccggagguauagcugugcccacugccgugcucaccuggccaaccacgacgaccucaucuccaagguaagcaggucacauuuuagucuagaauggcaaugggcugccuggcaacuccccaccaauagcccuaacccccuccucucgucuccccacuacccuccaguccuuccagggcagucagggacgugccuaccucuucaacucugugugaguauucaucuccuuccuuucuuuuccugaccucuguugugaccugugacucccugguaugcugauauucccagagucccuuguuucugacaggaagccaugaucaggcuccucuuagaggcuaagaccagacacuuaacauacuagcuagaggguggcucugggcugcugagacccucccugggacuacccuuuguccccacagagugaaugugggcugcgggccagcagaagagcgggugcugcugacaggucuucaugcugucgcugacauccacugugagaacugcaagaccacuuugggcuggaaauaugugaguuugagaucucugacccuaggcuggccuuugaccuaaccucaucccuucuuccuuaaaaguaucugccuuugccuuucagaguaccaguggcccagcacaaacuggcuuucuuuccccagugacuggcguuuguccauugcagggcuuugaggguguucucuucccucgaaggauuugcaccccuguccuagaugauuagcaucauguagaaucaccauuuaucaauugcuuaucugccaugcaugugaacacauggcacauagucucucgaucauuacagcuauucugguggcagagucuguuccagaagacaaggaggucugaagaugcuaggacauuugcccaagaucacacaacuaagacucuguagcaauguggaaacuagguccccagaucucugcauagcuccugucacuucugaugcugucuagcaucugauuucacaaccucaagucucauuuccuuaccuggcaugggagcauaaagccacuaccuggcacagaauaucauugugagagucagauuacacguaacaaaguuauuccuuauacacuugaggauagcauagggaauugggcacuuggcauguuucuagaagcuggaugccccauugcaaagacaguccuaaucuuacuuuaccucugacccugccacagauuuccugugugucuuugcacagguggcuuggccccucugaaauccuaaaauguagccuagaccagagguuaaaaacucaaaugucagcagugugugguggcgcacgccuuuaaucucagcacugaggaagcagaggcagaugaugucugaguucuaggccagccuagugagcuccaggacacccagggcuauguagacccugucucaaaguacaacaaaauccuucaaaugucuauaagaccaagcagaaccgggcgugguggcacacgccuuuaaucccagcacuugggaggcagaggcaggcggauuucugaguucaaggccaaccuggucuacugagugaguuccaggacagccaggacugcacagagaaacccugucucgaaaaacaaaagcaaaaacaaaacaaaaaaagagcaagcagauacuguggguuuauaaauggguagauauagggcagagaaagcaggcuggggcaaaaugaagugaguauauauauaguuaucauuuaguuguaaguuuuauuguuuuuuuuuuuuuuuuaauguggugcuuguauugaauccaggcccucccacaagauaaacauccccaacuccuaaaguuguuuauauuaagcucucugcuaucuaaacaaaacuaccuuagguugaaauggcccuuaggccaccaguuuguaauccuuggaccuugaaaucuuguaggggcuuccaaauccucccuguuggagcugucauugauuuucagaacuacccgugcuucagaguucucucucuucccagugaggaaaaguggugucugggcaggcagcugagcuucucugggccacaggguuuuuuguuuuuuguuuuucauauauaaaccaagaccaaugguauucauucccaaaaccccauugccuagugguaaaaguauugucugugccuggcagcccuuucucuccuuccaggagcaagccuuugagagcagccagaaguacaaagaggggaaauacaucauugaacucaaccacaugaucaaagacaacggcugggacugaccuagcuccugccgcauguggcuucagccuggccuggccgccagggggagccacugguuucgcuccuccugaagggagcucuggacccucagggcccccacaggggaaggacccagcuccuguacauacauuuuauugcaugcacugugaccuuggggggagacaaagagggggauuguacccccacccccugcaccucccugcgaucuggcuggcuuggaucucauuuuuuaaccccuuccugucuugccugucccauagauaaggccugugugcugcucucauggcccuggugcaccaccuuucugugaaucucucccacuggaucccucuuaccugcaacgugucuguucucguucuguagcauuuguaaauaauaaaacaauggaauggagacagc

SEQ ID NO: 4095 - RNA, 4080 nt, Mus musculus
guuuccugagcacuaaugucuuuggaguuuuauuaacaaaaauacucugauccugagaacaaauuggcauggcuugcacuaguaacaaggcccccaggagguggggguacugggcugggagccccauuuggccaggcagaggcucccuccauucgcacuaaggugagagcugaggggaagcaggccccagcuggacucagagcugccuugccugagcuuugaagccagaggggguggagugaaaucaaggugugaacuaaaggguggaagagaggcccaagccagccauuuggugggggggagggggauaccacuucaaugcggaugcuaccaggcugggggaagggagcuggaggaucaagggaagauggcauaggguuacuacaccgaggcucaguacauuggcuuggaucccauguccagauaaccuccagguccuggguacgguagagggaagggacccccuuggaugaaguguggggcaaaggaugguacagauggagcugccugauaggcagagcccccugguccaggcuguagguccagaaaugcagcugaguagggggcugggcgcccagggucuggagccucagcgaagcuggggguccuagucacaggagacagguaugagaacggaagaaggccacccccuccuggacaacccagcccucuacccuucaccuuaccuggcugguaggugacugggggcgccaugaaaagcggcaggguguagaagguaggccucagcacuggggcccccacauggaggagcugaggcagaagcagcuuccugggggguuggggccugcucuggaucugagucccgaauguccccacccaggguggagucacagggacccccugguguaucuaaggagaaaaaaagcacagauugguuaggggagguuccaugucucaguuuuggccccaugccaccaggacagcacucacccccacucccacaggccucuguggccacuggcucugggccccgaaguuuccucuucacacgggcaucccgcucccuggggaaugaugguggugacgaugaugaugugaugaugauggcacuaauaguacuuaccaggugccaggcauuccacccucccaggcacccugugggcaggugcuauauuauacccauuuuacagauaaggaacugaagaccagagaagccacuaaaaagcagcagagcggagguuccucucagacuuguaacuugguucuuuagugcuuucuuuccucguuggguauuuagaaucugagaaagccccuucccggcagcaaaguccaguauccgcccaacuucauagcugccccacagcccuuuggcaccugacaaucuauacuccuuucaggaaggccucccugaccuguggcaucacacaccuuccucacagcaugucauagcucucuccguauuugagcuagugaaccagucacuguugggauagacuagcagggcuaggucagcucucaggggcuguacuuggaagagaugcccaaguccuuccuugguaagcauuggcuggucucccuucacucugcagccucacuguaggacacgucugccucagggccuuugcacaugucuuuuucccagacacuuaguuuucccuccccuucccaaaggucuuuauccauguccuucggcgccuuuucuccaguuucccuccaggccuugccaucuuuugcaggcuuuauugcugcuagaauuguauaguuucucauuuuugucugcucugccggcuagucuuaucaauuguaugaggacugagcaagcuuaaguaauuguugaaucgagugaauagagccauguggugguggcacacaccuuuaaucccagcacuugggaggcagaggcagguggauuucugaguucgaggccagcuuggucuacagagugaguucuaggacagucagggcuacacagagaaacccugucuuggaaaaaaaaaaagaguggacacauguuuuuacuuaccaucauguuccugguacccuggcacaguacccggcacacaauaauuaguaagcauucccugaaugaaugaugcccaccucuuacaguuucugccauuuucucggaaaccuuuggcaaagggauuggcugcgaucuucagcugugugaucugaggacacacacgcaggucaaagccccuguagccugggcgacagucacugacccucccucaagcaaggccacucacccuaggguucugguaggcugucacagagaugaauguggucucaggaaaucggaaggaggccacacccccccaguguuggcugcauaguuggguggcucucaccagguggaugcgaggcugguacuugugcaucgagugcaagaucagcugggagggaagaaacgaggugacucccagccgucaccuuccucccauuaccacccuaacaccccaccaaggagucccagccugggccucacguggccauggggguccagugugcuguuggugagcuuaacacgauggaaggauacgggcugccgcauccagugggcaccaguggcaggagagucagggugaauguagacacggucggguaggcgggguucagccuugccacuuggcucccagugcuggcccugccagcgguaucgggccccauccacuggaaccacauccagaagaaacaaguagcgggccucuggguccaggccagugacugauacucggcaagcagggaacaugcgccugcgcagggaaaggggaaggaggagaggccuggagcuacccucuaacagcugugagcccagcaucagugaaggaacuagcaauaggcaccucaguuuuggcacgguaaagccagagagguguaacuagguucuccagcagagucuaagagccauuguacagaugggcaaaggggacagacagguuagggguucugacaggccggagcagguuaaucuccccaccugccccuucacucucuccauccuaguuacaacaugguacaauucugucuccgagcccuugccacauccuguccaggcuccugcccccugcccccuguaacucucuuugcagaaacagugguaacuauuuucuuccugaagccuuaggagccucuugcuccccaccuuggugcagcacugaccucuguggcagcaaagacuaacuuucuucagaaauaauaggugcugggcccuggggacaggauuuagccugggguucaggccuuagagaccuugccagagcucacacgguaggcaaucaccuuccuucagggugagcugggacuuagucacacacggccccugauccuggacagauucucccacacuggucacugacugguccuugacccuucucauaggcugucugcuucugaguuaggccacaugccaaucuacaacccagccaggcugaccuuucugacccuugauagaauggcuccuaaacccagucacaaacucgccagccugauccuuaaaccucgacacaguguaacuccuguuaguccagggucacagugucaggccauaguuagauucugcugucuggguuguccuagcccugaaggggccccuaacccuagcucugucccaggaauucucuuuucuaaaagcugacuuggccgucccucaccugccagccuuggugaugaucaucucuguccccacagcgcugaauuccuuccacaguuccugguucuccaagcucaggcugaccccaggaagcgagugaagggccucuggggguggcggugcugucucggggcccagagcagaugggagaaggggcaaaggagcggcugcagccagaguguggggagcugccucgaucccagagaggaagcaauccaguuuagaaguauccaaaucuggagaugugggaagaaugaggauccaggggagggccacauauucccaguuuccugccccuuacccagagccaauccaaccgcucaccaggguagcgguaacccucugucagggcaggugggaagguggagucugccccaggcugggggugucccagacgguagccaguccccagggagggguacaacucucguggaugguacauguuguaguuucuucuggccuugugu

SEQ ID NO: 4096 - RNA, 1031 nt, Mus musculus
cuaggaggaaggaggcaccaccuuuauuucucaacagaaggcaggguagauguguguggcucacagcuggguccagggcuccgucucuggcucaccugcucaccucagcuggcucuggcuggauaucucauuaggccccuuucuggaaguuccugaggaguauggagaucagaugaggagggacacauaggagacuuggguccucuggaagggguagggcgaggacacagagacacaacucacacaugcaagcagaacuggaaaagcaggaagaagaaggccaccacuaauguccccaccaggauguucuggaagagcccaggacuggaaucugccagacaaugaacaacagcguccuuccagaccccgccaggaggaagaccccucuaucaagcugauucauaccugucuuaacgaacguuauaggcuucucuccaauaaaccgggccacagcaagaaggcuagcucggucugagucuggauaaucaaagaaaagccuguuuacaacuugcuggggucuggcuccugaaaccgagggccggguuccaucucuucugggggcuaaaaaccaaagcagagucugugacaagagcccaagggccaucaugcccaccaaugaggccaggcaaacccagagcucugauuguuuugucccagggcuggcugagcucccaucagaagcccaccaugucugagaugggggggaaagguuuggacugaagguuugggcuauagagcaacacuuugucucaagacaaaguaaaaugagacaaaagggaggaagaaggaaaaaagagaaaaggaagaaagaaggggaaaggaagggggggguggggaaacuaaggccuggggcugggccauccuccucccuccugcccacaaugaaguuuacucccuuucucuagccucccuuauuccuacuauuccugaacucaguuccccaccuguuucuaugguccccagcucagccaucaacauccacaccccuacggcuacccacagccacagcuucauaaccccccacgacuaug

SEQ ID NO: 4097 - RNA, 1031 nt, Mus musculus
cauagucgugggggguuaugaagcuguggcuguggguagccguagggguguggauguugauggcugagcuggggaccauagaaacagguggggaacugaguucaggaauaguaggaauaagggaggcuagagaaagggaguaaacuucauugugggcaggagggaggaggauggcccagccccaggccuuaguuuccccaccccccccuuccuuuccccuucuuucuuccuuuucucuuuuuuccuucuuccucccuuuugucucauuuuacuuugucuugagacaaaguguugcucuauagcccaaaccuucaguccaaaccuuucccccccaucucagacauggugggcuucugaugggagcucagccagcccugggacaaaacaaucagagcucuggguuugccuggccucauuggugggcaugauggcccuugggcucuugucacagacucugcuuugguuuuuagcccccagaagagauggaacccggcccucgguuucaggagccagaccccagcaaguuguaaacaggcuuuucuuugauuauccagacucagaccgagcuagccuucuugcuguggcccgguuuauuggagagaagccuauaacguucguuaagacagguaugaaucagcuugauagaggggucuuccuccuggcggggucuggaaggacgcuguuguucauugucuggcagauuccaguccugggcucuuccagaacauccugguggggacauuagugguggccuucuucuuccugcuuuuccaguucugcuugcaugugugaguugugucucuguguccucgcccuaccccuuccagaggacccaagucuccuaugugucccuccucaucugaucuccauacuccucaggaacuuccagaaaggggccuaaugagauauccagccagagccagcugaggugagcaggugagccagagacggagcccuggacccagcugugagccacacacaucuacccugccuucuguugagaaauaaagguggugccuccuuccuccuag

SEQ ID NO: 4098 - RNA, 5580 nt, Mus musculus
cuuccgaaugugguuccccagagcggcaggagcaggucucuccucuuucgccggcgggucccuaggucacugcggaucucuaagccacacccacggacacccagggguaggacagcugcccuuuccuuuccccucuggugcuuucuaggaugggggugugaguggaaaccagcgucgcuauggcaaccaggccggguggucgggcccuggagcccugggagccagcgaaggcgagaggcggggcagcgggaggcgccagggcugcgcggcggggcgggggccugggucucccgggaggagcuggggaacaccgggcgccucucgcggaggugcacgccaaguucucgggugagugugcacgcgugugagcuggcccaaggcucacgggcgggcgugagcacgagcacacgugucgagugugcacucgcgugcguucuggggcccgugucuggcccucugcgccccgcgccccucccggccgcccgcagcagcucccgccacucccgccccgcgccgcuucucgcucgguccucgcccgccgcgccgcagucgccgccgccgcccagccugcgcccacgggccgcccgugccgggcaccuguuggaggcucagggacaggugcgggggcuggacuggccaggggagcgcgggugagggugagaggcggagaaaacgaggcagggggucccuaccuugggagaacggaugacccggguuagggauaggcaggcaggcaggcaggcaggcagaagcuugggcugagugaagagaagccuagaggggugggugacacccuggccagccccgcgccuggugcagaagauggccagagcuucagagcaagcagcaaaggagggaagcuguggggucccuggaggacuugaggggauggggacagagggagagcccaggaugagaggaaaacccuggaaaggugacagagggacaaugugcagguagugagcaggguuaagggggagucacgaccugucugcuuuaggacugaucuggcaacccacccagcccuuugugaagccaggccuccugccugcccaccagccagcgcagaucaucuuuucccucgacacccaggaagggagggcagugagguuccuacagaccccagccggccacuccagcucuacacccgucucccagucagaggugcugcaugaggggccgcaggggcgaucgcaugaccaucaacauccaggagcacauggccaucaacgugugcccuggacccaucaggcccauccgccagaucuccgacuacuucccucgcagggggccaggaccagaggguggcggcggcggcgguggcacgggcugcggggaagccccagcucaucuggccccucuggcucuggcccccccugcggcucuccuuggggccacuacacccgacgauggagcugagguagacagcuacgacucggaugauaccagugagucugggggcucagugagcuugugggagagagcagccuccugaaugugugcguggaggauggggaggagggagggcagucccgccaccacagcugcagucugggugcagauuacagcuucagcaaggcucaauauucaauauuucugcugagacacuccaccacccacacagacaguugcggccgagccagggaccuagacgcaggcaugcacauggcugcucagccuccugcacauacacuggcaggccagcagagauguggacacauccuuuuagccaccaggucucacaccuugaccuggaccaaagacucauacuaccuucucucucucuccuugcccuuuuucugcagccgcccugggcacacuggaauuugaccuucucuaugaucaggcuuccugcaugcugcacuguagaauccucagggccaagguguguaucccuccuuccuaggcugucacccuuggggagagguuccaucuuccccccaaucagagguacuccuuccugcuccuucugcaucucuggaacuguacucuguggggaaucuaguccugcaggaggcgggagaaaggcuugggggucuaaaguccccuuugcauccuguccuccagggccucaagcccauggauuucaauggccuggcugaccccuauguaaagcuucaccuccugccaggagccugcaagguaugucuccuuccaggaccggcuugguuuaugggucccuuccuacccccaccuuuggggcuggcaggguccaugcaucagaacccuuugucccccaugccccaggccaauaagcuaaaaaccaagacacagaggaacacacugaacccuguguggaaugaggagcugacguacagcgggaucacggaugaugacaucacccacaaggugcucaggugagggcagcgccucugggcaagcuggcauuguaauguuuguuugguccaucucuuuauguccgaucaagacugucucguugauaccccaccauacccaguggcuccccagccccucagcagcagguucaaauguucuuacaggucuucuagcuggggccuggguuuggcauccgaaggccuucagccgugccuacaaguucuuggcuuccccugccaaccucagucuuugauaucugaggcucagccccaaacaugccucuucuggaaagauuucucugcucuccaagacccccuuccauagccuuuggcuucagucagaucuacacaccccgggcugccugcccuaugccauaucuaccuauaaucugaggaggaaagucuucccggucagagaacuugccaccacccuaggugugagaaagcaccccuaaaggagaguguggcagcugaguccaggccaggaaagacuuuacuccugaguaauagagagccgcagagggccucuuaucaugggacagacgaaggcagcagcagcaaaaguggccucacaguagacaguggacccucaaggucacaggcaguguguuguuucuaccgggucggcccaggcuagcccuggacuucgugccacccuacccagcuccuagggagcgugucucuguuuuaauccucauaacagcauugugaggacacuuggaugacuuguccaaggucacacagguaaugagcagggcuggaauuucaacacaccuucacaccauaaccacucaugucucaacaccauacugcugcaccugggccuugcucaaauggggaaaaacaaggcacccaagucaaucaggagucauuggcugguuacuaccacugugucuggccauacccacccagacacacauguagcguucagcuggcacuuguccccagguggggaauggagcaguucuaaaagcugcgaggacgaggacguccuguucagcuggguaauucuugauaagauacuggacagccuugggcagauccacuuacccuucucaagcucccacccguuuuacagaugaggugaacuuagggcagagcugggacugguccgaggaccuuuuucucccuccggaguggggcucagauacccaggggcccugacccugcaguucccugccaggaucucugucugugaugaggacaagcugagccacaaugaauucauuggggagauccgagugccccuccgccgccucaagccuucacagaagaagcauuuuaacaucugccuugagcgccaggucccgguccgugugggucuaacagguacgggggaggggaucuggaaaggucagcuugccagaaccuuuucuuucccccccucagcuuccuucacccucuucaaugucugcggcgcugaggggcauauccuguuaccugaaggaggugaggcgaaugaugccgagagcccugucugggugggagguggggagagccuguagacucaccucugcccccuucucuggcagcuggagcaggcagagcagggaccugggcugcuggaagagcgcgggcgcauccugcugagccucagcuacagcucucggcggcaugggcugcuggugggcauuguucgcugugcgcaccuggcugcaauggauguuaacggcuacucugacccuuaugugaagacgugagcccuugcccaagccugaccccagccuaacugcucuggggccuagccugucucuaaccaacuucacguuccucucuuacccccuagguacuugagaccagauguggauaagaaauccaagcacaaaacauguguaaagaagaagacacuaaauccggaauuuaaugagguaaaaaugucagggaguagaaauaaaguugggcuggggacagcgaugugguuaggccucacagaaagcaccgccugccuuuguucucaggaauucuucuaugagauugaacucuccacucuggccacuaagacccuggaggucacagucugggacuacgacauuggcaaauccaaugacuucauaggugaguggcagagcccaccaggugcucugagggaaguggaggagagugggcgcugacacguuggccugccuugccuguucuucagguggugugucucuggggccaggagcccggggagaggcccagaaacacuggaaugacugucuacaucagccggacacagcccuggagcgcuggcauacucugaccagcgagcugcccccugcagcaggggcuuacccuuuggcuugagugaacagcagcuguccaucacaggcccucuggggccggguccaguacccaaccuucgcacgaguguguugcacguuuacauggggugggaugccccugccccacacuaccugucuuauuuuugugagucucugugacgggccugucuucuugugagggacuguggagagcuauauucacauaugcaaacuuccuccugccugccuugcuguuaccugcaaauaugcaaccacccgugcacagggccacgugggagucuccugccagugccccaccccauccugcagcuccuuucuuggccuuuccaggcugccugguccccugccccacagggagggggucggauuagggaagauuagaggaggacguuuccaaauagaggaaaggacaaggaaagaaagagccaacucuuuaauacagagccuucacuaaaucccagcccugcguagcugcucuucuaaaggggcggccaccguaggucucuaccucccgaagauguagcagacccuuuuggccacucguuuaaauaacuguucccuggauggggcugggauguaagggcaggacccugccaccuuccucggggacauugugcauguuuacgccuuuucugauugugucaguggccgaagcauggcaacugggcaucaauaaacaucucuugaggaagugggcuugaguuugcuggcacaggaggagugcugugaggugccuggcagguggcacuggguggcuacucuggaaugucgaucaccaggucgucaucuccguccagggcgucauccccacugccugcaucgcugaacaucugcugagggacggugcucaggauuguauguggaggcaucuugggaggaggcaggggggucagggcugccccaacacuggcaccagaaccccuggcugggaaagccagcggcccacccacggggcagucaggggguccaaccgacaucug

SEQ ID NO: 4099 - RNA, 4018 nt, Mus musculus
ggguugcgggaaggagugacgucagggugagugggcgcccaagaagggguguguaggaggucgggaaucggagaggacagacccgacccuuucgagggagaagacaggucaaggagagaggaaagagaaagagccgcuauagaguggggcugcgggccagguggaguaggaaccgcuguugucaggggaagcuagaagaaaaagaaggggucgauaaggaaaggggggcuggaguggagggaggagaaaccagcugagacugggagacugaggguggagagaggaaaggaagaggagacugcgggaaggggaaaggagagaggaaccacagaaggaagagagaacaagagugaucuccgaguggagacaaauagaaaaggaaggggagaaagaaagagggaagugaggggaagguuuguuggggggccuguaggaggagugaacaggaguggggauguggaagggagggaaucaggaagcagucaucgaggggucagguggagaacuggggguaccagggagcuggggucugcaagaugcagcuugccacuuagccagggccucuuugccuaucauguuuccauggccacugccucuaggcuccucagcccuuacuaugcuccucggagcccucacuucucuguuccuuugguauugcuaccgacuggguucccaagacaugcaggcccuggggaccgggagccgagcuggggguguuagugguaugccugauguauguucucagacuggcccaaggggccuuggggauucuggagaaggacccagggcagaaggucuagugagcaggcggcuucgggccuaugccaggcguuacuccugggcugggauggguagggugaggcgggcagcucagggaggcucuggccucacaggaggggcaggggucaugggcauucagcgcccuggcuuacuuuuucuaccagaccugccuucgucccccuuuguaccacgugaugcccagaggcaugacguggagcuccuacagagcagcuuucccgccauuuugcgggacuucggggcugugagcugggacuucucaggaacuacuccucugccucggggcugguccccaccccuggccccugggugcuaccagcuccugcuguaccaagcaggccgaugccaacccagcaacugccggcggugcccaggagccuaucgggcacugagggggcuacggagcuucaugagugccaauaccuucggcaaugcuggcuuuuccguucuacugccuggggcccggcuugagggccgcuguggacccaccaaugcucggguuagaugccaucugggugaguauagccugucuacaaaccuuccaucuuuccuacuuuacuaccucuuucugcacuuugguucuuuucucagaaucuuccccaaccagaucugaguucuguuuuuaugcaucuauccagucagugguggcuuacacagugucccacgcugacucuuugucuccaaccaccagccacccuccccccuuuuaacuuaaaagaaauucucacugaaauguaaguggucaguguuacuugcccugaagaggaaauacccagaaaaugaauuuuaaauuguaaaaagagacugcuuggagcagggcauggucuugcaugccuguaaucucagcaccugggagacugaggcgaggaucacaagucugaggcaagccugggucuuauuucucuuuuauuuagucuagggaguauagugagauaaucuacaucucacuauguaguacuggccuggaaucuaaauacaggccaguuggccucaaacucacuaagaucugccucccacuaccuccugaguucugggaucaaaggugugagcaguagguagccuacuuuauuuaggcuucuucgcugauaaguagcaauguuagugggguguucaauagcaccaaccuggcauuuucuguuuucagacacaccagaagagggcgucggaucucacuacagauaauugugagccaccgugugguugcugggaauugaacucaggaccucuggaaaagcaagcagugcucuuagccgcugagccaucucccuagcccccugagauuuucuaauguucuaaagauugaaagaaaauugggaaaguaaauauuaugacuucagcuuagcauaaaucucuguguacugccagcuggguggaucuuaugauuuggggcauacuacuuuuccuaccagaccugccuucaccccucugugccaugugacacccagaggcaugacguggaguuccuacagaacaguuucccugccaguuuacaggacuuggggcuucucagggaccaccccucugccucagggcucaucccaaccccuggucccugggugagggcuuuuuggcugcucccuggagauaccaugcacauguuggacuuuuaaccuucauaagguugggaacacuacccagucuuaaggacgacuuuccggaaugucuuacuuacgucagagucggcuguuuucucagcacacucgacuaagguccuggggucagacuggauccauuaguuuugccucaugggagaggugcccaguacacaguagauucuggaacugaauugacagaaaguccaggaggagaugguuuaggggagauuucuuccaaaugacagauaugcuucccaaagcaggacuuccacagaaucuggccugugaggcccauugagugggcaggcccccugaacacaggcaggaaugguggauuccauucccauucucucuucacaggccugaagaucccuccugguugugaguugguuguugguggugagccccagugcugggcugaagggcacugccuccugguggacgacuccuuccugcacacaguggcucauaaugguaauaggacucacauucuggugggucaggggaccaaagaccuggagggauuccagccaaucugcucucagcagcacuguuuugggacugcacagccuugggcgagccacagcuccuccaaucaccuguggggcaucugccuucuuuaccgggugacugugcauaugggcuaggcccauaagcuagacuaucugcaccccuauccucuugcugugaaaccuuaggcauuuauuuaaucauaucaugccugucagcugguauaaaauguacccguuuugggcacacagagcuaccacuguaaaugccagguauggugaaacucaggaggcugagccaggaggauggugaguuuaagggccgggcuacaggaugaaaccguggcuuaaugaacaaauaugcaccacuggugagggccuggugcugacuuugcuuuccucagucuauacuaugaauccuagcacaugaguucugguaucagcugcugucuccaucccugugugcccuaggauccccugaagaugggccucgaguggucuucauuguggaccucuggcauccuaauguggcuggggcagaacgccaagcucucgacuuugucuucgcuccagacccuugagagacgcuucuggcaccugagcugagugaugcugcacucacggacagccugagugguggucaggaccucuucuccaccuccucagccagcauugaauacaaauucucaauccucuccuaaguccugauucuuuccuucccaguuaccaaucccaggccagggcuugggacaaggggcucauguuucuaccacaaaacagccaggcauaagcaucucucucuuuuuuuuuuuuuuuuuuuuuuuuccgagacaggguuucucuguauagcccuggcuguccugaagcucauucuguagacuaggcuggccucgaacucagaaauccuccugccucugccucccaagugcugggauuaaaggcaugugccaucacugcccagcacaucuuuuuuguuuuuuguuuuuguuuuuuuccguagcaucuucuuaacauaagcgucucagcaucccucacccgagagucagcagcagaccuucagcucaacuuuauuccaauaauuuaauagaaaauuaaaauaauaaauaauaugaaaca

SEQ ID NO: 4100 - RNA, 20366 nt, Mus musculus
aagauaacuuaggaacucagagacaaguuuuuauuuaaaauuuauuguaauggggucugcgcaaaaggagggaggggaggguggggaacaugcaagggacacaggaacacgaugacauggccagggccauagcuucuguuaugggaaagaggaagaaagaccagggcuggagcugggguggaagagggaagggggagacacuguggcugcauucccccacccccaggaagcaccucuugucccuggcuccccuccuuugcccuggcccccuaagauuccaucucucuuguucugccucuggcuccaguggcuccuucugaugcuccccuuggcuucucccuggacagacacuccaguaggaugcuugggguuuaaccacccaaccuuacucaaguaucccucugccuuccccgcuucugccccuccucaauaccaccuuuucucuccucugggacagaaucuucuuuccccuccucucuccucccuaccccugggaaaaaacaacaacaaaaaagaaagcaccaacuccccaggaaggggcagcagacaguaggggaggggacagaaggaggagagcacaggaccuucuaggaaaggcucacaaaucccugggaggcaaggcaagggguuaaaggugagggcaguggcugcugcuguccucugccaccccugcucauuguccaggggacuucaacacaacucaggggacagguguuuguagggucagcucugauagggagaagaaaggagcaggagaaacauuguuaaaaccuagugaauuccuucuuccuccucucugucuggaggcuccuugguugaugaagagucgugaggaguuggugggaagaggagacuguaccaagaagagcuuuccuccacucuccccucucccccaucaacuuggagcucaccaaggcugggagggaaguggcugagagcucacugguacccccucugccccagagagggagcccacagcuguggggggggcugccaccacugcugcugccgccgccgccgcugcugcugccgcugccgccauuggacaaaccucaccaguaccuauagggagaaacaccaaggaucacagcacaaccuaaauggcaagaaacauguuccauaccccagacuuuucaacuauuucccuauuuccccugggacacagccguuacuuccuaucugguccccagaggcuucggccugccugcuuacccagacugagcauguccauacugcccucucuggaucccaaggcucccuaaucugagugacagacuggcaucccuggccuuccugcgauccccuauugggcccuuugaguucccuugucccacacaucccaugcugccccccccagccaugucccacaccuugccuggugggugcaggggucccccucagcagguaggcuguggcuggggggcaucucccgggauaggaggggcggccccccccagaugggucugcauguggccggccagcugggcaggggucuugcagugcacgcugcacagcuuacacaggaugcggucagcccgcggggccuggagcccaugguccuucaccgcguggaugcgcagguaugcugcuguggugaagccuauuggggggggggguugggaugggggguuggggucagccugguggagaccccagagacagggcuguucuccuaggcuggggacacccuccucacauggcacuguccuccucccacauccuugguaggcuggggccaacuacuccagagaagcauagccuuucccuacgcuugcuggggacugguuuguguggugcccuuacuuaguccuuaaucucuacagagaccguccacgacacggcuaccuagcuuuuuaaaggcuugacucucaguggagacggcuguguccccccccucuccagugcccccgucucagcuccuuuagucaccaaccacagugaaacagcuuucugcuacuggguagggugcaugcucgucacaccccugcugauguacuccaccugccccaggagcuggagacaagagcuuguggcugcuaaguugaaacccuugggacuggcuuuuuggcuauuccuuucucaaaguaaccacgucccacuucauucucccaagcacacccaugagguugaauuucugguagacggucuccugugaaccauggcacauaauuuaguggugguguuuccaaugcuguuguacuugccccuuaaagaguucucucuacucgccacaagcucuuagcugcagcacccuugacccacaucggugaaaaaaaacccaacagcucugugccccccuuuuuagucccugcccuccuggcaccccuuagcauguaccuuuguugcagagcucacagacauggugagggcccuggcugugcaccuucauguggucggaaauauaagccgagcucagcaucuugccacagacaugacauggcaccuucuccucgugucggacugugugcgcucggaggcgauccuucguagcaaaagcugccucacauuucugggggaggguguggggucacaggagaguuaaagcuucggggaguagagagaagggagcaagauaaggggaucagagucucgggggucuuugaucuguaggaaaugggcgugagaugaccaggccuugaaggagaaaugugaaaauggagugaagaggcaaaaagagagagaaaaagggggucugagaggcugaacccacacagcuacaaugaggaucaaaaucaugaaaaccaggacaggaggaagcuggcuuccuaccucacauuugaagggccgcucuguugagugcacuugucugacgugacuguugaggugauccggccuagggauauguugaggugggaggggguguguguuagggcuuaggcuccaagguaaggugugccucaaaucuaccuagguuccuccaaaaugccucugcaaaggucccagcguuucccccucagcuucaguccucaggcaggaaagcccucaaaccaagauuccucuucugcccagaggcugcuuuccuucagcccagagacccaccucuucuaaaguaccacccccuguuccuagcaacuucccuccucccugggagugguuccuguccccaggaacgggagccgccuccccaccagccaaagacaggccaccuuguugcccucccccccaccggccuagugggcagcgaggccccugcacaccgggagaagcucuugccacagugggagcaguuguagggcuugugcacagcgccgucaugugagcgcacgugguaacucaugcgguccuugcgcuugaagcgcugcuggcacacagggcacugguagggcuucucguccgaaugcgacagcuuaugucgguucaggugguagacgucgcggaaggccuugccgcacaucucgcaggcgugauucuuccggaugcgcuucccagaggcagucguggucacaacgccaccggccgccaccgcggcugugccgccgccagccccggcuucucccccacccccgcuggccccgcucagcugggggacacucaagaggcucaggggcaccauggugggcaucuucauagcacccgaagggacccggccagccuuggcucccguguggauggcuucgugccuucggagguuguagccguucuugaacuccuuggcgcacagggcgcaaauguagggccccuugcucuuugucuucuucuccaagacagaugcaacuggggccacggcgaccgucgagguuggggcgacgacagcgguggcagccgcugcugcgauaguggcggccgcggcggggggcgcggccucggcggcuggugcggagacggcaggggguggcggaggaggcgccggaggcugcuucagggccgcuguguccacuguggaggcggcggcaggggccgggggugcaguaaccacugcagcggcagccgccgcagcagccgccgccgccgcggcugauuccugcgcggcggcgagaaccgggagcaaguccacuuggaggggcucggccgccggggccuggggcgugggugggggcgccggcgcggccugcggagacaaggcgccgugugggccgcggucgcuggucggcgccugcccgcccggcccggccccuacucaccuggaauggacucugggcgcagcccugggaggcaaagaagcgggacuggagcucagccccgaccugcaggggguucugggcgugacccugagguggcgggaaggaguucaugaggccgcccaccccccgggaguccaggcccagcacggggaaggggggggccagcagcgugcaagggaacacggggaacauggccucggccacagugggggcccccggagcucagcgggagccgggggcacgggccgcgcggggcccgggcucggggcgccgcccccggccggccggguugggccgagccgaacgcauggcccgagggccgccccgccgcccgcgcaccccggccggcgggagggagggaaggagggcgucuuguggggcgcggagcgcggcggcggcggcgacgcccccugggugggggcgagaggccccgcggggccgagggccggggccgggggcggggggcccgggcggcggcggcggcggugguggcggcgguuggagccuggcggggcgggguggggggagcgagggagcagcuucggcccccgccgcgcgcgcgcgcccagccggcgccucggggagggcgggggagggcgcgagggagggagggggacagcugcgcgcgcaccgggcgcgcggagggggugugggacaggagggagggcgggcaggagggggugugggagggggggcaggggcggggggggcggggguuguuaccuggaagaugaagcugcuccaguugcugggauccauggcggagggaggagggagguggcucgcgcucacccuggggcgggaggaggcagcugugggggagggggacccaaggaggaggcgcgcaaggagggaggggggaggagggugggggagcggcgcacacugcgcgccggagggcgggcggggggcgcgaggacacacaagaggcuggagcgggcgcgagcgcgagugcgcgcggggccagcgggagggggagggacaggagggacucuagagggcggagggacuggggagccacccagcagccccggucgccccgagcgcgagacccccaagacgguugcugauuggcuggcgauggugcagguggugggcgcgcgggagacuaggcggcuucucuucccccacuugaacgauuccaccccccacuucccuccgccagcggccguuauuucgcgcgcacgcgcacauaacagggacgucguugcugagcgggagaguggggagcgcgccgagggaguuacagcggggcggggcuagcuuggagcgcgugcccgcuuaacggucggucgcugugcuuaagcuuucgcgucagcuuuuugauucuucuaggccaccguccccuccccauuccagugguuuauuuacaaucuuggccuaguuuggggguuucccaaagauggcgccuacauggguguccugcagagcuugauccugacccccaggguaguuauggacucugaccccagcccugucauccucaaaaaccaggcucaaccauggaauaaaaacuguauuuacacaacacgucacuauacaaggauuuuuaaaagaagguagugucaagagggaccgcugugcuggcuggcggccaagcucaagagauucgccuguaaagaagaggaacgugcguuagcauagcagccuaaggugggcugcggugggggaacaccaugcagaaagggcaaagguggccuuaccuucaggaaagacuccaccugcuucccagagaugccuuccaccuguuccaaguccuccaccuagugggacagcaacacuaggaagggaguggacacagcacggggacccccccacugcaccuguccccaggguuguuaccucacugaaggggccguggagcucccuccagcccacgaugagcugggcuuucuucuggccaaugcgcugcaggcugcgcaguucccgagcugagccuucauucagcagauccaauaauuuuuugcgcccaugugccaguaacucugggcuaaucuguaccucccaguaguccucauccuuuuccacagcuucugacucaggggauggcuccagcuaugagguaacagaaaugccaguaaaggcagugggugacugccaugacgaggcacaguccaucucucugcggccucuccccucuggucacuaauuuuguugugcuucuuuaauugcuagcuccuuucucaguugcugugaagagucagugagugacugagcgcacacaucaauccugauuaggaagaaguguaauucagugguagagcgcuugccuuccaugcuugagggcugggguucaauuuccaguacaggggggaaaagggaaaccaaacaaaaaacccaugcgggggaaacugcaucaugccauuacaauggggacaguucuacuaauguuuuguguggagaaaauuauauuuuucauuuuaugugagagauucuuaaauacuuguccauuuccuaaauaggcucuacaguucuuagagggcaggggccacauuagauccagucagcagccaauccaaacacaaggggcaucaggggcaucaagaagaaaagaaacagugguagauauuuucuaugagacacauccauaccucacucccccaccacacccccucaaaaaagcucuauaaggcaucuuuaaggcauuaugcaaaaggcucccagcuggaaaauggggugggacucaccuuccuuuuggggccuuucuucaggagcuggauuugguuugaggacucucgcugcuucugaacugaaaggaauuuggaacuggucaaagacacaggccaccuccugcccucccuccccuccuaguaaccauuugcuucucccauuucuauuucccuagcuccuuccuuucaacaugacuuuuuuuuuuugaggcagggucucauucuauaaggcuaaccuagaacucauaguaacccuccugccucacccuccugaguggcaccauagccagucaguaccccacugucuacaauacuagaggacaagcaucuagggcuucuucagacccagugggaggaugagugacaugauaacagcaucuuuccgucucuuccuuucugaaauagcugcuucuuccuggaaccuggaacuaaacuuacuccguugcaggggcaucacuacagccuuuuucaggggcuuugccacugugccacuauaagaggcaggcggcuggagaauugugggaguguucucuuuuucccuuggauccggugccuccugggccaacaccuuggcuuccaguucuuuuugcuucaucuuaagccucugucggaaagaaucaugggagaugugauuuagcuccagccccaaagcaguggauuaggaagguuagcagauagaguucugagguccaagaggagagacagaauucaaaauaacuaagggaggucuacaucagagggcuaccuaaagacagaaugaguccuuuuaagcaagguauucaacgugaggaggcuuuguuuuuugguuugugggguuuuuuguuuuuguuuguuuuuuggcuuuucaaggcaaguggugaaacucaaacucagagaucuaccuaucugccuucagagugcucgaauuaaaggucugcaacaccaccucauguuuuaaagauuuuuuuuuuuugauuauacaguguuauaccugcauaggcaccagaucucacugcagacgguucugaaccgccaucaugccguugcuggggccuguacucaggaccucuguaaggaaaaccagcauucuuaaccucugagcaaucucuccagccuuagauuuuuuuuucuuuuacuuuuuuauuuuuuuaagauaaggucucacuauguagccacagcuggccuagaacuuacuauguagauugggccaaacgaauucacaaaaagagcugccugccuacuuaggcagguuauauauuuuuacuuauauguguggguguuuggccugcauggaugucugugcgcuaugugccuggugcccuuguaggucagaagacagugauggguccucuggaaauagaauuauaggcagucaugaacugcucuguaguugcuagaaauugagucaguguucuuaacugcugagucaugucucuagccucugguaauauauuuacuaucuuguguaugugugcagucuauguauauacccaaagaccucagagagauguuugcuuccugaagcuggaaguugccucaugugggugcuggcaauuggauuaguguccucugccagaacagcaugggcuccuaaccacugagccauuucucuaauuuggauuucuucccccuguuaucugaucucaguuguuucuuaggcuucagucauguuaagugcauucaagcaggggcuagagagauggcucaguagcuaaguauacuauuccagagaacccagguuugauuccaccaauauggggcaguucauaacuaucucuuaacucuagacccagaguaucugauaaccucuucugaccucuguaggcauugcacacaugugauacacagucauaaaggucagaauaaaaccaauauacauaaaaauaaaucuuaaacaccaaacaaacauuauuccaacagaagacagaaaauguccagaacgggauggaaacugaauucuagaucagcaucuaagcauccuuuccugucugaagauacuaggaaugcuucuuaaagcugguuggaauauucagccaccuuccccaacauuuaccucaaucucuaaguucuuuuccuccacugucuucaugagcaccauucguucucgcuuugggguauucaguaggggggucccuuggcuucccugggaacccagcaaacguuccauacucaggagguucuccaacauggcuggauccauauugcuuagcuucuguaagaggcugaguugaaaaaaagguuaccuuuucucuccucaccuccagcagcaggacaacccuugucauaccuuaacuuggugcauguguuccaugauccugaugggacucuuuaagcaguuaccuagucucugauaacugauaucuaguuaucuugucuuuuucaggugaaguaaacucucagggauacuggaauaucagauaagaggcuaacaugcacuggaugccacacauuagggaccucaauucuacccuguccaagagguacuugugauaaggaagaaggggaggggggcgcugggaagaugacucagcaguuaaaugcuuugccauguaaacaagggacuuggaaguuggauacuuagagcccacaauaaaugccaaguggguguggcagccuauuauucuagccucaaagggagacacaggaugccccaagcaagcaagcaagcaggcuagaaauacuagccacaacaggaagcucuggguuuuauugagaccuuaccucaguguguaagguacaagagugacugaggcagagucucagcuucauccucaagcauccauaugcauaugcacacauagccuugcauaccacaugcagaugcacacauaaccaugcauaccacaugcaagcacacauagccuugcauaccacaugcagaugcacacauaaccaugcauaccacaaacacaaagaaagggauaagguaagagcugagggcuuggacauuuguaaagcaagcagggaaagugucacaaaagaggcccucgugaacaggaaaguuacuaaagaccuaaagugagaagacgccuuuauccagugggcuguauacagaagauucuuguuccagcggaguccuggcuaucuaagcacaguaaguccuaucagucauacaucaaucugccuugaaccuucacccucaccucugaugaaaauuguuuuuucaaagugaaaaugccacuuuucuaauaacauccagugagauuaucugugcuacacugaacgagcucuucaaagccacaggccaugaccuguucuccaugucccagccuuaggagaacagcauaagaaaguguagagugaacaguaggaauaacuuuuccuggcuuucacagaacgagucauucuuuuuggggagugggguagggaacaguuuagagacaggguuucucuguguagcucuagcuguucuagaacuugcuuuguagaugaagcuggccucaaagucaagagauccacuugccucugccuuucaagugcuggauuaaagauaugcaccaccacugcugggcaccugguuuucuguaugagcuuccuggcuuuaaaaacucaggaucuccaucuccuaaaagugaauccucaaagugaggaucuaagcuugaugcgccccaucuaagcgugccuucguccagagcgccaaucuggcuggcccuuuggugaguuuaggaugaaucccuuugcucaaagacucgacaggcuaaccccacuguuaccuccagcuaucuuauccuguagggaaggccugacucucaccuuaguuucugggaggcagacgcuggagcugcuguagacucagggcucccaguugauucuucuucagggccuuuggccuucuuugccucugacgggccuagcaguucuuucugagacagcuuaacaggugccaaggcuaagaagauuaaugagauagaagaaucagaguggucagcuucaguaucagugcuuggugauuuuggcaaacuccccaacucuccuggcuauuccaccccucuucccuaguccucaccaugaggcuguagacucucauuggugaaaggccgguuaaucaccuccuuggaccuagcagugaaguucaaugcugaaauuguauccugguaaaaacgucuuucaggagcaauguuggcaaugaggaugcuaugagcugagccucccagagaguccugaggagugagaauuagaguaugggucagacuccuauuccuuuacaacaaugccugcuucccuaaccagcaggccuaagugccaccuucuccuguuccuuuugauucaacauggguagacaugaccugcagcagacgagugagcuugcugucccgguaugguaugcgagggaggcccugguuuaaugcauccaccacuuugcccaguacaaagagggagguguugauggcuccgcucucuuugagccgaaugcccugguugccugugcgacgguuguccucugaaccagccaaaucaauaagguagaguuuuccuucccgcuggcgaaauggagucaaacguucacgcugaucuaccuaggggaagagcaagagacccagacucaguccacauuucaggggcuucccaggccuuucugucagcgggccuuaccuugaccaagagcacugcgugacuacgggaagagcgcugguuaagccggguggcuccuacagcucgauuucuacuggcuggaaggaagugcugcucgaagucagagaagcuggugaugggcuucugugugaggccugggaucaggauguucccucggcagucuucgcggaucacgaggucuccugaugcaggauccaagaggucuaauaccuauuugagcagugacagugagcccauuucuccaugaccagggugccugcugaagcagggguuaggaucccuuucucuacuggacuguuaggguucuuucacuugcuaccccaacccugccugucuaggcuucacuacaccuuuacuagaggagagcuucauguccucucuagauggcccugguacuuugcccccuuaccuuuuccugguagaucucuaaauaggacauagcaacagaaacgucccauggccgucccucagcacucucuucccuugcuaguugcaggagguccaugagagcccgaggaaucacuccagguugcucugggcugcccagcauugugugugucuucccugggcaaagagcagagaaagguaugaaguuccccucaauguuccuaguucuuuuccucaugcauagguaguucucgucuggcucucucaccugccccaguaggcccauaggcaaguacacuggcauucugcccuuccagcaagugccuuaggaugggcuguacugaaccuacauagacuuccugcugagugcucuucucgccauagaaggcaucaaaccuguaggugaaaaaagguguuauuaggauguccuauugauacccucaccuagaugaugcuggcuuuaaaggcucuaucccauuuuuuuuuuuuuuuuugacaaagaccuucaaagugucucugaaaauuuuaccauauccagucauuguacugauguuagggaaacaaauuaaucucacacugcaaucugguuggccagauauccauacucuacaaugauucaggagacaagcaagaccauguuagaaggaauaaaugauuuugccagcagaaggaagugcugccaaguaggacacagggacaagaggcagugcucuguggaggggagccuaaacuccggaaguauguccugagcuugacgugaacaacugccuccccagacauagcagacaggguucagagagcagagcaggcuggagaaacagaggccaguugagcugcuuggaagaggcucauugccugcaggcugugccacgugcuccaggauuccaucucugugagcuggagugggcucuggugauacagcugucuaugggucauuuaccugcuuauaaacccauauuccuauaaauaaccccaaauaaaacguguuggcucaccaaguuggauauuggugguguccuuauuuagguuauuuuggcaguuaguuccugcccugugacaagcacccacacaacauggugugaaagggcuuuccaguauuuuccuugagguagcauuggaacaggguaaauaaaagguuggccuagugagucagugcaugcugacaagagagagcuggaaagggccagaagccuaauugcuaagggauuagcacugagguaaacuaacuuccuauaaagaagcaaauaauaaauauuuuagguuuuguguaaacaugccuuaauucuaaggcuaguuaagcaccuauuguuuuguaaacaaaugauaaacuuuauuuacagaaaagucuacugugcugggcaugucagcacagcaccugggaucccagcacugaggagggaagucaagaggaucaguaguucaaggccagccuggacuuuaugagaccuuguuucaaaagaacaaaauccaaagaaacaaaaaaaugaaacaaccaaauggaagacuuugguuggaucugaccugcaugcagucugugguuuauagcccucuaggccagacuaacaggccaaguguaagucuuuuguguaguucccgucuuguuugccauuccggaaucugaauggucuucucugguugacugccaggucugcuuuccugcccuuccccuguauuuucuagaacuuauuugaagccacauugcuccuuccuuccuuuguucaacuucuagucuuucuccacagcacucaccucacaccauuaacaucuaaauaacuggaggaaggauugagugacagcaaggaacaggauccugagagagagagagagaucucagaaacccagugagaguaacaaacgcgcaggccgagguggaggaucagccugaaccuuacugauauuugagcgucuccugguauuucuuccaguuagccacuucaagagagcagcugucuauggcucggacacaggggagcuccuucgcuucugucucuccauccauaaacgggcgcagccgcacagccacccuuacucgagcuagaggcggacgccggccaagcccuccuuugcuuacacagcggccagguccugcaauagaccaguuuuagguguuaaaauuuggagaagcacagagaaaugggaaucuacuuugcuagaagguccaggggugccucuuacuuagggggaagcucuuuucaucaugguuguugugaugguugacccagggaguggcauuauuaggaagugugaccuauuggaggaagugugucauuguggaugugggcuuuaagacccucauccuagcugccuggaagccaguauucugcuugcugccuucagauggagauguagaacucuuagcucuuccugcacuaugccugccuggaugcugccauguuccugccuugaugauaaugaacugaaccucugaaccuguaagccagccucaauuaaauguuguccuuacaagaguuacuuugguuauggugucuguuguuauauauaaggcaaguuuuuuuuuuuuuuuuaagauuuauuucuuuuauuuuuuauuuuauuuaauuaauuaauuaauuaauuaauuaauuuugagacaggguuucucuguauaccccuggcuguccuggaauuauuuauuuauuuugagacaggguuucucuguauaccccuggcuguccuggaacucacuuuguagaccaggcuggccucgaacccagaaauccgccugccucugccucccaaagugcugggauuaaaggcgugcgccaccaccgccuggcagauuuauuuauguaucugaguacacugcuucagacacaccagaagaagguaucagaucccauuacagaugguugugagucaccaugugguugcugggaauugaacccaggaccucuggaagagcagacuguguucuuaaccacugagccaucucucuagccccauaaggcaagucuuauaaggaccacauuuaauuggggcuggcuuacagguucggagguucaguccauuaucaucaaggcaggagcauggcagcauccaggcggauguggggcuggaggagcugagaguugcaccucuuauucugaaggcagcaaacagaagaccggcuuccaggcagcuaagaugagggucucaaagcccacucccacagugacacaccuacuccaacaaggucacgccuccaaauagugccacucccugggccaaccauauacaaaccaucacaguugugcugugggcgucccucaaguaagccaguuccuucucugcucuauaaguaggguagguggacacaagacacaaagcagaauucuccaagugugauauauacauaaauaacauggaagauuuuguuuaaaucuauaaacagcauaagucucugaaugaaucugagauugucuuucuaacaagguuucagacagugcugggccccacugugaacugccaaucacaggaauacccuaaaggacuaagaccuccucuccucuccucuccucuccucuccucuccucuccucuccucuccucuccucuccucuccucuccucucgucuccucuccuucccucucccucucccucucccucuccucuccccccuccuucucuccuccuucuaagacuuuacaucugacacugacagaaccaagcaagggcuggagagauggcucagugauuaaaaguacugguugcaaccgggcgugguagcacaugccuuuaaucccagcacucgggagccagaggcagaggcaggcggauuucugaggccagccugguuuacaaagugaguuccaggacagucaggacuacacagaaaaacccugucucgaaaaaccaaaaaaaaaaaaagaguacuuguugcuuacacagaggacccagguuagguucaugguaaacaccugggggccaggccaggagaaaugucuugaguuugaggccaauauccuuuucuggucgcuaugggcaccccccccccauguacacacauacacacacaucaauaaaaagggaaaaguccuggguuuuacugaaaugacuuguugaucauuuaguuaaauacaaaaggcaaacaagacaaagauacagacguguaacucuuaucugacacacucgucauuucuuuccagugauuuagucauuggaaaaaaauccuaaacuauuuuuuauugucaaaaaacacaaaaguuuuuuuuuuaauccuuauuuuuuauuuaugauauaugucuguuugaaugaaugccccuccuagagcggugcccaccaaggccggaaucgagagucagguccucuggagcuagagguauagaagaugugaacaguccaaugcaggugcucagaaccaacucagguccuuuggaaagcagcaugagaucuuauagaugagcccucccuccagccccaagccucuauuuacagguuaaaaaaaaaaaaaaaaagaaucucuggggcuggagagauggcucagcaguuaagagcauugacugcucuuccagagguccugaguugaauucccagcacccacaugguggcucacaaccaucuguaaugggaucugaugugucugaagacagcuacaguguacucacauauauaaaauaaauaagucuuuuuuuguuuguuuguuuuuguuuuuggagacaggguuucucuggguagccuuggcucuccuggaacucacuuuguagaccaggcuggccuugaacucagaaauccaccugccucugccucccaagugcugggacuaaaggugugcgccaccacgccaggcucauaauaauuuaucuuaucuuggaaaguaucauaacaaaguucagagagauucaagccuggaucauuuauucuaaaauuguuucaguuugguugguuuguuuugcgaucauaaggggccucuauagugcuagacacucagugccugagucugaacccugaccuccuuccugaaggaauucaaaacccagcacacuugugagacaaguuucccagccauccauuucccugguuaucuuauuaguuuuccugacuauuccucaguuuagcaaucuuaauuaaaugcuuucccuaugucccauccucugucaacuuuuguauuacuagcauucugaguuguauaguucuuuguuucgaggcugucacacuguaaacuguucaaccccgguagcacucuccuuauucaccuccaaguuguaaugagcaaaccgucuccagacgcuuccacauguucacugggguacaaacgucccuaggugagauagcucagauucacuucacaggcacagucaccugcucucuuggcaccaauuaucuuuuguuccuuuuaaaaauauuaucuucacccggguggugguggugcacgccuuuaaucccagcacucgggcgggaggcagaggcaggaggauuucugaguuugaggccagucuggucuacacagugaguuccaggacagcagggcuauacagagaaacccugucuugaaaaaccggaaaaaaaaacacaaaaaaacaaaccaucuucaaguugaugacuccuccuuagcacuuccuauuaaagagcugucucuggcuggcagagcuuccgcccaagcuaccaucuagcuucuccuggauguucuuagguaccucaaauuccaccuguacuaaacucuucccuugcccaucucugcaacuguuuccucacuuugcuaacacccacaaauagcucagaccccccacaagaagaauuuuuaacuguuuucuuucuucccacagucaucaauaccuguuaacucuuuuuaauuuaaaauuucucugauguuauguaugucugugugcuacugugcuggcuaguuuuauaucaauuugauauaaacuggagucaccugaaagguagcaaucucaguggagcaaaagccuccauaagaaaaagcuguagaacauuuucuuaacuagugacugacucggguggugucaguauccuuggguugguaguccugggucuuguaggaaagcaggccauggugaacggagagugagcggaugaaguaaacagcaucccuccauggccccugcaucagcuccugaguaucaguugcaacccugcuugcauuccuguccugacuuccuucagugauggauuaaaaugugggaguguaagccacauaaacuugcuuuuggucacuguguuucaucacagcaaugauaacccuaagagaaccucauacauucccgaugaccguggaagccagaagagggcaucagaucuuccaaaacuggaguuauagaugguugugagccaccaugugggugcugggaacccaaccaggauucucuggaagaacauccaauuuucuuagcagcugagccaucuugcuagccuuggcucuaccuuuuuuuuuuuuuuuuuuuuugguuuuucgagacaggguuucucuguauagcucuggcuguccuggaacucacuuuguagaccaggcuggccucgaacucagaaaucugccugccucugccucccaagugcugggauuaaaggcaugcgccaccaaacccggcuggcucuaucuucuuaaauauguuuuuguuuuuugagaaaagcuggcccugagcucccaauccuccuaccuuggccuuuugcgugugaggaucacaccagugguagguuuuaauucuucuucuguuugugcacacccacaccuaugugcgaaugcacaugggcauggaggccaaagaucaaacccuaguguuccucaacaugggaugaaacucaguccucaggcuuccgggacaaggacuuuaccgcugagcggugcucccagcuugcuccucucuacuaggaagagacaaccauucaccacaaucuuccuggccucuuuuauugcuaagcaacgcuugcucuuuuugauauuuucaagguugaguaaaaguccacccaaccucugaacccacuuuaacuaccauuuucacuaucuuuuuauguacguguuuugccugccugcauggagauccaggaggcaaucagucucucggucugaauccuaucugacuaauggaauucaaaauucggcacgaaaguaugugcaccauguccaagccuggugaacgggaccguuacuggaauuacagagcacuaaacccagcuccucucucaguccuaacuaucauuucucucucuucccuucucuuauuuugguuuuuccagacaggguuucucuguguagcccuggcuguccuggaacccacucuguagaccaggcuggccuugaacugagauccaccugccucugccucuugaguucugggauuaaaggugugcgccaccacucagcuuccaauuaccauuucuuaauaaagauuucucaaaauacccaaagguuuguuucagauucuacacuacaaguuuaugcuuuucuaccaauguauuuccucauacuacauuuguuuaugggacuauuugaaaaugauuguaauuucuuggaaagggcuaacagucuuucagcacuuuaacguuuacuacauaccaagcacccugggucucagagucuguauucggacauaacugucaagggcagaggcauuacaguguaacuaccugagugugaauuuagauucccaauauuuacuaguugugcuaucuugaagaagcuaucuaccccauuuaugccugcuuccucuugucaaaacacaaguacagggggcuggugagccuuagaaauugagugccuauuaguuuucuagagguucugaguuugguucccaggguccacaucugguggcucacagcugccaguaacuccagcuuuagaggguccaacacuucuggcuucugcggagauccacacauagguggcacacauugauaaaauuaaagcuuuuuguuaaagacagggcauuaacagucaugaccucagagcucuguacaacauuaaacgguucaucacaaaaugcuugcagcacugccuggcugaggcguucuccuaaaggucugccucccccaaagccaaacaaacaggccagauuucggccuauagaaagaggaaagacacgcauacgcaaaucgucuuaggaaagauuuggaaucuccuggcagccagccuuuucaccaggaaaacagcauccgguuccaaggcuggagggaaaggauuuuccuuugccgugugaucucacacagccuucagucggagugggaucucugaacagacagacagacagacagacagauaaagaggcucuucgcugcucagucuuuacagacggguggcugcccggcuuuacagaugacacaaauugaagcgcacacauuagcgcucaggcucuagacaggagcuggagccucggcagggucucaacccccucuacaccgccgaaggcagcgaauagaggacagggugcgguggcgcccaccuccacgcccgccagccagcguccccucgcccuuccgccccgcgccggcuggauuuuccgggaccacugcuacucuguaagucucacgcaguggugcucccuccucccggcccgcguaccugagguggccgacgccaucucccgucgcugcggacacgucuuagcccuuaagcucauagccuucccuucuucggcccgcuucucucuuuugaauuaccggggccccgccucccucucagauucgacca

SEQ ID NO: 4101 - RNA, 2707 nt, Mus musculus
cuuccgccuucuucugaggccagcccuccagggccuuucagaucgcugcgcgcacacacacccucccggcaugcacugggaagaagggcucugaaaacggcgaaauccaagauugaagcaaggugacaggugaggugaggggugcggaagcaacugcaaaugggggacugguggcagagauguggacaaauaccaacaagggaagcagacaggccagugauugggcagagcuggggaagcuggauaggugccgggccacagaccugguacagccagauagcacaacagggccaccuccaaggagagcgguuagguggcucaaagaguaggugcauauggaagggaggggccagcaagggguuucucucucauuccaagucuccucacuugagacugaggcaagaccugagagcccagaccuuugaucugucaucagaggugggggguggggcuggaggggaaguaaggccugcgacugugcaggggagccucagccagcucuggcuuguucuccggccucuccugguuugcucuugaccucucugggacccuuugcuccucucuaguuuugccacccaugcucaauaagccaauuagaagagccgaauuaacaguggguaggggugggggugggagcaggaacgcaagaugagggacaaagagauccagcacucccgacucccaaucugucucugagguucugaaguaaaguuacaguuuaaaaaaaaggccaaugaugugcagucccagugacaugcagucuaagcacugucucauccugugccacggucaaguuguuagaaccguuguugaaucucuuuccaggaaacgggauauccucugguugcuguccuuuccuucucccaguggagacguuccugacuguucugaguccacacugagucucccagaugccagugacgccucagcagcccucugggcacacggaggggcucccugagccuacagcggaggcagcaguguggguaguaauccccuguggaccuuguauucccaucaugcugggccuggccucucucacagccuucuucaucauaacuacugcuguacuggccgaacgccuguuccgccgcccgcaaccagaccccagccagcgugcccccacccuagucuggcgcccuggaggagaacuguggauugagcccacgagcagcgcccgggagcgcucugaggauugguacggcuccuccaugccucugcugauggacagggcuccaggucccccaacacccgguggcaccuuagagggcagagcaacugcuccaccagccacuucagccccauacucuucccucaguucucuaguuccucagaccccaccagaagucccagcccagagcaccuucuggaggccucagacccaagaggagaggccccaugacacaagccuggugagcuggguugggucugagcccaugccagaggcuggcuugcagguugggagccccaggccuuggaggccgaggcaagggagccuggaaccugauuggggucuccagccucgggucacccuggagcagaucucagcauucuggaagagggaaggccggaccagcgugggcuucugagucuucaggaccuguaagacuaacucccaccucagagggacuacaggggucagcuccagccuuaggccugacccuugcgcuggaaauuuuguguggaaauuucugucuucugcaccuggcuggugggcaggcuaagaguguggacagccugcacuccaaggcuugccugaaguucagcuuagguuaaaaugccuaagucgugacucugagaauugaaggcaagucuagcuggcuacaggccagaaggcuucaagauggcacgucaggguacaaacuuaccuaagacagccuauccuguaugggaugcugaccaucagcccagagcugguaguuaugagugucagucauguggucuggagauggcaagaaucuugcucuccagagccacaaacccuaucugugccuggccacucucucccaccacugugaggcccuccaggaaaacacagaggacaaauccaggaggugucuuugauuccguacaaauaauggccuuggccacuaaacagcaacaugggauuugaugggccacacuggagaggcuguccuugccuggaauugggacacagaaccaaaacagaucaguaggcuccucugcccccugacuuauggcugcacacauccuacaguacaguuuuauuauucuguguuaagacaagcauggccuaucgagaacugaguuuguuccaauaugggaaugaagauuuuuucccagagaaaggucacuccccaaacauagccucugccaucuuucccuccagcuugcuggaguggucuagagaggcagguuugcuguggggcagacuuacuuacagugauccauaccauagaaacggagucccgaauacccgugugcccaccagcugacaacuucuuuaggagagggguucgcaguggggaagauggagcuuucggcaucuggaaaucugacuuuccaaacuucagucaagaguaugacgauccugccguauguuuacuuuuuguuucauuauuuacuuuauauuuuuacuuaaaucgguucacuguaugcuuaauaaauuuguuuuaaagugaauccuuuuuguaugaccucuguaagugggaaaucaguauuuccaguauuacuugccacaaguuca

SEQ ID NO: 4102 - RNA, 2707 nt, Mus musculus
ugaacuuguggcaaguaauacuggaaauacugauuucccacuuacagaggucauacaaaaaggauucacuuuaaaacaaauuuauuaagcauacagugaaccgauuuaaguaaaaauauaaaguaaauaaugaaacaaaaaguaaacauacggcaggaucgucauacucuugacugaaguuuggaaagucagauuuccagaugccgaaagcuccaucuuccccacugcgaaccccucuccuaaagaaguugucagcuggugggcacacggguauucgggacuccguuucuaugguauggaucacuguaaguaagucugccccacagcaaaccugccucucuagaccacuccagcaagcuggagggaaagauggcagaggcuauguuuggggagugaccuuucucugggaaaaaaucuucauucccauauuggaacaaacucaguucucgauaggccaugcuugucuuaacacagaauaauaaaacuguacuguaggaugugugcagccauaagucagggggcagaggagccuacugaucuguuuugguucugugucccaauuccaggcaaggacagccucuccaguguggcccaucaaaucccauguugcuguuuaguggccaaggccauuauuuguacggaaucaaagacaccuccuggauuuguccucuguguuuuccuggagggccucacaguggugggagagaguggccaggcacagauaggguuuguggcucuggagagcaagauucuugccaucuccagaccacaugacugacacucauaacuaccagcucugggcugauggucagcaucccauacaggauaggcugucuuagguaaguuuguacccugacgugccaucuugaagccuucuggccuguagccagcuagacuugccuucaauucucagagucacgacuuaggcauuuuaaccuaagcugaacuucaggcaagccuuggagugcaggcuguccacacucuuagccugcccaccagccaggugcagaagacagaaauuuccacacaaaauuuccagcgcaagggucaggccuaaggcuggagcugaccccuguagucccucugaggugggaguuagucuuacagguccugaagacucagaagcccacgcugguccggccuucccucuuccagaaugcugagaucugcuccagggugacccgaggcuggagaccccaaucagguuccaggcucccuugccucggccuccaaggccuggggcucccaaccugcaagccagccucuggcaugggcucagacccaacccagcucaccaggcuugugucauggggccucuccucuugggucugaggccuccagaaggugcucugggcugggacuucugguggggucugaggaacuagagaacugagggaagaguauggggcugaaguggcugguggagcaguugcucugcccucuaaggugccaccggguguugggggaccuggagcccuguccaucagcagaggcauggaggagccguaccaauccucagagcgcucccgggcgcugcucgugggcucaauccacaguucuccuccagggcgccagacuagggugggggcacgcuggcuggggucugguugcgggcggcggaacaggcguucggccaguacagcaguaguuaugaugaagaaggcugugagagaggccaggcccagcaugaugggaauacaagguccacaggggauuacuacccacacugcugccuccgcuguaggcucagggagccccuccgugugcccagagggcugcugaggcgucacuggcaucugggagacucaguguggacucagaacagucaggaacgucuccacugggagaaggaaaggacagcaaccagaggauaucccguuuccuggaaagagauucaacaacgguucuaacaacuugaccguggcacaggaugagacagugcuuagacugcaugucacugggacugcacaucauuggccuuuuuuuuaaacuguaacuuuacuucagaaccucagagacagauugggagucgggagugcuggaucucuuugucccucaucuugcguuccugcucccacccccaccccuacccacuguuaauucggcucuucuaauuggcuuauugagcauggguggcaaaacuagagaggagcaaagggucccagagaggucaagagcaaaccaggagaggccggagaacaagccagagcuggcugaggcuccccugcacagucgcaggccuuacuuccccuccagccccaccccccaccucugaugacagaucaaaggucugggcucucaggucuugccucagucucaagugaggagacuuggaaugagagagaaaccccuugcuggccccucccuuccauaugcaccuacucuuugagccaccuaaccgcucuccuuggagguggcccuguugugcuaucuggcuguaccaggucuguggcccggcaccuauccagcuuccccagcucugcccaaucacuggccugucugcuucccuuguugguauuuguccacaucucugccaccagucccccauuugcaguugcuuccgcaccccucaccucaccugucaccuugcuucaaucuuggauuucgccguuuucagagcccuucuucccagugcaugccgggagggugugugugcgcgcagcgaucugaaaggcccuggagggcuggccucagaagaaggcggaag

SEQ ID NO: 4103 - RNA, 5809 nt, Mus musculus
guuuuguuuuuuuauuaacuuuauuuuauauaugugaguacauugucgcugucuucagacauuccagaagaggguauccgaaucccauuacagaugguugugagccaccaugugguugcugagaauugaacucaggaccucugaagagcagccagugcucucaagcacugagccauuuccuccccccuuaccccgccauccuuuuuuuuuuuuuuugagaugggcuuugucuuuguaacaacccuggcugcucuggaacucauucuguagaccugguuguccuugaacucagagaguugccugucucugccucugagugcugggauuaaaggcaggugcccccaccaccuggcuggcugagccaucuuucagcccugugacuauuuagcuguugaacuauuuggguuucagauguugauauugagacagguucucauguagcccaggauggccucaagcuccugacccuucuguaacacuucccaaguuccaggagcaacaggcuuguguuaccagggcuggcucaugguuuauguuuuaaaaugacucaaagaaaaaauuuugaacacuuugucacaaauaaguaucugaguggacaggcaaguuaaucauucugaugugauuacucagcguugugcauauacugauaucaaugauauauauguaccucacaaaacugaauaauuaaugcauaccagugcaaaauagaauaaaaauuuguccaggcauagcugaauacuccuguacucccaacacuuagaaggcugacauuggaggagagugagucucaagacaucugggcuaaugguaagacccugccugucucaaacaaagaaaaauaaguaauccagaauaaaccuuuccuucuuaaaacaaaggaaauaauagcuggcuaugguggugcacaccuguaaucccagcacuugggagccagagggagacaggccagcaguuccaggucaguuggacaucccaggcuucaugucuuaaaauaaaaaaaugaacaaacaaacaaacaacaagaagaaaaacugcaaaacaaaagaccaaaacuagaagaagagaaagaggagaaagggggaggaggaggagaacaaacagaaauaaaacagaacaugggggugggguuaugcaaggaucucaggaaagcacaggcaaaaugagaccugaagaaaggaccauggggagaagggaccgacuagugggagagucacggacuuaggaccagagaagcaagcaagcacugggaaguuugaggaugucuuuagacauguugccuggcaacgggaggaagaauggcacugacucuccacaguggcucugugggacagaugggaugccccacccauuccaucccaacacucagaagacaacucaagccuucugacacugucuccacagcucucuuccaaccauacccuccguggcucucuaagaaacaucuguuuaccaauuuuuaaaagauuuacuuauuuuuaugcguauggguaucuugcccacauguauguauuuguaaccacaugaauaccuggugcccuugaaggucguaagaggccauuggaucuccuggaacuggagcugcagacaguugggagcugccgcuuaaggugcugggaacagagccuggaagaacagcagugcucuaaucaagaagccauuucccagcccccucaccaauguuuuucauaacugugaaauuagagacauuuauuguguaaaacacagaaaacuaaggugaaaaaucacacuuaaauuccccacguuuaggaggaccacacuaaacacgcaggauguagcuucuuacagauguauuuacagaucauuuaauuuucccgaccccacgucagccacaggcauuucugaggucauuacacauuucugaagacgaggccaggaugucacaaacacaagcuaugguuucauaacugauggaguugaaacuguuuuacaucucccuguuuucuguuugccugcuuuuucuccuccuccuccuccuucuucuauuuuugccuuuuccguaucuguuacucacugggcuuucucucucccgagcugaaggacaccuguccaccugucuguguccaccaugaucucugcuccacuuacauacuuugcauuacuagucuuuguguuaagugccuuccccugcuaucugccaaugccucauucauucauccauccauccauccauccauacauacauacauacauucauucauggggacaugcacugagugcuugcugccugccaggcaccggagucacugggaagagagauguggccaagauccgggacaagcguucagcuuccuugucuuccuucagagguagaauaccaaccacuuccuaguuuuguuccucuuguggacacuuuugucugucauuccacuuagcacccagaacaucugacccugucugggcugagguccuguugggugcuagccaccaucucuaccccauuuccuugucuuccuccaugcaccugacagccugaaacaccuuagaaguggcagugaaacaagccauugaccucucaacuuagcgauauuuucuucugagccugaaaucaggacacacaguuuggcaaaaacaaccacaacaguugcugugucccuuaagggccacuggcaacucacucgagccaucucuguuguagcuggcccacacagcgccuagugagcaguagaaauggguucaguguggcccaggugugcccagcucaguccuucccucuuccccacagacucgaggagggaacgauggcagcuugaugugguagcaacugguccaugucccuuuccauuccucauccccucccucccaccuuccccuuucccauccaggucacacacaaucgcacgcacacaucucuuucuguaggucagucuguucucaagggcagcgcccucugacucaacagcuuccucuugcacaucuccuccagcaaccaccuuuggaccacgugccugggcuggcggggucagaggcagcacaauugugaccuguccccucucuguaccucagacccuuagggacucucuggcaaccaugucccaccccuugggccugucuuucauuuaacucucucuuauuacccugcgacaagggaaagacuucagccuugggguggaagaggaaacagacaacugagccuguagagaaaagcaucaacaccagggguuugugccacccagucaccgcacuuggcugacuccucucccgaucuugcaugugugccuacuggugugugcacggugugggcguggugagagcuggugugagggagccucugagggaaggauauggcagcuuagcugaagaacgcacacuugauggcacauuuaguccccaucacauuugcauucuucugggggcugcagacacacuuaggucuucagcagacaggguacagcuccugggucccuccuuuuggaacucaccagcaccugcccugcuuucucccauggucuauauucaccaguacuguuugcagccaucaccuaaauuguccuaucuugcacacaaaccauacuucugaguggacacaguaggugcgggacuauaccaccuacaccuacaccaccagccaggaacucuccgcaucccuaacccaaggagaagugauggaucucuggcaggcucccaccagcagcuuccagccagccccaaaucagagugcucugggaaaagucacaggucacaguucacccaagagcaagcuggauguugccauccaggcucuaagcuggccccaaagcaaaugguaguugagaggcauuccugaaggggccccugcugagaaggaugugagugcaugggcuucacagcuucauccuagggaguuuucuggccuguugggaucccagaauuccaagggggauccucggggaaaauguggguccacuaagaucauccucauggugauucagcaauugguuccaaagaaagcacagaggaaggggaggugggagacagcggggcugggggguugcgggggguggggggaaggaaaugaauguauggauggauggauggacggauuugguccacaaauauucacaaaugcagagugugcggcagcuaacagcaggauccggggcuaaggagcagauuggaugaauaccuguugcucauagagauugaggugcggccucaucuuuggcuuguggaccgucagaaguugggguuuccacagcuucauccucacugcccacaagcggcucuuccucccccuucagguugggacccgacccaggcuucagcucuucuaguacuaaagagcccuggcgagacuuccgucugcugaagaacguagugagcgugggucucugcccggagccuucugucuccaguaccucagagcccuuguugcccccugccccugaugugguuguggccucuucaucaggaacccgggcuggcccagcccaggcauccaccaccccauuucguuuuccuccuccgcucagggucagggccccaguccuccgcuuuugccucuggcgccacaacagcaguagcgccacgagggccaaaaccaccaccaaggcaauaagcaugggcaccaguaacaugccacuugauucuuggcuuggugaccuggugguuaugggaucuuggguagacgucguggauguuuuucugcuggaaacugaggugccacgggccacacuggaacucuccacagaacugguugcugugguagcagggaguccaugcaucucacucgagggccccagagacccaguagcuguggugacagggggaccacuggucuuggagcuuacuguuguagccacagaggguccacuggucucguuagagcuuguugucacagugguggggggugcacugguuccuuuagagauagauguagaugcugcaguuccgucugucacaggauuggcugcagguccgucugucacaggauuggcugcagugacaggagggucacuggcuacauuugaugguucuggaagcagugcugaugucuugcuggaaacuuccugagaggcaguaggcucagguacaggggugcucaugcuggcaccagcagaagucuccaaagaagacaauucaguaguuuccaagggggucaaagaaacugggauuguggucugcccccaggggcugauggucuccuucgaguccacugucccugaccccacagaaacugaugggcuggcauucugggcuucagagguacuuggagcugugauaugugggguagaugguagcaucgucguccucugcagacugucugggcucgccaccuggacccagcaugccccaaagaggaggagaaggugcaaggccaucuccagagggacaggcaggagcaggaguugggaccugaauguagggaaguuacagaagaacgcgguuggggagggaaacuuggccagccccacuccuucugcccacuucccugccaacugccaagcccaucuugugguuuaacguuuuuuuuuuguuuuguuuuguuuuuccauucuugcuuucacuauuaucagagacaacaggggaacagauggcgccagugacucccacccuggccuuggcagcucagacuccagagcagccaugucccccuggccuucauucauuguuccagcccguggcucuggacucccuuacccccucacccuauucaucuuuucaaacuauagguacauuccuucauccucugagcauccccacccccguacccagcaagaucauacccucuuaccagauuaaugguuaaggcacagggccagggcaaguaccuccaguucuuccugaggcuuggucaggacuggggcagacu

SEQ ID NO: 4104 - RNA, 5411 nt, Mus musculus
auugccaccaauaagaaacaaagaccaguugaguuuuauugagggccagggugagagauggagcggcuacaagccuaucuaggucuucugagaccuuggguccccuauuccugguccuuagcaucaccaugugugaugacguagcagauguucuuguaguccacguugccgcccacgucuggggggaaggcugcccacauguucuugaucuguaggaagacaggaguagcucuaggaccgguucccccacugcuucccucucucccacuucccuccacucggaguccucuuccuucccgggcucuccccaacucaccuccuccugggaaaaucggucgcacugcgugguaagcagcuccuccaagcugagaaggacauucggggaggugagauuggauucaugaguacgguccccucucauuucauuccuguucccaccaaccguuccugaaacaugucuggcgcaucucccaaguacugucuagaauuucuucccuuaguuauuauaaaaaugucacccaguccuuacugcucaugcauucugucaaccugucaccccuaagcagggauuuuuggaaaagacaguagagccacuagagggagccacucacaacugcuuuuugauggugcccuucccuucuggguccaggaccuugaaggcuccagugaucacauccuccggguccgcaccugcagggacagaggacacgagucuagcgcguccccaaaggucuggaaagagcaaccagggucuuggguggagaaccuuuuacucacccuuaagcuuuuccccaaacauggucaggaagacagugaaguugaugggcccacuggcuuccuucaucauagcgucgaguuccucauucuucacauugagacggccugaauggggugagcguuagggguuggaguuggguguuggggaccagaggugugcuucucauaagcuuauauuagcucauucauuuuuuucaucugggcagauuaaggccugaagccacuggauuccccuccaacuccauagcuuucaacauuuauagauaggaguaggggccucacccauggcugcaaaggugucccgaagauccucuuugucgauaaugccaucccuguucugaucaauuacagugaacgccuguggagggguaggggugaggacagaugaaaccaggaauuggcccaaggcagaucagauucuggcccugagccagcugucccccuccacccuuugaagggaggggaaggauucuccuccucccucaacaggugcacuuucugggaaggagggguagggaggaggguggggaggaggguuggggaggcuuuccuuagccucccacucucaccuccuugaacuccuggaucugagucuggucaaacauggagaagacguuggagcucccuuccgcuccugcccuucucuuggccuucuugggugccugugaggguaaagguugaacaggggaguuacaggccaguuccuguaccucucuccugggagcagcaaaccagacuuuuguuucuguuaaggacagggucucauggagcccucagacuugcuacuuaacagaggaugaccuuggccugcucaccgugccuccgucucuaaccuugaccgugcgaguuccaggguuagcgucacgagcagcacauccuauuuuauuugguugcuugugcaugcuaggcaggcuacauccucaaccccaacccugucccuccccacccccacccugagacguggucucaugauuuagcccuggggccuauucuauagacccagucuuccuuuccuugaacccaggagaucugccugcuucuuccugcugagaauaaagauauucaucaccacacccagauucuccuccucuuuucuuuuuguuuuucuuuuuuagacuggucucacugcauaacucaggcuggccuugaacuccuggacuccuggauuccuaccucuucaggcuuuaaagcaguugaaauuacaggcauacccauuaugccugaucagauucagauucggaguucuuugaguccauuuuuauagaauaacucuucuuuuucuuggcaccucuuggcuaaggggccucauuuuggcugugugucuuaauucccaacuauagcucccagaucacuucauccugacugacaagugcccuucucagaauccucugccugccaacuuggcguccauacuugcuagcuuaaucuacucacuggcccuaucugaaccucuaguucccacuuacaaaaugcaagcaggaucaucucauucgucugaggacuuuaggaaaugauagaaagggguggaacagacuuugaacaggucuaccccuaccccuagacaucaugguuagauaucugagcauauuauccuugacugaaccuuucagcccaucacucuccucuggccccauucuggugcuaagagagaggguucauauuuugccuguaguuggaaugagaagcagcacccuuuuuuuuuuuuugaaggguagggcuauccugagcuaaugcuagguugggaggaaucuucacucaccaugucuuagaucuccugggggcaaggcaguagcuccagauggaaaaaggaagagaaucugcuuggagcaguucuucugggguuauauaguccugccccggcagcccuuaacauaccgugguaaccuuagcccuguggauacccaccccagauacuaaaauagcccagcucaggggccucuccuuucuuggaggccugcagcagcuggagcccaggaagggagggggaggaggccuugggaugcaagucucguuaggaccuagguaggaagggauguucuuucucccaaagggggacugcagugugccaggauucagaggggcucagggaagcccacaguucuggaagagaugaacuagacuuuugagccccugaguggggugggcacagaucuaaacucaguaagcauuuugugccaauagacaguaugcuugguuuuguggguucacuuuagcaagcaagcaggcaaguaagcaaaugacaacagcaaaacucagcaggaagcuaaggaagugagugaggugaggaccagugagcagaccgcagggcacaugggcaaaggccagcacagugaaagucagcuguuaggauugccagaaucaggauggggcuugauguuaagguuggugaccaaaugcugugggguuugcaacaacaagcagagacaucaucggugcacuugaaaagaaaggauugaagcaagagagguuuaggcuuuuuuuuuuuuuuuuuuuugguuuuuuugagacaggguuucucuauauaguccuggcuguccuggaacucacucuguacaccaggcuggccuugaacucagaaauccaccugccucugccucccaagugcugggauuaaaggcgugcgccaccacgcccugcaagguuuaggcuucuugcuggaccucagagaaaacacagaggccccagccauccucucccagguagcauaaccaguaucuuuuccuuucugggaaaaugcuagcuuggcugauguugugacuuucauaauguucugggccucaguggcccauacugauccaugcagugggaaucuagggaaaccgcaguauaggaaccccaggcuggcaaugguacgcaucuccuccugcucccuuuaggaccugauguccugaggaauguguucccucccuugcccuccuccaguccaugccaaugccacuaagacauuuucuuuucugggcacuggggcccagccaccuguugucucuaagaagagagaaggagccacccuaaacuuagcagcugcccuuggccuucgcacagccccucccggcuuuaguuggcagcuguuuugccuuauauggguaccacauauggguaccacggagggggcuacgucaugcaggagcccacucauuagugcauucugggaggugagaaagacuccaaaaagggaaugggauuuguggacuucucaguaaacuugaaucaaaggggaagauggagaaguuaugaaaagaagaucugacagguccucaccggguccgggucagagcuggaagcgggaaaguaagcugacaagacuaaggagcuucaaaagacagaaagggauagggacauugagagcuaggucucacuaggauuuugagaguggccuuauggauuugguaguccacucauccuggggcucaagagaaugagaacagaggaagcaguguuuagaagugggaagguuccugguucagcgguggccuuuagucucagaacucaggagacagaggcaggcggaucucugaguuugaggccagcauggucuucagagugaguuccaggacagacgugcagggccacacagagacacugucuugaaaauaaauaaauaaauaaauaaauaaaaaacaaaacaaaaaaagaagaaucuggaagguuagaacucauaacgucaggucuuguaguuaguagcuaaugaguacuaagagaaguggauaacaauacggcuugguucuugaauccuucaaagaggaggguucaugguauugaggauucauggauuuggguucugagaugggaccuccacccacaagccgggagagugaaguagugcucagaggauauggguuucagaaauugcaguguuugcggcggcgggguggagguggggggggggggagaagcugaguuuguacaugagaacuuagagaaaccuggucugaguuccugccugaaauagggaauugagagaugagucuuucagaggacugacuauagucuaacuagacacaucgagguagagaguacugaugagggcacuggguuuguggugcagcucaggaguugaaugaacaggggcucuuuuggaaacccaagaaggccagcgcggcacucuuauuggcuaggagccgcaccgaugcuccaggcucuucucagugauguccccaguugucaccuccucucgcgcuugucucugguugucacugacuauucuugcucuggcaccgccugcuggcagcaucccuggcccuagaagcagagaauguuaucuauuucuacucuuaugcaaaguggagaaggacagucauuggcuaacaaguuaaucacaaguuaagcccgccucucccugguugucauuccuuccugaucaucucaggaagucuaagaauuuuucggcucuuucuauugacugcugaugcugucaucacaggaauagacgugaccgucagucaauuugacugccuagccccccuuuuuaauuugguucccuuuucaccauuuccauuggcuaacaaguuccuagucccugccucuuacugcccaacaccagccucauuccccgcccuucugcggucacucacucucuucaguuguguuuauuggccuggaugcucaggaucucucuuuucuauugcuuguuuucu

SEQ ID NO: 4105 - RNA, 639 nt, Mus musculus
acugggugacauuuuuauaauaacuaagggaagaaauucuagacaguacuugggagaugcgccagacauguuucaggaacgguuggugggaacaggaaugaaaugagaggggaccguacucaugaauccaaucucaccuccccgaauguccuucucagcuuggaggagcugcuuaccacgcagugcgaccgauuuucccaggaggaggugaguuggggagagcccgggaaggaagaggacuccgaguggagggaagugggagagagggaagcagugggggaaccgguccuagagcuacuccugucuuccuacagaucaagaacaugugggcagccuuccccccagacgugggcggcaacguggacuacaagaacaucugcuacgucaucacacauggugaugcuaaggaccaggaauaggggacccaaggucucagaagaccuagauaggcuuguagccgcuccaucucucacccuggcccucaauaaaacucaacuggucuuuguuucuuauugguggcaauuucaguguguucaugcgcaaacucaggugggaggcugaaacaacggcccagacagacaggaguggcuaacaguggaaugacuaguggccaggaggcccccagcgggcagcuccauu

SEQ ID NO: 4106 - RNA, 639 nt, Mus musculus
aauggagcugcccgcugggggccuccuggccacuagucauuccacuguuagccacuccugucugucugggccguuguuucagccucccaccugaguuugcgcaugaacacacugaaauugccaccaauaagaaacaaagaccaguugaguuuuauugagggccagggugagagauggagcggcuacaagccuaucuaggucuucugagaccuuggguccccuauuccugguccuuagcaucaccaugugugaugacguagcagauguucuuguaguccacguugccgcccacgucuggggggaaggcugcccacauguucuugaucuguaggaagacaggaguagcucuaggaccgguucccccacugcuucccucucucccacuucccuccacucggaguccucuuccuucccgggcucuccccaacucaccuccuccugggaaaaucggucgcacugcgugguaagcagcuccuccaagcugagaaggacauucggggaggugagauuggauucaugaguacgguccccucucauuucauuccuguucccaccaaccguuccugaaacaugucuggcgcaucucccaaguacugucuagaauuucuucccuuaguuauuauaaaaaugucacccagu

SEQ ID NO: 4107 - RNA, 10821 nt, Mus musculus
guuuauugccccauuugguuccguaccuaauguuccccuucccacccaccucacuuacaggcaucgugaggugaggauagaauacuuuauucacucagaagggccaagggaauguagucggggacgaggcaugguucuagggaccccgguauggcauucccuaucucccagucccagagcaccccgacccaggugcaggcauggaaggaacaauucaggugccagucccaagugccccucgcugccccgccguggcucagcugcccucgcacuccgggcagcgcucggugggcguggcggcuguggcacuggcggguagcuugaagucucggccgcagcccgcgcagauguagaggcggcgccgcaugugcgcgcgacgguggcggaugaagugugagcugaggcggaagcgccggccgcacuccgugcacggguagggccgcucgcccguaugcgugcgcgcaugcuccgccagguuggaacgguggccgaagcgccggccgcacacggcgcagcggugcggcuucucgcccgugugcacgcgccggugcuuggccagcgccgagcucugagcgaagcgcgugccgcagucggcgcaugcguacgggcgcucgcccgugugcgugcgucgguggcgcgccaggcacgaacuuccgccgaaggcucguccgcaguccgggcacgcguaaggcuucucgcccgugugcacgcgcagaugcugcgcguaauuggagcucugcgcaaagcgccgcccacagugugcgcaugcguacggcuucucuccggugugacgccgccggugcugccgcagguucgaggcggcggagaagcgcuugucgcauuccgggcauugguagggucgcucgcccguaugcgugcggccgugcuuggucagcgccgacuucugcgagaagcaccggccgcauuccgugcacgcaaagggacgcucgcccgugugcgugcgcgcauguuuggcuaguguggagcggcgcgcaaaggcgcggccgcaguccgggcacgcgugggggcgcgccgggucggccgauggcgcuggcaucuggcuggcaaccugcagggaaagggagaacaggucaacccuaaggccccagcggaaaccucggucucucgaacacugcacacucuuugcgccucaauuccuuaaaugacuuaauacaucacaacaccaggugacauuauaguuaccuguguucacaaaauuuauugggcacgaucuagguuauagaguuaagagacacuggggauuuggcauuagauaaaaagugccaggugucugacauuguagagaugagacaggaagaucaagagguccaggccaagcuggcacacgccuuaaaucccucccagcacuugggaggcagaggccgguugaauuucugaguucgaggccagccuggucuacagagugaguuccaggacagccagggcugcacugagaaacccugucuucaaaaaccaaaacaaaacaaaaacaaaaaaccaaaaaaaaacauaaggagccccuguuucgaaacccgagugcugguaauguagcagugacagcuugccuccuaauuuccucagaccugugaggacugaauccggggaggagucccaccuacaagagcaauggguuaauugcuggagugcugcagacacacauaaggcugggaagacccuugguuguaauaguuaucaggaggaaggaaacacgaggguuucuuauuuaaggaccuguaguguaaaugagauggagaaucacugagggauuucugagaauuuugaucaggaaagugacggucacacucuuugggaacccgaaugaaggagaagacagaaccaggagccucgugaggaggcuacugcacucaucugacuuggccuaagcccaggaagcaaguagaaaguagagccagugagauguugguuucucucuccacuuuacagguugagauaagagauggcaacaaacuggcuuugagguauggagauucaaaaugacuauggguuaguccugcuugcuucuucugccucuccuccucggauuaaaggugugggacaccaugccuggguccaaguaacuaagauguuuaaguucagaacugcacagaugaggguugccauguacagaggggaaccagguaagaagaaagaucuggggcuggagagauggcugagguuaagagcacugcccuuccagagguccugaguucaauucuaagcagccacauggugguucauaccaucuauaaugacaucugcugcccucuucuggccugcaggccuacaugcaggcaaauaaaaaaaucaugcaugcaugauaaaaaaaucuuuuuugaggagaaggaggaggaagaggaugggggaagaggagaugaucugcuguuuggggcuguauggaacgcaggaaggagccagggcuggcgaugagagguuuuugguguauaaaugucuagagacugaagagaucucacagggaauugcagaaggaaacuggagcagccauuuggcaaauauaagcagaagccaggacagggacagcuuggccaggaucagacccuucaaaguuuucaagcaagcacuuucuuaagcuaugaagagaaagccaaauguugcucugagaccugagguucugaagcuuggaaugagucaguuuggacuucuagaaguaaacuaaggagaaggaaagcaugcuguguaagaagcaggugaaggggcaggugaauuucugaguucgaggucagccuggucuacacagugaguuccaggacagccagggcuacacagagaaacccugucuugaaaaacaaacaaacaacaacaacaacaaaauuaguuccaggcuggugagauggcucagugguuaacagcucugacugcucuuccaaaggucugaguucaaauccuagcaaccacaugguggcucacaaccauccaaagugagaucugacgcccucuucggguguuucugaagacugcuacaguauauuuagauauaauaaauaaaccuuaaaaaaaaaaaaaacuuuaauucauucugggcuuagugguucaaaccuucaauccuagcacuugggaggcagaggcagaaggaucucugugaguucaaggccaaccugguuuacauagcaaauuucaggacagucgggauaacaaagacccugucuuuaaaaauaaacacacacaaaccauuaauucaugacgaaagacucaccugccacacaggacaagacacaggcugccuuguauucagcccaccacccuccuuuuacagaggagacaacaacauaaaaaaaccuaagugacaaagagcaggaccuucccuuucagaagcugugguggagcacccugaaggccaucgcccucugucaugagaaacuggcucuggggccagguaggugguacaugacuuuaauuucugcacucagcagacagagggaggcacagcucuuguggauuuaagaacaaccuugucuacauagaauuccaggccagccaggguugcacagugagacacuaucucaaaacaaacaaaaaaaauaauaauaaaucaaagaaaguagcuuugaacuacaagauaugacaguuuuggaaauuagcaaucagccaaaagaacucugguuuuaauaauaacaauagucuucccuuaacuguggcuugauuuuccuguuucagcugcuagcugucauagucuaaaaauauugaauggaaaauuccagaaauaaacaccuuuuaaguuuaaaacaacuuuuauuauagcauauuguuaucguucuauuuuauuauuguuaaacucuuauugugccuaauuuagaauuaaauuauauuauagguauauaccuaaaggaaaaaacacaggcuggguaugaccgcaaaccuauaauaccagcacucaggaggaucacaaggucucagccagcuuggagaauauagcaagaaccugucucagcaauaaccuaguuaaaaugugugugcgcaugacugaauccacucaagguuuuaggcaccggugacagggugugucugucuugaaauguccccugugaaaggagcuucuguaaggaagacccucacuucaggcuuugaugguacugcuuuacguaugcuaucacaguaaaucuuccugacaccccucagucaggugggacaguauuuuauuuuauuuauuuauuuauuuucguuuuucgagacaggguuccucuguuuagcccuggcugcccuggaacucacuuuguagaccagacuggccucaaacucagaaauccaccugccucugccucccgagugcugggauuaaaggcgugcaccaccacugcccggcugggacaguauuuuaauguguagcucagguuaacuuauacauauagacgaucuagccucugccuccugacuguuugauuacaaguguguuccacuacgcaggguuauuuuguuuuugcuuuuuuuuuugguuuuguuuuuagagaguuucuugccuugccauauagcccaggcuuacuuccaccugcugagcagagaucacaggguuaucuagacagcagagaacaccaaggcuuagagagacugagcugacagagcaugggagggugccacucgcccugaccucacagcagggccggacagaagccguucucuaagucucuaucuuucuccaagaaagccuccauguuaaaguagaugcuguggggaaguccagugugaaguaguucgaggccacacuuucucccuugcccuggcugugacacugcaaccuuuccccagcgcccuucucuaaguugucacugcccagccuggggacggccucacgcuggcuuuucugaagcaugagaaagaaacccuucccacuaaucauccucauugucuccagcccaggaggagcggccugggcaccuggagaagaaucgugguaauggucugagucuagcuccuccagacauggauaaggcugggguaguaaccagcauccuagcaucacuguguagcccagacugggacuuacaauggccucaaacucagagauccaccuaccuaugccucccaagcucugggagugcgccaccacugccuggcaaugaaacacaucuuaagauuuuuuaaaucuucaucuuaugcugguaauacagcucagugguacccaauaugcacaagacccuaaguucaaucuccagcauugcagaaauuaaaacuuucacuguauccaguucccaaugaucugccugcauguguaacauaaguccaaacacucccucacacuggcuucucugacuuacggugggcagugagagcauacuccuucaagucuagcaaucaaucuagaaguugaagcaggaggaccacaaaguucagagucaccacacguaaggaggagauaucccaucucaguaaguaggaaguguaaagcgaagccaucuagucugcaggugagaagagccacaccagagagggcgggugcacagcagacaaaguuugugggcugaaccacaguugcguucagggucaggugugucugaagcugggcaugaggugccaggcugggcaugaggugggugccaggcugggcaugaggugggugccaggcuggugccaggcuggacaugaggugggugccaggcuggugccaggcugggcaugaggugggugccaggcuggugccaggcugggcaugaggugggugccaggcuggugccaggcugggcaugaggugggugccaggcuggugccaggcugggcaugaggugggugccaggcuggugccaggcugggcaugaggugggugccaggcuggugccaggcugggcaugaggugggugccaggcugggcaugaggugggugccaggcugggcaugaggugggugccaggcuggugccaggcugggcaugaggugggugccaggcuggugccaggcugggcaugaggugggugccaggcuggugccaggcugggcaugaggugggugccaggcuggugagggcacuuguugcuaaguuugaugacuugagucuaauuccuaagacccacccugguagaaggaaagaacuaccuuuuguaaaguuguacucuggcucucauaggugccaugguaaccccauacugugguacccacuguaccugauacucaaagucacacagauaaauauaauugaaaauucagacaggucagaguuugacaggcagacaaagacuacuccaaacucugaguguagcaucauugaagccuauguuucuccaguccugugaaccacacaguaaggccagcuuuaccccugagcuacauccacagccccuugacaccaauucuuaacaaagaacagccacuguugacagguaacaaccccaguccacugguacuggaugccacaucccagagacgcauuugcuauguaaaccaugcuggccuagaacuugcaguccuacccuggccucccuagaacugggauggauuacaggcaugcaccacaaugauggcuggaaggcacuuuugagagaauuaacauguacaugaacaaaagaggcuaaaggaggccacauagcaauccuugugcuauuuuguuagcagagggucaacuguggcugucuccaaccuccagcugguucgcccuccuaauccacuuacucagauuccagauugaaguuuugaucugucuguuugaaacagggacucucuaugaagucuuggcuguccuaggacucaauauguagaccaggcuggccuugaacucacagagaucauccugucucugccuccugaaugcugacauuaaaggugugcaccaccaugcccagcacacucagugaucuuauuacugaagcugaggcaaaguugguaaaugauagagcuaggauuugcuugcuaccugacacuauauagucuggcccaagggaacuuugaugacuuucacaauaaaccuucucuuaauccuugguuucggcuguuucagaggggguauccaaacacccuuuucucuuacugcugcuacuacuucaaagcaggccauuaaccuuagcagcugauguuguuggguuuuuuuuuauuuugguugguuagggguuuuuguuguuauuuuugagauaggguuucauguagccuaagcuguccucaaacccacuacauuacugagguuaaguuggaacuuuaaaaaaaaaaaaucauguguaugaauguuuugucuacaugcuuggugucccuggaggccagaagacggcacuggaucucagaacuggaguuacggguauugugagcaauccugugggcgcuaggacuugaaccuggguccucuggaagagcagcaaguacucuuaacuccggagccaucucucuggucccaacucuaaccuucugauuuucuuuccucuaccucccuagcacugagaccacaguacaugccaccaggccugauuauguggcgcuggguaucaggacuuuucugcaugcuagacaagaacucuauggacugacacauccuggccucccugcuggggauucuuguaaacagaaaaucuaaucauuuuuaucaguuggccuaagacuuccuaugucacaagauggaacacaguaugcccaaacugcuacccuguccugcuuagcagccuuucucaggcuggccuuaaugaaaccuucuagugcugccuucugugagccuuugcuccugcccuuccucaccucaacuugccaccucuccuccccacacaagccgucaagguccacacucaauaucuuucccgaacucuuucccacugccuagguaguuugccuucacucuauccaauuccugaaaucagccuaaaaaaacauucgauaagaaugagcggagaggucagcaaguuggaucagcagguagaagggcuuaucauguagcccugaagaaccaaguucugucccuagaacccuuaguggaaggaaagaagugacucucagaaguugucuucuaaccuccaccugagugccuacacacacacacacgugcacacacgugcacacacgcucacgaacacaacaaauaaacauaaugguuggagccagcuauaguagcacacaccuuuaaucccacccaggaggcagaggcaaguggccaucuuggccuauaaggcaaguuauaggcugcccagggcuauacagagaaacccugucuugaaaaacaaacaaacaaacaaggacaaaaaccagguaggugugccuuguaccccuuguaccccuuggugcuguaguaagaggccaggggaagaucaguuggacuuguaggccaccagccuaguuccagauccagugagagacccccgucaagggaaucagguggacaguaauggagcagguaccugcuguaccugcccagcuccggcacaagcacaggacacacauucacauacaccgcucaccuacacacacagagaaaaaaacggaacuacuuacacacugcuuaugugcaagacauagcucuaacucacauauucacucaguccuuacaucuccaggagguaagugcugcuaugcucucccuguacaaaugaggaaacugaggcacagagaagguagaaagccaaguagcuuugcucaggccugaaaucccacucaauuaauaggaaugccaaggucaaaggacugccugccuggacuacagaauaaauucuaggcccaccugggcaacuugguugagacucuaccucaauagaaaagggcuuggcuacaguacagagacggguaaagccuuggcucaauucuuaguacugcaagaaaaacuaacaaggccgagaaacuugucagcugguagggaggugaugagaauggaaguccaucuuaaucucuggagccuuagguccuuaguguucaaaccaaaguguaugcgaggucucaaagucaggcugagugaagaugauagccaagaaggcuggaaagaaccggacuucacaguuagcaguggaagaggccuagagagcagguguccuuucccagcaacucaucagguccgcuaggggaacgagcauuuauccccaaggcagccagagcccuccagcugaacucaagucuacugagaaagggacagcccagggucccuggcagcucugggaaguaaaauaauuggugaauaguuagggucucaaauggcagacucuaacucauucugauguccuaaaaaccuccaggagaaaacccagauccccagcaugcucugccaaccaaccugccuggagcugugcuggaguaugagggaacuacugucccauagcucccuacagacagagccacucuuccagucugggguagucacuuaggucgguugccaacugucuuagacucaguuccucaccuagaaaauggagucaguacuagcaacaaaccagacuggaggugcuuagaauagcaucuggcacaccauaaacuaugcgagagguagcuguuguuacugcggccuggccucaucuucccucaccucuggccuuugcuaacuccuauaucuggacucaggauacaggauugugaguuuacagacaucaggcugcguggagacugaagccacucagcacggugccucaagcagcacccagcauggcaucuggcucucacagugggccaaacgucuauccaauggggcguggggggcagugagcacaaggaugggccaauucugaguuucuagaucugagauccaggaaaaggcgggggcaggauuuuugacuucugucugagggacguugaaccuggcacagguucgagggugggggugggaucgggacggaacacguaccuccuuguuguccacagggaucuugaguuucaccaccucauacuucuccucacccuccuccuccucacccuucaccagcagcaccaucuccuccugcaucucuuccuccuccuccuccucugccugcuguucgccaggcaucuugguguccugaggcggggcgcuggaucagaggcucaggacccgccccccacccccacccccacccccacuguggccccggcccagacaaggcggugcagccguggcuucccccgcccugcccaggcuccgaguccaguccuuucccauccacccuaacccaaccccacgcuccgacacugcccagggcccagcucagaagacacccguucaccccacucaucccgacauucagggcccugaacaguucgaaucuccagcucccgcgaguugccacccuccucgcgcugagucacuccccagagccugggucggcgaccugagcgcuaagggaugagccggaggcccgcuggagcugaggccccgggguggagugcgcacucaccagcccgagguucggugcucgugcggccccgggccugggcgaggggcgguugggugcucugcgaaggccgcggcuccggaggcgggggcggggcggggccccaggggcggacauucauugguucgcccgucuggccccgccccuaggggagaggcuggaggccugagcuucugucccuaaccgccccgggagggguagccgggacucagagguguccgcggcccggaaacuccuaaccaacagaccaugccuagcccggccuucaaggcccugcagccgaguuccaaccacccucagccgggcuccgccgcugcuggaucuugacgccccaccgagauugcugugcccgcguaggccacgugcgcucccgggggucugggccucucgcuggcgccccgccuggagagcgggcccuguugccuccucucuucuuuccccuccuuuuuccuucuucguucuuucucgcgucgccuucccauccccugaucugccagacagcuuacuguuugcccgcaugcggcccagauccaccaccgcccaaucugucgcuuucauc

SEQ ID NO: 4108 - RNA, 2195 nt, Mus musculus
guuuuccaacaaagucccuuuuauuuaguuacuguaagaaauucucuuuauuaauuaaaucuccagaaguuucaguguaagauucaauggccaccgacaccuggcucugagguuuguucagccucucccaguccuuacugggaguuagagggagagacaucauuaucagagaccaagucagguggcuagucuuccuuuccugucggacaagcugcucaacucuuguccagaacaggaaaagaggcaguuucucagaaaaaaauuaauaacaaauuugacaauaaaucaguaagaguucuccuaacaauuuagauuuaucaauauauugguccaaauaauuuuucauguugcagguuuacuuuucucauauguaaucuuaauaaucuuuacucccugugcagaaaugaaucaacucagugcaaaaaaaaaaaaaaaaaaaaaucccuaaaacugaaauagccuccucuugcuuugggaaacggguuuuugcuccucaugcucucaacagaugaacacacauccgcagcgccauuacucacaggccuggaugcacauacaggaagcuuuggaugggccuggaggaaccaugcaagcagccuuuggaaaggucuuaaaaucaacccuggccagcagucccugagcggguagaauggcuccgaguucccaacaaccgcuauuccauuucaagaacuaggcucagaggcugcguuggaauuaucaggagcagcagcagcagcagcagaggcuccccgagguagaacuucaauaacgcgaggcuugucaaugauccgggcuguccgguuucccuucuccacgaugccaacgauccaagcuuggugacccucuccguacuuggaagauuugauuuccgaacaaaagcgggccgccugcucucuuggcagacaaaucaguaaucccccagagguuucagcugacguuccuuggaggaggccaaagcgcccacuggcuuugcugaucgcagccaucuuggcaauuauuggcagauuauguaugacaaaggacacuucauuuuuuugcuguuuugccagguucugagaguguccuaauaugccaaagccugugauauccguggcugcgugggcauuaaaagugugcaucaagccagcagcaguccuguuuagaguagccauauugaacauagcuuccugauaggcuaacucuacuuccucucuggaaaccaccaucuugauuuuauuccauuucucaggauuauccagccauuggugggcauuggcagcaaccuggguuccuaaagguuugguuaauaccagcacaucuccuaccacggcacuaucaggcauuaugaauucauuuugcugacacaccaccguggcaacgccaccgaugauaauccacggguugaccacugucuguccaccggucacugcagugccucccuccuccgcagcgucacgaaagccuuugaucaugagcggugucaccuucucucguuccuuuucacucaugcucuggcucacacugaguaacaucaacauguugucacacucagugauacccauggcauagaggucacugagcacauuggcacaagcuaugcgccccaucauauagggaucuuccaccaagggguaaaagaagucgguggucugcaccagcgacaggccuccgugccucagggggaugacgcaggaguccaugccaaugcucagcgaggggaaggcugagccggggccgggccugguggacaggcccccuuccugcaccgucucuuccuggcccccgaccagacccgagguaagcgggggcugcagcgcgggccgcgucagucccuccaggaguuugagcagggucuccugggggaccuugcagccucagcccuucaugccggagaagcucgucagccgccagcucgggcugaagcccagugucuggggcucgaacggccgguaguuggagaaacuccggccggcagaccagcccgccgggcccaaggaaccuucugcggccacuagcgccgccaugguuucuccgcuggcgcccgccgccgccgcuuccgccaucgcgccgcucgcccgggaggccgugcggaccagaaggcccagauaccugcagaugagucucccagccacagcgggccaagguuacgccaggagaugaucaaccacgcgagccggaccggaggacucgagccacgcugccugucggagcgccgc

SEQ ID NO: 4109 - RNA, 2809 nt, Mus musculus
caggggcgcaguagcccggccggggcuaggggccgagacuagagggucucgggcugggaguuguggcugggggacggccggaggagucgccucgccccucaccuccgaggccacgacgcgcgggggccggugagggccacgagacaaucggggaccuugggaggggggcggggcagcggacaggggcggggccggagaggcccagggucaagacguccggccuucgcggccgaagccaggccgcccggucuccucggaggcucugaacgcgcggguggcgagggcucggggcuccaggcacucgaacugggucguaggaucguccgccaucgccaccgccgccgcacugggaacuggcagggauggagcgggaggcgucgucguggggccuggagucccgggaugugcacagucccaacgcagugggcagccccgaagggucucucaaaggugagggaaggaccgcgccucuuaggagugugccagaaaacugggcuguggccugcgggagggaaauaaggccggaaucuuaaacacuuggaagugggguggaggguggagacugagugccccgggucuuuagaggggaggugguacauuuugucaccucacuuguaggggccaaugacccugcuuggggagugggaagagaauuuugggacaauuaauggacccaaugaccuuccagacccccauucaaucuggauuuucuguaauucucagauccugcaggcaacacaagugagaaugaagaaggggaaauuucucagcgagaaggcaauggggacuaugaaguugaagaaauaccuuuugggcuugaaccccaaagcccagaguuugagccacaaagcccagaauuugaaucccagagccccagguuugagccugaaagcccaggguuugaaucccgaagcccuggguuugugcccccaagcccugaguuugcacccagaaguccugaaucagauccucagagcccggaguuugaaucccagaguccuaaguaugagccccgaagcccuggcugccaucccaggagcccuggcugugaaccugggaguccuagguaugaacccaaaagcccuggguacgguucaaagagccccgaauuugaaucucaaaguccaggguaugaaucucagagccccggguaugaaccgcagaacucuggagauggcguucagaauucugaguucaaaacccauagcccugaguuugaaacucaaaguuccaaauuccaggaaggugcagagaugccucugagccccgaggaaaagaaucccuugagcaucucccuaggaguccacccccuggauuccuuuacucaaggguuuggggagcagcccacaggagcgcugccuccauuugacaugccuucgggggcucugcuggcugcaccccaguuugagaugcuccagaauccacugaaucugacaggaacccugcgugggccaggccguagggguggccgggccaggggugggcaaggcccucgaccuaacaucuguggcaucugcgggaagagcuuuggacgaggcucgacccugauccagcaccagcgcauccauaccggcgagaagccuuacaaaugugagguuugcagcaaggccuuuucccagagcucugaccucaucaaacaccagcgcacgcauacaggcgagcggcccuacaagugucccaggugcggcaaggccuucgcugauagcucuuaccuacuccgccaccagcguacccacucuggccagaagcccuacaaauguccacacugugggaaggccuuuggcgacagcuccuaccuccugcgacaccagcgcacccacagccacgagaggcccuacagcugccccgaguguggcaagugcuauagccagaacucgucccugcgcagucaccaaagggugcacacugggcaacggccuuucagcuguggcaucuguggcaaaagcuucucccaacggucagcacuuaucccccacgcccgcagccacgcccgugaaaagcccuucaagugcccagagugcggcaagcgcuucggccagagcucaguucuggccauccaugcccgcacccaccugccaggccgcacguacagcugccccgauuguggcaagaccuucaaccgcuccucuacacucauucagcaccagcguucccacacaggcgagaggccguaccgcugcgcuguguguggcaagggcuucugucgcuccuccacgcugcuacagcaccaucgcgugcauaguggggagcgaccuuauaagugugaugacuguggaaaggccuucucgcagagcuccgaccucauccgccaccagcggacccacgcagccggccgccguuaaccagucacggguggggagguggugugcagaagagauggggucaaggaauuuauggauagaggaaaagcugguggagaauagaaggacgaaauauucuagaagaugggucagggugcaggaagucacaugcccucaagaaguaugagaguugggcuauggagggguuggagggaggccagacaggcaccaggagcaagucugccucagcagcagugagcucuuuaucugggaggcccuguucuggcaaaguacuagauggggaggggggagggcaagggagugucaguuagaguaggguagcuuagauugguagcugcugagacccuugugaaaccaggaagagggcaaaggguaggcaguggggagugaggcccaaggguagggucuggaucucagaguaaacugccuugucuuccucagguuuuggagcccugugaguucaauaaaccuuuuaugugguaagagau

SEQ ID NO: 4110 - RNA, 7046 nt, Mus musculus
aguaggcaagaagccaucucgcagcgccauuacacuuuagggcaaggagguuaagaagucggcauggcguucgggucaauaaaaucgauagcuggaaccugccuguguucuaggcagcgguggugcaggagcagcgccgccaucuuccccgaaggcaucuuccggugccucucacccaaguuccagcgggaguucccugaauaacggucugugucgggccgcccggccccucaggcagccgauucagauuuccuccgggccuucccgacggagcuucuaggucuccggguccccguggcaaggccggggagcagguccgauggcgccaccuucggcuccgcuucuccugcgggcagucggagaggcuggaccuacucggaaaaggggcaggaggccaagggccuugaaguucguggacguggccguguacuucuccucggaggagugggggugucugcagcccgcucagaggacucuguaccgggaugugaugcgcgagaccuacggccuccugggcgcgcucggugaggcccggcccaaucugcuuacgcggggccuaagggaugauggagcuugagggcgggguagagugggggcagggagccuaggguccugaccugcgaucggcuuguuagggguuggcguuuauuuuuuagcauccuuucuucgggccagcucucugacugguucuccuuccccaggaugcgcaggucccaaaccagcucucaucuccugguuggaacgaaauaccgaugacugggaaccagcagcccuagauccgcaggaguaccggagauggguaacauuccagagaagugagugaaaaauacccacgaaaaccauacugccuuccugaguaaugcccuaaacugucgacccaaucuaaauuugucgucugaugagaguuaaccagguugcuuguacugugggcauacgaacuacaaacgguacuucauugacauaagugaauuacugagcuuugaaaaagauaacuacugcuuuccaggauccgggacuuagcuuccauugaacuucuccaauucccaucgguccugggaagacuagaaagaguccuuaaccacugagacaucucucucuagccccugguucacucuugacuuuaaaaaagaaaaagccccauugauuggaauguucaucuaggcuugugaacuacuggaugaaauacaguccaagguuuuuuuguuuuuuuuuuuuacaacucucucaaagugcuccuagaccaacagcugcauauuugggaguugucuuggucagagguuucuaugcugugauaaacaccaugaacaaaaguggcuuggggagaagaggguuuauuucauugauauuuucauguaaacauccaucaucaaagcagggcagggcaggaacaucaaggcaggaacugaagcagaaagccacaaggaaggcugccuccugcuugcucuccuacuuucuuacacacucaggaacaucugccuagggauagcaccacccacagugggcugggcccucccaugucaaccuuaaucaaucacuaauuaagaaaauguaccacgcugggcaugguggcacacaccuuuaaucccagcacucaggaggcagaggcagguggauuucugaguucaaggccagccuggucuacaaagugaguuccaggacagccagggcuauacagagaaacccugucucgaaaaaccaaaaaaaaaaagaaaaggauguaccacaggccaaucuggugaggacauuuuucuccguugagguucccucuucccaaaucacucuagcuuggaucagguuggcauaaaacaagucagcacaauugaccccuuguuagcaugacacacaaacccaucccuuuuaaccauaaccuuuguuuuuuguucauuccaagaucucaauucaaacacucaauucagacucuccuuaaaauaccuagucucuuucaaaguuucucuaucauauccaaaaccucucuaaaauuaacuauggguuccuauuaaaaaaaaguuacauacuuguuuauuccaagaaguaauaaccagugcacaguuacaguaaaaucaaacccaaagucuacgugugacgcucagugccagccuucugagacucugcuccucuaggcuccagagggcuuggcaguggcacucgucugacauccacugcacacacagccagcucacaaagcucuaaagcugcugugaguggucaucugugccaaugcucucuccaaaacaccggaguucuggguacaccgggagccuuucuugggaucucuuuagagacacugagccugccacguggugccaggccuuaauuuaucuccaugaccccccuucaguccugagguuuguacuuuaacugaggcugugaguuuaccaauggucugggcuuuccagucacagugccaagccucauugcucuccaugacccuuuaugccuucaaaacuagaacaucuggggacacuuacacauagucaacuucagcugccaacaggagccuuggccccuucauggaccacagcugcugugugcugauccuguggagguacucccagauuuaucauccuugcugaugcugguguuugguuuuguuuuguuuuguuuuguuuuguuuuuuguuuuuuacuugugucaauuucuuggauccagcuaauagcaucaauugccccaguuaagaaagguuucccuuuagugguuuuuaauaaacgaauaucacauaaaugguagaaucguaggcagucucaaacuucacuccagagcggcauuaucuucugaguccccacagaguaacccacagagcucugagcacccaauagccuuuccugcuccaaaguuacuaucacacccuccccaaaacagauagcaagguuuaaucacagcaauaccccacuccugguaccauugucuguguuaggguuucuauugcugugguaaacaccaugaccaaaagcagcuuggggaugagaguuuuuccuuucacuuccacauuaccaucuaucaucaaaggaagucaagggcagggccugaagcagagaccauggaggagggccgcucacuaagccugcuuucuuauauacccaaggccuccuguccagaaaaccuggugaagacauuuucuccacugagguucccucuucccagaugacuccaccuugugucgaguugaccuaaaaccaguacaggaauguuuuuaaaaaugcaaauccugggcuggagagaugacuugguuaagaccaucugcagcuuuucccgaagcucugaguuuggaucccagaguccacauugagcuaucuuguauguaggaaaggcauggggaaccggauauauuugcccugcaucauaagcuccggcaaggauggcauggagggcugcucacuggguagagugcuugccucccgcugcacagcucaggguuugcuccccagugcugcguguagauaaggguggcaccugccuguaauguuagcccuugggagguggaagcaggaggggaagaaagaaguugaaggucauccucaguuacguagugaguuagaggccagucuaggacacacgagacccugaccaaaaaaucaaacaaaaacccagaacauuggaagaaacuaaguagggacaaagguuucugugugccccugagcuacuccaccguuacaaaaaaaauucaaguuuucuauucaauuguuuguauggacaaagucucaugcaucuuaguaaagccucggaugugcugugugacacaucaaggaugagccaugagccacuauguauggugcaggauccaggcaagcacccugccaaccaagccaaaccguuagcccugaaacacucuguuuuaaagucaguugaauaucccuaaaaaaaaaaaaaccuaccuggguugcuugaagggcucuuaaugcccuccacauuuccacaacacgcuuaacugucucugauccuaauaauuaacaggagcgcagugaauugggcuugaaaccuuuaaaguugcucgugggaaagcauagaagucuagcguuugcuaauucucuguuucuugguagaaaccagauccaagcagaagacugaagagaaggacguauucccaccuaaggaagcaccccgaaaggggaaacgagggcggaagcccagcaaaccccggcugauucccaggcagacauccgggggccccaucugcccugacuguggcuguaccuuuccugaccaccucgcccuggagagccacaagugcgcccagaaucugaagaaacccuaucccugcccggauugugggcgucgcuuuuccuacccaucccuguuggucagucaccggcgggcacacuccggugagugcccuuacguuugugaccaguguggcaaacguuuuucccagaggaaaaaccugucucagcaccaggucauacacacaggcgagaagcccuaccacugcccugacuguggccgcugcuuucgcaggagccggucguuggccaaucaccggaccacgcacaccggugagaagccucaucagugcccuaguugugggcgucgcuucgccuauccaucucugcucgcuauccaccaacggacacacacaggggagaagcccuauaccugccuagagugcagccgucgcuuccgccagcgcaccgcccuggucauccaccagcgcauccauacuggagagaagccuuacccauguccugacugugagcggcguuucuccuccuccucucgccugguuagccaccggcgugugcacucuggggagcggcccuaugccugugagaacugcgaagcccgcuuuucucagcgcagcacccugcuccagcaccagcucuugcacacaggcgagaaacccuaccccugcccagacuguggacgugccuuccggaggagcggcuccuuggccauccaucgcagcacgcacacggaggagaagcugcacgccugcgaugacugcggccgccgcuuugccuaucccucacugcuggccagucaucggcgcgugcacucaggcgagcggcccuaugccugugaccuuugcuccaaacgcuuugcccaguggagccacuugucucagcaccagcuucugcacacuggggaaaagccuuuccccugccuugaguguggccggugcuuccgccagagguggucccuggcuguccacaagugcugccccaacacccccaaugguagcccuagaccucuuauaggagggcccagccagaggagcagugcucuuuagcauaacaaagaugacagaaagucacuuuauggaagggugcaaaacucaggaguagcugccagagguccuacagaaugggagcagacccagagcccuggcccgcugcuccacagcccgaacccagaacacugggugcccuacagcaugucugaaacaguuaccaggcgacaugaugccaugugauuaaaguuuuccaagcuaacuugucuuaaaauaauauggguguguucuucucccagccucuuuuaggggcugccuucuugguuuguguauacagauaauauucagucaggagacucauuuauagaaggcagaaccuccccugcucugccucuauuucuguaucauggggaaagccugaguuuggcuccauauuugcaacacuccugccaagugauaggccaucgcugaaaaggagcucucuaccucacaugcgggccguuuccuuguaggauggugcuaauuuuuaggaggcuauuuauugcauucuccuuuguaaacccagucuaggguaagcuuaauacuuuacccacaggguagcucuucagaaaaccuaaucagucuauuuugugcccagguuugugugugugugugugugugugugugugugagagagagagagagagagagacagagagagagagaaagagagagagagagagagagagagagagagagagguugaaugugugauucaccucagccuucugaguaauugguagucugggcucuggucaacuguucuuuuuuuuuuuuuuuuaaggaguauaugcauaguuuaacuauuuauuuauauuuuacggguuugaauguuuugccuacauguauaucucuacaccaugauugggccugguacccaaaggaggacagaugagagaaucagagccccuggaacugaguuacaaauguugugagccaccaugugcugggaauugaaucccagguccucuggaagagcagacaguggccuuaacuacugagccaucucuccagccccuggucauucuuggaagaguggcucuugguucccacaagugaaaucugucucuucuuagggaucauacagaaacaaaaagaguaucaugccaugugcuguauacaccaaucuuaacuacuccaggccacgcugcuuuggggugaugauuucuuuauuauguauacaugccuguucugcauggucagaaaagggcaccagaucucauuauagaggguuaugagcuaccaugugguugcuggaaauugaacucggaaccucuggaggagcagucagugcucuuaaccacggagccaucucuccaaccccaguuucagaccucuacacacccucaccuuucuucuucaagacguaguaaaaccaaaucuucaccacuuuugaaaaguugguucaggcugggugugaggcaucaacacaguacacugaaagguuuaagaggaaauggggugauugguaccaagcagcaggagguagacuucaguuugcuacgggugacuaauagcuggaaaaauggcacccaccugacuaggugcucaguaaaacuuuacuaccuucuugccuugggcagcuguaccgacgugguacaucaaauaugacuucugccaacagcugaacugggucaaccuccugcaucugcuucucuauggagcaucugcccucagcucugggugggggcagauggcaaacacugacuuguaauuaauuaccucuguuuagguguguagcaaauugauuguaaccauuugucuguuuuuucauggauaaugagugcccucugguuaggggcagugccagauaggauuucauuaaaauauuuaauggaagaau

SEQ ID NO: 4111 - RNA, 28150 nt, Mus musculus
uggaggcacaaaggagucagaaacauauauugaaaacuuuauagaaauauagagaaaaaaaauacaauugauucagagauuucuccccuaccuaaaggacggauggacaaauaguuggagcuccuagaggugacaaggguguuccuuaucugucuccuccuccaggagcaaggcaucuagcucccucagccuuucuugcaguagagaccccacauccuggcugggugccagguugggaguaaggguucugcuugcugcggugcggaccccucgugauggucgccgggaucgaggaaggcuacugucccgaaauucuacugcccuucggagcuuccuagagcugguaaaaaucagaguuccauugcgcucccgugguuccucaaagauggucucaaagguccugggucaggcagggagcaagagaucuuuaccaggauucucccugguucaaacagcccucuacugcccucagaccuuccaaguuucucaccuucugguugugggugauugguaguucuuauuuguauaaauuucuuccaaagugaacuccuucuuauucaaccuggaaacaaagagcagagggcacugaagauaugggcaaagccugaugcugaugggaauuuugguuucugggccaggugagagucagaagugauaggugaggagauucuaugcacacgccauguccaugccaaauguaaugucccagguuccuaugcucccugagaggacuaggacugucaccuacuuggucaagguagcucccugcucucugagccucuuaccugauuggucgaggcagccccauugguguaagguuugguuggagacggacagguguccuccguauucugaaucuagaaaccuuccccauggucugcaaaaaaugggcagagggugaaagaaaggcuugggcucaggccuuggcuggcuccugucuuuauacucacucauuaccuuggucucuggaucagaaaacaccuugucuuuugaggcucuuaacuccuuccccuucguugaacccaaccugcagagauggucaacagucaggacaagggcauacacagcaaugcacucgucuucugccagugaauacuaagcaagggaggcaaggcucaggcugaggccagaguuccagagggggagugagagcacuaccuggguucugccggcucgcagaagaaggaagcaggggcauuggcugagcaagauguagugagagaaggagagacucccacuccuccaagagggaagaccucuuuccggagacagggucgaggagguggugggguccgggccaucuccccacaacccacaguaugucuccggggccuggacuggcuuggcugggaugggacaggaggccagcuaccugggucagggggcccuagaucagggcaggaguagcuucgucccagagaugacuuagagacaggugcuagggaauugcacugaguccgccacuggcggauagggggccuggggcugacagauguaauuuucucaguagcccuggacugcucagccuccgagauggcaaucuucaauucuaauuucaugggaggugaaggggguggaggcugugguguuuuguuaggugugaagaagauaucagcaaagcuuucaagcuuugaucggacggaacggaagagaggggccaagccccagggacugagacggggucguaaaaggcuugacgauguuggaaucaccggggucuccagagcaggaucugcaguuggagaaaggacgcucaggugacuaaaacauuaccucagaagccucaguuucuuccuccaaacacuaaucugucucuagaggagugagccugcuccuaaaaugcuguaauaggauugccuaaugccauaagcccuggauuugauccccaguacugcaaagcaaggccauaacugcucaacuccuugagccuaaaucccauuguuacacagccugcucugccaagggagccggcuaagcuccacccacaguucugcuccuccuguuucaagcuuaaccguggcaguuccaaauucuucagucucauuccucuauuugaguccuuaccugguacuggacucucuggaggaucugcagguagaguagacaguuggaauggggguucuaggucacuggguguaggcauuggcugaccagcuuuugucacaggcucagcucucgggugaagggacaaaguaagaguugggcgugcuuccaaguccagaccccuucuguggcagugcuuccccgggcccuucaggcuucugaaggugcuguaaggaaggauuagacagguaaauccugaugcccccagcucuggauaucugcaugauagcuuugauaauccuuuccccacccucucaccuuugugcugggacaaugagguugggcugaucuucaucaaaacccuggauauaaacaggggagguauuuugaaaaggcaggaagccauuuuuggcuucuccaguuccccaugauauucacagauaucugcuugguuguacacaaaagauuuuuuucuuauuuccuuuaaguaguguccaccaaauaaaauuuuguugucauugggguaguggcacaugccuuuaucccaauacuugaaaauagauacaggcuauaaauugggauagccuagucuacacagcaaguuuuaggccaaccaagucuacauauugagaccuugucuuaaaacaaacaagcaaacaaauaaaaacuuguguuuuggccuuuacagaaauccaccucuagccccaugcuugcccuagcuggaaccagacaucuucacuguacuuucuuauaccucugcugguugucugccacuggcaaugucuuccaguaccaccacuagggugggcugugggaccuggucugucuuuuuugaggggcucuccucugggccagaugcugcccuugaucucauucucaaggcaggcgaggacuggcgggcucgagucaaggguucucugcacaaaugcagugggucaggaggccuagagaaagaacaagaaggucggcggggucagugggcucagcugucuucucagcuuaaacccuucccuuucacacuuaccuggcuugcauggaccacuugaccuguugggaugguaaagcaggugacugugugcagacaggauccugaugaugguugugagucagugggcugggaguguccucuuugugugucagggggaccuacaagaggaagggcuguaagaugcaagcaaaacuggguuuaugccuauaaucccagcauuugugaggcuaacacagaagacugcucagaguuccaggccagccuggucuaaaaggugagacgcugucucaguaagacaaaacaaaacccagagaaauagagugacuggacagggucuucugugucucacuguguccuuagccacagaggugaaagagauuuucagcuggacuccacgaaaaucccuaaaagaggugauuuggucuaaauuaggggugagauauuauuagucaggaacuacaggcgugaaaugauguaaucucuucuucuuacccagguucuagagaaauagaaaaaugguaaaagacaguaccauuuuucucaugucugccuuguggccaaagacacuaccagcaugcuuccgaacaagagaacagagaagugacaauuuuggauuuuuggguuuuuuuuuucuuucuuucuuuuuuuggguuuuuuuuuuggggggggguuguuuguuuguuuucugagacagggauucucuguguagcucuggcuguccuggaacucacucuguagaccaggcuggccucgaacucagagaucugccugccucugccucccaagugcugggauuaaaggcuugcaccaccacugcccggcuuugguuucuuuuuuaaaaagcacgaaaauaucauguuuuuguuuuacucccaggugugggauaugggacugcuuuagauuguccauagcaacuuacuaagauuugccuccagcaggggcauaauuuugccagcuacagacagguucugcaauuguaugacuuuuggaauucuggggacuuuucauguuaaggcccccaaggaauggguugguuauugauuggauguuuguuauuauucacaagaagaaaguagauauccugauggcgaagaucaaaccugccccaaggaacucgacaccccuaaucagcagaaaguagccuaccaucgccccauucccucccuugccuuuauucggagaucucuuuccucucuauucuuuuucuuucuuaacuaguguuaggggguugggaggauggaagaacccaccaaguagcaaaggauagcgauaacagggcagucagaagaguuuuucauacuuaguaggaugugguugggugagugggugacuggacaggcacaugaauuacccaaaaccauauggucuugcauuauggaggcugcuuugaaggcuggcuuaguggaacuggucugacuuuaguacuaagccagggcggggauggaggauagggaagagggaguggucuuucacuuaaagggcucacccuguuuguagucaugacaucuuccaacaccacggcaaggacccuccgagaggccuuuucuagggaugaagggguccccaaaggcugcagccucggucuuuucgggcuccuggcuucccaugaugcucgagauagaggcugacggcacaggcuuggcuguguaaaagggcuggagggugaaaguagaagacaguugccugaaccuguuguugccucuguuguagucgggugcagccgucagcauccccgucucccgagcucaagucaggcgggcgggguacgcucucaccuggaguucccaggcaaguccaugggggaagcggcgguuccggggagucccugggguaucccaggcugaggccugggguaaauuggggagcgggggaguggggaaugagggccaguuccucccccgggacuccgcccuucauaguccgccugcggcucccgguagggcacaggcccuuccuccaaagggcgcccccggccggccucucggagccgggucuucccgcugcagccgccuugaucacucgggcccugccuggcaccugccgcgagacuggauugcggagguuacagcucucccaccgcucgagccuccugggaccuuugucccuguuagaugccucccugagguucucugggauccggugggaucccggucccgagaggcuuccguuuccgcuagauuccucugugguccucgccccaccaagcaagagcuccaaaagaauuacuccacuuaguaacagcccucccuccuaccagaucgccuaaauuggaucucuguggaaagaauccuacugcgcgguucuuccaaucagaagccgcgcaacuugccuccucccacugagagcuucagcuuaacgaaguuccccuugggggaggccuaaacucaucacugaacucaguccggauucuggguuauaaacugucaaaccaaccgguagaccauucacuccaaucccagaagguccagcccaccgguaacaucccaccccaagcccccgcccuacuuggauccccgccccgcguucucgggcgccccggaccaguuggcucaaacguuuucuucuccccccgccucccggcccucucuccagcccggucccccccacucccaccccuccccuacgccucucaccgcagcuuuccaaggauccggguuucaaacagcucccaccuccggcuucuuuaaagccugccuuaugcagcgcuguccaaccgucagaggccuucuucugugugucuuaagcaccgcccaauugccgguuccggucuuccgggguuaggagaaacugcgugaaaucuccugcccgccauaauacguaggggcaaagaagcucaauugugccugcaccgccauuuuaauugagggcagucugauuuuagcacuagucgaccgaaaagcgucauuuuucaaaggcuggucagcgaccaacuacuauaucacguuucuuguuauauuuggacaaguguaggaaagcuaaaguuucuccaccuaacguaauuuuucuuguucuuaacgccggugaauaucgauuaaauguuaaggauuugggaauuucccauuuucuuagguuuaaguuccuuaggauugaaguuccggaagucgggacggcgggacggaaaaccugaagaucccaaguuaaagaguaggccugauguggccucuagcuuccaauucaguuucuggagagaccaggaacagccuaaguggggagaaggcugggugcggugagcuucauucacuagcauuucucucucuccuccccccccccccuccuuucuuccuagguagugucugcaggccacucagaaggcgacuaauauaaccaaccugggguugcuugguggagccgguucauuguccuuccuguucugggcuggcagaaguaacucuuggaagaggagccuguccucugcagggugucagguagucuuuuggaauaagagauaagcagucgauccuaaugcuggagagccugcuccaaaggaccuuuuguuaggagcuggacuacugguggggaagaaguggucauuuacuggcaucuugcacuaugaaugcgccuuuaccaccuaaccaaagcuccuaacuccccaagaauuagcuguucugugucucaguguguguguugguauguggaggucagaaaccauuguuaggugucuuccucaauugaucuuuuuguuuuuguuugguuuuggagacaggguuucucuguguagcccuggcuguccuggaacuaacucuguagaccaggcuggccucaaacucagaaauccaccugccucugccucccaagugcugggaccaaaggcaugcaccaccacugccuagcuugauugaucuuuuuaaagaaaaaaaaaauuacuuuuaaaaaaaguauguuuuucagaucuuugugagcgugaggccagccuggucuacagacuuaguuccagaauaaccaaggcuguuaaacugauaaaccaugacuggaaaaacaaaacaaaacaaaacaaaaaaaacaaacaagcaaaacaacaaauauguauguuuauugccaagugguggugggacaaaccuuuuaccccagcacucaggaaacagagacagguggaucucugaguucaaagccauccuagucuacauaguucuaggacagcauaggcuacacaaacccagucuggaaaaccagacaaagaaagagguauguuuacuuguguguuguauuaguuaggguucucuaaaggaauagaacgguuacaaugaauauacauauaugggauuuauuagaguggcuuagaggcugugguucuagcagcccaacaguggcugucuccugacugaaagggcaaggaucaaguaguuguucaguucagaagacuggcugucucggcagucccaucuggugcuagagucccagggaaguccuagagagcugcuggucuucagucuguguuggaauccugaagaaguagguucuaaugaaagaguaguaaacucagugcuccaagguaugcuaaucauaaaacagauagugacauuccuuccuccacccacccgcuuccugggcucaaagaguguucauucaaagagagucacccugacccacccugaccauuccuagaacccacuaugcaaaggugcuauugcuaggggcucuuagauuguuaggggcucuuagaaacugucuugagagauaaccugacacuugugacuuuguacuuccuugugacucuuaacuggcauuuuugguauuuuccaacaacgcccuucccaccuccuugaguugugguuccuuccuuuaaauacccccuuacucagcuacuuggggcaccacgguccucuaccccugcuugguguaugaccgugggcccaagagcgcucuugaauaaaaauccucuugcaauuugcagcaagaccguuucucguuggugauuuuggggugucgccucuccugagucagaacgugggggaguccucacguugugggucuuucacuaauaccagugaagggguggcucaggaacagggcagacgaauuccuucuuccaugcccuuuuaugugggcugccaccagaaggaauggcccagauugaggaaaggucuuauaacucaaauaauguaaccaggaaaaaaaucccucagaggguuuugguguuuuguugguuuuuuuuuguuuuuuuuuguuuuuuuguuuuuuuuugagacgugcccagcuuagguuuuaguuaguucuagauguagucaaguugauaaccaagauuagccaucccauguguccuuauguaugggggcacauguaucacugugcaugugugaagaucagaagacaauaugucuaccaugugggucucaaggauagaacucaaguugucaggcuugguggcaagcacguuugcccacugagucggcuccuucaaggugacaaaacauuagccaaugaggaacuugauucuauuuuuuagcaaagggcaaacaagaugguauugcacugguggugguaguggugcacagcuucaaccccagcaccuggggagcagaagcaggcaaaccucugaauuugaggacagccugggcuacacagagaaaacuugucucagaaaaaaaaaaaugguaugacauauuuuucuuaaauauacuuuagagcuagaaagauggauaucucagugguuagaacaccugcacuugcagaggacccauguugggucuccagcacccauaugguugcuuacaacucagucacuugagugccaggggaucuggugcuaacugcuacccucuguacuagguauucuugugcacacacacacauaagcaaaacacucagacauauaaagaaaaccauacacuuuuaagaguauacuuuuuaaauuuaaguucuuuggcaauuuuauauguauauagugcauucuggcugcugucuccccuaauccucucauaucuccucccaugcuuacugaucccuuauaccuaucgcuuucccagugacucucuaaacccuucuuucaucuaugccagauuauugaugggcccauucuuguguagaucaaauacacuuucuugagcaagacuuuccuuuguuaguagcacagauccaaacacucacuuuucaugaacauuagcugaaaaaauauagaggagaaaaauacaagcaaaacucugacaucacuguauucauagaaagaugaugucauggaggcaagcaacauucuguaaggagcauuuugccaaauccguccuguuggcauaaugaaagcuucaagggagaaaggaggugcagauguuuuugucuguuuguuuuggacagaaucucauguagcccaggcuggccccaaauuugaucuugaccuccaaauucuauccaccucucaaaugcuaggacuacaggcaugugccacuagagccugggagacagggucuggcuaugaagcuguauuagggugcucuaaaagaacagaacgaauagagcgaaucucuaugugauggcuauucuugguugucaacuugauuacuuuuguaauuaacuaaacccuaaaaugaagggauguagcagccaccaguggccauggagaaguggguaucuggaaggagagagcuggaaauggaugggaaggagggacgagagaggaaugaaaccaagacaacguuucugaucaagguccaauguuuaauucuuuucaagauuuauuuauuauauguaaguacacuguaguugucuucagacacaccagaagagggcaucagaucucauuauggaugguugugagccacaaugugguugcugggauuugaacuggggaccuucggaagagcagucuuuccucuuaaccacugagccaucucugcagcucccaauguuuaauucuuaaauuuuaauuuuaaaggugggaccccaucccccacuuugccaggauugccuaaggaagacaagcuccguugcucagcagguauuggcuucuuacaggaagcugcagauauggcaggacaauaggaagacuccacccuaggugggcuaggcaacuguggcaaacaaggucagauucggucagauucagucagcuccgggcugggggaagggcacaguccuucucuuuuuauuuauuaaaaguuagcuggacuggggcauaagauuuacuuaugcucaggaggcagaggcaggcagauuucugaguucgaugccagccuggucuacagagugaguuacaggacagccugggcuuuacagagaaacccugucucgaaaaaccaaaaaaaaaaaaaaaaaaaaaagacuuacuuaugcuccaugguccugcaugagaauuaugguggcugguaguagacucuggcuuaggucugugucuauacucucucucuuaccuguccuagaggacacaugcagcuugcuuguguuuauuuauucauuuauuuuuaaaguauuuuagucuuuuuuuaugguuuuaggguuuucuggggggucuuauuacuuuuaauauauuuuuuuaauuuuuucgagacaggguuucucuguauagcccuggcuguccuggaacucacuuuguagaccucaaacucagaaauccaccugccucugccuccccagugcugggauuaaaggggugcgccaccacgcccagcugcccagcugugcuugugcuuguguuuauuugaacaaauagggccucuuaguguuuuuggguuuguguguguguguguguguguguguguguguguguguguguguguuuucaagacaagguuucucuuuauagcccuggcuguccuggaugucacuuuguauaccggacugcccucaaacucagaaaucuaccugccucugccucccaagugcugagauuaaaggcaugcaccaccacugcccugcuccuuucaguguuuauuaugaacaaacacagucucuugacacaugcagcuguuuuagauugauaagagucauagaacaucaguggcccaucuuuaacugcuggcccucauagcacaucuuuuucccacucagaccaaagccacaauaugcacucaaugcauuucuucauagcgaugaauaacugccauggugaaugacugagcuugccaaaaaugauccuauaugaaagcaaccaaucugcuaaaaauacaaagucaaaaguuaagagcaagcugggcgugguggcacacgccuuuaauuccagcacucgggaggcagaggcagguggauuucugaguucgaggccagccuggucuacaaagugaguuccaggagagccaaggcuacacagagaaacccugucucgaaaaaccagaaaaaacaaaaaacaaaaacaaaaaaaguuaagagcaaacuggaguaaggcuggcuguggggaguguccccuagcacucaauucaguuguaaauuagcaguguucagacccaaggcuaaucccugguuugggggagguggcuuugagaaucaagggaaaacuguuacuucuuagguaauaguggaggcugugcuccaaauuagcucagcuggcugauaaagacuuuuagccgucuucauaauuggaaucauacuugcuagagacucaggaccuguguccacuugaagaaccaaucuuucaggaggcccucagggcuugucuucuuuuuuuuuuaagauuuauuauuauauguaaguacacauuguugcugucuucagacacuucagaagagggcaucagaucucuuuauggaugguagugagccaccgugugguugcugggauuugaacucaugaccaucagaagagcagucagugcucuuaaacacugagccaucucuccaaccccugggguucuucuuuuuguggaaaaaaaaaaaaaaaccaaaaacaaaaaaacaaaacaaaaaaaaaaccccacaaaacacaaacagaaccucucccccauauuaaaacggauucuggaccauuccacguauuaguuaggcggucucaccauuuaaccauggcauaugagcuggaagcgacuggaugccaguggcaaucuacugcagacuaaccuuuaccaucaguuugcaaaaaaguaagagaacaagaugugcuuuuggcgaccuuggggaguacaauucccccuuuuuuuguuuugaaaagccaauuuuucagagugugauauacacguucgacaauuccuugucccauuagguuauaaggaauuccaguuuuauguucaauaccaauuuccuuacaaaaugauauaaaguuguuaccaguauaggcuaguccauuaaucuguuuuaaggacuuuagguaaucucauagcauuaaaagcuuguaaacaaugauaaauuacauuucuagaggcuucuuccauguguagagaagcaaagagauauccugaacaaguguuaauacaaacauauauauuucaauuuuccaaauucugcauaauguguuacauccauuugccaaaugugauuggacauaggccucacggaugaacaacaccucaauguggacauggagauaacguaauacauuuagggcauuguuuuacaaucauucuugccugcuccuuagugaucuuaugucugagccuuaagguauggcuagagagaugaaauuuauuaugaucaggucuagucaaugcaacaggaucugaaacuaagaucucuccaauuagagcucugucaaugcgauuauuaccugcagcuaaagguccaggaaggccagaaugagcucguauaugaccaauauaaacgggauuuuuuuucaagcaagaaugauguuuugcaauugugaaaacagagauccugcugguguauuaaaguuuuaaacguaccacaagucuccagcaaaggaauugacugugcaacauauaaacuaucaguaaaaagauuaaaagcaucauucacagacugaaaaacauucaguauugcugucagcugugguaagugagcugagaguccaggagucucuaugacuaccuguugauuauucauaagauauccagcucgcccuuuagaggagucgucaguaaaaaaucaaaagagcauuauauaaaggcuguaagaugucauauuaggaaauaucaccucauguacauuuaaaaauuuuaucaacccaucuugaggaaaaugauuaucuauaguuccuuuaaauccuauuugagcaagcaaccaauccauucuauccugcuucagccaaguaucuugaucuacacuaaaagguugaacucugaugucugguucuuugccaaaauaagucagcgccugcuuccuuccaaguauaauuaucugggcuacugccucauaauauggcaggauauuuuuuuuuuuuuuuaagauuuauuuauuuauuuuauuuauuacauguaaguacacuguagcugucuucagacccuccagaagagggagucagaucucauuacggaugguugugagccaccaugugguugcugggauuugaacuucggaccuucggaagagcagucgggugcucuuacccacugagccaucucaccagcccauauggcaggauauuacauuuaggagauauccuugaauguauccacauaaaaggagcccuuugccacaauaauccuguaggccucugaguuguaauagccguagccgggcgugguggcgcaggccuuuagucccaacacuugggaggcagaggcaggcggaucucugaguucgaggccagccuggucuacagagugaguuucaggagagccagggcuacaaagagaaacccugucucgaaaaaccagaaaaaacaaaaaacaaaaacaaccaacaaaaaaaaggcaaguccugaggaucuuuucccgccauuaagacaucaucuguguaaugaaugauguagaucauuggccauugcugucuuacaggcugaaaggcuugugccacaaacuuuugacauaagguaggacuaugagaaaacuguccauugauaucuuuucauagguucguuaaaauuaauagaaggaacacugaaagcaaaucuuucacaauccucagggugcaaaggaauaguaaagaaacaaccuuuaaaaacacccacaauuuuauaauauccuuuaggaauagccgcuggagauggaagcccagguuguaaagcucccauagguaccaugguuucauuaaccuuucuuagaucuuguaacaaucuccauguaccagauuuuuucuggauaacaaauuuuggaguauuccauggugacugagauucucuuagaugcccugccucuaguugcucccacacuaucaaagauguggcuucuauuuuuucuuuagauaaagaccacugaucaacccacaccggaauauuauuaagccauugaauuuuaucagcaugagaugcaggcaagauaguagccauuauggaaaacaccguacgccucuaguguuagagugaggcuuaggaccuuuaaaugucuuaaugccuuguccuuccuuuccuagccccugaccaggcaaaaauccuuguccuagcaucugcuuagucacugccucauuaggacuacacauuauaagacccaucugugacaagagaucuuuuccccagaggguaauaggcaaauuugacaugacacaaggcuaaauuuguccugaauugcccuccucaccucuccagauuagaaguuuagaguuuuguuuuggguuauuagcauaaccaaucccuuggaggugagugagcauaucagauaaaguccaaguugaaggccaaucuuguccucuaauaauuguuacaucagccccaguauuaauacuucaaagcuuuuuccuucaaugauuaauuuaaggcuuaggucucuuacuaguaaaagauugaacccaauacacaucagagaaaccaaagccacucuguccucucuacucuuaacaaaucuggaagguagcagauucaagggaacuaaaauaaguugagcaauucuuugguuagaagauacaguuauaauaccaugaggggaagcagccauaauuuuaauuucucccucauaaucauuauaauaccuggauaaaucuguguccuuuuacaauaguacugcuuuguccuagaagaaaccccaaguuucugcagguuaaggaccaaaaacuccuguaggcaggguuugaacuugcauuucuggggauuacuguguggaugguagaacagagguccaauccuacacuuccugggguugcccugauaaguuaaaaaauggauuucccuggccuggcagcagcuucauggccccauaagcugggacggcaugggacagcccugaauaucuguccuagauuuacauucucuggcccagugguuacccaucuugcauggaagacaaacucccaggccguuguagccugauugcuugcucguggugccucuguuccuaguacaaucuuuuuucuuuuuucuuuuuuuuuuuuuuuuuuuggcuuuugguuuuugaagacaggguuucucugaauagcccuggcuguccuggugcucacucuguaggcuggccucaaacucagaaauccgccugccucuagcucccaauugcugugauuaaaggcgugcgccaccacugcccagcuaguucaauuauuuuuaaauugauucaaacuuccacaucuaaagcauacuuuauucccuuguuucugugaaagcauugcuugcacagugcaaagcaguggccacagccaagccuugauuauaugaaggcccaaucucugcacaaagaugaauauacccagcuaaguuugucugugcuuuguaugggugaacagugucaugauacccugcauuaguauucucauaagccaauuguguaacaaaaggaauuccugcuugagaaucuccaaaaauucuacuagcugcuuuuaguagccuauucacaaaauccugcaggaaaagguucaucaggagccugucuaauacuagcuaaaguuccacugagaucuccuuuaacugauuccaagcacagcugucagccuuugcaaccuaagcauacacuccaacaggaaacccaaucugauuagcauugcuuucauauugaccuucuaaaagcgugucagcaucccaaucuggguuuccugucugagcauucaucauagaaucuaugaugaaucuauagcaguucucuuacuagcuucaugccauucagaacuccaaaguaagaaaucuccuccugacaaaguagacuuauacagucuuccaauccagggggguuaaauuugacuccaguguccaauaaaacuuguguaaaaggagcuguagggccauacugugcaacagcuguuuuuaacucuuaucaccaugaacuccaaagucugguauuguuugacucuauuguucugcuggucaauuaucucaacuauagggaaagcuggcaugucaaauagguccugccuuuucccaagagccugacucacagcucuuucuagcagcaauugguguaucucagaaucauugcucuucccuguacuuggcacccuuuuuuuagcuccuguagcucauuagucaauuucugcaguuuaauuucaaacucuaauuuacuuaguugcauguccaucugggcagcaucuccugcaguagaggccauaaguggaggccgauccucaucauaauauuuggcggcuccuuguucugaaugagcuuccuccuuugauguuagcucaucuuuaguaucucucuaccuuucuaauuuagaguggagagggcccuuuucugagaaagcucucucuggcaggcguucuuccugagauucuucaagcccucccugggcacugucugacgccugcaaggucuccucaucaauagcaucuuucaugagcacccagaggcagagggugauauuaucugccugggugguucucagagcuucuccaauuuuuuccccaugguucucuuaucuaaaguuuucaucuugaauccacggucagcaagaauugaucugaucugaaacguuuucuaacaauuguucuucaaacccuaccccucucgccugaagcagcucuugaaggcuguagacaaaugccuguuuagaauuuuccagucccaucuuccacugucaaucccuaaguggaaucaguguuggguuggcacugccccaacuuagcccgcaucccuuugcaccuacggcaacaguuucaacaagaugaaaaguaaggggagcaccagcaucagugcuguaugucgcuuacugugcaggauaccgucuuccuccguuuucuguggagcuccaccaagacaguaucccucagaugaucucugcauauccaguccccauguucggguuccaccuguagccgccagaagcuacggagaaguggguaccuggaaggagagcuggggauggauggugucuuaguuaggguuuuacuccugugaacagacaccaugaccaaggcaagucuuauaaaaaacaacauuuagggcuggugagauggcucagugaguaagagcacucgacugcucuuccaaagguccaaaguucaaaucccagcaaccacaugguggcucacaaccacccguaaugagaucugaugcccucuucuggugcgucugaagacagcuacaguguacuuacauauaauaaauaaauaaauaaauaaauaaauaaauaaauaaaucuuuaaaaaaauuggggcuggcuuacagguucagagguucaguccauuauccucaaggugggagcauggcagcauccaggcaggcauggugcaggaggagcugagaguucuaugucuucauccaaaggcagcuaguggaagacugacuuccaaggcaacuagggugaggaucuuauacccacacccacagugacacacccauuccaaccaggucacaccuauuccaacaaggccacaccuucagauggugccacucccugguccaaggauauacaaaccaucacagaugggaaggacagaugagagaggaaugagaacaagacguuucugaucaaggccuaauguuuaauucuuuuuuuuuuuuuuuuuuuuuuuuuuuuaaagauuuauuuauuuauuauauguaaguacacugcagcuguccucagacaccccagaagagggagucagaucucauuacagaugguugugagccaccaugugguugcugggauuugaacuccggaccuuuggaagagcagucgggugcucuuacccacugagccaucucaccagccccuaauguuuaauucuuaagucugaauuuaaaggggguggggguggggaccuaucccucacuuugccagaaucucaccaagaaagcaagcucagcugcucagcaggagguggcuucuugcaggaagcugcagaugugacagcacaauagauuucaccuaggucagaagacuccacccuaggugggcuagcccacuguggcaaaacaaggucugauuuagcccacucaaggcugggggaagggccuuacagagggacauaccuaugagggauuuuuguuuaauuuuaaauugaaaggucuacuucuaauccagauauuugaaaugcaccuugaauccagaucuuuugagcuugggccaugccuucugcaggaagccuauauaaggacacagaagaaauugucuuucuuugccuguuuguuccagccuuacuagcaaaucuauuccuucauuggcauuagagccugcuucuuaggaauucugguguguacugaaggccagcugagacauccagcuucauggaccugauaaugauaggcagccauuguuggauuagcugggaccacagccuguaaguuauucauauauauauauauauauauauauauauauauauauauauauauauauauauauauauauauacauauauauauauauucuauaaauauauacaagauuauauauuuauaaauauaguauaucuucauucuauaaguuguuucucuaggaacacuaauauacucuuuauauauagacugaggauuuauuaaaauagcaaugacaucuauaacaucagguugaagaauccaguaguuguucagaggcugacugucucaguguauuucauuuaguguccacaauauucauccauguuccguauaugucagaauuacauucuauuuuggauacuacuggauaauauuccaguguacauuuugcuuuguuuauacauucauuuuuuugaugggcccuagguagauaccaucuuccacuguuucaccuaauucugcuaaggacauacauagauauaaagauccuuugagguucuacagccagcucccuucccccaucccaaacaagcuuucccuguuugucccaagguagccuugaacucaagauucuccugucucagucuccaaaaugcugugauuacaggcaugggcuaccaugccccuaacuucuucugauguagucucagaagaggaauuucagccugaaugccagcaaaaugguacaggaaucucagaggguacuggcacuuacuuaugggucagaugaccuaaguuugaucccuggaucccacaagguaguaguaggaaaguucuucuauguuuaacccccaacacaaaacaaaacaaauaaacaaacaaaaaacccaaaacacucacacacaaaacagaaaaaccacaacacacacacacacacacacaucaugccaaaaaaaaaaaaaaaucaacaacaaaaaaagucacuuuagaaaaagaaucucagaguaagccaguguggagaguugauguuuauaaagagaaaggcacccaggaaaaucauaacgcacaccugaaaggacuguggcuucuucuaggaaagucacacgguggccacacacagcucaaggagucgaugagaagccuuucccaccagucuuggcaaaugaggucauaggcugauugcugguacauuagcuaggcucacaucugaguagguaaaaacauggguugaaauguguagggacagggauggaucugaggauggcucagcaguaggagcacagguuguuuuuugagaggaccugaguucaguucucagcacucaugucaacuccaggcccaggauaucugaugcccucuucuggccucucgaugcacugcaugaaucugggugcugcacaguguagauuuuauccuuuauuuuuucuuuauucacuacuuuguagguuaucccuggguucuucucaugucuccuaacaauaucuucuccuggcccaacugucaccucuucuccuacucucugacccuacucuccuguguccuggguccuucuccugccuacuccccaguccuacugcccagcucucagccucugcugucuuuuuauauccauaccuguccccaagauucuaaggaggcaacucacauagaagggcauagcuucuauaaaagggccaggcacauaagauaaaucacacggcagcgcagacacacauacauauaaaaauuacaaccacguuggcuuugaauacagagauccugcuucugccuccugggugcugaggucaaccaugugcaugaccuggccugacugacauagagaucuguaaaagaaacgcugccucccugcuguuggcaagugugaaaaguaacuuuuauuuuuccgacauaaucgucaucuccaaggcauacugcuuuagucugcuaacccaggccuaaucuuggaagcuuccagccuccauaaagucuuaucuaggccuagaaugucuucacccucucugagacuuacugcagaauuuucucacccuuuccuguucuuucugaccucuguuggcugguguaacucagcuguccuggcucaaaccccucucuaugcugacucauucaaucuggcuucuuucucagucuuuggcugaauugcucugcuuggccucaaacuaacucuggcaaucuguucuaaucucuggcuccuucucauucuccggcucacucugccuucaccugcgucugccuuguucucucucugcagucugucuauaacugucccaggaaaacugcuuucuaaagucaccucuccuuuuugucucuucuggugugaguuguguguauccuaucucugacucauucugucaacucuuccucugauucaucacuuuguuccuucauuguuuaggauuaaaacuguguauuaaguaaggguggaucuauauuccagccagagguauuacaggugugugcuaagggcaugucuguauuccugucagaguaaccuuguagcuggauuaaaaucccuuuacaacuguggugguuugaauaggaauggcugcuacaaacugaaguguuugaaugguugucacauagggaguggcacuauuaugugguguggccuugagaaagagugucacuguugggcugggcuuugaggucucauauguucaaguuagacccagugugguacacagucucucccuucugccuucagauugagaaguagaacucucagcuacuucuccagcaccaugucugccuauaaguugcuaugcuuccugcuauaaugacaaugaacuaacccucuggaaguguaaaccagccccaauuaaauguuuucuuuuauaggaguugccauaaacucuauggugucucuucacagaaauaaacuaagacagaaacuuucauagcagaucuuaauucuugcaucucagauagcuagaggcuucuguuagacucaaguguaaggacuucuuuuguagucccugagcggcaggcuucaggagcugucaaaauggcagcaacuccuguuccugccucagccugcagccugacaugagguagcuucauaggagcuguccacgguggcggcaacuccuuuccugccucagccugcaguggucacaggagcuguccacgguggcgucuccuucuuuccaggcuccccaaacagcuccgcaaugaugacaccucagucaaagcugccuguggccaggaaggucuccucauccuaaccuaugguccugaugcagggaaugggggugaaaaaccuaccagucccggagcaggaaaucccaccaaugcucacucuggaaaccucugcccugaaaagcucugcccccuaaaacaacccucuaucagcccuguccuuuguucaauucgcuccuguccucuccugggaggggaggcagccauuccuggauuuaucaucccuccuggacccuucaaacaaaucucuuuuaugauauuuguugcuuggugugacucucuucucggaagaagcaaagaagaggagggaguuuuuuguuuuuuugguuuuuuuaaagcugggcgugguggugcacgccuuuaaucccagcacuugggaggcaguggcaggcggauuucugaguucgaggccagccuggucuacaaagugaguuccaggacagccagagcuacacagagaaacccugucucgaaacaaacaaacaaacaaacaaacaaaaaaagaagaagaggaggaggaggagggaagacuugaagaaauagaguggggcugagguuccucagcucagcuggggauacccuuccuaggagcugcaacacucugcugagaaggcuuccucucagagcuuugugguucuucagcuccugagucccaggauucccuuccaucugagcaggaacacuuagaccuuuccuuccugugccucuguaccuuucccugucucguccuccuccucuucaucuuccuuaaauagaaaacugcugcuuuuccugcacuagauguggcuucugaauaaagagcccccacauaaguccugugccuugaaugaacaagcuuugguacuguucuggguucacacacaacugcccaauugccacccccuaaagacauuuuuuuuucuuuucuuuucuuucuuucuuucuuucuuucuuucuuucuuucuuucuuccucucucucucucucucucucucucucucucucucucuuucuuuuuuuuuucuuuuuucuuuuuuuuuuuuuuaaagauuuauuuauuuauuauauguaaguacacuguagcugucuucagacacuccagaagagggugccaaaucucguuacggaugguugugagccaccaugugguugcugggauuugaacuccagaccuucggaagagcagucgggugcucuuacccacugagccaucucaccagccccucucucucucuuucuuuuucugacaguuucuuucuauuuuguccuggcuauucuggaacucacuauguagaccaggcuguccucaaaagaagagaucucaucucucuuguuuuacaaaaaacuagaguuagaugugaaaacagaaagagacucaagaaccgaggugaaagcagaggcgguggugcacgccuguaacccuacauuugggaggaaggagaggagucaccuuggcuacauaaugaaaccuuguuugaaaagaagaggaaacuuuacccuugauacagucuacuuaagggaggacucacuauggaagcauggcaaaacccuguggagugacuuaguggaguggcugggcuggugcuacuuggauucuaauucuaaguacugguuucucaagaugcgguugccccuaaugugcagauccucacguacacaaagugaugcuaugugaaccuucuuccccaauuuaacuggucaauaaaaagcuagagccugugaaugggcaguggagggagaaaggugggacuggagguuagagugaggugagugugcagguagagaaggaaugaggaagauggagguagaggaaggugccaugaaccaggacugcauggccaggagaaacagcaagaaacaagcaacuucauagcuggggaauaaauuauuauagcuguaaccugccugguuuaugcuuauggcuuguaaaacaccuggauuguguacuuuuauauagacuuguuaggauucuaaacucucugcacaacuuagugcaaggccugcagcuggaccuucuucagauucucagcuaccaagcaauaauauacuuaugcucaugucucuuuguucuggcugaggcccuaccucacaacacuaugcucuuugcuuuauuuuuauauauuuuuaacaguacuauggauggaacccugggucccaaugcaugguagguaagcauuguaacacuaaaauacaacuccagcccuuguacugacuucucucagaaagcucaucugguccagcaccaguuccucaugcaggggacauaguguacaccuugucccagcuguggcuguauuuccuaccugaguccauccgcacagacuauggguaccacugugccuaccucucccuucuggccagccauugacaagagcuuccaagguuacugccaacaucgccuauaaucuggcacucacuaugccagcugggaaacuuccuucauuucacaggucauauacaaagagaggugcucuacugugacuuaauuaaggguagugcaucugucugucacagaggguccuacagccagucauaggcuugugugcgcacagguggcaaacaggguuugucacaugcuaugccgaauucuucugccucucaacucacugcuguucagccacagacagacaacugacaagacauugcuaugcuuuaaauaugaacucucccccacgggcucaguguugaacgcuggauccaaagcugguggugcuaguuuggcagguucuggaaaguuuagaagguaagaggauccagcuggagaaggacaucacugugggugaguccuuccuauuccuccucugcucuugucugauguaaagugaauagcuuccuccuccuccuccuccuccucuacauauucuugccuccauaauguucugcucaagugcaugaagccaagccaccauggaccaaacugucugaaacugugagccaaagugaauuuacccucccuuguuucugcaaguauuugguaaaaugguuccaaaacuaguaacagacuuuccuugcagcagccgugggaaagcuucccgagacagugaaagacugugaaaguccaccugccuagcagaauucuagaggaccacuuccuggguauucccuagaauagggaauucaucuuucaaguagguuccagaaauaugguuguuacugguaugggucagggucugugaaagaacucagaacauguguauuggagaaaggcaugcagagugugcaggggcaaaagaaaaaggaaagaugcacaaagugacaagaccuguaggaacuaggaaguccccuguuggagagugguuguaggagucaucagaacuguauucagugaguccuggcuacguggcuuagugauaggacuuguguuagcaugcugaggugcaucagugaagaacaugucagucagaaaaggacaguccgaaacuagauugcacagauuuguuaaggugggcuaugaucagugauugauggggggggggggggguucagcucauugagugugauaccaucccugggcugguaguccgggguucuguaagaaagcaggcugagcaagccauggagagcaagccagcaaguagcaacccuuccuggucucuggaucagcuccugccuccagauuccagcccugcuugaguuccuguccugacuuccuucagugaugaacaaugauauagaaguguaagccaaauaaaccuuuuccucuccaacuugcuuuuuggucaugguguuucaucauagcaauagaaacuuuaagacaccuaguuugcauaauguccuggguuucaucccagcaccaaauaaaacuggguaugcugugcauacuuauaauugagcaugcaggaguuaagagguaggaggaccagaagcucuuggucauccuuagcuacauaguguugaggcuagccuggacaacaugaggcccuaucugaaaaagaagaggaggcaauuauuguuuucauuaauaaguaguuuuucuacuucucucuaggacugauauugcuuguccuagucuggguuuauggugaagugaucccuuaggcagucugugaaaucaaaguguguuaacauuuaagguugcauuucugggugcuggcagucacugagcaugaaccauggacugaaucuuuuaaaaaauauuuacuucaugaauauggguguuuugugugacuguauaucuguguaccacauguguaccugcugcugcuggaagacacaguggcagauuucuuggaauacaguuacagaugauuguuagccaccaugugagugcuagaaacagaaucuggguccucuguaagaacaagugcucuuuuuucuuauuuauuuauuuuauguaaguacacuguagcuguuuucagacacaccagaagagggcaucugaucucaucacagaugguugugagccaccauaugguugcugggauuugaacucaggaccuuuggaagagcaaucagugcucauaacugcugagucaucucuccagccccagaacaagugcucuuaaccacugagccacuucuccagcuggggagaaauuagucuuaaagcguuuugcccaacauaagaguugcuagagccacaaagaagacauuccauguuuggauuucauuccuaugucuaguaacagauuuugaggaagcugauccagauuuguggggguuuuauuguucauuuguuuuuugaggcaggcugguuuugagauagccccggauagccuggaacucacuuuguagaccaggauguccucaaacucaagagaucuaccugccuuuuccucccaagugcugggaauuaauggugcgugccacugcacccggcugucuuaugauuuuuguuguaguucucuauggaggggggaguccaggacucuagacauaaaguuucagacaccaucuacucgaauaguccaggugcuuggcuggcucucagcagcgaaggcacagccucucuguguggccucuagaugugcgaauccuauuuacccucugugcagucuuccuuaccugauaauuauucagaaaggagcaauagguucggcuucauacccaguccuggguaucuauuuuaaaaauacuuuuauagaacuuugggccccaugcaugcuaggcaaaugccugccacugggcuauacacucuucauuuaaaaacagggucuauguugcccaugcacuccugacacacguugacacagcugcacuauuucggaaagcaacgguacaggggugauuucccugcuucauuauaaaugaaaggaucaacuagccaucugucuuuuguucccccugguagccuaaaugugcauuccacuguacaaagaaaggguaagcccaaagcuauuggucucaccucuaaacaagcgaacuuccuugguacucagguaggccauucacuucuauagacuacuuaggagcugcccaagguacaagaccagucaacuuaccauucuagucauucaauuuuaccagacgcgccuuuugugcaccagauccuuaccaccgcucccuucucaucuaguacuuuucagaauuccuggcugugacaccuuuaugaucguaggauguagcuguucaaaaauccauguugucacugugugacuuucccuuuggaagaccuguagaaacgucuucuccaaguagggcaaacaagcguuggagaacacaagaaaagccucccauucauaagacuucucacaaccggcuuagagacacaggauccaccuucuugcccuuaagaauccguuggcuucauucaaaugggccgccuucauugaugaccaaucagaacgcccgaucuucagcuaccaaccaauaaacgaaugcaauagauaggaggaaaguaggcaagaagccaucucgcagcgccauuacacuuuagggcaaggagguuaagaagucggcauggcguucgggucaauaaaaucgauagcuggaaccugccuguguucuaggcagcgguggugcaggagcagcgccgccaucuuccccgaaggcaucuuccggugccucucacccaaguuccagcgggaguucccugaauaacggucugugucgggccgcccggccccucaggcagccgauucagauuuccuccgggccuucccgacggagcuucuaggucuccggguccccguggcaaggccggggagcagguccgauggcgccaccuucggcuccgcuucuccugcgggcagucggagaggcuggaccuacucggaaaaggggcaggaggccaagggccuugaaguucguggacguggccguguacuucuccucggaggagugggggugucugcagcccgcucagaggacucuguaccgggaugugaugcgcgagaccuacggccuccugggcgcgcucggugaggcccggcccaaucug

SEQ ID NO: 4112 - RNA, 13921 nt, Mus musculus
caugcgcuugcgcgaaauaccaacaggcaaaaaggcagccacuacacaccagaaaagcgcaccuaggacagccuaacgccuaccaguggccugcugccuaccacuccaggcaccaccucccagugccucgcacugucucucaguagauggccaauaaacagagagcaggaagaggcggguggccuaaggaacugcuccaaacaccuacuucggaccaguccagucacaagaccuggggagggcggggcuaaccugacaacccaaucccacauuugaaggcuguuacguccggcacuccggcgacuuugacuccgcccuuugcauugacguuuacuugccaaccuauaaacgacugagccucggagggagggggaaggaggcggagagaggaaggaggcguuggcugaggaggaagagggaggaggggcagggaaguucugguggagaagagccguagacgccgaagaagacaacaggaggauacggcggaguuccucacuguccaguggccuuuccggauccuucuagcuacaagccgguuaggaacggaggaaaggaggaagagucuuuuaugucggaggacagagagagaagcucuauccgucaccguugccucacauccgggacuuuggacggcaggcuccgcccccuugcaccuuucaaggcuacgggaggcggagaccucguuaaaucuccuuaaagggguggguaccgaacucggccgacuccaacgccagucuuaaaggggacagcagaagcugacaaacaacuccugcuggaagaauuggggcaaguggaguuuuccuaccuccugccccacgcaagaaguucauuaaauucaucuuaaaggggaagugacagccugugaagggcuagaaacuuagcuacgcucucuaaaaagggacgacucgcuguuugaaggccucuggacucuuuaaagggguggccucuuucagccggaggacuugagacacuuuuaaaggggaagucgugcuuuccgccccuuuuaaaggggugguccuuccucuuccucugggagacuugccucgaccccuggcacggggccgccaccgcacuagaccagccggacacgguggagucgucuuaaaggggccgggggcuggacaauuugaggccucgccuuaaagggacggccgcccaguuuuagucgucgcggccccgccagcccuacagggggggccuucaggcuugucgccccgggggcggcgccggcucucugggccuuggccuuggggcaagccagaggccagcggauccuguuuuaaagaggaagccggagcucucccgucccugugcaagcgccagcgccgcgcucgcgacccggggccuguggacaggccgcuucgggccccgccgccuccggaugcggcgcugagggccgucaccauggagacggccgcggccccaggcccgggcugggcagcugaaggggagcggcgacggagacgcugcucgcggcgagaccgugaucgggagcagcggcgccgccgagguccaggcggugacgcgccccgggccuuguuggccgccccgcgaggcucuucauccuccucgucaccgccgccgcccgcccgucccuggucgucagcuucaucuggagagcggccugggggccuacgacggcggcggccccgacccaggccucgacccccgagaccgcgagcucggaagcggccugccgguucgggcagccgcggagaggaagaggacgaggaggaagaggggggcgcagacgacggagaagccgaggaggagccugaggaggaggaagaggaggaagaccugaucgaugguuuugccaucgcuagcuuugccagccuugaggccuugcaggugugcccuaaugggauuugggggucuuugggaggugggucagaagggcagagagaaggguauagcccuuacagaggaugggguugagggggcaguggugacaccccaaaccagagcaaccggcuccucuugccggguuucugccccacccuggggugggaggagguagagcuagugucuggggacuaccuagguuccccugcuugagaggcacuugaguaacuuggucacccuuagagaguuaaggagcuuuucuuucuccaaccacauuuccaccaccucuucuacagaaggaugcaucucuucagcccccagaacgacuggaacaucggcugaagcauucugggaaacggaagagggggggcuccaguggggccacuggggaaccaggggacagcucagaccgugagccuggccgacccucuggggauaggccccguaaauggcccaauaagcgaagaaggaaagaggugagcaugucccagauuccaguccuuccaauuuguucagucggaauauaucauuccuguagacugacuucccacgagcaucacaacugccgaucccagcaguaauccuagugucuaggagcacaggggaaggcagaacaaauuggacagcagccccaucuccaauccaggucugaaggaccuaacuagagucaaacucacuugcuuuugcuugugcuauguauacuacuaacaagcugauaauucaagagauacaucaaagacagcugaauuauaaauaagagauguccuguccuuuccucuagcugguggcagccuaaggggaaagaaacagccaaaaagcaagcaccuagacuagcuugagcagcuguguaaggcagugaucugggagagaucuaggcaaagugcuacagaaacccacaugaggaagccacucauucugucugggggaugggcagaggguugcgguuagggaaagcccccuagaacgucuugggccccaguguagucagaaguuugcugaggaaagaagugaggaaaaguuguuuugaauacaguuuuaagauuugagaaccuagaguauuaggaaaauaguaagcugguugguagcggagguggaaguaaacagagaaacaagagcaugauggagaguagcuuuuaaguccucuugaaggucuugcugggaguaguggcuuuguacaguugcuuggucagucagccucccuuacuucuggacucuggucuuucucaggccuucucccgucacucucuggaagcuggauauauaguaagugucaccuaccuguaauggcccaucccuucccuguugggucccucuccuauccccugaugucuuucucuuuaucuucucagugugacgcagaaagugaucuggaugagagggugaguggggccaggagcuguugggugggcacuauuguggggguuuaagcaagcagccugcaguuugaacaacucccacaaacaauagacauccuuccuaaaugggaacauggggcauauugaaccagaauuaaguuuugaggaggaagggagagaagaaaaagguauuggguugagaggugaggccacaguguccauguguuuuugaagggucaguucuccuucuaacaugggguggaacucaggccaucaggcgucacaagugcuuuuaccuguugagcuaucuugaugacccugggcuuuuuuuuuuuuuuuuuugguuuuguuuuuauuuuuugguuguugguugguuuuguuugauuugaggguuuguuugguuuguguuuugcuuuuaauuuuguguguggguauuuugucugcauguaugccugcauauccucaggaacuggacaguugugagccuccaugugggugguaggaguugaaccuggaucuucugcaagaacagccagggcucuuaacugcugaucugucucuccaaacaugccaccccuccacccacauggguuuuuuuuuguuuuguuuuguuuuuuguuuuuuguuuuuucaagacaggguuucucuguagcccuggcuguccuggaauucacuuuguagaccaggcuggccuugaacucagaaauccgccugccucugccucccgagugcugggauuaaaugcaugcgccaccacgcccggcagcaguuuuuguaugauuagagucuuguagugaggacaucagaccaugguugaugagugcagauacccauccuggaaagcucuuucaguuucucauuagugacuguugggagaucaugugcccuugacggugguguuucaccccuuuacuuccauaagaaacuacauuuauacuccugaggcuugucuuuuuuuuuuuccuucucacaguuuuuagaaagugauuauggugagcuaaaggguuguggucuaccuacaggacuggggucacuauccaauuuuaacuaauuauugcuacaugagaauaggggaguauugucaaaaggccuucaucuguguuuuaacaugggcuuuccagcucugaucaguuuuaaggguuugguuuguuacuucauuuugguuuugguuugucuguuucauuuuggguuuuguuguuguuguuguuaauauuuucaaaccauacauaucagcaggccagauaguguuuugaaucagcaguuagucuaguuuguuuuuuaaagauuauuaggaccagucauaaugauguauaucuuuaauccuagcacucaggaggcaaaggcaggcgggucucugaguuugagaccagccaaggcuacauauugagacccuaucucaaaacaaacaaaaaagauucuuuuauuacuuuuuaauuauguauaugugucuguaugagugaguacagaugccuacagagaccagaggaaucaauuuccccugaaccuggaguuacaggccguugugagcuaccugacauggauacugggaaucuaacuugggucuaguucuaaccacuuagccaucucugcagcucuccagcaguuagucuuaguugacauuacuuugaucugcugucaucuuuaccaucucuggcauagcagaauuugggccucaguggccuacucccuucuuaaguccccuaaagccaacaacauuccaauagaugacagcuaggcugaugaccuagacaagucuucaacaccuaacccugcucugccucucaccaggucucagaugaugaccucgacccuuccuucacugucucgaccagcaaagguugguccuaagggcugggaaggaagcaggaaggagaaacgggugagcaugaauuacugcuaagcaugucuaccauccugcacucacagccucggguccucauggcaccuucaaugggaacugugaagcaaaacugucuguggucccuaaagugucgggccuggagcggagccaagagcagcccccggggcccgacccgcugcuagugccuuuccccccaaaggauccaccaccuccaccagccccucggccuccugucucauccccuacacccuuaccagcuacccccagucugccacccccaccccagcaccagcugcagcuucgggucucacccuucggccuccgaaguucucccuauggcagcagccuggaccucagcacuggcaggugaguuuacaggguccguucugaucugcaagggcuguauuccauaacugggacguggaaacagucugacuugguagaggauucugagauuggaaagucugagugacacuggguaaaauaaauuuaaagagauuacugcaggacuuccuucaguccuuuauacauucauguauaggcuguccaguuugggccuuuuuguagcuguauaugcuggugaaaacuuuguguaaugugcaucugccacagauaauguucuuggaaacauacuuugggaaguacuaacuugaugauuaacagugcugacuugagugucagucagaccuggauucagacuggcuacuuacugggugugugauuuuuuuuuuuuuuuuuaacaaaucgcuugaccucuuuaaaccucaauuuucucuuucuuaugagaugaaauaacaauaguaccucuuucucaaagcuauuuugaggauugauucugagugaaagcaguguuucccaaaguguguacacaucauuagcaaaacaugggaugauuucaggucuugccuugguaaacucuaaaauaggcaaaguaagcugcuuuaggaaaauuuagcuaauauuuuaacuuuuugauuucacauguuacuacuuagaauagacaaaagaagugaguuguguucuagaaaagaauugguauaguacagaugguugcauggcuacaguaacauuggggaagguggugcgacauguuggagucuuacauugacuuguagagccaaugccagcaguuggucuacaguaaguacucgcuaaggguuaagaauuaauggcucuacuuuuauggguucuucauuguugucugucuucaucaucauuguuguuauugagaaaacuaaggcucagagaggggcagugacuugcucaaggucacccaggguguugauggcaagaugggcauggaguugaggauaccugaguaguaggauaggauauugugguauugcuucuauuaucuuagggugguggcucuggugcucauuguaauuaagcaucaaaaugaaugcucuguuguaugcugugguugagucagaaaagaaagucauauggcaagugaugacagaggcaucuuuguagaaacuagaucuaaagaggagaagggguuguugggugugggaggcaucucaucccgagaccggauucucugcagggagucccugggggccaaguucuaccaucucccauguuggagaaccaaggccacaucaccacccaggcuucugacccaccuccuguuagagcuagcaccucccacccccucacucaucuccccacuucucuccccagcucuucacggccgccccccaaggccccggccccucccguggcucagccuccccccucaucauccucuucguccuccuccuccucaucugccuccuccucguccgcgcagcucacccaccggcccccgacgcccucacugccccugccucuguccacccacagcuuuccuccccauggguugcgcccaccaccaccccaccacccuuccuuggucuccccuggccccacccugcccccacccccaccucugcugcaggugccagggcacccuggggccucagcugcuaacgcccuuucuggugaguuugggguccuggcaggguggagugguggggggccauggccccaaggaugggcucaguuggcuuuggcaggaaccaagggccuguggagggaguggcucaaggcuaaagggaaggccagucaccuuggcccaaagaggcugacucgguggcgccagauauuaaagccuucuuccccuccccuccccucccacagagcaggaccugaucggccaggaccugaacucacgcuaccugaaugcccaggguggcccugagguggugggagcagggggcucggcccggccccuggccuuccaguuccaccagcacaaccaccagcaccagcacacccaccagcacacccaccagcacuucacucccuaccccccgggccugcugccuccccacggccacauggugagcuccuccuugggcugcugcugaggccuaagggaaagugucuccuacagggaaaggaagacccuggcccccuggcugccagcuuacucuucccuuuucuucccuaguuugagaaauacccaggaaagauggaaggccuuuuccgacauaaugugagugugugugagggugugugaagugugggaauguauguaucaguggaguccagucuucaccuccaaaagcacgaacccugagcuugagaaagcuccuuggggguguuaggguggaagccaaagaacuaauggguagagcagaccugggcugcaucuccacucccuucuuggacuagugcccuucucuccacagccguacauggccuucccucccgcugugcccgggcucccuccgggucucccaccagcugucuccuuuggcucccugcagggggccuuccagcccaaggugagcuccuaauccagacaacuacuaccucccaucccuuauaaacauccuggaacccuuuaccuguuucccauuccccaaaauguuucuagcccccauucucccuucuggacccaaguuuuugcaaagccacgaucccucucuugacccuuuuuccagcuuaguucuagaccccuuuuuaacuugguacuggcucugcugucugaucccuacacuccccuucacuccccuuucccagaacacgaacccugagcugccaccacgacuggggccagugcugagcgggcuaccccagaaggggacacaggugaggggggcagggcagguccugggggaguuggaaaguaugcugagggaaagcagaauugacgagagagggugaguucuugguucuucccuuaggugucuaaagagagaacuuuugucuaacaggucuaccccggcaugggaguagaagguugaugauauuaauaagaagaaugaaguaauuaauagagcaguaguuuuguauuuuaguuuucuuuguuuggugugauucuagauaucaaaccuaaggccucacacaugcaucuacuacugaguuauagcucuagcaagacugauuuuuugauaggggucuucaaauguaagucacagauuuuuuuuucccaaauagcaucauaucaggaagcccuguccaugcaaagauaaacuuaaccuuuguaaaaugaccaaagucuuucccccuaugccucacaugucucagaccccaggguucugagaauacugugagaaaaguacaggacaugugucuugaaggaaagacuaaaguuuucugacucccuuaaaaggcuccuccccuuagaguuuuccuguauggagccguuagaggacagacgcuucucugguagagaaaccuauccuauguagccaucccaacaggguaccacccuaggauugugcucagaaaccuaauacagaaggagccauaccuguaguggggggaaaccuaauacagaaggagccauaccuguagugggggaaagugggaaaggaguuuugacaccgccaagaaugguuugaggaagcuguaguaacagggaaauugugggaacagugcuguaagagauuugacacuugggucaguaaacaggucugaaucgccuccaaucucuccuuuaccauccccagaucccugaucauuuccggccaccuuugagggugaguuuggugaggaucucaggcugcaugagguugggggcugguuucaggguguuuggcuaugguuggugggauccugauugggaaaaauuaaguucaagaugugaaggcagccagguguaaaacaauagaaaguaagggcuuuuaagucacagccuggucuuagauauaccuggccaugggaccuugggcaaaacaguucaucucucugagccucaguuuccuuaggcuuuaagauuaagcuagucaucccucaguuguagggaugaugguugaggaugcuguguggcaaggcugggcccagggccagaccugggaugggugaugagugaacauuuuuccuucccuuucccuuuggucauccuggggcgacagaaaccaggaaaauggugugccaugcacguucguguggcuuacaugauccugagacaccaggaaaagaugaagguacuggggcuggagggcuugggagagugggucuugagagucggguugucugaacucuggguaguaucuucaacaaagcucauuuucucucucauccuaagcaguucuauagcacccggguucucugccuaguuacuggaaugguuagagaagaugcuaaaagauguagaaagcacugaagucuuuuuuggugccagcaagcucuuggagggaaguuagugguaaaagagauaagagccagggaugaccuaagaauaacaggcuauaaagggguaaagaaucuagaccagaccuagcuccucacuggcccucgccgugucccaugcagggugacucccacaagcuugacuuucggaacgaccuccuacccugccuuccggggcccuauggggcccugcccccugggcaggagcucucccacccggccucucucuucacugcgacuggugagucuagccagcccucucagagccuauggcccaauguccaccuugcucucacucauccucaucagacucucccucuucucugccccaggagccguccaugcugcagccaauccuuucacaacagcuccuggggcccauggacccuucuugagccccaguacccacauugguaagagccaagagaauuuuggauuuccuauacccuguucuaaacauggagguagagauggaaaccagaccuaaggacaacucaaguuggguaguuaggauucucuuuacugugugaccuuaguuauucucccuacucugagcugugugguucccucuucuguggaaugaguguggaaggcagcaugguucccacucugcuugugggacagaggauagauaguguuucaccugggaaagaguagagaaggaaggcucugcaggcccaagacagcaaggucauugcccuaggggacuugaaaguuuccuggggagauucauggguggggaaaaaaaaguugaaccccaggucagcuuuccagcuauaaagacucugagggggcuggugagauggcucaguggguaagggcacccgacugcucuuccgaaggucugaaguucaaaucccagcaaccacaugguggcucacaaccacccguaaugagaucuggugcccucuucugguguaucugaagacaacuacaguguacuuacauauaauaaauaaauaaaucuuaaaaaaaaaaaaaaaaaaaaaagacucugaggaucccacguagcgguagacuaguuaauucugacagauuugugauaaguaugaaguuagaaucagccugagaaagguauuucaaauagggugaagccagcacaagucuagaggcuaguuaguaguuugcaagcagaauugagagcuguuaagaggucucaggugucuggagugggaguacagauaagaauuugacuuuuaaaaucagagaggcuccagguugauggugucauuuuauagcuagauuccuuuggcaagucauuucaccucucugagccuguuucaucauuugaaaaugggaauuguccuuuuuacuccaggagauugugcggugucuggccugacccaagaaaugcccaguacaugguuguuaaaacugagucacuaagagcuggcuauaaaugccuuuaaucccaacacugggggagguagaggcagguagauaucugugagguccaggccagccagaacuauauacugagaacccuauuucaaaggauaaauaacaaaacaacuaagccaccaaguguccagcuucauugcugauuugccucuuccccacugcuucuuugggcggcucagaguuggauugccugugcucugaccagucccccuuucuucccacagaucccuuugggcgucccacaagcuuugccuccuuggcugcucucuccaacggggccuuuggaggccugggcagccccacauucagugagugcuggguagaaugggaaaugagggauggaagcugcaaccgaggggcuauaggcucaagcugggcuugugaugcucucuguagagcauccuccucucggccccugucacuuucuacucuaccuucuacucagacuccagcgccgucuuugcccagaaagaaagcccaggagccccaccagccuuugccuccccaccagacccauggggccgccugcaccgcaguccucuugccuuuccugcuuggguccgucccccugaaacugcccggacaccaggcucagauaaggagcgaccuauggagcgaagagagcccucugucaccaaggaggagaaggacagguauguccucuacacaacugccaccuaacccacuccagugcugucagccacagaaguuccuccauucugucuccuugucucccuccccaccagggaccucccuuucucacggccucagcuucgaguuucuccugcuacuccuaaggccagggcuggcgaggaaggagcccgaccagccaaagagucugugcggguaaaagaagagcggaaagaagaggcugcugcugcugccgccgccgcugcugccgcugcagcugcugcugcugcugccgcugcugccgcugcugcaaccacugggccucaaggucuucacuugcuuuuggagaggccucggccacccccauuucuuggcccuagccugccagagcgcugugcaggcuucccagagccaaccugguuggcagggcccccacgccuggccaggccaccacgcuucuaugaggcaggugaggaguugacuggaccaggggccauggcugcugcccgccucuauagucuagacccugcucauccacugcuauacagccguuuggcuccuccaccaccaccuacugcaacuccaggaaccccucaccuucucagcaagaccccaccaggagcccuuuuaggagcaccaccaccucuugugcccgccccccggcccaguuccccaccuagggccccuggcccagcccgggcugacaggugaggagaggugaggggcaggggcaaagcuccacccccuuuccccauaccuugugacaaaaguccuagggcugaaguuuuuaagccaggguuggaaggcaaaggucacaauuucauggucaucucugaagucauggaccugggaauagaauccccagaccccccccccccacacacacacacauacacacacacacacacacacacacacacgcaaguaucucguggacuguggggucacugggaggacagaggucacuagccucuagagagaagugugugcgugugcaugaggggguuauuucagagguuauggcucaugacuuaaggugcaccaaugcccccucuaagggccucuaggcccuuggccugccuccccaagggcucacuaagccagaggccaaagugccccccucccuuucgccuaccacccaaguucucaugcccuccgagggcugaggaaggaggaacuaaaggaauagggguuucauguacauauuuaucaccccuuccacaaaucccccagaccuuuuguacauuuuuacaggggugccccucccuauaauucccuuccugguuaauuaaauccucagacuggugcuguguuccuagccucuggccucucuaaccucugguagggugucccagggaagagccuggagaggacaggcagggacccagggcuugacccuggguaugugggauccagaaggagguagaccaacggggaaagggaccuagacuauaagcuggagggaagagcaauaggaccuggcugucagcccaggcuucucuagacuuguuccuauuaauucuguguggcccacagcucuaagaaggcucagccuuuaagcuucagauuccaccuuuuaauggcuaagucccuaccaccaccccauuucuaagugccccccaggauuccugggcccuguuccacagaaaccugucccaaacuaagggagggagagguggccagagaaggccaccgugaaacacacaccaaagaaggggguugguucaggggugggcaacauaggcagcuucuuuagcagccucccagcagcagccccaggcuucccaaagcagcaggcaccuccaggcugggccccaaauagaaggcagggcucaguuuaacaaaaccauaacguugacuuuuuccccaguggggcuuauucuguaacaugacuugcgaauauuuauauaaaaaugaguguuacaaugagauuacccccuacccuccggcuccucuuugagucugugugaguuauccgucauggguuguacugggucccagaaugaggaaagagugaggacaguacugaccauguccugaucaagggugcccccccuacuuccagaugggugaguuguuuaaugaugcguguugguguuuuucaaauacauucgauucaaauaaugcagaaagacacuga

SEQ ID NO: 4113 - RNA, 13921 nt, Mus musculus
ucagugucuuucugcauuauuugaaucgaauguauuugaaaaacaccaacacgcaucauuaaacaacucacccaucuggaaguagggggggcacccuugaucaggacauggucaguacuguccucacucuuuccucauucugggacccaguacaacccaugacggauaacucacacagacucaaagaggagccggaggguaggggguaaucucauuguaacacucauuuuuauauaaauauucgcaagucauguuacagaauaagccccacuggggaaaaagucaacguuaugguuuuguuaaacugagcccugccuucuauuuggggcccagccuggaggugccugcugcuuugggaagccuggggcugcugcugggaggcugcuaaagaagcugccuauguugcccaccccugaaccaacccccuucuuugguguguguuucacgguggccuucucuggccaccucucccucccuuaguuugggacagguuucuguggaacagggcccaggaauccuggggggcacuuagaaaugggguggugguagggacuuagccauuaaaagguggaaucugaagcuuaaaggcugagccuucuuagagcugugggccacacagaauuaauaggaacaagucuagagaagccugggcugacagccagguccuauugcucuucccuccagcuuauagucuaggucccuuuccccguuggucuaccuccuucuggaucccacauacccagggucaagcccugggucccugccuguccucuccaggcucuucccugggacacccuaccagagguuagagaggccagaggcuaggaacacagcaccagucugaggauuuaauuaaccaggaagggaauuauagggaggggcaccccuguaaaaauguacaaaaggucugggggauuuguggaaggggugauaaauauguacaugaaaccccuauuccuuuaguuccuccuuccucagcccucggagggcaugagaacuugggugguaggcgaaagggaggggggcacuuuggccucuggcuuagugagcccuuggggaggcaggccaagggccuagaggcccuuagagggggcauuggugcaccuuaagucaugagccauaaccucugaaauaacccccucaugcacacgcacacacuucucucuagaggcuagugaccucuguccucccagugaccccacaguccacgagauacuugcguguguguguguguguguguguguguguauguguguguguguggggggggggggucuggggauucuauucccagguccaugacuucagagaugaccaugaaauugugaccuuugccuuccaacccuggcuuaaaaacuucagcccuaggacuuuugucacaagguauggggaaaggggguggagcuuugccccugccccucaccucuccucaccugucagcccgggcugggccaggggcccuagguggggaacugggccggggggcgggcacaagaggugguggugcuccuaaaagggcuccugguggggucuugcugagaaggugagggguuccuggaguugcaguagguggugguggaggagccaaacggcuguauagcaguggaugagcagggucuagacuauagaggcgggcagcagccauggccccugguccagucaacuccucaccugccucauagaagcgugguggccuggccaggcgugggggcccugccaaccagguuggcucugggaagccugcacagcgcucuggcaggcuagggccaagaaauggggguggccgaggccucuccaaaagcaagugaagaccuugaggcccagugguugcagcagcggcagcagcggcagcagcagcagcagcugcagcggcagcagcggcggcggcagcagcagcagccucuucuuuccgcucuucuuuuacccgcacagacucuuuggcuggucgggcuccuuccucgccagcccuggccuuaggaguagcaggagaaacucgaagcugaggccgugagaaagggaggucccugguggggagggagacaaggagacagaauggaggaacuucuguggcugacagcacuggaguggguuagguggcaguuguguagaggacauaccuguccuucuccuccuuggugacagagggcucucuucgcuccauaggucgcuccuuaucugagccugguguccgggcaguuucagggggacggacccaagcaggaaaggcaagaggacugcggugcaggcggccccaugggucugguggggaggcaaaggcugguggggcuccugggcuuucuuucugggcaaagacggcgcuggagucugaguagaagguagaguagaaagugacaggggccgagaggaggaugcucuacagagagcaucacaagcccagcuugagccuauagccccucgguugcagcuuccaucccucauuucccauucuacccagcacucacugaauguggggcugcccaggccuccaaaggccccguuggagagagcagccaaggaggcaaagcuugugggacgcccaaagggaucugugggaagaaagggggacuggucagagcacaggcaauccaacucugagccgcccaaagaagcaguggggaagaggcaaaucagcaaugaagcuggacacuugguggcuuaguuguuuuguuauuuauccuuugaaauaggguucucaguauauaguucuggcuggccuggaccucacagauaucuaccugccucuaccucccccaguguugggauuaaaggcauuuauagccagcucuuagugacucaguuuuaacaaccauguacugggcauuucuugggucaggccagacaccgcacaaucuccuggaguaaaaaggacaauucccauuuucaaaugaugaaacaggcucagagaggugaaaugacuugccaaaggaaucuagcuauaaaaugacaccaucaaccuggagccucucugauuuuaaaagucaaauucuuaucuguacucccacuccagacaccugagaccucuuaacagcucucaauucugcuugcaaacuacuaacuagccucuagacuugugcuggcuucacccuauuugaaauaccuuucucaggcugauucuaacuucauacuuaucacaaaucugucagaauuaacuagucuaccgcuacgugggauccucagagucuuuuuuuuuuuuuuuuuuuuuuaagauuuauuuauuuauuauauguaaguacacuguaguugucuucagauacaccagaagagggcaccagaucucauuacgggugguugugagccaccaugugguugcugggauuugaacuucagaccuucggaagagcagucgggugcccuuacccacugagccaucucaccagcccccucagagucuuuauagcuggaaagcugaccugggguucaacuuuuuuuuccccacccaugaaucuccccaggaaacuuucaaguccccuagggcaaugaccuugcugucuugggccugcagagccuuccuucucuacucuuucccaggugaaacacuaucuauccucugucccacaagcagagugggaaccaugcugccuuccacacucauuccacagaagagggaaccacacagcucagaguagggagaauaacuaaggucacacaguaaagagaauccuaacuacccaacuugaguuguccuuaggucugguuuccaucucuaccuccauguuuagaacaggguauaggaaauccaaaauucucuuggcucuuaccaauguggguacuggggcucaagaaggguccaugggccccaggagcuguugugaaaggauuggcugcagcauggacggcuccuggggcagagaagagggagagucugaugaggaugagugagagcaagguggacauugggccauaggcucugagagggcuggcuagacucaccagucgcagugaagagagaggccgggugggagagcuccugcccagggggcagggccccauagggccccggaaggcaggguaggaggucguuccgaaagucaagcuugugggagucacccugcaugggacacggcgagggccagugaggagcuaggucuggucuagauucuuuaccccuuuauagccuguuauucuuaggucaucccuggcucuuaucucuuuuaccacuaacuucccuccaagagcuugcuggcaccaaaaaagacuucagugcuuucuacaucuuuuagcaucuucucuaaccauuccaguaacuaggcagagaacccgggugcuauagaacugcuuaggaugagagagaaaaugagcuuuguugaagauacuacccagaguucagacaacccgacucucaagacccacucucccaagcccuccagccccaguaccuucaucuuuuccuggugucucaggaucauguaagccacacgaacgugcauggcacaccauuuuccugguuucugucgccccaggaugaccaaagggaaagggaaggaaaaauguucacucaucacccaucccaggucuggcccugggcccagccuugccacacagcauccucaaccaucaucccuacaacugagggaugacuagcuuaaucuuaaagccuaaggaaacugaggcucagagagaugaacuguuuugcccaaggucccauggccagguauaucuaagaccaggcugugacuuaaaagcccuuacuuucuauuguuuuacaccuggcugccuucacaucuugaacuuaauuuuucccaaucaggaucccaccaaccauagccaaacacccugaaaccagcccccaaccucaugcagccugagauccucaccaaacucacccucaaagguggccggaaaugaucagggaucuggggaugguaaaggagagauuggaggcgauucagaccuguuuacugacccaagugucaaaucucuuacagcacuguucccacaauuucccuguuacuacagcuuccucaaaccauucuuggcggugucaaaacuccuuucccacuuucccccacuacagguauggcuccuucuguauuagguuuccccccacuacagguauggcuccuucuguauuagguuucugagcacaauccuagggugguacccuguugggauggcuacauaggauagguuucucuaccagagaagcgucuguccucuaacggcuccauacaggaaaacucuaaggggaggagccuuuuaagggagucagaaaacuuuagucuuuccuucaagacacauguccuguacuuuucucacaguauucucagaacccuggggucugagacaugugaggcauagggggaaagacuuuggucauuuuacaaagguuaaguuuaucuuugcauggacagggcuuccugauaugaugcuauuugggaaaaaaaaaucugugacuuacauuugaagaccccuaucaaaaaaucagucuugcuagagcuauaacucaguaguagaugcaugugugaggccuuagguuugauaucuagaaucacaccaaacaaagaaaacuaaaauacaaaacuacugcucuauuaauuacuucauucuucuuauuaauaucaucaaccuucuacucccaugccgggguagaccuguuagacaaaaguucucucuuuagacaccuaagggaagaaccaagaacucacccucucucgucaauucugcuuucccucagcauacuuuccaacucccccaggaccugcccugccccccucaccuguguccccuucugggguagcccgcucagcacuggccccagucgugguggcagcucaggguucguguucugggaaaggggagugaaggggaguguagggaucagacagcagagccaguaccaaguuaaaaaggggucuagaacuaagcuggaaaaagggucaagagagggaucguggcuuugcaaaaacuuggguccagaagggagaaugggggcuagaaacauuuuggggaaugggaaacagguaaaggguuccaggauguuuauaagggaugggagguaguaguugucuggauuaggagcucaccuugggcuggaaggcccccugcagggagccaaaggagacagcuggugggagacccggagggagcccgggcacagcgggagggaaggccauguacggcuguggagagaagggcacuaguccaagaagggaguggagaugcagcccaggucugcucuacccauuaguucuuuggcuuccacccuaacacccccaaggagcuuucucaagcucaggguucgugcuuuuggaggugaagacuggacuccacugauacauacauucccacacuucacacacccucacacacacucacauuaugucggaaaaggccuuccaucuuuccuggguauuucucaaacuagggaagaaaagggaagaguaagcuggcagccagggggccagggucuuccuuucccuguaggagacacuuucccuuaggccucagcagcagcccaaggaggagcucaccauguggccguggggaggcagcaggcccgggggguagggagugaagugcuggugggugugcuggugggugugcuggugcuggugguugugcugguggaacuggaaggccaggggccgggccgagcccccugcucccaccaccucagggccacccugggcauucagguagcgugaguucagguccuggccgaucagguccugcucugugggaggggaggggaggggaagaaggcuuuaauaucuggcgccaccgagucagccucuuugggccaaggugacuggccuucccuuuagccuugagccacucccuccacaggcccuugguuccugccaaagccaacugagcccauccuuggggccauggccccccaccacuccacccugccaggaccccaaacucaccagaaagggcguuagcagcugaggccccagggugcccuggcaccugcagcagaggugggggugggggcaggguggggccaggggagaccaaggaagggugguggggugguggugggcgcaacccauggggaggaaagcuguggguggacagaggcaggggcagugagggcgucgggggccggugggugagcugcgcggacgaggaggaggcagaugaggaggaggaggacgaagaggaugaugaggggggaggcugagccacgggaggggccggggccuuggggggcggccgugaagagcuggggagagaaguggggagaugagugagggggugggaggugcuagcucuaacaggaggugggucagaagccuggguggugauguggccuugguucuccaacaugggagaugguagaacuuggcccccagggacucccugcagagaauccggucucgggaugagaugccucccacacccaacaaccccuucuccucuuuagaucuaguuucuacaaagaugccucugucaucacuugccauaugacuuucuuuucugacucaaccacagcauacaacagagcauucauuuugaugcuuaauuacaaugagcaccagagccaccacccuaagauaauagaagcaauaccacaauauccuauccuacuacucagguauccucaacuccaugcccaucuugccaucaacacccugggugaccuugagcaagucacugccccucucugagccuuaguuuucucaauaacaacaaugaugaugaagacagacaacaaugaagaacccauaaaaguagagccauuaauucuuaacccuuagcgaguacuuacuguagaccaacugcuggcauuggcucuacaagucaauguaagacuccaacaugucgcaccaccuuccccaauguuacuguagccaugcaaccaucuguacuauaccaauucuuuucuagaacacaacucacuucuuuugucuauucuaaguaguaacaugugaaaucaaaaaguuaaaauauuagcuaaauuuuccuaaagcagcuuacuuugccuauuuuagaguuuaccaaggcaagaccugaaaucaucccauguuuugcuaaugauguguacacacuuugggaaacacugcuuucacucagaaucaauccucaaaauagcuuugagaaagagguacuauuguuauuucaucucauaagaaagagaaaauugagguuuaaagaggucaagcgauuuguuaaaaaaaaaaaaaaaaaucacacacccaguaaguagccagucugaauccaggucugacugacacucaagucagcacuguuaaucaucaaguuaguacuucccaaaguauguuuccaagaacauuaucuguggcagaugcacauuacacaaaguuuucaccagcauauacagcuacaaaaaggcccaaacuggacagccuauacaugaauguauaaaggacugaaggaaguccugcaguaaucucuuuaaauuuauuuuacccagugucacucagacuuuccaaucucagaauccucuaccaagucagacuguuuccacgucccaguuauggaauacagcccuugcagaucagaacggacccuguaaacucaccugccagugcugagguccaggcugcugccauagggagaacuucggaggccgaagggugagacccgaagcugcagcuggugcugggguggggguggcagacuggggguagcugguaaggguguaggggaugagacaggaggccgaggggcugguggaggugguggauccuuuggggggaaaggcacuagcagcgggucgggccccgggggcugcucuuggcuccgcuccaggcccgacacuuuagggaccacagacaguuuugcuucacaguucccauugaaggugccaugaggacccgaggcugugagugcaggaugguagacaugcuuagcaguaauucaugcucacccguuucuccuuccugcuuccuucccagcccuuaggaccaaccuuugcuggucgagacagugaaggaagggucgaggucaucaucugagaccuggugagaggcagagcaggguuagguguugaagacuugucuaggucaucagccuagcugucaucuauuggaauguuguuggcuuuaggggacuuaagaagggaguaggccacugaggcccaaauucugcuaugccagagaugguaaagaugacagcagaucaaaguaaugucaacuaagacuaacugcuggagagcugcagagauggcuaagugguuagaacuagacccaaguuagauucccaguauccaugucagguagcucacaacggccuguaacuccagguucaggggaaauugauuccucuggucucuguaggcaucuguacucacucauacagacacauauacauaauuaaaaaguaauaaaagaaucuuuuuuguuuguuuugagauagggucucaauauguagccuuggcuggucucaaacucagagacccgccugccuuugccuccugagugcuaggauuaaagauauacaucauuaugacugguccuaauaaucuuuaaaaaacaaacuagacuaacugcugauucaaaacacuaucuggccugcugauauguaugguuugaaaauauuaacaacaacaacaacaaaacccaaaaugaaacagacaaaccaaaaccaaaaugaaguaacaaaccaaacccuuaaaacugaucagagcuggaaagcccauguuaaaacacagaugaaggccuuuugacaauacuccccuauucucauguagcaauaauuaguuaaaauuggauagugaccccaguccuguagguagaccacaacccuuuagcucaccauaaucacuuucuaaaaacugugagaaggaaaaaaaaaaagacaagccucaggaguauaaauguaguuucuuauggaaguaaaggggugaaacaccaccgucaagggcacaugaucucccaacagucacuaaugagaaacugaaagagcuuuccaggauggguaucugcacucaucaaccauggucugauguccucacuacaagacucuaaucauacaaaaacugcugccgggcgugguggcgcaugcauuuaaucccagcacucgggaggcagaggcaggcggauuucugaguucaaggccagccuggucuacaaagugaauuccaggacagccagggcuacagagaaacccugucuugaaaaaacaaaaaacaaaaaacaaaacaaaacaaaaaaaaacccauguggguggagggguggcauguuuggagagacagaucagcaguuaagagcccuggcuguucuugcagaagauccagguucaacuccuaccacccacauggaggcucacaacuguccaguuccugaggauaugcaggcauacaugcagacaaaauacccacacacaaaauuaaaagcaaaacacaaaccaaacaaacccucaaaucaaacaaaaccaaccaacaaccaaaaaauaaaaacaaaaccaaaaaaaaaaaaaaaaaagcccagggucaucaagauagcucaacagguaaaagcacuugugacgccugauggccugaguuccaccccauguuagaaggagaacugacccuucaaaaacacauggacacuguggccucaccucucaacccaauaccuuuuucuucucucccuuccuccucaaaacuuaauucugguucaauaugccccauguucccauuuaggaaggaugucuauuguuugugggaguuguucaaacugcaggcugcuugcuuaaacccccacaauagugcccacccaacagcuccuggccccacucacccucucauccagaucacuuucugcgucacacugagaagauaaagagaaagacaucaggggauaggagagggacccaacagggaagggaugggccauuacagguaggugacacuuacuauauauccagcuuccagagagugacgggagaaggccugagaaagaccagaguccagaaguaagggaggcugacugaccaagcaacuguacaaagccacuacucccagcaagaccuucaagaggacuuaaaagcuacucuccaucaugcucuuguuucucuguuuacuuccaccuccgcuaccaaccagcuuacuauuuuccuaauacucuagguucucaaaucuuaaaacuguauucaaaacaacuuuuccucacuucuuuccucagcaaacuucugacuacacuggggcccaagacguucuagggggcuuucccuaaccgcaacccucugcccaucccccagacagaaugaguggcuuccucauguggguuucuguagcacuuugccuagaucucucccagaucacugccuuacacagcugcucaagcuagucuaggugcuugcuuuuuggcuguuucuuuccccuuaggcugccaccagcuagaggaaaggacaggacaucucuuauuuauaauucagcugucuuugauguaucucuugaauuaucagcuuguuaguaguauacauagcacaagcaaaagcaagugaguuugacucuaguuagguccuucagaccuggauuggagauggggcugcuguccaauuuguucugccuuccccugugcuccuagacacuaggauuacugcugggaucggcaguugugaugcucgugggaagucagucuacaggaaugauauauuccgacugaacaaauuggaaggacuggaaucugggacaugcucaccucuuuccuucuucgcuuauugggccauuuacggggccuauccccagagggucggccaggcucacggucugagcuguccccugguuccccaguggccccacuggagcccccccucuuccguuucccagaaugcuucagccgauguuccagucguucugggggcugaagagaugcauccuucuguagaagaggugguggaaaugugguuggagaaagaaaagcuccuuaacucucuaagggugaccaaguuacucaagugccucucaagcaggggaaccuagguaguccccagacacuagcucuaccuccucccaccccaggguggggcagaaacccggcaagaggagccgguugcucugguuuggggugucaccacugcccccucaaccccauccucuguaagggcuauacccuucucucugcccuucugacccaccucccaaagacccccaaaucccauuagggcacaccugcaaggccucaaggcuggcaaagcuagcgauggcaaaaccaucgaucaggucuuccuccucuuccuccuccucaggcuccuccucggcuucuccgucgucugcgccccccucuuccuccucguccucuuccucuccgcggcugcccgaaccggcaggccgcuuccgagcucgcggucucgggggucgaggccugggucggggccgccgccgucguaggcccccaggccgcucuccagaugaagcugacgaccagggacgggcgggcggcggcggugacgaggaggaugaagagccucgcggggcggccaacaaggcccggggcgcgucaccgccuggaccucggcggcgccgcugcucccgaucacggucucgccgcgagcagcgucuccgucgccgcuccccuucagcugcccagcccgggccuggggccgcggccgucuccauggugacggcccucagcgccgcauccggaggcggcggggcccgaagcggccuguccacaggccccgggucgcgagcgcggcgcuggcgcuugcacagggacgggagagcuccggcuuccucuuuaaaacaggauccgcuggccucuggcuugccccaaggccaaggcccagagagccggcgccgcccccggggcgacaagccugaaggcccccccuguagggcuggcggggccgcgacgacuaaaacugggcggccgucccuuuaaggcgaggccucaaauuguccagcccccggccccuuuaagacgacuccaccguguccggcuggucuagugcgguggcggccccgugccaggggucgaggcaagucucccagaggaagaggaaggaccaccccuuuaaaaggggcggaaagcacgacuuccccuuuaaaagugucucaaguccuccggcugaaagaggccaccccuuuaaagaguccagaggccuucaaacagcgagucgucccuuuuuagagagcguagcuaaguuucuagcccuucacaggcugucacuuccccuuuaagaugaauuuaaugaacuucuugcguggggcaggagguaggaaaacuccacuugccccaauucuuccagcaggaguuguuugucagcuucugcuguccccuuuaagacuggcguuggagucggccgaguucgguacccaccccuuuaaggagauuuaacgaggucuccgccucccguagccuugaaaggugcaagggggcggagccugccguccaaagucccggaugugaggcaacggugacggauagagcuucucucucuguccuccgacauaaaagacucuuccuccuuuccuccguuccuaaccggcuuguagcuagaaggauccggaaaggccacuggacagugaggaacuccgccguauccuccuguugucuucuucggcgucuacggcucuucuccaccagaacuucccugccccuccucccucuuccuccucagccaacgccuccuuccucucuccgccuccuucccccucccuccgaggcucagucguuuauagguuggcaaguaaacgucaaugcaaagggcggagucaaagucgccggagugccggacguaacagccuucaaaugugggauuggguugucagguuagccccgcccuccccaggucuugugacuggacugguccgaaguagguguuuggagcaguuccuuaggccacccgccucuuccugcucucuguuuauuggccaucuacugagagacagugcgaggcacugggagguggugccuggagugguaggcagcaggccacugguaggcguuaggcuguccuaggugcgcuuuucugguguguaguggcugccuuuuugccuguugguauuucgcgcaagcgcaug

SEQ ID NO: 4114 - RNA, 2436 nt, Mus musculus
gggggauucccgccagaacccgaucccauagaccgggucacaggacucagauguccgcguccgucggcgcccccacauccacagaccgcaaagagcucgggaaggaaggguucgugcgccaagucucgggcuccuaaauggcuuauggugggcgcgcgcccggacuacucgucccgugcaccccuuucccucguccgcgcccccgaggggaggcagguuggugggcgggcagaagcgcaccuggguccguccucucgagggcugcucguucgcgcacgcgugcgcagaagggcaggaggggggcgaggcgccgcucugacaccaggugccgcucggcccgacgcccucccccccacccccggcuccgggagcgcgcgcaggcaaccucgcucgccagccccggggccccgccgggcggugcgcgcgcagcaccccgggaaggugggaagcggcgcucgcagaugcgcgcgcaggcacccgucaggggaggggaaaguguggggccuccgccaucuugucucccucuccuuaccugcguccucgggggcgugcucaccacccccccucccgccgaggaggggggagggcccccucuuggucgccgccuucaccacuuuaaauuccccuaagggccguaacacgagccaccccgaugcucccaccgcuuccagucacgccgcgaagaggugcuuggugaguugaagaaaaaggagacgcuacucccagcgaccccgccgccgccuccgcugcucccgaggccucaccaaaauggccgccgccgucucggccgccaccgccacuagcaccaccacuaccaccaccaccaaggcucguuaucgcuaccgccagagcggcccgucuucucgcgauacacaguaacuggaggcugaaggggcggguaggcucgcgugcuagcguaggacugugcggcgcaaagcaaggugggaguuguaguucgcuccgaggcuccaugcuggcccagcacgcuucaauaggucugaaacucgugcugcauugcagcugcccacugggaccacccuuuggauuucggaguuuuuguucuuacauaucacccagugaaaugaaacaaaugaguagaagagcuuagaccuacugauuccuacagcaguuacuuuuuguuuuugaaaggugaggucuaacaauguagccuuggcugacauggacucgcuauguagaucaagcuaaccuuaaacuuacaaaguugcuccugcgucugccuggaaugaacguaugcaccaccacuaccagcugcgguugacuuuguaacaccgguuuucccaagaacucucaaauacaaguaccauagguuugcagucuuuuacauuuaagaacuauuuugagagguugagaacauagcucagugauuaagaauauuggcugcuuccacuuugagaggacauucuaucuccacacuaaagaagcuccuaacaguuauuccaguuccaaggaauccgacacccucuucuggccucagagagcaauacacaaacacggugcacagacauacacgcaaguaaaacucccauucaagucaaauaaaaauccuuaaggaaaaaaaggcuggguggugguggcucauggcuuuuaaucccaauagaggcugacgaaucucugacuucagagccauccuggucuaugaagcuagcucuaggacaaccaaagcuacagagaaaaauuccugugucuaggggggaaaaaaucucuuagagaaucugauacucccuuccgauuuuaaggaugcauuuauuaucuacaacgguuccaaggaagauuuugagccauugguuacauaacaagacccugccccaaaacauaacuaauaauuaagaaaacaggauaaaaauaaaucagcgauggacagaggagaagcuauugaggggaaauggaaguugaauagagacuggaagaaagauucuuuacagcuagguaugguagcauaaaugcacaaucccaauuuacugguugaggccaaccugugcuguugcauaagucaauacaaacaaccacacagagcacacacacacuaauauucuaaaguucaagauuauccugucuaaaaaaaaggauaugcauauaaucuuauaguaacuauguguugcuuuuuuucacuuuaguacuuuaaagguguguguguguguuuaaauaauuuacagaggcagagcuggagagauguuuuaagugguuaagagcacuggcugcucuucuagagaacacaggguuugauucucagcacccacauggaagcuuuuaacaguuucuaacuuuagucuuaagggaauugaaaccuucuaauacauagacauacauucaggcaaacacuuauaaaaauaaauucuaaaauuacagagguaauaaauauuugcuuuuguaaaaauaaauguaguaugaauuaucaguaaaaggauuaucugcaaa

SEQ ID NO: 4115 - RNA, 13974 nt, Mus musculus
auuuccaacucagaaaagccacaagaacuuguuagagcugagguuacagccccaucaaccucaucuucagccaccuccucuccugaggguccuuugccugcccguccuccacggcgucgaaccagugcugauguagaaaucaggggucaggggucuggccggacaggacagcucccaggucccaaagugcuucgaaagcugccaggaaggcuaguaacugugguggaggaaaaagaacuuguaaagcgacggcgacaucgggcaccugccagcacccuaguaccugggguaucugaaguuagcgccaguccaagaagcccaucgauccacaguaugucagggccagaauccucaccuccuagcagugggcccugugaagcugcuccuacaucuucacugucuaccccaacccaauccaccuucauagcuugucgucacaaugaacuggggacgacuacugggggaagcccagagaauggagaaggaacagagcuugccaucacuccaccugcugugaaacgucggagggggaggccucccaagaagaacagaucuccagcagaugcugggagagggguagaugagguaccuucauccaucucuaaggggaaaaccaaugggguugacccaguccccggcccugaaacaguaacuguugcagaaccugaccucaggccccaauuuguuccugggccccagccuccuggaccccaaccaguucacagaccagaacccaccauccuaucgccuguggagaaaagacggcgugggcgucccccuaaagcaagggauuugcccauuccugggaccauauccucuccaggaggcggcaauuuagagagccgaacacagucgcucccuuucccagcaccccugacaccacuccuagccugucccacugcugucaccaacacugucacuacugucaccauuucaacauccccaccgaagcggaagcggggccgaccucccaagaacccaccaucaccaaggcccagccagcacccugucuuggaccccgacagcucuucuauucuugagaguuguggacugggagugcagcgccaaccccugggccaggcagaaagugaaggcaguuccucugaugaggauggaagccguccucucacccgccuggcccgucuucggcuugaagcugaagggaugcggggacgaaagagugaaggguccauggugauggccguaauucaggaugaccuggauuuagcagauagugggccaaguggguuagaacugacaccaccuguggucucauuaacucccaaauuucgcucaacccgccugcguccagggucucuaguccccccacuagaaacugagaaaaugccucgaaaaaggucaggggcuccaguugggaguucugggauggcaaaacgaggccgcuugcagcccccaaguccccuggggccugaggguucaguagaggagucagagguagaagccucaggugacgaggaggaaggagauggaaccccacgccgucgaacugguccccgcaggcucguugggaccaccaaccaaggggaccagcguauccugcguaguagugcuccuccccaccuauguaucccuacuauuagucacagaggucgaaaggccaagacgugaaugggcagccccuucacuuauguaucccaccauggccgcuuucccuugcccaggccugacucugauaaccacuacuugaagucuuugagggaaaaagccuccagggagacauagggggcugucuuccuuuccaccaaaguaggggguagguuacugguugucauggaaauggggcuugucacaacccccuuucucuccuauauggcugggcaguguuaaggguggcaagauaguuucuguccccacccccuuguacuugauuccccagcugucuuucacagccucaaacccuuaggguaaagggggaggggcuuuucaaugaggugggguggguuuguuuuguuuuuuuuucuuuuuuuuuuucuuuuucuuuuuuucuuuuuuuuucuuuuuuuuuuuuuuuuaagaaaaaaaaaaaaaagcauaauaaacuuaguuucuguacaagcauccguguaaggaggcuucugauuuucuggucugguggaggguugggugggaauuuggacgucauuuuucaccucccucuuacaaugacuccaugacugaucucuaaugcaagguuacccuugaagcagaacuuaaucccgcucccagucaaaaaaaaaaaaaaaagaaaaaaagaaagauugucaaaucugaucugguaggcuauauagagucuuuuaaaccacccagauaaacucuuuucucugagucuugaacuugcccucaguucuccaacacccgggaguccccuucagucuccuuacucaggugcuuccuuacacuccugucuucagaaagcaggcauccuccauuugcucaugccuuagcccuccucugcucgccaucuagccaaacugguuugagcuggccaugccccuucccagagcccugggcucuucacaugguggcuggcccuacaacucuaccuuggcuuggcuuggagccaugagucagcuucaucuccacccaagccaaaucaaacccgaggcaagagccgaaacucacaguuccucaaagccuauggccagguaagaaucuaugcuuauguuuauaguuucugaccauaacucccugggcccuuucuuaggcucuuuucauuuacugacaauucauuucucaccucaacugcuguugcagcuugccacaucuuuuugcucucucacauucugcauuuuuguuucuuguggcggggaaccacaggugguuucauguguccaggcuguaggauaaugauuagacaugaggguggaaagauauuuugaugugcauagagggccugaguacuaggaaggcauugugcagguuucugugggcaaagucauuugaacucugcuaaucugauuggguuguauggucugggauaaaguagaggugacaagcauagaaaaggaggugucauauucagggguuuuguuuugagacaggaucucauguauccucagacucagcaaugcuggccuugaauuuagaucuuucugcuucuguaccgaauugguauuaucgaugucugccuccacuccuugguuaggugggauuuuuuuauuguuacuuuuauuuuguuuuguuuuuauaaacaucaaaaagaacuuaaccauaugaaucuugccuuucuuuuauccuccaaacuauucaugcccaggguuuggugguacacgccuuuaaucccagcacucaggaggcaggggcagauagaucucagugauucuaggccagccuggucuacagagugaguuuuaggacagccaaggcuacacagagaaacuaucauaaguaagccaagcaaagccagagccaggcagucucugaauuugaggacagccuugucuauauacugaguuccuggcaagccagggaggggcuacauaacgaaauccugugucaaaacaaagccaaaaaaaguuaccuaguaauaagguuuuaagaugauaucucucagccgggcaugguggcgcacgccuuuaaucccaccaguugugaggcagaaacagauuucugaguucaagcccagccuggucuacagagugaguuccaggauagccagggcucgaaaagauuuaaaaaaaaaaaaauucuaucuccuguuucugguagccaggucagcuucauugucuauauuuauugaagaauaaguacauucacacaugcuugcccuucaaaagauucagaaucuucagcuauggaaaggaucccgaccacguaguuagucuucucaccugagucacuggaggaauuucccaguaagacagcauuccugaguguaggguuaggacacuagacagcaugcuuugagaaggguggagucaccaugcccgagcaagagcucauuuguugggcuuaaaagugccuugacuauaucauccacaggugauggaggacaaggagaaggcagcggagagcuuggugagcaacauggaagcugcucauucuccauccccuauccacugccgcuggcuccgccuccaauauuuggcggcuacuagcauuaucuguggcuguucuugccuggggaucauggcucuuguguuugccaucaaggugaggaauaaaauuccuaugggacugggaggguauaaugaaaugacuguaucugaucugucuacaguuacgguuacuacauaucuuuugaugcuuagcucugagcuuagugacagaguaagaauacuuucuaaggacucgugucuuacgaaaacgaaaguuguaaaaauggauaauuaguagaauucaguucauuaauacuguaguacaggagaagugugaguguauugaggauggaagaacaauucaaauaaaggcaggaauauuugagauuugacaucaaaggauccagauccugaaggccuccgauucugaacuuaggaauuuuaacuuuaucuugaauaguagaaagcaauuuaaauuuuuuucagaggagugacauggccagauuuguguuucagaaagaucuacucucaaaccccccauugaggcugaaucacaaggggcaggacuacaggcagacaguuuagucgugaugagaaggaucuccaucgugugcaaugaguagagcaguuguuagagaacagucugcaccccuccugcuuuuuguuguaauugggauagggguggcauuacuaggaauugaguccagaguccugcuuaugaaaagugauaauuccagcauacacauauaccuagugaaaggcuauucaaacuaauuuaaacauucuagaauuuucucacuaccucacagucagaaacauuuugucaucauaagaauuucuuuuuuuuuuuuuuugagauuuauuuauuuaauguauauaaguacacuguagcuguauugaugauuguaagccaucaugugguugcugggaauuugaauucaggaccucuucucgcucaggucgggccccgcucucuccggcuuaaagauuuaauuauuauaucuuuacacuguagcugucuuaagacgcaccagaagagggcgucagaucucacuauggaagguugugagccauugugugauugcugguauuugaacugaggacuuucagaagagcagucagugcucuuaacugcugagccaucucuccagacccaucauaagaauuucaguggggcaaaaaccauaaaagcaguccuucaugauaaaaaugguggugccuuuuggaccaugagagagagaaugaaugugggacaaauagaaaagaauggaaauagaaggauugcaaaguauuuuccaguccagaaauguaguucagcagaguacuugguuaguaugcacaggcccuuggguuccaucccaaaccacaaaacaaaccaaaguuauuuaagauacagucuuugugagcuaacuguggccaguugaaaaguaaggcagaacuaaaaugaauacuuuguauugcagaugagccaagaaagaccagaaaagguuguaaaguguuuaugugugcaauuaugagcuaugauggaucaagaagugaaauggggcaguggguacuuugggacagaagcagggggagaaucuaaccaagaaccugcccccaacaggcagaagagcggcauaaggcaggccagucggaggaggccauaugcuugagggcacgggcccggagacucauucuggccaguuuugcugucuggcuugcuguccuuuuucugggcccccugcugcuguggcugcucuccuacaccauugcucaggcugaauaacccuggguggccuuugcugagagucagucaagaccuggauccaauccaacauuucggcagugcucaguucuggugacaggagugguucgugguucuuccugucuggaagaauguugccuuuggaauggagccauuggaagagcucaacuaggcuauucaaagcaccugagacuucaaggggaggucagccuauguucuuucauuauucuuugcuuucucucccuugcccuuccauccuaggagccuccauuaagagaaagggaugaaaaccaggcuugauuuuauuagaauuuguuuuguaauaaaagucuuuuuugauggugaaauauugucuaauugcucuuuuuacugauuuuucccuugggccuuuggugaaggcaagagaagacaucuaaaugaugacuuagccugcaucuggccuuuuaauucuaucucauugcuccaaaagaaggaaagguuugggguuuuuuuuguguuuuuguuguuguuggguuuuuuguuguguuuuuuuuuuuuuuuuuuuuuuuuuuuuuacauuuuuuagaaauuuuccuuggaaaaaaaaaucgagcuucuuaucagaaccuaaagacaugaaccuaaaaagacagacuaaaagaauaguaguaguagcuagcacaccgcucacugaguaauuacugcuaggcugugcuccaggcauuguuucuuucuucugagaccucacaauaguuggugccauuuuucuuuauaguugaggaaauggguauauauguguccuaggcccuaaugcuagaaaauagaaaagauaugauugaauucagacaguuugguuccagagggaugaaaagauuguuuuauaggaacuaccacccuacauauugacaguuuuaaauauauuuuauauucuucaucuuaaaacuccugauauuuuagauuuuuagguauggaauaugagccugguuuuguuuuauugagucagguugucugucccucagacuugcugugcaagugcugagauuacugguguauaccaccaugcuuuuuuuguuuuuguuuucugaaaugacaaggccucaccauauagcccauacuagccucaauccugauucuccugcuucuguuccugagugcuagaauuacagaugugcacugccacacucugcuuaaacagguuuuuaaguuuuaaaauauacuccauaagcagguucccaaacaaauauaaaguuuaaauuaacaccuagccaauaccugaaagcuacuacucaaauugacugcugucaguacuguuuccuuaauagacucuaaucauuccuuaccacaaguaacuacgauucugacuucucacaauguaacuugauuuugcuuguaucugcuuuauagaaauguagucaaccaacuaaggaguaaauaaauguuaagaauugggauacaugagggcuggagagacaugcaacaguuaaaagcacuagcucuugcagaagaccugaguuuccccuuaccuacaugaugguucacaccuccauaauggcaguuccagggguuuccagugccuucugaucucuacagguaucaagcaugcauguacugcacauacaggcaggcaaaacauucauacauaaaugauugauuuauuuauuuuauguauaugagcacucugcugcauguauaccugcauugccagaagagagcaucagaucccuuuauauauagaaugucaugagacaccauguggguauugggaauuugaacucaggaccucuggcagagcagcaagugcucuuuaacugcugagccuucucuccagcccagcaaaucuuaauggaauacaagagcaucuucuucaaaggagcuggagaaaggacucaagaguaagaguacuugcugcucuugcagaggacccaaguuuggaucccaacacccauauccagcagcucaaaacuccacuuccagggaauuccaucacucuggccacugugaacacacacauaaauaaaaauuaaauugucuuuauacagauggaguccuguuaucuuuuugucuuugcuguuaacauuguauaguaaguauuauguauuccuguaauuuuguugcuauguuauaugaauacaguaaaauuuguucauuaucugauggaagcauuuggggugccaaaucaugaacauuauuaaaucauggauauucuuauauacacauaccauuuugaaacaggguuucaaaauguagcuuacuauguagcacugguugucaaauucaaguuuucagaccaggcuggccucaaccugucugcuuccugugcaacaccauaccuggcucuuguacuugucuuuugaagcuuacauguguaccucacaaauagaauuuuuucugacuaccauaauucaggaaagaguagaguuaugcaaauuagagguguacccacugaugaugggggaggggugguacaugauggcugucaucaguguuccacaauguuguuuuacucuuuuugggggagucaugaauauguucaccccagauaggacaccaacaguaaaccaaagaaucaguccaagucuaguauaaggaaccaguggguuuauugggauuauuuauggaacauagaugacucaaaggcuacaucccuaaaaaguccacgucaccauggacaguaacucacaaaagcugcaucccuggaacugcuugaccaaagguuuuucuccuuagcaauugcuuacuaauuguauaaccaaaggaaaagacuuccugagucuuccaacuaugagcuuccucauuaagugccuccuugcucuuaaggggaaaaccuuucagcuaggagagaagagcugcgcaccacucuaccucucuaguucuucagaucccuucuuuucaccaaacucggaggauguucccugagguuuuuguuuuaggggaaugggauggauugacaacgacgucuggucauuucuuccauuuaugauuuagaauugccacagugccacagagauggucacuuauuuuuagaagcuugacugacucuaaaugucugcuaccugcuggaaaaaaauucccugggauagacagaugucuucacaauuaagagcucguaucacccuaacagguuccaaguucaguucccugcauucauguuugccagcuuagaaacagcucuagggaaucugauguucucuggccuccacaggcagcugcacucauguacacagacaugugcaugcacauaaaguaaaaaacaaaguugaaaguuuccuuuuguaaccaaggcugacaguaguaauaaccuauggauauaagcaaaaauuauuguccaguaguccacauuguaccuucugauuuuuuuuuuaaagcuagcuagcagcaauugggcucacaauucagucuaauugauuucuccauaucuuacaaccaaugugguguuucaacaacugacuuaucaaagaguuugaugcaaccaauagcaauaacaaugguaucuauuuuccagggccccagaggcuuuucuggcuacaucucugagaauauacucuauucuggcacugggauuuucaucuaaugagcuuuauagcuucagaacguuuuuuuguuuuuucucuccagccacucugggugccccuguggaaauuauuucauugaaguuuuuacuguuccuccaauugcuuucuuucuuucuuuuuuuuuuuuuauaaaaggguuuuuuuuaacauuuauuuauuuguuuuuuguuuguuuauuuauuuauuuauuacauguaaguacacuguagcugucuucagacacuucagaagagggagucagaucucauuacgggugguugugagccaccaugugguugcugggauuugaacuucgaaccuucagaagagcagucuggugcucuuacccacugagccaucucaccagcccuccaauugcuuucuaagucaagggcuaacauauaaugaaacuuuuaucacagaagauuggcaggcucccugaaguccuuuccaucagagggaacucugaaaacaccauuggcaagauccaauacauuugaaucaauucaucaggagaguaauguugguuacagagcagacagaggacaaugcccuuccaacauugccauuucccaucagcuaucgucuccuacuccucggacauugccuuugggcuagcacaucacccaugcauccugaauggucucaaguagggcuaagcauuacuuggucuggaccaaagcuaaaugaaaggcuagcagaugcauauguagccuacaucacuugcuacuggagccagcuuccagugucugacaggcucugaacuuguguccagcaucucuccauugacuguaccuaacugaaauaaacuccauucucuuuacuuuuucauacagauuaaugugcucuggggggauaauugccuaccacuaggaaaaacuuugguaaaggcuuuuggcuuuuuaauuucacauaggaauucugucuugauuaaagugccacauuugucucagguucuuuguuguucuaauuuuuuuauuauuacagauggacuuuaaauuuuuaauuaaauuauuaaauuuugccuacauuguaauauauaugccaugcuugauuuaugucaaggaugaucaaagagguuguuagaucaccuggaacugaaguuauagauuauuguaagccacuaugugggugcugggaacuaaaccagagcagccagugucuuaacuacugguucaucucucuaauucccauuuuuauugauuuuguaagugguauggggaggguuccaguacagcaugcaaacagaaauaagaggacaauguucaggaauugauuuucuuauaccacaugggaccuaggaauugacucacaucgucaguauugguugcaagcccacugaacuguauuucguuuuuuacaauggguucauguguuccaagcuggccuugaacuaacuagucaauaaggauggccuugaccuccuccuuccacuugcuauguacugacagacaugucaccaagcucagguucccuggccuuuaagugaucagaccgcucugccuuuuuguccuccccuuugauuguuuuauaccuuauaacuugauuugcaugccucaccaugagguucugcaagcuacuggcagcccugaggugguugcugaauuaacuuguuucucucucaugauggugugaggaucguccuuucaggcccaguauauuuggcacuaagcaugacuguccugguaaugccucccauuuuucuguuguccuccagaaucugaucuugagagagcuuuagccagugguaaucaaacugguguuucauacagacugauccaccagggauuccuuucccuuuuauucccugagauuaugcaaauuuauauuauuuaguuucuacuauacaagcacauuccauccaucccccgggucccacagcuuuuuuucccucccaacaggccauuagaaacuuuuuauuucuugcuuaaaaaucuuuucaggccaggcugugguggcgcaugccuuuaaucccagcacuugggaggcagaggcaggaggauuucugaguucuagcccagccuggucuacagaaugaguuccaggacagccagggcuaugcagagaaacccugucucgggggguggggguggggguggaucuuuucagagccagcaaaauagcucagaguaaaaauuucuaucaucaaaccugacauccuaacuuugauccuugagacccacauugccaaaggagccagcuccugugacaugucugcugaccacacacacucugugaugugcauacauacauauaacgugugauuuuaaaagucauuucccauucaagcagaucagauguaguuuucccugguuugucuguacuagacuuguuacuaagugcccccaucuauaugcugaauuaauggauuuuccccauuuucuguauuaaaggucggggagucucuucugcuucucucccucuuugcuuucaaaguucuccuaugaaccuuagguuuuuggaacucaagaggacuauaaggaacuaguuuguacucuuuuccaucuugcuugcucugaaaaauagcaagccaauauauacaucaucuuccaguuucucacauuuccugucaagucagaaacuaauauggaaggaaauauuuacuuaucuuugccuccuuguaauaccucuuuacacgaacaaguucuucugagccuuggccaugucuuacuacccacagagaagaccacaggacugccaccacagcccacuuaccaucccaucaaacacgacaauuugagggguguaauauuuucuagcccaucagccauuuuggaguguccccauacuuguggcagaccccauucagcaaggagacaugcuacccuacaacaaaugagaugacagcuggaucacucugaaguuuucucucucaaaaaugcuguucuuucagaauucugagcuuugauugcacuucuuauucauugcaggaaacaugcaucugccuggacagcaagguggcacaauauuuccuaccacacuggggcacaguaaucauccggauagcccuugccccugcagaugcuauacugagaccauuucagaaguaugucucguccccauaguagggacauggaaccgcaucucccagcuaacuguuggguuuguggguuccuguucauaugccaauugcuuuguuugacuuuacuggaaagaugugaacaaacacuuauucaucccagauagggcauacugaaggccaaagaaagucacuaaccacugaguuuauuugguuuuauauaggagcauagugacucaaaagcagcugcaucaccgaaaaucacuguuucuccuuuauucaucaggugaauaauuuauauacuuucucaauuuuuauacccaucucucucucucucucucucucucucucucucucucucucucuuuucagcgcuuggaguucugcuuggccuuguuccugcugggcaagcauucaauagcuaagcucuaucccaaguccugcugucaucuuuaaaauauguucuagucaaguauaaugaacaugcaguaaaccccaccuacuuaaagucugugaguuaaauggaauaucgggaggcucagguugugauuccugacacauuauuguuguccuuggucauuucccaaagaucccugguuccuuuguuugcaaccaagagaaaucagcauuuagacuuuauacuagcuucuguuuuggggguccuuuuagaaaucaauacuggaaaauauaaaauuauuuuuuaaucuguuuuucaccauugcccaaauuuuaccuguaguucuuccucuaguuccagauuucauauucucauaggaagacucuucgguuccuaauuauaugaauacauuauuuugacuaauuucagaauaauuauccccuguguaccaacaacaaaccuacuuaggaaaguucaaaacuauuuuugcaaguuguuaaaguuaagcuugaugaggaaaggcucuacagugacagaaagcaaaaacacuaaauuacuugguuuccuuauagaaaaagcuguuagaaaaucaugcuguaaucuaggcguccugagccuuaaaucccagcacucaaacugacugaucuuuggaguuccaccccagccugggauacacaacgaaucccugacuaacaagggcuacauagugagacaccgucuaaaaaaacaaaaauuaucauuucucuuuugcuggacuguaaccuugaggauuugcuuuuuucuuugcuguuacuccagaaccuugguuuuaggauaugucuggcuuuggaauuacucuaggcaggaccuuaacaaccuuguguacuuaaugcaggagggucugggagcaagacgguaggagucugugaccccaggaugauggacacuauccugaaagcucuagucaggaccaaacggccaagcugcauaugcauuuuguuuuguuguguuucucaaaacaguuucucuguauaaacagcccugccgguccuggaacucacuuuguagaccaugcuggccuccaucucaagagauccaucugccugccucgccuccuagugcugggauuaagcgugcaugaccacacuugucuacacgcagguuuccacaaaaaaaggaauuuuggaacaggcucuuacuauaauaaaugaggauuccagaaggaaacuaaaagggccuuguccgagggcacggugagguagugc

SEQ ID NO: 4116 - RNA, 9970 nt, Mus musculus
acuggcucucccaggcuuguggcagguuuuauuucagaugcagcgcagguggcgauagcuaggccaggcacaacccucgaagaggcucccuuccaucucugcccugaucuccaaguccagaguaguagggguaaagggcugguuucugugacaagcagcauucucaguuguaggcuuggcaaggcagggcuaaggucugagucccaaacaguuggaaugauagaaaaaaaaauguccuccuggagaguccuucuuucuggcuugcccagggauacggcccuagcuccguaccaguguagccucauccucugugauggcaccggagucuccuucgaguucaguggcagcaauggggaacagccuaggaggcuggugcuggaagagggcugcccgguucugcugcucacccuucuuuacccagugcccauagagccggaaggcacaguugucgaugaggcgccguacuggccgcagugcauaggggucucucaauagugcauucuuaguuaguggccguaaacggugacugcuuaaggccacucguccggcagccaguauuguccacacugccaccugggaaagggacaguauuagccccaguaaaacgcccagcacagggaagaggacaaggccuggguacagacccugcuacucucgggcuuacccggaaccgcuggcgaggcgugagguuccaagguuggcugccuucacagcgcucaaagaaggggugcugcagggcuugcucagcugucaggcgcgcuucaggauccaccugcagcagcuuggagaucuagagaaacuuuauagcaugagggucacaucuugggucuucccuaguauuguuucauggccccuacucaccaggucuuugacgguguuugaacgaucaucccacucaggugaaguaaacugauauuggccuuccaugaucaugcguagcaucaggauuuggcgccggugccagaaugguggugagccagccagaagugugaacaggaucaccccacaagcccagcugagaaugagaccauggucagacugacauaggcaacaagaaaggaugacacggaaggggaaggcaucacagagacuuacagaucaacuuccuugccauagccuggguggguuucauccauggagcauuuaaggaucucuggugcuagauacccuggagucccgcacaguucuggggagagaggccagaaguugaagggacugccgcuagcauucccugccugcaaagucucagcccccaagccucugcugcagacucucgauugcauuaagaacacaagugcacccuuuuugcuccugguuuccugcugagccucaaagcaagggcauauccccagcaaaccaccuuaaauucccacuaaagcucacgguggccuucuuaggaaaacccaguuugggaauggcuucaaagucuuacucaaugacaucauuuaucucccccaccuuuaagccaagcuacucauucaucaaaacaacuuguuuuaccacuaucucacauacauaugugaaaagcaaaauccuuuuuuuucuaggcaagaucucacuauguagccuuggauggcuuggaacucauuauguggaccaguguagcuucagacucaaaaucugccugccucugcuuccuaaaugcugggauuaaaggagugugccaccacgcccagcacaaaccuggaauugcuuaagaacauacugggguagucccuguuagacccuucuuaggguuuggucuaguuaugaucuacaucauauaugcaggucuacauagcuaguuccaguacagacauguagagacaaagugaaaaaaaucccuccacaauaacccuuccaugauucccucucaaggcaucagaaucguguccaggugccuauggcucagguuucucugucacuugacacgaucuguauuuuuaguuucuuguacuuccaagagaacucaauaagccuaaauugaaaagacuuuugggggcuggagagauggcucagcgguuaagagcacugacugcucuucugaagguccugaguucaaaucccagcaaccacauggugacucacagccaucuguaaugggaucugauucccucuuuuggagugucugcagacagcuacagugucuuaauauaaauauuaaaaaaaagaaaaaaagaaaaaggaaaagacuucacucucuagcacagaucaggagucaugagggagauggaccuuucccaagcucauuaccuuccaggaaguagguaagaaaugaguguuaacucaugggaaaauagaaaaacaaagcuuaaagugaaccccaaaucacucaaguuaagaaaggugaagcaggcauggcaaagguauuccaaaaagauguguaugugaaagccagaagggagaugacacacaguguccucaaggcccccagaacccacagguuaacaugagacucuacaguucaaguucaaacucugggcaccuaaucauaaaacagagacucugauacuauuuucuauugagaaauucuguuagggaaauaagccacaacauagacaucuggugugacauuugucucaugauaaauacccauuauuuguuugcuacuaguauaugcaguauaaaacuauaaaggacaagauagcucuugggauuccuacaucugaauaugcucaaaguuucccuucugcacuagaaguguguguguuacgcauguguaggcucaaggcuaugguugaccgucuuccucaauuacuuucuccuuuauguauuuagguaagacuuuucacuugagcccaaagccucacugaucuggagagucuaauaaccagcuuuuuccaagaauccccucuuugcuucauacauacugguauuucaugguugcugggaucugaacucugcuccucaaacuugcauggcaacuacuuuacccacugggccaucuugccagucccagaaauuuuucuuguuauuacaaaugagucauaucaggauccucuguagugugugaagcacuacagagaggucuuguuuuauccacacuucaaacugcugggacccucuggcucuaccuacucccucuuuccucccagaacaaagcccagaucugcaggcuccuccucugcaucccucagguucaucaggguucccuucuucuggccucccuggcauggcccucugcacacaucucaucccucaggugaagaagugcacugagccuuugcaucaagaguaccucagcagugagcagucacuuucuuuuccuugguaucagggacucaguucucgaccuggccaggcaaccucaaguuugggccugcuucccucccucugaagagaucugaccuccucaccucgaagcuucucgccagcuuccaaauggcaggagaacccaaaaucugaaaggcguaucugcauauugucaucuaggagaauauucucaggcuucaggucucgauguacaauguuguuggcauggagaaagcucacugcuuccaguagagaccucaugauggaccugggugaggcagacgucucuguuucucccuguaccaucccccuaggcaucucaagggcaucagggucuaccaguaccugguuuccuuuucugagagggccacuuucucggugagauagucaaacagcucuccuuuccgcauccuaagggauugggggagggggagaagagcaaaugcacuccuggagacugagaaggcaggaaggcuagcagcaggagcagcuugggagagagcacuccaggagugaaggagugaacuagauuccaggggcaguuugacacaguguuggugguugaaauauccuuaaugugucacaaaggaacacuuuuauuaagaauagcaacuucuugugguaagucacaggaggccuuucuugucugagagcagcuacagcugcaaaaggcuucuuaaagucaguauuagaauaugggccaaaaguucaaauaacaguuacaaaaagguagaauaaaaggauuuuggauggaauuugcuuuuuuuuuuuuuuuuuuuuuuuuuuuuuuugguuuuucgagacaggguuucucuguguguagcccuggcuguccuggcacucacuuuguagaccaagcuggccucgaacucagaaauccaccugccucugccucccgagugcugggauuaaaggcgugcgccaccacgcccggcuuggaauuugcuuauuuuaucacccuuuaaaauugagguuacggccuggugguggugauggugguguaaaccuuuaauccuagcauucaggaggcugaggcagauggacuucugugagcucaaggccaaccuggucuacagaaugaguuccaggacagcugggggcuacacagagaaaaccucugaaacaaagaaacuaacaaaaaaaccaaaaaacaaaaaaacugagguuccagcagggugguggcccacaccuuuaaucccagcacuugggaggcagaggcaucugaucuuuaaguuaaagaccagagcagcuggggcuacaaugccagauucuguuucaaaaaaacauacauacauaaauaaacaaauaauaaaacugagguuauauuuacaauucuaaucaguacucaaaaccaacugucacuguccugcacaguugcaggacagugaauacacauuccuauuuccccucagaauuuugcagagagccauuugauggcuucaugaauuuuuuuucugaauaauucagauuauuccuuccuuucucggauacaguguucugauacaaagcccaggcuagcccugaauugguaauccuccugggcuuagucucuggaguagugggauuauaggcaucaugauaaaucauacucuugaaauuuacuugcaacuagugugcacucuaccgcguuaacauagaaccucagauucagauaaaggaaaggaaaagaaccaguaggcacaggggcagcagagcagugugcugaguagggaaagacucccgaggaguuuguaaggaguuggcgcagugcucaacacucggcgucuagucuucucccuccucauuuauaaccaagagggacugggauggacccugcuggugucuuggcauuugauugauuguuauuacucuugaaguuucugccucaauaaugacaccuaaagagaaggcccaugccuuggacuuucagggaaaagaacaagagagagcccuggcaggagcagagcacgguauaaacagugguggugcccacaagcuguaacccuguaacccucagaccacacgugaaggcaagaacagaguccucagaugagcacggugauacucacaggucaaacaccaggaacaugaagcuagaagacucguaggaaucgaugagggugacuggggaaagaggcagaaaggcagagagagaugggaaggagcggauacaccuugcaggugcuuuuccacccacaggcagcaguagacuaguaugcuggggaggaaggagaaccaaggaggcugcagggacccaaagacuggccuugcuaggagguagagagaucgaggaagaagaccuagaggcaauucuagggugugggucaugaauagggccaguagggauagggggcugucagccagcaggagcagggaaugcagccucacugauauggggguggccagcgaccuggcgaagaaugugcaucucucgccguguggcaucccgcaccuccuccagcugcucaagacucagccgcucagcugacaccuccaugaucuucacugcgaacucaucaccgguagcucgauggacacagcggcggaccacagagcucacuccucuggcagaaucaaauaauagccuaaucaggcaucaucccacacucccccucucaccgguuuuucguuuccucccucucuucuucuucagucucccugcuuuguuuguuucuuuucuuccagacagggccucauuacauagcucuggcuguucuggaacugagggagaugcaacugccucuguuuccugagugcugggauuaaaggcgugaaccaucacauccuguaagacuggguguugcuguguagcccaggcuggcccugaacucaagauuacagugugcaccaccacaucgagcuucuacauucuuucuuccauacagaauagagccuuggaccauuaugcuuaccacaucagacucacaucaggacaaguacgaugaccucaaacccuagccuaucacugcuucacaauguccugaggcauguggguaccaagcgacaaaguaccacacagagcccacagaaacucagguaggugacuugaguuggauccaggaucuguccuuccccauuuaagcccugaacaaggcuuuucacaagaucccagaauuugcccuuugcaggaagugguaagaaaccaucuaagucuccauccaaaucccaaaucuccccuauaacucugaguguaagaaaagcccaauaaauguauauauaguggauucagggccucaugcgugcugggaagcauucuaccauuaagcuauauucccaaccucuagucauuccucauuguuaauaaacuucauugggaaucuucuaauuucaggaaguacaaaggcucaagucauguagaucggacuaaaugcugcccccaccgauccugucugcuccccgcccuccucaggcaucccagacaccuuuuacuuuaagggugcuuacucuugaguaauuaagccuuucuaauaagauucuacaucauuucaaaggggaaugcaagucuuaagacucaaucuuuuuucugcugacagacugcagugcuguguucucugcgaucuccuuaaaggucagccuugggcugggagaauggcuugggggugguggcugcugagcauggguuaacagacaaaauauaggacugggcuacagcucaaugguagggugcuugauuagcauguaaaucucugagcuuaaacccaguccucaacagaggcaaguguguaacacucagaaggcugagacagacgauuuugaguaccaggccaaccucgguugcacagagagacucugucucaaaaauacuagauauuaauaaaaauaaauaagugggcuuacccagggccccauccuuagcccugaacauuuuccuucaguaucuucuguaccucugcgacuucaaccucuaagcccagauauuucccuugucagauccuguuuuccuggacaucuuuccuuauggaucauaaagacauuuuaaaucuaucaugaugacuguauuuucucccacaacuaacuucucucuguauuuccuuuuuuuuuuuuucccuucagacacaccagaagagggcauuguauugaaucccauuacagaugguugugagcaccaugugguugccgggauuugaacucaggaccucuggaagagcagucagugcucuuaccggcugagccaucucaccagccccaaaugcuuucucuuuuaagcugccuuggccaugguguuucucacagcaauggagcagauacugaggcacagugaguccccugcugaccugugcugaauucuagaggcuuuaaauaucuacgugcaauugucacuguacacugucuuugagccuuaauuucucaccagaauccugguucuaaacugcuuucaugacaucuccaugugguaucuaaaugugccuggccaaaucuaaugccacacgccugccuuucucaggccucagaagcagcuccuggcaaccuucuaaaagggcauucuuucacuuuucuuacuagcucacagauggcaucuccccaccguccucuguagcucuucuaagugaucaggaaauggugacaugacccaggagccucagccccgucccuucucuacacugucccugcuuagugccccuuucuaaauguugacuccuccacauuuaugguuguuauccagacucaaacccacuugagagcauuauccauccacgggguaucucaaacuuaguauuuccaaaauaaaacuccugacuaguucacuccauuccccaaucuaauccuuccucaagucuucauuucaguaaaugguauucaggugcucaaauaaagaccuuaaaagucccccuguuuuccccuuccuuaugaccgauauccccucuccucugaagccaucacuugcaccugcuugcuucucuccagcucugcaaucgccacgaguccaggcgucaccaucaccagcccuucccuaucucuacauaaaggccagaaagagcuuuuuaaauuucuaaguguuuuaagugccaccacaaguguccuaacacaauuccccaacucacaccaaaugcacagcagacuagaaggugggcucugcuuuuacccucguuaacccaagcgcagagaguaagcgcccugcucacaagcacgcuccacgucaugguaccgcucugaaagcguccgcaucauggccuaaagccccauuuuccucacuuccuuucuugucuuuccccacucugucuauggucuagccacugccuugagcccugcacuaacugcccccucuaaaugagaagacaccccccccccccagccuauucucacacuuuaugucucagcucaaguccucggagcugagaauguggcucuguaguaaagcacugucucuuaggauggggcccugaguuuaauccccagcaccaugaacaaccaaacaccccucccccaacccuccugucauuuucuuagaagucuccuaaagccccuccucuguggagaccccguugauugaauccuacugccuacuuauuuuuuccccuaacgcuccuuucgaccuuuaucuuuuuuucauuauguaaagauagaaacauuuccaagacagaaacuuccucaggguuccuguucugucacucccucacccgguguucuuggugcuuaacacaacauaaccaauacacuaugcuucugaaacuaaaccauaaagcaucugugguggcgaucacaguagcaaucccugcuccccuccccgacaggguuucucuguguaguccuggcuguccuugaacuuccucuguaaaccaggcuggugucaacucaacagagauucaccugccucugcugggaucaaaagcauucaccaccaccgcccagcuccaagcaucuuuucuacagaccccuacuucucgaacuagauaccuuugaaaugcucacgugauggguauuuucuaccuucccguugucuggaccacaaacaauuguugacaauauagaugaauagaggaaaaaaugcggguuaacucggaauacuagccaagucacuaacuguuuuccacuguccacuuccuaacuauccagucuucagaaggaagccuuauuuccuggcugggagcugacuacacugggccgguguaugcuucagcugugaaggcucaccugccaaugauguccuuagggucguacuucugguaaaacucuuuggccgcagcccagucagggaguucauccuccggccccacguccaacgucauucugagggaugugggggccugggaggaggaaacggagggcagugagggcaaggaggcccacagguucugagaggaugcacaucguggcucccgggggcgcagcaccugcggcuggggcgccaggguccuggggguugggggugggguaggggaaggaucaggaccggggagaccacaacgaagggccuaggggggagggagggaagcagggcagggaagaggauagggaagggcgggaggggggaaagguggcucggaagaagggggaaauggcacaagugcgggcggcuguuaccgcgcaagcgcacuuggcguccacugggaggggcgcgggggucucgagcaggaugacccgugcgagcggggagggggaagggaggguggggggaggggggugaggagggaacagucuaaccugcgcaaagacccucagcugcuugguuuauguuuguuccuuugcuuuaaccuguaaggcucccacagcgaccuaaggcaccgcccccaucauugcagccaauggccccugcuguuug

SEQ ID NO: 4117 - RNA, 6277 nt, Mus musculus
cacuucuggcuggcucaccaccauucuggcaccggcgccaaauccugaugcuacgcaugaucauggaaggccaauaucaguuuacuucaccugagugggaugaucguucaaacaccgucaaagaccuggugaguaggggccaugaaacaauacuagggaagacccaagaugugacccucaugcuauaaaguuucucuagaucuccaagcugcugcagguggauccugaagcgcgccugacagcugagcaagcccugcagcaccccuucuuugagcgcugugaaggcagccaaccuuggaaccucacgccucgccagcgguuccggguaagcccgagaguagcagggucuguacccaggccuuguccucuucccugugcugggcguuuuacuggggcuaauacugucccuuucccagguggcaguguggacaauacuggcugccggacgaguggccuuaagcagucaccguuuacggccacuaacuaagaaugcacuauugagagaccccuaugcacugcggccaguacggcgccucaucgacaacugugccuuccggcucuaugggcacuggguaaagaagggugagcagcagaaccgggcagcccucuuccagcaccagccuccuaggcuguuccccauugcugccacugaacucgaaggagacuccggugccaucacagaggaugaggcuacacugguacggagcuagggccguaucccugggcaagccagaaagaaggacucuccaggaggacauuuuuuuuucuaucauuccaacuguuugggacucagaccuuagcccugccuugccaagccuacaacugagaaugcugcuugucacagaaaccagcccuuuaccccuacuacucuggacuuggagaucagggcagagauggaagggagccucuucgaggguugugccuggccuagcuaucgccaccugcgcugcaucugaaauaaaaccugccacaagccugggagagccagugccaugucugcugucuaguuucacagggaaacccagaaggugcucgugaaggugggggaugggacacuguggcccaggucuuuauuggggaagaugcugggaucacuuggucuuggucuugccuuugcugggaggugucuggaacggcugcuccagugcagccaguuugcugcucagccuuuccucgcucuccuugagccgcuccuccaccagcugcuggagcugccucagcuccuugcucagcugggacuugauguaggucuggaggaugcacaccucaccuacaggagaggggagaggcaggacaaggguugucugggagugagcugcacagaggggaacgcugcuaaugcugcuucaauuuaggaacugucagccauuuccucugaggcagacaguugggcaguguggccagacugcacuuucuguauucacauucuaacugcacuuucgucugacaucaggcagauuacuuagcgcaugcaucaggugugugugugugugugugugugugcaaaacauggauggugaugguaggauuggguuaauaugcacauuuaacacugggcauccuggggucugguaucacuagacugugcuuguuauugaaaaccacccucccaucauucgcuuucuguggccaccuguucuacacauagcaacaccccagaggcuccagcaccauggcucagugguuaaagacacugacugcucuugccaaggaucugggugcaauucucuacagccaugugguggcucuguaacuccaguuccaaggacguucacugcccucuuggugaccucugugggcacugacaugugaugcacagauacacaaacauggaagcagaacucccagauagagaaaauaaaaacaaaaaauaaagcucaaaaauuauaggggccacuggaacuaaaacuaaaguccugggcuggguaugguggaacuucuauaacccuaucacucaggaguuagacagaggcaucuugaguucaaagccagccugggcuacacaguaagaccuuguuucaaaaaauaaauaaauaaaacaaggguuggcaggaugguuccauggguaaaggagcuugcuguguaagcaagccugccaaccugacuggcccucagaacccacagaaagcugaaaugagacaggacuccaaagauccucugaccuucauacgcauugucauucugucuaacgaaacaagggcuggagagauggcucagcuuuuaagaggcagaggcaggaagaccucuaggaauuugaggccagccuggucuacauagcaagugccaggagaggcaggacuacauagagagaccccgucucaaaaaaguggguggguuacugaggcugucccccugaaugguagaacucugcugcacaugguucuaaucucacuccccagcacuacaagacaaaauggugguugccugaggugaggugggagggaucaaggcucagguaggcccaaccauuucgcggcaccuuaacccuuccaugugcucacuuggcuguugcucuggcuccgucacaguuuccggcucuuccuccuguggaguagcuacuugcucuaccaccaucaucuccucguuuucuuucucugcauagcagaaagcaggaagaggucuuggccccagcucuggcccagucccaaccuggcccacuuguacccaucuuacccucuggccagagcgugaguggcuguaaccccguguaagucaaagauagguccagucgcaccugaagagacaagggaagagaggcugagaggaagcacuugccauaagagaaagggggagacagguggccacucacugccuguacacaguaccuguggggugaagacauauuuguagagcuugaaguggcggaaguagguguugaccacauagucugccagugccagcagcuguuccucuuuaaagaggucaaugcugaaagggggccgcugugacgauaauccgggacguaagugcccugacaaccuccagaagccuacccagcuagucugccaaaagcagcugucuagaagcagggcaagccccagguggccuucagaggaagauggugggaaagagaacaggaauuugggcccgaucuugccugugguugggugaaggcuucguuucaggguacugacccugauuccaugacaaaagagaacgcugguaaaguagcgguagcauuccuccacguugcccagagggguagcuggagggaaacaaggugaagcugucagcccgccuacucgccuacucuuccuucugcuuuuagagcaggagauggagaauggggcagacuuaggaguaaguccuggucgcucuguuaauucacucaguaaacaccauauucucacucuacacuuuucucggcacucaaagacagacaagguccuucccucagaaggaugcuuuguuucuggucggaaaguauagaacuaaaguuggccucaaaccagcggcauugccccugccucagccuccugaaugcaggugugucaggcuugagcuaccacacgcggcaucauugggaagguacuuuguuguugagacagggugucacgugucccaggcuaacuuugaacuucugacucaucugccuuuuaggaaagaaacuuccuaagugcuaggauuauggauaugugccaccucacuugaguacacaggguuggaagugaacccaggauuuuguacuuaggcaagcacucuacuaagugggcuauauccccagcccccuauuuagauacuucucagaacagacccauaauauuaguacuauguguuucauuucuuaauaagggaagcucucaaaggugauaaaugugguacauuaauaccaccuaugguggaacacaaaucccagacugcagguucccuacuuuaguucuccacggucacuucugccagcccagccuccucuccuagggcucaaaccuuuugguggcuaccucccucuccucaccaacacaggccuugugaagaucuuggagcauggcacaggcugcugaugucugcucuggugaaaagcccugcuggcggcagaagauaagugcgugggagaagagguccaagauaauggcaucccgcaggcucugcucaggaaagccaagcuccaagagcucagcaagaacccuuggggggggggguggaagaggcaugagugacagacagcagggguucgcccgccccccaccucaccuuaggauuuauuucuauuauauggguaguuucccuguauaugugcaacacaugcuuuucugguacccauggagaccagaagaagguauuggauccucuggaacuugaguuauagacuauguggaugcugggaaccaaaccuggguccucuggaagaacagccauugcuguuaauggcugagcugccucugcagcccugaacacaagccucuucucgucuccauugccugacacucacucuauacuuuaaaguuugucauuucuugugucuccccucccaagaguucagucucgcccaacucaaacccauacucucucaucuuuuccacaguggcugccuucuccagucugugcauagaauggauguccagguauuuccugucaggaaaagaugagacaaaucacuggugguucauacaacuuccccgauggggcugcaacuuggagaguuucaguggggaucaggagcugagacuuggcgaacuugcuaaggaaccuuuagcaaaucauuucacugucaacggggaacaucauggucuagaauccagucuguagauuuagcagauuuuuuuuuuauuuauaaacccacugauuagaaaagaguugugccagguaguggugguacacucacuguacccagcacugugaggcagaggcaggcggaucucuugaguuugaggccagccuggucuacagagugaguuucaggauagccaaagcuacaaggagaaacaaugucuugaaaaccccccaaaaaacaacuuugaguccuugucuugcucugugugaccuugaugaaguccccugggccuuggcaucggugugcacagugcuccaucauugcagcuguguacauuccugccuuugccucccuucucacaccgccacuuuacacugaggcaccuggcacgcuggugacucguuaccuugagcacuucucagucucaucuuuguaaaacuggagagcccuggcuggacaggacuguugaggacaccuuacaggaguaauacaaaugagaaguguaacuuuuccccugggcucuccacacucaccacauacagauccggggcugggguagugguggcugcggagagaagacagauuaugggacaaauagauacgacaguauguauccccuagucccuaguaccucaugaauuucuagcaggucugagugugcuauaauuuuaacuauagcaaaauagguaaaaccgggcuucggugggcucgaaauacuauuuagcagccuauuuacaaucaaagcaacuccaggaaauucccuaauguugauaaacguaaugacuggcggcaccuuuuuugggaaaccuaaguauucacuagaggacaacucugucccgcccucaccgggaacaaguuggcuccaggaucuucagccacuuccacagggcuacuaguggcuucugcgggcgacucggucugcaugucuguuccguuccuuauggccgagccguccaccgagcugggacuccuguccaguuccuccugcaauuugggagauuguuccgacuccaucugcaccuucauucccaggcucuggcuggaacuggggguaaucaucucuucguccuucuuagccucagucaagggcucuccagccugggcucugggacagccagcucucccacugcaaagcccgguccugccccuucuaguguuucuucagaggcggugaagcgagaggcagccaauccgcagagggcgucuucccaacuugucuccccggugaccguuguuaaggaaaguagaaaguacaagcccacgccaaucauugaaaagauagagcgcaugcguaacgaguugcacgugccucuuagaaguugcuuguaagggugcuuuugagggucggucuuuuuaaagauuuaauuuaaaucuuuaaaagauuguguuugugcgugcgugugcgcacauauguacaggauguucgggagggcuccgcggaggccaggagaggaugacggauccucuggaucuggaguuacaaggggucguguaccgaguaccccgaacagcagcaaaggcuccaccccuccaucuccuagugcaacugcggggucaguaacuaug

SEQ ID NO: 4118 - RNA, 5487 nt, Mus musculus
ggaauaccaagcagcuuauucugggacuugguagagguugauggucccugcuguggccuuucauucugaugaggauucucugucccuuccagaaccgcugccagugcaguuucgagccccucucagugagccggccuuggcuuuugugguggcacugggcgccagcagcugugaggaaguggagcugcagcugcagggucggauggaauucuccaaggcugccgugucucggguggucgaggccucggaccgccugcaacggcagguggaagaacucugucagcgaguauacagccgggguuaguucuguggacccuacccugagaaauccacccuggccugcguuguucagaguccccaguaaaugucagccuuguucuuguugggacaacuuaguucagacggggauuucagcuuuaguuccugaaguggggcucuagagagacggcuggaggagcuguugaugcuggcagggucacagcccuucagcaggagggcucucuggaacuuugcaccaaccucagggguagcuauugucccacuacacugagaggcaagugcccaggcuuuuugaggcaagggguuuuuuccuccugcccuuaauucuccucccuaguguccauuuucuuggcugaauggucccucugugagcuagcuuagucugaguuugucauaagcaguuggugagauagcuggugcauaacacugagcacagaaacuccaggaucaacuaguucuuccuugguuauccagggacuccaggaucaacuaguucuuccuugguuauccagggacuccgggaucagcuaguucuuccuugguuauccagggacuccgggaucagcuaguucuuccuugguuauccaggguuuggcucucauccaggcuuugcauucccaggggacagugaggccccuggggagguggcacgggugcgcacccgggagcuaggcagagagaaccguaggcuacaggacuuggccacucagcugcaagagaaacaccaccgcaucucguuggagguaggaguugggcuuugggugcgguuagaacuugggcaggguuuggguuugcuauccgaggaccucaggaaacaggccacuguccacugccccuaguacucugagcuccaagauaaagugacaucgacagagaccaagguccuagagauggagaccacaguggaggaccugcagugggacauugagaagcugcgcaagcgagaacagaagcucaauaagcacuuggcagaggccuuggagcagguacgagaguggaugggaccaaauugaguacuuggggccccgguuucugcccuuugcauccacugugucuucuuucucugcagcucaacuccggcuacuaugugucugggagcuccacaggcuuucagggaggccagauuacacucagcaugcagaagguaagcagccuccucccccuccccuccaggucugccucggacuuuccugagggcaggcaucuucaucagaguccguuuccuggcauugcugcacauuuuuuuuucauuccuuucuacacuuguuuauuaaauaauugcagaacuuaacugcuaggagcuaggcgggcugaagaggacgaaugggagcgggagcuuacguugucuugagaagcccaggcccgugggcgcugcccuucccugagcaucucuuucugccuugaugcuguauuucaaugugugugaaaucccuuuguguuuugccucuuuguauuggaggcuaggucuugugauguggucaggcuggccucagacuuguguagcugagagugacugagacugauccugccauacuugccuucuaaguggugaaacucuaggcuuugcaccaccuuaccuagcuucaaaucaaacguuuucuuacuaaacuucaguucuuucucuuaugagggaauaauaaagauuccguggaaaugagguucuaugugaggaauagacagugcuuacguugguaguuaguugguaguuacauugguaguuacguugguaguuaguagauaguccugugcagggcugaccuccuauucccccaagagcccuuagaaaacgcauugcuuuggaaguuuauaggagcuuggguggggugcgugcuggacgacuggggaaaauacugcccauccuggucuugccuaccacagccccuuccacuuccuaguuugagauguugaaugcagagcuggaagaaaaucaggaauuggccaauagccgaauggcagagcuggagaagcugcaggcggagcuucagggagccguucggaccaaugagcgucucaaggucggcugugguuaggacuggaagggcuaggacuaaccucagaucgauccugcugcuaacacaacccuucuggacauuucaccgccagguggcccugcguagccuuccugaggaggucguucgugagacaggggaguaccgcaugcugcaggcacaguucucccugcucuacaaugagucuuugcaagugaagacccagcucgaugaggcccggggguugcugcuggccuccaagaacucccacuugagacacauugaacauauggagguauggucuuggaggagggcuggaaaugagacuagaucuuuagacuugagacauuccucagcuuccaaggggucuuguggaccugcugagagucccuugggcauagauuguuccuuggccagaggugagacuaggggauauaucuauuuuucuuuuuuuuuuuuuuuuaaugguuuuucgaaacaggguuucucuguggcuguccuggaacucacucuguagaccaggcuggccucgaacucagaaaucugccugccucugccuuccgagugcuggguuuaaaggcgugcgccaucacgcccggcuuuucuauuuuucuuccucuguuuuuguaagaccuaggcuaagagaacaaugagcugaagugagauuugaaccacugcuaccaaagaguuacuauuucuuuaauacuccgaugcaaauacacagcgugcaaugcaaagcccgcugaguggagcacagacugccuaagauguauagaaaggagguggcucuguugggguuuuuuccuaugcaccugguucugguagcaaguccugugcguuagagcagugugugcucuggaaacuucauuuccugcuugcgggacuaacuggguccaggaccacacaagaaagagcuugcuuuaaacaccuucagugccucucccucucccuucaguggucacagugguaaugguucaaacccuuucugguaaugguuuuacaguuaaccugucuccagucaaagucuacguuuucucuuaagagaagcagugagagggcacgggaagcccccagggcucguugucugcugcaggugcaagccgcagcucugcccagugaugcaaacgaguucuagguuauuccuguuaggcuuugaucaugucaacauuuaaagagauuaagcuggauugccaaauauuuuaggacuugggaaggauggcauauguguauucaugcuauguauguguauggcguagcauuuuuauguguaugaguguuggcuggcauguucaucuguguagcacuuacaugcucagugcccucugaggccggaaaacagcauccagggaacuggaguugcagauggcuaugaaccucccaguaaugguuggaaaccaaacucguguccuuuggaagagcauccagugcucucaaccacucuuuaucagggucucaguacauagguguggguggccugggacucacugugcacaccaggcuggccuucagugcaagauauucacaagauccacaagcuauugcuuccugagugcugggauugaaggcacacaucaccaugcuuagaguaguuaucugucuuaggaucauuuaccaaaauucuuuuuuuuuuuuuuccuggagaaacaugagaaaaugaaauaaccagugcuggcuuuauuucuuuuucuuuuugagccaggguuucugugucuagcccuggcuguccuggagcucacucuguagaccaggcuggccuugaacucagagaucucccugccuuuaccucccaugugcuaggaucagaggccuauaccauccuuccuggcagcuuuauuuuuuuuauaagcaauaaaucaggucuuccgauuaguacugaguaguugcauuuucauaggguugugugucuuucauacccaacccugcagagugaugaauuggggcugcagaagaagcugcgcacagaaguuauccagcuggaagacacccuggcccagguacgcaaggaguacgagaugcugcgcaucgaguuugaacagaaccuugcggccaacgagcaggcugguacgucgugggauuuggauagaagugggccucagagggguacuggaccaacucacccauggcgcuuagcuagaugcaauaaguugagcucuuuucuuuucucagagccucaggcugccacaggagacagguacauuaccugucucacagagagccugagagaugaaaagcugggcaggcaucgccagacugagcuacucuggccucuauaugaagauuuguuuuacaaagacuuauuguguaauccugugagccaaacuccauucugcauucugggguuuugccaauaaacagaguaaggcaucucugcuguucccgagggacucuaguggaggagcaguguacaauaaaggaaaagguaaaaugugagagagugaaaacgauuuucauaaaaaugcaucaggaaaccuagcaugauggcgcacaccuauaaccccugcacauggggaacagaggcagggagagcucugagugugaggccagccuggucuacagagugaguuccaggucaacaaagguucauaugcaaagcacauaaaauaaaaauaaaucuuuuuaaaaagaaguguuuuuguccccuauccaccucccucuccgccucccacuggcuagagcgguggcucaguaguucagagcacugacugccuggcucuccuagaggacccagauuugacugccuguacccauaauucccagggauccagcacccucuucuggccuuugaguacacuacauugcaaacacguggugcauagaaaucuaaguaaaacaccguacaaacaaagugaaauuuagaaacuaaaaagacuaauguuucuguguguaagcauuuugcuugcaugcauguaugucugugcaucucaggaaugugugccuggugcucagaggccagaagauccaucaccuggaacaguugaaguugcuguguaggugcuggaaauugaucacgagugcucugcaagagcagacaguguucuuaccuaccgagccguuucuccagccucugaggcuuugucugcuucucugugggcacugacuccgucuguggaguuggugagcugaaggagacagcucagcacacucacuugcugaccuuuccccagggccuaucaaccgggaaaugcgccaccugauuagcagccuccagaaccacaaucac

SEQ ID NO: 4119 - RNA, 8426 nt, Mus musculus
gccggccucugagcucccccaaaagcugaucuuccgugauuccacuagacacugggagaggggcgucaucagccaccuccuugcuuccauacccacccccucauuuuuucccaggcugugggaggcaaaggguuaaaucccauagagcugauguucugacuccaggcuagaggggcccgggaagcuggggucacuuccugcuccgucccagucacccugaacugguccccggguccucagccuggaaucaccccuugagaaggacccuagaguucccggcaucuagcccgucccccgaggcagggcacuuaagggguuaaguccccuggggcuggccucugccuuucggcuuuucccagaccccagagccgugaguuggggccgccuggguucccgggguggccuggaggcccgggacagccgccggggaacaauagggccaaggaggcggcgacgggcgaggggcgcaggccgggcccggggcggcgggggacggcggccgggggauugugagaaccgcgcggggaccgccgugggggaggggaggcgcgcgcgcccagagagcgaguccggccgggggcggcgaggcggccgccgcucucccggagccgggcagccugggcguccgcggcggggagggaacgccggcggcucgccugggcuuugggagccggggacagggugggugcucccggccggaggcgcucaagucuugguccgccggggugcggggggcggcgucgagggcggucccgcugccuccuggucagggucacccugggccgcgcgcaccuccgcgggaaggcagccgucuccggcaguccuucccgccucgguccucugggggucguccggggcaggaggcuggcgcucuugggccugggcugguucccaguaguagucgccucgcagucuuugcuacuucuugcauguggccugguuauuaacucuuucccuucuacgguaggcccuugaguuuuaaguuucucuguccaaguaucuaagcuccuaccuguucucggucagcucagcaggguaaccuucuccucuccggggggcccccaucucucccuaaaaacacuuagagauaggggauggcuaacucacuucucggcugcauuagcaguuggucagcuguccauugcuucaccugcuucacaccccagcuaccucuuggugagcuuuguccucuuugucccugugcacaaaguaccuaugcacacugucaccccgaggguagauuauuccagggauuccguuagaugucagcgcccuccugcagcccuguucucucuccuggggaucacccccgggauuuugagugacagauaugacuccuuccccugggggcucacucugacgaacuuaugucacuuuucugacaucgaucugcaaacugaucuuaaaagacacugaacaagauaggcuggcuuucugggagcaugagguguccagcucacucaguccuccagcagaguuuuuacuggguacuuguccuaggugugugaugaagcaucaacaaaaagaauaaggcagaaggauggguccccaggugugugucuggguggcuuuggggacauccguaccuagagcucagagacgcagccucucagaccuccucacugggucugacuuuugcagccgagggaacugggcuucccugcacuuuucuggcucauucucgggcuuccgagcucuccuccucuccugccaggagaccacaaguaggagucucaugugacugucaaggucaacccaugccacagggcaagccaaacacagaacgcggaauuuguggucuuagcccuguuacuucccgccuuggggccuuggagacauuucccccagugucuacuuacuaaucuguaaaauggacaaaugacucuuaagucucucaaggcagugaaaggaagaagacaccugguagucaccuaugcucucuacacacuugcuucccuccccuccuugcuuguccuuucuccuucauuuuguuugagacaaggucucggguagcugggacugaccuugaccuugaccuucugauccucugguuuccaucucccaaguaugccaccgagucaggcuccccuuuuccuugccuucgucuccuguaggagccccugacuucagacuccccuucccacccauaggcuauccucugugcuuggagaauggcaaacugcccccacucuuugugaguaguugucccuucagggaaacuuuuuuuuuuaaccccuuaaaaagagucagucucaguucucucuggggcucauaagggaaaaguuuauugcucucaauuagcagucccauaaaggaagaaaauuggagucuuaaugagcuuccucugauuugcaaaauaacacguuuccaggccucugggcaucagauguguggggugaaagccugccucccaucugaauguuggauagcgcuccagccuucagugcagguacagaggguuaugacgaugggguuuccauugccucuccauucaccgacuugcuucauugcaaucuggaagauuugcaguauuuggaaccaggccuuugagacuaaggggcucagugagaaauggugucggagaagugaguggcggcagguccccgagagucacacaagugggagcacaaagaaaagcacuaaaccuggucccauuguguacccaucucuccccaccagagacccuggaaccuucacagucugcagccgugggauggagccugagacggugcuguggggcccggaucugcaggguccugaagagagccagaaugaggcucauagaggugaggggcacaagggacugugggcagucacaggggagggaagagagaccagaccccauguucugaaaggagaugggggcuggagacucccuuucugucuguaggugcuggaagugggaacgaagaggagagcccucagcaggaaaguucuggggaggagaucauccugggagauccggcucagaguccagaauccaaggacccaucagagaugccccuggagagccccucccaggaugccucagccccucaggauuccccaaccccccuggguucuucccccuuagaucaccagaccccuauggacccaucagcccccgagguagucccuuccccgucagaguggaccaaggccugugagaccaauuggcaguggggaacccucacccccuggaacagcacaccuguagucacugccagugaacccagccugcgggagcuggugcagggacgcccaucuggggccgagaagccauacaucugcaacgaguguggcaagagcuuuagccagugguccaaacugcugcggcaccagcgaauccacacgggggagcggcccaacacgugcucagagugcggcaagagcuucacgcagagcucgcaccuggugcagcaccagcgcacacacacaggcgagaagccuuacaagugccccgacuguggcaagugcuucagcuggagcuccaaucuagugcagcaccagcgcacgcacacgggcgagaagcccuacaagugcacggagugcgagaaagccuucacacaaagcaccaaccucaucaagcaccagcgcucccacaccggggagaagcccuacaaguguggcgagugccgacgugcuuucuaccgcagcucggaccucauccagcaccaggccacgcacacaggugagaagcccuacaagugcccggagugcggcaagcgcuuuggccagaaucauaaccugcucaagcaccagaagauccaugcaggcgagaagcccuaucgcugcaccgagugcggcaagaguuucauccagagcucggagcugacgcagcaccagcgcacacacaccggggagaagcccuacgagugccuggaguguggcaagaguuucggccacagcuccacgcucaucaagcaccagaggacacauuugcgcgaggaucccuucaagugccccgucuguggcaagaccuucacacugagugccacccugcugcgccaucagcgcacgcacacgggcgagaggcccuacaagugccccgagugcgggaagagcuucagugugagcucuaaccucaucaaccaccagcguauccaccguggggagaggccguacaucugcgccgacugcggcaaaagcuuuaucaugagcuccacucugauccgccaccagcgcauccacaccggcgagaagcccuauaagugcucugacuguggcaagaguuucauucgcagcucgcaccucauccagcaucgccgcacgcacacgggcgagaagcccuacaagugcccggaguguggcaagaguuucagccagagcuccaaccucaucacgcacguccgcacacacauggacgagaaccucuucgugugcuccgacugcggcaaggccuuccuggaggcgcaagagcuggagcagcaccgcgugauccacgagagaggcaagacaccugcccggagagcucagggugacagcuugcuaggguuuggggauccugcccugaugacuccgccaccaggagccaaaccucacaagugucuggucuguggaaagggcuucaaugaugaaggcaucuucaugcagcaccagaggauucauaucggagaaaaccccuacaaaaaugcagauggccucauaacacacccagcccccaagccucaacaguuacgccccuccaggcuccccuuuggaggcaauucacacccaggugcuucagagagcagagcugaccccccaggacagcccucgaaaguccccgagagucaggagggcucaggccaaaggccaggccaacccucuccuaagugcuauguuuguucccacuguggagaaagcuuccuugauagggcugugcuccugcaacaucagcucacucacgggaaugaaaagcccuuucucuuuccugaguguaggacuggccguggggaaggggcaggacccagccccuuccuaaacgcaaagcccuuuaaaugcccagagugcaaaaaaagcuuuggccucagcucugagcuguugcagcaccagaaaguccaugcgggugggaagucccagaagagcucugagcugggaaagagcucuucaguccugcuggagcaucucaggagcccuuugggagccaggcccuacagcugcucugauuguggggccucuuuccucgaucgacuagcucuuacacgacaucaggaaacccauacucacgaaagggccuccacuccugaggacaccccuucagagucagccacauuguccacaaaccaggaagaugagggagaggccucuacccccccaaaaagcagcagccacggggaagaggaaagucccaaaacuguuucggagaaaaagcccuuucugugccccgaguguggagauggcuucacggagguugccacucuccuccuccauaggagcugucacccaggggucucccugugaaguaggucuggugaccagggaccacucucuccugauaaauuuuggggaaaggaggccagcccuaucagaucauagagaaguagagggucaagaacccugggaagaaauagugaguuugcaucagugauaagaagccuaagagaucgugggugagaaccacuuauaagccguagagaaaaacuccuggguuauaagcccuauaaauauguaggaaaaaagcccuuuaagucuguagcagagaaaucuuauaaaccauaguggguaaaagcccuauuaaauguagaaagagguucuaacaugucuguagacaaccccaugaaacuguaucaaacccuuaucagaauccucgagugggggagguauagggaacacagcucuacagcugggcacugacuugugaggugacccucagaugacagaggaaacagucuucccagucaguauucccuccuggcagccauggaaggaaagugcucagagggaauacaggaaugccguagaacuagaaaaagaaaaauggggggagaauggccaggugcuuccaaacccacaggugaaacaagaugaggaaaagugucucaucuugucacacugggggcucuucggggguacgaggucaauccugggugaauuguauguacuaggggaaggaggacugggggucccuuaucaguaaaguuccccaaguaggaaagaaacaaauauggcaagccauuuuaaaggcuggaguuugggguguaucaaaacccucaaguguaaggaugccgagaaaacgcugagagaccaucucggauccuaggggagguuccauuuauuugaagggaagcaacccaggguggagagacugcagauggaagacagucaguuucuccuccuucccgggagcuuguuaaacuccaaguacaagcacaucccaguucgugcuguuuggauucuccucagacaggcagggccagccuuuccccagcccagcuggaaaugucuacucugagaggccucugggguugcaaggggccucugccacauucucaggucucacagguuuaaccuggaagcuaacugccacaagucuuacugcaguggcaacccauucccucggauucuguccucaguggagagagccacucgcugcuagucaacuuccaaagaauaaauuccuucagagauucaaggcuugugugugcuuguccucccuagcugccugcaaguccacacgagccacuugugggcgaggagggacggcaagacgacaguacagacagcuuugacuuaccagcacaugacuuaacccucagccuuuugugugaguuugguguaagaacgccggcaggacaagccaggcugcccgugguggauguccugacacggcacagacuggaccagccuccugaagaggcaaauggauacucgaccaccuuccucacucccagugcuuggaugccccugagaggccagauuugauuuuggcuccggaaagggaccuauuccacccgaucccuuuggccucucucucagccagaaacuugugaagggaaaugaaagcaaaagaaaugccccccuaccaggccuaucuccuccucagacacagcagacuggacaggucaguagcggaacuugcucauggaacuggagcugugugauggagcaggggucuugccauauaauguguugaagaaaaacuuuguugagaaacaucuguaacaaagacccuuaaagauggggaggauuuucccugguacuugccaagggaauguccucagccuguugcuggcacuagugacucaauguccaaagaagcaagauguagacuccaaaugauauauauggcucuuuaggaauccugugcccagaaggguggccuggauuccuacaaagcuggggaagagaccucuaauuccauuaccuaaaaguucaaaaaguagagagacccaucacccuucaucuguccuguccccaaagggaugacccucaaaauuuaaaggaccaaaaucuagaauacugggagagaaaaaaaaucccaggccuccuggggagagagagaaggcaugucuuagacaauuacagagacagccuugcugaaguccugagugccaggagaggggccccauggagacgaggaggagucugucuguauauugacagaaauguugauaaaggggguaucccuauacaauguagauacucuccuaaggauaagcugauuuguccccuucuaagaugguagcagaaacuagagagaaauccuuuguaaaacuaggaacagauucccucagacacaggucugaacccgugucaucagaagagugcuggaggggagguggucagugaugucaugcugacuacaaacuacggaggacuaagauggagccugugggauaggaugcucucguguucugcagacagugggggcuaugcuccugauuccaguacugaauggaccuuguagcuagguuccugggcuuccuaguaggaaagagggcagagcagagaccuuguggugagaccuguucuuuuagccaacccucucucaguuccagcuauaccacaggacgaccuaacuggcucaggaaaagguccaccagaauuaagccuggaaggcacaauggagucgacucuguccuggaccgagagcccucagaagugcccuuggguaagagcccagcaaccauagacaaaggagugcaaacacagggggguggagcugaucugcacuuaaggugagacuuagaacugauguugaguauagguaggaacucuuaaaggaacuggguaugagucaugagucggggugaggauuugaaaccaucaugacacccccacgccagucugaaguggauggcucucagaagccuuugcccccacaaaggaagccccgcucaccccacuuguccccauggggugaagggaaauccuguuuuugaguguugugugucaguaacaguguugugucaccguggucauguugaauaguugaagagaauaaagggaauaagauuuccuaguug

SEQ ID NO: 4120 - RNA, 1178 nt, Mus musculus
cacacacacacacacacacacacuagugagauggcucagugauuaagcacacuugcugcucuuucagaggacucagguugaguucuaccaugcacgugguagcucacaacagucuauaacuccaguucaaggggaucuaaugcccucuucuggucuccacaggcaccauauacauaugguauacaaacauguaugcaggcaaaacacuuauaaaauaaaacuuaaaaaucuaacauauacauauauauucaauuauaugugaauauauacauuuauauaaaauaccaauauauauuuuaagcauguugcuuacauuauauguaggggaagggaggaggcacacacuguaguuucagcacuuggaaggcuggggcagaaagaagaauuaccagaaguucaaggauaaccugggucacauaaugagcuccagaccagagugugcuccguagugaccaagacugccagaaagaaagggagagggagggguuuuagcgugacuucaacuuacaaaacaacugcgucuccagcucacuuuuguuguuguguuugagguaggguuucucucugaaguccuggauuacuuagaacucacucuguagaccaggcuggucucaaacucagagaucugccacccccugcccccuuguguugggauuaaaggcaugugccuccaccuccucuauagagucccucuauucuugggaguuagccaagaaggaaggaagggggccuguggaggaagguagaugcccaccacauaacucuuuugaugaaaagucaaggcacugaagaagggagcugguugguaacccacucggagcagcuggagggaaagcacgucuaugucugucagcaggagugcuaacugacagaauaacagcuguguauggaaugggauaguucuucagucuuaaaaaggaacaaaauucugaccuaacauuggugaacucuaaaacauuacauuagguaaaauaggucagacacaaagacaaauacuagagcgauaccaguucuuaagagcacugguugcucuuccagggacccacuuggcagcucacaaccacguguaacuccauuucaggggaucuggugcccucuucuggccucugcgggcacugcaugcacauggugcacagacauacacaaaggcaaaauacccuuacacaucaacaauaaga

SEQ ID NO: 4121 - RNA, 1310 nt, Mus musculus
ccaggucauaauuuauaacuugaacauguacaaccacaaauucauuauacauuuuagaauagguggcaauguccuuugaggaaaguuacuuuaauaccucauaacuuaaaugugagaaccauugauauuaucucaauugaugauacacuguaugauaaagaaacuuagugaagaaaacacaaauaucugugcaaacagguucuuaccaaaauauucuguacaggccagguaggagggcuaaagggagaccugggagccccucuccccgcuuugucucccaaguccuugacggugacacuuguuccuggauucacuauuuuccaugguagagaggcaacucuaaagacuuccauuuagccuuuccagccauaauagcccucacaccacagaccagggaaccagugugagaacucugccaacuucuaaguauaucuaucccgauuauacauucugggacuugggaaauaaccacaggagaaauucaggcucucccugagccuacuaugagucagacuuuagccuaaacuccauuaaucaccuggcuccuaucauaagcucugacuuuaacugaugggccaccaugucucuagggguuucccagaaccagggucaguucagaacagcauucaguagaccucaggaagucugauaguuuccuuccccucguguacaauuucccuucuaaaagcccguaggucccucuggggaaggacaggagaaagacuaacaguaaaacuuuuaggugucuuaucaagguccuuaaucaguggaacuuggccacucccucauucaaggagaucugggucugcaaacuggcucaacucuagaaauugguucacagguugagauucucucuugaucaugacuuaauguaagccuuuuauuuguuugagaaauuuuccucuuacauaguaggcuuccuguuucaugccuggaaacaccaugguugguuacccaguaccuaaguccauaccagucaugccacccuaaaauucacuuugccugugcugaccaucauggcaggcuauuacgaucauugcuuuguuguugugcugcucauuggaauaacuaugaucaccuugccuuaguuaauucagugcugccaccuggcccugcuacucugugccccaguuaaacccauugcauuuaauucauccacugagcagcagcaucuccagcccuuaggucuggcacaaggaaaagggcaaaacucuucaaaugugcuggugcaccauuuugugucuuacaggauuugugaagggcgugucuucugggccuucacguuguggagguuuuacacagcguaccca

SEQ ID NO: 4122 - RNA, 5342 nt, Mus musculus
cccaguuccuguuucggccccugggccuucuagacgcguccguaacuguucccgcugggucugccuugccacccaggauggggucccacccgcgcuugggccgucccuucuuggggauacaaggcgccucggccccuccuugaccaucugcgcuugugguguaacugcucucaggaugaagggcggcgagggggacacgggcgaacaggccccgcugaacccggagguggacagccccgcgggcucagccacguaccgggaguucgugcaccgcggcuaccuggaccuuaugggggccagucagcacucucugcgggcgcucagcuggcgccgccucuaccucagccgggcuaagcucaaagccuccagccgcacaucugcucugcugucgggcuucgccauggugaggggugggaggggguacacgggguggguaaagcacguggugggagaagucaagaaaauggguccccaguacuggacugaauaaaaggguuucuuuaggauaaaagaaggagcuaagucccaagggacuggaaaaacccuuuaugucgggcacagcucuaggaauauaaacagacugaagaucggucccagaaaugccguggaagaagggaguaaagaggucagcagaugcagacugguggggggaaagucugaaguggcuuaguuaccaaguccucgagaguugaaaggcagucaaagcugaaugagagccuauaucaaccagaucggggaagggggauaguguaugugagagucauuugacugaagggcccaccucucagaaggcacagagaauugccgggaaaacuaagaaaccaugaggaagcugcuggggaaggaagcugaucagggagcuagcagauaagucugauaaacugcaggugugggaggauaaugucagcuaacggucccagcaguggccccgggaaguggaacugaagauuccagaguguggccugcagauguguccugguuccucccuacuuagggccagcugugcggccccaagucgacauccacuccaguugccaucuuuaggaaguugugacaucauagaaggugcugucucuguggucugccaagcuuuuguccaggaggaugugggauucuuauggagacccccuagaacuagguguguuagaacaagcuccgcuuagcaaaggaggcucuucuagaacagugugcuaucuagacuacauggaagcugcuguuuagacaaggaugcuccgcaggguauggguguggagugaagcucugcuaguuucaguuuucuucacacuuggggggagggcacccuucauaauguacccuuguguaaauaggccuuggagggagcuaaggugagggcauauaaaaguaacuuaggucaauaccucccuuuuuucugcaaccucaauaucaggacgaaagaaucuguaaucuuaaagguugcucuugcucuguugcuuguaaggggcccagauuucccccaaacagccccauaguuccugaggacauuugacugaaaggaaucagcaccacagaaagaagggcacagcagcuuguguuugaaccacguggcuccgccugcuucuaaaggaacaguacagugugcagcagaaguugcagagcagaucguuguggugucagugugagagggcuuucucugaggagcaguaggcugaauguguagguucuaggaccgcccccaguccugacaaagaacccuggguuggacccugggagacaccagaauuaagccuggcccagaucccuguuugugaacacaccugccuacuaucugcgguggcccaauuccccaaaauacucaguuuuauuuuuguaaguaccacuguaucccugcaccacaguaaucucgggaucuguaagaaaugggccgggcgugguggcgcacgccucuaaucccagcacucaggaggcagaggcaggcggguuucugaguucgaggccagccuggucuacagagugaguuccaggacagccagggcuacacagagaaacccugucuccaaaaaccaacaaacagaaaugggagauaucuuccuaaacccagguggccugaaguuaaaacauacaaaucauauucacaggcugugaaucuagccuaguucuaguugguagaguauuugccuaccauucaggaaauccuagguucaauuuccauuuaaacaacaacaaacaugguauagcguauagcacaccuauaaucccagcacuugagguaauaaaaaagaacaaacaagguuguucuuggcuauacagagagucaaggcuagccugggcuucaugaaguccuaucucaacaaacauucaauguucaguaccugguauaguggcaguuguucauauaagaaaaggcauguuagacugcacagugagcuagugacaggauuuuugacuucagcagccuggcuuuaaagcccaaacuuguccaucaacacaaauguuugcaaaguucaggcuagcuggguggagucacgguagacucccugaccugucaaacaugagcagccaugauucauccugcauaguuggcacauugaaugcagccccggugugaccagauaugacaagcuuuuuagauugaucuggaaacgugaagcuuauuggaguuuaagagauggcaguuacuaccuucuggguuuucucucuuugugccuuagacauuagcaucaacucuaacagucugugccuggcucuagucauagaauuuaauguuuagcauuaacuuucucacugagacuauuguccccauuuuucagguaggaaacugagggaggcacuugcucagagauuacacaguuguucaaggucauaggacuguaacccuacucaggacauugaaguagggggguagugaauuugaggcaagucuggacuaguaggcuguugugaggaaacuacaaauuguagaacugagaacagacccaaacagcucaagauuuuugcuugcuuugggucuauagugacuuuucuuucuuuuuucuuuucuuuucuuuuuuuuuuuuuaaagagggucucuauguagcccuaacuguggcuugguacucuuuaguucugggauuaaaggcacuugucacuacacccagcaguuucggguucuuuuuuuuuccccuugguuuuucaagacaggguuucucuguguagcccuggcuguccuggaacucacucuguaggccaggcuucgaacucagaaauccaccugccucugccucccaagagcugggauuaaagguguaugccgcugauuggguugagaugaaguuccaaccacugggagaagccuaggcuacucucaaacuugagauccuccuguuucagcucccacaugcuagaaagcaugcagugccacaccagccugagucugcuuuuuauuuuuuauuauggguuggagauuaaaccuagagugaugugagugcuagggcugcugagucuacuuuuuagccaguauauuauaaccagguaaaagcucagaaaaaugccccuuugagacugaggugaagucacgcaggaaagcugaggcagcaggaucacaaguuucagcucaaccugcacuacccagcaagcuccaggcuagccuaaauuauaagagcaagacacuaccaaaaagggggcugggaugaggaaagcugaguaucuucuaugcucuaaguuuuaggauguuguagucaugauucuaaacaggcagagcaaaacauguucuagggacucaagugucuuccuucuugugcccacagguggccaugguggagguacagcuggagaacgaucaugaauacccaccaggccugcugguggcauuuagugccugcaccacuguguuaguagcugugcaccucuuugcacugauggucuccacaugucugcugccccauauugaagccgugagcaacauccacaaucucaacucuguccaccagucaccacaccaacgacugcacagauacguggagcuugccuggggcuucucuacugccuuggguaccuuucucuuccuggcugaaguuguucuggugggcugggucaaguuugugcccauuggggcacccauggguaaaccagcuccuguuguaccuaugucccaggugccaccugugacugucucccuuaguuuagcuucuaaccucacaccauccucugcuucuauuaccacaucacaacagccuuccaaagccuguccaccccggcaagugugugauagugcucauggaccaggcuggcaggcagcuauggccuccacggcaaucaugguaccugugggacuaguguuuauggccuuugcccuacauuucuaccgauccuugguugcccacaagacagaccgccacaagcaggagcuggaggagcucagucgccugcagggggagcugcaggcuguguaagccuggcuuuagacuguugcaagcauugccucagaaaccccagggaucgacagaccuccuuccuugcccuaggcuggagccaccuccuguaagcucugagguagaggccaaguaccugcccagcagcaucccacacucccagggaugaucccugucaucauguucugguggguuuuguaaauucugcucugcuuggggaacuguuucagccuaaggauccuggguuaaaugagaggaaagaggcccgccugccuuagugagaucccugguggugcugagcaguuguuugcuccuccaggaaggugacaugucugcacaacuguccucaaggcaaucagcccuugcuuaucuguauaaucugcuuugcaguuggcauccugggagagauuuuacagggcuccucagaugagccacuucacccuuggugacuugugguggucguuccacugcccuaggcacugacugucuggccagaacugggagaggaggaaguauugacgagugggagauugugcagcuacuugacaaggguuggugaguugguaagggagaagauucagcccuuagaaugcagaacucuucuucagacacugauuuuuuuucuuuuguuuuguuuuucaagccagaguuucacuaugucuguugcucuggcuguccuggaacacucucuguagaccaggcuggccuugagcucagagauguaccugccucugccucccauguacagggauuaaaggcaugcaccaccaccaccugacacugaguuuuugaugcaccuuguuuuguaaauaaagugugucucacauauguuccuauggcuaugaaugggaugaaggugaaaccuuggguaugguucuuuguuccuaagggccagauggagguaauaugcuugauagaugguaugaguccaucaggugcugacaagaucugauaaacuucugaaugugguaaaca

SEQ ID NO: 4123 - RNA, 1726 nt, Mus musculus
ggaagaggcguggccaggauggugaccugcuguuucuccaacucccggacuuuacucuccaguuuggccauagucugccgaauugucugcaccuaggaaggaucaccaagagggcugaagacuuaagugucacucuaguccgcccuacuccucgguucuccugacccuuaccuucuggaagaacucgucguccgggcugcccaaccgggcagcaccugagugcaccaccagcgcgacucgaaccucaucuucaucgucugagauguuaucccccugccagggccggagucauuggcgacaguugcucgcugcgguucucgccccgcaggaaccaugggcuuccgggauuuuccuuccuggccaucagccacccgcccgggacccaaaaccaggaguccucacuccagcgcgcccgcccggccccgcuucuccucacuccaggguguccucaccaucccgguuucucaccugccucaacucguggguccugucgcgcaugguggucggagugcccuggacccgagcccaaagggccucaagguucuaaauuuggaaguccugcaccucucucacacuugacacccccucccucacccagcgaacuccaguacaccccggagccgccaaaggccccaccccuuucaccauccacagucguggggaagaacccgaucauaggacccccaaaguucuacagguuggaauucccuucucuuccccccauccugcucccgcagcugccgccccgccccucgggggaugacuccgagcaugcgcgcgagggcucggcucguccucgcuagagggaaaggcggaggucggaagcaguggcagccgaacggaagcgaggcugccugaguccagagcccgccccgcugcuccccccccccccacuaccggaacaucucauauuggagccgagaucuaguugcccaaaggguugggaaugcgucauuugcacgcagucugagagccucguaucucacaucaccccauggcgcccccucaucacgugacaggccgggcccagcuccgcgggcugcacgcccgaccgccagucauguguuccggccugucagcgacgucucgggcuucagucucgcgacguccccgacaccccagcgucugagcugugccccaacagcuucuucgagguggggaaggguacacugccuacucucagccaccuacuaaggaugcucuguagaauucacuuuuuuguuguuuuaauuuuggguccucgggcgugggcaaagugaagacuugcauuuggggcugucaguaucaugagaccuuggaaaucaggaaauaauaagacccgagucuccagcgucagggaauugcaggguuuuguaggcagagaaucugggggugggaagugaccucagccaagguggcgcuccccccgcugcucccccgcguccuccuggcacagccucugacaggugggcggccuaugccccgagugagcauugcagucccgcugagcucgcuaccuucugagcagcacgacaauuccagagcagcucagacugagaaaaauguacuguuaccuccgcagcccugccuuacagcugacgucucagcaugacuugcuuuucuuuaacggaauccccaacaccaaauucgguagcugccacauagcaguccugcauagaagauuugauccgaauaguagccuuuccuguauuugaaacuaaagcccguggcuuccugaucuucuuua

SEQ ID NO: 4124 - RNA, 2585 nt, Mus musculus
ugacagcaggccccgcccugccccguggcgauucuucccuccugucccugggcuguacugucgacaugggcaccaccuggaggagcccuggacucgugcggcuugcacugugccucgcuggcuuagcccucucacuguacgcacugcacgugaaggcggcgcgcgcccgcgaugaaaauuaccgcgcgcucugcgaugugggcacggccaucagcuguucccgcgucuucuccucucggugcgugcagacauggaaagcauggggcucuugaaggccagguuaccagauaauuuuggagucuggggucgcaguguccacagaaaggacacuuugagagcggccuggcuccauggguuuugguggguaaucggacgugcacacuggaccucacagagauacuggugcuugaacgcuuucugaggauacuguaaauaccaaugaugggaagacuggaggaggcagggcaguauauugcauagagacugaggaaacuugagaugauacaaagcgggaggaggggguggacuauuggcugugcugaggggacaaaguggcucacucuguccggguuggaggaccaaauguuaguggguggugagggaacuguagcuuuguaggcccaagcaaauagauuucccaguugugaucaccguaaagcgaaaucaagcugggaaaaacuuuuaaccuuucauuuauuuguuugugagguggcacaugcaugccacuacaugcauguggaagucaagagaauaacguucgggaguugagucucuccuucuuugugggcugcggggggauucgauccaguugacaggccuggcagcugauacuuguuuuuccugagccaucucaccaacuccugaaaaauuauugauagucugugaugacaggccacuaagagccccaggacaugccaggucaaugcccuuuggacucuuaguagguggagcuucuugcuaaucacuguucuacaaaaaagcucaagaggcacuuggccuaccccacuuaccugcuucuuucacuuccaccagguggggccggggcuuugggcugguggagcacaugcuaggagcggacagcguccucaaccaauccaacagcauauuugguugccuguucuacaccuuacagcuguuguuaggugagugaguggcuuugccccuucaugaccugucuucugaaauccagagcagccccaccucgugucgugucgugucggugacccagacaauugacacccagcugcuaauuacugagcaaucucaucacaaggagucaagaaagcagaacacuuagcaggaggcuuauccuacuugguuuagguagccagaggcugagggcccucaaagauuucucacaaucucaguuuuauggcaaagaaucaacuucuuucuuuuuguuuaguuuuucguuuuuucuucucccucucccucccucaccuuuuuuccucuuccccccucccccccaacccaaggagaggauuucucuguguaauccuggccguucuggaagucacuacaugggccaccacaccucacauggguuuuguuuuuguuguuugguuuguuuuugagggguguggugaggcugaggcagguguugagauaggguuucucuguguaguccugaauguccuggaacucacucuguagaccagcuggccucagacugagagaucugacugugucugccaucagagugcugggauuaaagcauggcuuuggaccacaccugguagguuuugagacagggucuuuuugagacagggucucucuacauaacccuaguugucccggaguucauuauguagaccagucuggccuagaauuugcaggaacucuccugcuucugcuuccggagugcugggacuguacaccaccgugcucaacugauaguuuuuugguuugcuuugcuuugggagacauuccagguugaccuugaacuucuuuuugagaggacuccaaaguguaacuuguguuucaucuuguguagcuuagcaagagaauuuacucugggucccaagaauuauugaccagaugaggcccaucagauccugucuuaagaguacuuucaccagaagcaccugcugucugucauugaggaggcaugacagaguucuagauauaccauuacugaccgucucuuguuuuacagguugcuugaggggacguugggccucuauccuacuggugcugaguucccugguguccgucgcugguuccguguaccuggccuggauccuguucuuuguguuauaugauuucugcauugugugcauuaccaccuaugccaucaaugugggucugauguugcuuagcuuccagaagguaccagaacacaagaccaaaaagcacugaguucccaccucaugccagacuaaccuaacuugcuuugccuuggcacaugacccuugcccaaguguguggguuccuagaaggcccuacccacaucauucaaaccccccuccauaaccacacacagagaaaugaccaaacgugccucuaaguucuguucccaugggcugcauucugcuguugguuaaagagaaggauuuugaacaauaaauuuuucuauguuggucaag

SEQ ID NO: 4125 - RNA, 6650 nt, Mus musculus
uuuuuuuuuuuuugguuuuucgagacagggcuccucuguauaacccuggcuguccuggaacucacucuguagaccaggcuggccucgaacucagaaaucugccugccucugccuuccgagugcugggauuaaaggugugugccaccaugcccggcuuucguaacaguucuugagaggggcagcuugaggucagaacucagacacuaugguccaagaaauaucugaccguuguguaucuaugugagauggcauugggaauagaauagauccuuuuguguguggcacugagggaaagcuggcuggaugauucggcaugcacugcucuugucgacaaucucagcucugcuuccacagcaagcagcucacuacugccuguaacuccagcucuaggggauucgaaaccccucuggacuccacaggccaucuacagcaaugagcacaaacccacagguagacacacauacaaaaaauaagagagaaggcacuaggaaaaacugguuacuuugcuguugggcaguaaagaaguucagagcaggauaauaccaggugcccggcacccuaagaaugagaagauacaaccaaaggacaccucccacucuagcccucuucaggaucauuacagcuuuugcccaggcuucuaccucacuugacacuucaccugacaucuucagaugauguccuuccuaaguaaggacuagccuaggcauaguaaauacaccaugcuguccccaugccagggccaaccaugauuaacauguaaauccaacuguuuuuuccagaacuugggggcugugcugagacacccucuacuuacuguuauuguguuuaugaguaugaaccuacaugugugcaggugagaagacuuggcaggacucacguaguccucuccugcgauaaacucuaggagauaccuuaguggcaggugccuuuacugccgaaccaugucgcugggcccggaugcuuuuuguugcuucugaugcuguaucuguguuguugcucucugugguuaaccuguacuuucauuccuuuuuuuuuuuuuuuuuuuuuuuugguuuuucgagacaggguuucucuguauaguccuggcuguccuggaacucacucuguagaucaggcuggccuugaacucagaaauccgccugccucugccucccaagugcugggauuaaaggcgugugccaccacccccggucuguauguacauucaaagacuagaacaugaggcucuucucugacaacuacccguuaagacaggguuuugccaagcagcccagguuggccuugaacucgugauacuccuauguaagcaucacuaguacuaggaccacaaguguguacauuugauucuaccuggaaaggcuaaaguuuucaguguaggaauuucuuccaucccagcgucaagugagggaacugguuaccauggagccucacucucuuauguguaccugagggacaguggacuagcucuggacuucucauuacaagucauuuccuugaccucuccccuuuccuuuccugcuucuccuacucccuuuugggaguccuaccaagcagguccguaggucuuacacagcggggagaguuacucuugguucaaaguucaccuaaaguucuguuccacacacuucuggucaccgugcuuucugcccaagucccugguccucccuaagacaacuucuccguaucugucugagguaaucaggucucugcauaaccucaugcaauucuuuuugcagccacagugggcaggcaguauuuuuaaccucaugcaagcucaggaaucagguggcuuacagacugcccagucuagugaccuuuaccucucaaacccacggcugccaggaagggaagagucgggccugaagcuaagucuuuuggggccucugauagcgucuggggcccagaaagacuuguucaaugagcccaaguugccaaagucacucucacucuugccaaaucaaauaggcaagaaccuugaaaucacuucugccacagugccaggacagccagagacuggacaugaccagguuaacucccaaggccuagggaauccaaagggggcagaaacaaagcucgccugcccucccaacauuuggggcccaagagggcauucaaaaaugcaaacuuuaauaagcagcaggucaaaugaggaguccucaagaaugagcagagcagagcugguaucagaggccucagaggcaccugcuuccuccccccaaggccgggagguagaaagcagugagcccugcugaggaggaguggugcccagcuccaucuaaguccaccugucugaggcccuaagcuccauaaagcgaaguggcagucuguggagcccagcggcccccugccaggccuaggagguccuccgaggaguguggcaggcuagccggccaaaauccaccauuagauucugaagcuuuccucccgaccaucaauguggcggagccguagguagacauccgugccaaugcccugcagggacugcagcugcagggagccaccaagauacucugcauaugcccuggacgugggcaacccgaagccaaagcugggagcaggggauaggauaggggugucagaggccugcgaguccugguuuaccccuuccccccauauugggaagguggggccuuacccaugcauagguccugacuggccaccacugugcauauccagguggccgaagaggggguugauucggggguccugggugcuggccucagcuguggugaagugguaguccaugacccgauccagguccuuaugagcgauuccuccaccccggucugagauccuggcaggaugucaagaacauggacuuggucaggucuaauaggucucacccuaagcauacagugcugggucuauuccuauugucucuaaagguggaaugugacuuuaucaucuucuacacucacaucugccugggccgcagacugcuucuacugucccauacaauuugacauuaacuuuuacucucagcaaacaccaucucccaacugcagguuccuccgcuggccccaaauccauaauauacagcuccuggcaaucuuaggaucaaauaucuuuucugaccagguccacgucccagaucaggguagguucuggcuuaagguccugcagcaagcuagaaauggugcccaggaucuucauccaacccagcccgauucuaucugagcaaaccugaugaugagaucaauaucauuauuggcgauggugaugaccacaucugggacauuguagggagugucuaggugacucuccauuguggcucuauucaaaagagaaagaccaccaugagguggugcccaaguuagucgccuucccacccuccacccccauccccaagcacaaccagccagcccaccucauggcauucuugagcagcucaggcaggauauaguccagcggcaugggaaugaaggggaaccgggcagccacauguccguugaugcggacucgaggggcauugccauacuugugcucacacaggcgucuguggauagaaggguucaguaggugccccuagaguuacaguucucaacuugagcugauucuucuucccagugggcaccacauggauacaccguugcuccucgaauggaagggcacuucuggugucaaaugaauagaaaccaaggguuguacuaaacagccuaaaauacaaaagagcccuccacuaguuuaagaugucaguaauagggggauggagagauggcucagcaguuaagagcacugacugcucuuccggaggugcuggagagaugguuccugauuguugagagcacuuguucuuacaggggacucacaauugccuauaacuccaguucuaggagcaccucuguggcaccaagcacaaacauggugcacauacauacauacagacaaacucucguguacauagaaaacaaguaaauauguaaucccagcauuaagaagauggagaggagaauuccaagccccaggccagccuugccuguacagugaaauuuugccuuaaaaagaauaagcuaguaaguaaguacguacguauauaguuuaaaaacaaacuggcuggagagauggcucagcagugaagagcacuugcccuuccuuauagaggaccugaguuugguccccagcacccacagggugcacagacacacaugcagacaaaauacccacauguauagaaauaauuuaauuuuaaaagaaaaugaaaacaaagaagaaaccuugcugcagaccacgcaaggacucaagacacaggccucccugccggagccacccacuccccaccauucuagucucaccuggcaaaauccacccacuucucgauaaucuucuugggcgacagacgaguacagaugaugccaacaaaaucaggcuggcaggaaagagaaggucagaacuagcaacacuuccacccaacuucaguugccaaaucccacaauuucuggaaugccagagcaagccccaagcccauccucagcccuaagggggccuguggccaggugccuuuccccauuuaacauucucagaucagccucgggucucugcuccaccuugucuucauguagcgccaaguggugaguagccagcauucggaucccaagucuugacgucaguguuuuauccaagaaguaccggacuagcuuuucauccuauagagggugagucucagaaaccuguucccuucuugacccucccccuucgccaggcccauucucuguugccucugaccuggauguguuuccggcucucacgaagacccucagcuaacagggucaccacauccuuguggucaucuagcagcugucucaccagcuggcaguacugggccucaucugccugguccuugaucugcaggucacagaauuaugagcaucagaaguccaauccugaccuuggccccuuacccuacucagcccagccucaccggagggaagucugucagcuucuggaaggcccggauguauagcucgugcuguauggaguaaguaugggaauucacagggcugccauagacacuuaaguagaaaacaguacccauagggaucaaugcucaacucaacucaauuaguaagcuccaagccccaacagacccuuccagcucucaugaauauguaaucuugcccucugauguuugaggcuuagucccauccagaccugauaccuuucagcaggccugggcucccucccccauuugccuuguuggcagugugcauacugacagaagguccccuccgccuuaccacaugcaguaugguaggguugcaaccaaugaugaaaggaaggcuacggaagcccuugaugcggugagcaauccucacugguaacucuugcugcaaguagcggccacuuuucuguaagaaaaagagggaagggcuuaagcagcuggcuagaaagaaccccuggggcagagaaggaaagagagaaccuuaccagaagguggcugccauccugugagcgaccggaauagagcaucauggugggagugaggcgaacugagggcuaaaagggaagacgcacuuugagcaccagauauucaaaaccaggccaacccauuuuagcucagcccuuccccauaagacuuauucugugagucaccuucucugcugccacaucaauggcugacugguuguaaaaagaggugacagucuuggagcguucccuggccagcucuacaugguguguaucgguggcugauguugagcgagcccggagugacagugaggaccccaagaggggccaaagugaagaccagcuccgagggccgcugcccagcacugaagucaguaucauuguccugcuacuuuguugaacuagggugacacuauagcacccgacaggcaauggugaccccaaagugggaguaaagagaaagugggugggcgggauuuucuccggauuucaggguugugguucccucgaggaugcagacgugcucagcgcccgcacagcagcuuccaucuauuggagugguggaaagagauuuuaaggauccgaauccagaugguuugcacuacuucuccacgugcacaccaguggaucuggacaauccuguccagcccucacaaccaccaccucccgcgauacaaucaggcugagguuggacaacacauuccagguguucuacucuucuauguagaacaaccuaaaggcuugugugcacacucggggaagcggguggggcaaucuccaguucauucuacccauaaaaccucuccccagcuuccucagguucuggacagccccauuuaggggcuggauuugacccccuacucgguguuaggggacuuaagucuuuuaagacuggccugcgucccugcaacaagaauagcgcacagaagaacaggguucaugcagcaaaacugcggucccagaguuccccacuggagcuccccccucugcugggucacuuagucugggcagggucccccccauaugguagaugccagccucggcccaugcgcauugcugucagagguggacgcugaggagcuaugcugccgagcguccgccggagggggucugugugaguuacugugaguuauuccacuuaccgcgaggccagacgcugggcccggguucgagcggaaccgcgggagcagucgacccgcucggcuagccgagcccgccuucgcccuccccggcuguaacaucgcgcg

SEQ ID NO: 4126 - RNA, 13325 nt, Mus musculus
ucacuuccggcacagcaauggcggcacagggagcuacagcugcaguugcugcaacaacuucaggaacuguaggggagggagagcccggcccgggggaaaaugcagcagucgaggggccugcccgguccccgggccgggucucuccgccgacuccggcgcguggcgaaccagaagucaccguggagaucggagaaacguaccugugccggcggccggauagcaccuggcgugagggcggggcccagggccuaggggcgggauuuagggaaugggcauggccuaggaaugggcgcucuguggggcugggagucuuggggccaggguggugacucagguaagaaggcgggauuucgggagcugagaagcccacuuuguaauuggagguuggagucaggccaugcuuguuuucaccuguaaagccaccagucagcugaauacagaguuggccugugaacauucacucugguucgauuucaggcuucauuuuuuuuuuuuuuugcuauaucuguuccuucauugguguuuuguugucugucuuuacauuucucuugcccccucaucgccagcaaagaggacagcccaguuccuaaaaacacguuuccuuaucuuccuuaucuuuucuuccuuuucuuucccucuucaaaauaaaccucaagcugcuggcuucaaaauaaacuccgagcugagauggcucaggacauaaagguauuugucaccaagucuggugauuugaguucuguccccaggacccacaugguagaaggagacaaugauucuuacuguuugcccucagaauccauauaagaguaucccccacccccuaauacgauaaauacaucuaauuuaaacgaauaaaugucggucaugguggcauacaccuuuaaucccagcccugggaaggcugugaguuugaggccagccuggucugcauagcaaguuccagaagagccaggacuacauagagagaccuugucucaaaacauaauuaaacuccuuagacuggguuuguuuguuuuuuguuuuguuuuuuguuuuuucgagacaggguuucucuguguagcccuggcuguccuggaacucacucuguagaccaggcuggccucgaacucagaagaaauccgccugccucugccucccaagugcugggauuaaaggugucugagaccuuuccaguuucuaggcacuucuaguaagggcuauugccagaccaaucuugcucugcccgccaaaacuauguguuuaugugccuuuuaucaccugcucuugcuauaaguaaucucaugucuuccuggcuagcucuuacucaucucuuaauuuuuguuuuuuaaaaaguuauuuauuuauuuuuuauuauuauuuuuaaaauuuauuuauuuauuacauguaaguacacuguagcuguccucagacucuccagaagagggagucagaucucauucugggugguugugagccaccaugugguugcugggauuugaacuucagaccuucggaaaagcagucgggugucuuacccacugagccaucucaccagccccuauuuauuuauuauauguaaguacacuguagcugucuucagacaccccagaagagggucucagaucucauuacagaugguuaugagccaccaugugguugcugggauuugaacucgggaccugcggaagagcagucaaugcucuuaacuacugagccaucucucucgccccuagucucucuuuuuuuuuuauuauuuuuuuuauuuuauuuauuuauuauauguaaguacacuguaguugucuucagauacaccagaagagggcaucagaucucauuaagggugguugugagccaccaugugguugcugggauuugaacuucggaccuuugaaagagcagucgggugcccuuacccacugagccaucucaccagccccccuagucucuuuaucuccuguggugaucccauucuagaccccuucaggcaaagucaguugcuugcauggucuggcacguuuuucuuuuucguaccucagccauacuggguuuuuuuguuuguuuguuuuuuguuuuuucgagacaggguuucucuguguagcccuggcuguccuggaacucacucuguagaccaggcuggccucgaacucagaagaaauccgccugccucugccucccaagugcugggauuaaaggugugcgccaccacacccggcagccauacuguuaaaauuaucugccuuucucugucaaugggaaaacacuagagaacaagaucucuugugauuccucacuguaucuucucacuguggccagcauuacauaguggagcgccagacgagcauuaauuucuagacaucucugcaucugucccugugcuacagacuaaagcauggucacccuuuuagguauucuccagaugaaggaacuaaagcucagaaagucaaaccauggggcuacagucauuuaggaaaugugaaggaagcuuaaacugucuuaauccccagccagcucucauggcccccaaaugagugaaugagcacugacuuuggagguagucuuaaacaugcuuaaauaccagguuuucucaguuuucaaaucucugguccucuguaacacccccuguaccucccccaaguccuaaccuggcucaccuuacaggguaaauggcagguguggacagauggaucuggaaauuaccccucagaucccccccccuuuuuuuuuuucuugacagauucagcagaagugauccagucucgagugaaugaccaggaaggccgagaagaauucuauguucacuaugugggcugugagugccuggggcccuggggccuggguggaaggagggaggcagucagucagucccucacggugcguccuaacaguuaacaggcgacuggacgaauggguggacaagaaccgacucgcacugaccaagacagugaaggaugccgugcagaagaacucugagaaauaccugagugagcuggccgagcagccagagcgcaagaucacucgaaaccaaaagcgaaagcaugaugagaucaaccaugugcagaagguccuggccccucccuucucaggaccaucacaacaaagccauagcaacucccaugugaaagcugguaguaugccaggguuuuucucucguuuauucacauaugaaaaaauccucagcuuauagagagaagaggguuguucucucacaguaaggaaacgguacaguuaggacuggaacucaaacuugaaguccaaagggaaggaaagaaacuaaaauuacgucauuuccucugcuauccauccccacgccgagcacuggacgaucucauccaagccucccuggccuuuaucaccacggggcaaauccuugguuuuguguaugaggaggcaggcuccgagagguuaagcucaagcuucuuggcuugaaagccagaguauuagguuuaaucuacuucaccugcuauugcagagcaucucaauauccagagggagcacaggccggucuagaagucuugguaggauuuacauugucuuaggggccaggcccuaccugacacauccuacagagguauccaaaauaaggaaucuuugaaaagcagaaacaaaguauguguguuauuaguguauguguguauauauacauauauuucaaaauauuuaguauauguauguauaugcaugauauguuccugugcuucuauguguguaugcaugguauguggggggagggguuaugugugccaugguuugagaauguggagaccauagagcaacuuuguggagucaguccuaccuuuaauuaggauccagggaucaaacucuggucucuaggauuacguggcaaguccaguacccaccgagccauggcaguaacccuuuuuguuuuugugagacugucuccuguaaucaggcuagucucaaacuuccuacauaggcaaggcuggccuugaacuccucaucuuucugugccuacuucccaaguguaauccaaggauuacaggggucagcaagccuggcucucuggucuuuugagacuguagcccaggauggcccugaacucucuucuagccagacuguuucuggggauuguguuuuccccuccuucccucccuccccccuuccuccuucccuuccuccccccuuccuccuucccucccuccccccuuccuccuucccuccuucuuucuauuuuggaagcuugacagauuuauuacaguuuaaaagaaaaaccccaaggcaggugggcugucaaguuuagggaaaaaucaugcuguucagaaucucacagagguuagacacaugguggacagucagccacugccaggguguaaagcuuuucuuuucuuuucuuuuuucuuuuuuuuuuuuaaauuuuuuuugagacaggguuucucuguguagcccuggcuguccuggaacucacucuguaaaccaggcuggccucgaacucagaaauccaccuggcucugccucccaagugcugggauuaaaggcaugcgcccccacugcccagcagggaguaaaguuuuagaggaaggaguaaggaaacccaaaaugucuggggagaagccagaagugcuaaggaaaauagcuuagagaagagauggaagagagaaaggaauaauuccagaaauggagcagacccacacuccugcauugauuuacaagcuaaggcaugucagccguccugagcggccacugcacagcugugcgauuccucgcaagcucuuagcaaacacagcgcaacaaugcuugucucucuggacacucugucaccaggcuggaaauuuguuuuggugugguauguauaacauuuacauuuuguaaugguuuuuagcuuuauauguaugaguguugccugcauguaugcguguggauccagugccacagaguuuagaagaggcauuggguucccugagauuggaguuaaaaauggcugugacuaccguggggcccaugggugcugggaacugagcucaggucuuccacagaagcaacaaauacuuguaacucucaaccauuucuccaucccuuugaaauguuugugggguaaguauuguuuagaggcaguuuuguuugacuuguaauccaugcauguauguguacacagacguuccagcuggcugcagugccaguguguguuaguaagaacucuuuuccauccccuaagcuacaaaggcuccgguucuaggguagcacugucuagugcacuguuguaaguggucugugggcugucgcuagucaauacaguagcuccucuggccaccuguggcucuucaguacuagucuguacauguccaguuugacuagaacuuuuuuuucaauugucaugaauuugagauggaauagcguuugcaguuaauggcuguucucuuggacagcacagguuuaaaaugcuauucucuggcuugaauggagugacuguuagucagcagguagaccagagugggcuggauauugauggaugagugauucaacucucagcaagguucgauaguuauuggagauuuuuguugguugauugguuggauuuuuuuuuuuuuuuuuuuuuuuugagacaugggcucaaacuuggucuauagccaaagaugaccuugaacugguuccccugccucugccucagacgugcugguauacagguauguaccaccaugcccuguucuaauuaauguuuaauucuaaauaaauuacaacauugaagaaaaauagugguuuuguaguucuuuaaugcauucacaaaaagaguuuuguuuugugaacauugaaaaaugcaguuuaaagaaacaccugaagagaaaagucuuuguuggaauugggccagcccagggcuucuuuuguuuuacaguucugugaaccugggcaagaugugcaagugcucuacuugcagguauacccgagugugccagaagagggcaccagaucacauuacagauggccaugagccaccaugugguugcugggaauugaacucgggaccucuggaagaguagacagugcucuuaacagcugagccaucucuccagccccaagauuuuucuucuugugccucaguuuccucuuuuguauuauggcaauaacgagcacucuugguuucaaagacucauuaugaaggcaaaaugaaaaugaugucuaagaguguuugguaguuacaauggcagcuggcccauggccugugaccucaucccuuucuguauguuuauuacucuguaaaguugaaauaauucucuuuaaggccagguauaauggugcauaccuguaagcacagcacuggggaccugagguaggaaagcuugguaggcugagguaagaauucccuguaagcuuggaguucgauuccagaccagugugauacgcauacugagacccuguccaaaacaaacaucauuaaguggcggcgcacgccuuuaaucccagcacuugggagacagaggcagguggauuucugaguuugaggccagccuggaguuccaggacagccagagcuacacagagaaacccugucucgaaaaacaaccaaaccaaaaccaaaacagacaaaaaccaacaacacaaaaaaaggagugaaucuagucagacauccuggaggauggucuggaaggauggcgggccuugaaggacaggaaagagcaaaauaauugcucgugguaguugacagcucugucguagacucaccuggccugugcucugcgccaaggugaggccagcacgugcagcaugaggaggagaggcgcucucucgguggaagcaguacauauguggaaggcuggggcuggagugaggagaggugcuuucacaguggaagcaguacauguguggaaggcuggggcuggaggaaaggccucgauagccauggauucgaggggcugagauggagcagggcgcugaggaccccagucagcuguccagaccuaacguggcauugauuauuuggagugggucagaaaaaauugcacaggaacugauucuagagauaaccacagagaagagagcuggcgcccccucuguuggccauugguuaggucagcuaccaggaugagaaagaagcuuuaagagugaguaggccagugauaggcagugauguuuaagagagggcccaggaagaagaggaaccuagagguccuuucuguucaccuacugccugacauccuaugagaagacggggagccucacggaacauauucaaaggcugcuggagucugguguuaaggagggagacccacgccagcagcaggcccaggccagcaggucucacucugauaugggaaaugagaucuguucuuucaucugagucuugccuaugacccgcuguacagcugaagcucuugugggguggggaguuuguuuuucaagacaggguuucucuguguagcccugauuguccuggaacucucuguagaccaggcuggccucgaacucacggggaacugccugucucugcuccagaaugcuaggauuaaaggcaugugccaccacugcccagcuauagcugaagcucuuaacccgcuuaucuagcucaagguccagagugagguguccagaugugugcguagguaggcagauagcagaggagccagccucaaccaaggaaaacagaggagauguugacagcaguauuuguuacugugcuuacuuucuuuacuaguauuacgagaucuaggagacagucaaucagcacugaguucuaggacaggaagggaacagucuaacuauguguguucaucucuguguacuucuuaucccagaccuaugcagagauggaccccaccacagcagccuuggaaaaggaacacgaggcgguaagaaucagcaggucuggggaccaguggggugcucccugcccuggggaccagauggggugcucccugcccuuuuucuuguuccuaaugagcucugagcugugcccuguccucgucucucucugucugcagaucaccaaagugaaguauguagacaagauccacauugggaacuaugaaaucgaugccugguauuucucaccuuucccagaggacuaugggaagcagcccaagcuuuggcucugcgaguacugccucaaauacaugaaguucgagaagagcuaccgcuuccaccuggugaggcugggucacuccccuggggcaauaggaaugaguccagagaaacuggggggaaaacacccaagggacuacuagagcccuagauuccucugggcgugguaguguuuccuauaauccuagugccuaucgaaugaacaaggaggucagaaguucaggguuauccucagcuacauaguccaggguuggcauagccuuuggagagcuggcucagggguuaagaacauggacugcuguugcaaaggacccaaguucaguucccagcaucaucaggcuccuguaacuuaagcuccaggucuaaagccuuccucuggccucugcuggaacuuguauuuauagacacaugaguauacauacauacaaacacacauacaugcauauguacauacacauauacauauuguuaagaauaaaaaucuguuuguuuguuuguucguagauuggccuuaaacccauagauauccaccugccucugccuuuggagugcugguauuaaaggugugugccaccaugcccagcuaaaaaaauaacuuuuuuaaaagaaagacggagggcuggaaagauggcucaacagucaggagcacuggcuguucuuccagaagacuuggguucaauucucagcacccacauuggcucacaacugucuauaaccccaguuguaggggauccaacauccucauaaagacauacauauaggaaaaaaaacacugauguacaaaaaaugaacaaauuaacuuuaagaaaaagaagaagaaagagcaacagagacagguggaucucugaguucgaggccagccuggucuucagagagaguucuaggacagccagggcuacacagagaaacccuguugcaaaacacaaaaaaacaaacaaaaaacaagaaaagaaaggaaaagaagaaaaaaaaggaaagagcgcucucuuucugcuuccagauaacugaccagcuuacugccucucuucagaccucaguuucuucuacagaauggagaccaaaauuuucaaguuccuugcccuuuacuaaggccugguguugggcuccucaguauaaaaagaggcaaccaauagcuccugagcaaugaugucaguccauaggaagaagugcuuuuccacggcugccaggaagggggcgcuuuucacuagcacagcaggauguuucccaaagcuggacccgagaugaaugaaugaggguuaggaagacgcuugagcaaguuaucagcucugcgcccauuaggaaauggacccuaagccaggcggugguggcacacaccuuuaaucccagcacucgggaggcagaggcaggcggauuucugaguuugaggccagccuggucuacaaagugaguuccaggacagccagggcuacacagagaaacccugucucaaaaacaacaacaacaaaaaggaaagggacccuauucugcugaugagaaaccagggucacuggauauaagguguuauacauagggccugcagauggcaaagcuaagaguuacauugggccagacuggugagugaaugccaccuggcagagauccaaaggucugaagugugucccucccuggauucccagggccagugucaguggcggcagcccccagggaaggagaucuaucgaaagagcaacaucucuguguaugaaguggauggcaaagaccacaagguaagcugguagcccagggcuugugggaaacucuaaccauuaucauauuauugccucugccgggcagaggccagcccccagugaguaucuauaucuacucuuggccaagugaggucucaugacccuggugcuuggccuguauugauauauagugaacacagccucaggccaggucucccaacuguuucuagggacuccuuggcugacaagggugguucuguuugaguaguucuggagccuagagacagacugucuugucugagggugcucuuuaaacaacuuccucuuucugugugacccaaagauacuuccugcaaauauagagauuuccuauuccacucugaagcugccacugaguuccugcuugucacaggagugacccuacugguagcaggcuuugaagucugcucucucccugccugugggucugagagagcuuuagcaaguguuugagucuccccugaagggccauguaguacuaggcgaagaggacaggcuucucacagcaccaugucacuuccuggcuggucucagacaaguuaccuaaccuuguuuugaucuuguuuccgcauccauaagacgagucauaauuauuuaccucaucuguuugcacaaaugagaccacaaaugucagguauguagcacgugccuagcaucuaguaggcuguugguaaacacagccuuuguugucuuuggugaccuuuggagcucagguagcccugugcuaggggaaucccuaccaagccugguucuugcuagcuacucuggcuuccuuuagcaugaacuguuaggaugacagaagggguucccacucgaaacugggggcguuuaccagcuccaccuucugucaacuuugaagccagccuccuaagucacaucagaccagcagugcugggcucacacaaucuuagauuggauaagagcagaaguuaggagguaucaaaaaccaggcauccucuguguggacucaugccuccaauccuagcacccaggaugcugaggaagaagaauugcuacaaauuggaggccaaccugggcuauagauugucuaaacccuaaaugagaagagcugggugugguagcacacaccuuuaaucccaacuccagggaagcagaggugggcggaucucagaguucaaagccagucuaguccacaauucuagacgacaguaagaccuuuucucaaaauacaaauacaaagugaaaaaaagcaaacaaacccccaaacccuuuacaucuguacuaggaacccagcuacagggguauugucucucccaaugcuggcccuggcagcaacuguguccugcugcacagaccccccaggccucuccaguuggcaguugccagcuuccacuuagcagcuuuguacugacuguuucaggcucacccaugaaugaggcagagccugggcccagcugaguuugaguccuggcauucaccagccuuggaaccuaaaccguuuuuccuucugagccucuguuuccugcucugaagcacaagcuaaugucuguaaagacugacgcugguuaugcguguaaagcccuacccucuauuuggcccugaaaaguggcuggguggcucaguagguaaaagugcucauuucguaagcccggcagcccaaguuuauccuggagcccaaaauggaaggcaagaaccaacacccaggaguugcucucugaccuucacacaugcaccacggugccuguguuccuucccacugaccuuuaaggcaggcagaucacuuuguguuugaggccagucugaucugcaaaauaaauuccagugaaacccuggaugaguggauagacagacagacagacagacaaaguagaagcuggucugcacagugagacccugucucaaacaaauaaauaauaauaagggaagccaugaugagucuugcucuccugcuccuguuggugccaacaggcuucacuuagagccuccuguccaccucgcugacuggauggcugcuuucugcuuugaauucuguguucugaggagggggaggggcuacauccuuugcccgacucuggcuccucugugcagccugguucuuagagggcugcagaguagccaccggccgucccuggacguguuugcuuacugucucaaccuuuuaucccuagauauacugucagaaccugugucuacuggccaagcuuuuccuggaccacaagaccuuguauuuugauguggagcccuuugucuuuuacauucugacagaaguagauaggcaaggggcucacauuguuggcuacuuuucuaagguacuggagagccuggggagaggguguuauugacuaggaugggggcuggcccucccaaaggaccugaauaccccauauucuacaggagaaggaauccccagauggaaacaacguggccugcaucuugacccugccucccuaccagcggcguggcuaugggaaguuucucaucgccuucagugaguagcugcugcagccuaggauguggguacuggaguuggggaugcugagggcuggggagagacuggauccuuacgauucuuucugccacugccagguuaugagcucucuaagcucgagaguacuguaggcuccccagagaagccacugagugaccugggcaaacucagcuacagaagcuacuggucaugggucuugcuggagauccugcgagacuuccggggcacauugucuaucaaagaucuuagguaagggccuugguuucuagccagguccagaauacacugucccacuggggacuuugugaaggaucgcuuggaacccuaaaggaaggggaucccccaagauuggucaugggucuugucucuuaucccuucauugauuccauaugcucgaauccuucucuacagccagaugaccagcaucacccagaaugacaucaucagcacccugcagucccucaacauggucaaguacuggaagggccagcauguuaucugugucacaccuaagcugguagaggaacaccucaaaagugcccaguauaagaaaccaccuaucacagguguguguggggugugugugugugugugugugugugugugugguguguguauauguguuuugugaaugcguguguguuuuggcagggugggauaagaaccaaggacucuuuggcuguuacaagauuguaaaccaguugaaccaguuucuaggauggcagccuagaagugguuacucauuccugggauccccucccccccaagggccaaggcucccuuuuguucucaucccgugaaggugaaaccuggccugcucccagaggagcagccaggcgugagcggcccagaggcccugcuuaccucucaugccucuuuccucccacaguggacucugucugccucaagugggcacccccgaagcacaaacaagucaagcuuuccaagaagugaguggccugugcccugcuugggaucuggguuuccuggccucuaaccuguaaauauguguacagaccuguuuugugucauuuauucauaaaguaaaaucugcuggugcacuggacuuuggagguacgcagagaugccaaagggugguauucuucauuucaucucacagacagccagcuguguuaaaaaca

SEQ ID NO: 4127 - RNA, 18249 nt, Mus musculus
cguacuuaaggcgggcgcgggaggcggggccgcucaguccucgcggcaucgcuucgcggucgucuggaacuuuguugcuuggcggccugcgcugcgcgcgugcgcggacauggcuucaaacgguaugugggagcgcgaggcggcgacggcgcgucccugcgaggccucguucccucgcagcaaggcuuuuggcuuucggcugggccugcgguggcgggcgagugggcucccccaccucuggcgggaagcagcggguggagggaaggggagggcggugucgccauuuuguuuggcuccccuggcgccuuuggcgcggagaccguggguuuucucuccuggcccggucacuugagucgaguguugagagagacgcugccuggcgacguggggugaccggggugagggagcucugggucuccgcagcuucgccccacccccuccccucccuccguucccggccucgcuuugucgcagugcugcauccgggcacuuggugcgcgcacgcgcuccucuggccccucccccuucucgccgcggccccccucccccccgccaggaguugguccguuuuuuuuacuuuuuucuuuuuuucuuucuucuucuuucuuucuuucuuucuucuucuuuuuuuuuuuuuuuuuuuuuuuuuugucgcgagacccucggcggaagacuugugguccggugcuggccucgcccugcucgcugggucccuugggaaggggcggggccaccucuucccgccuccguggccgcgcagcgggagcggaagcuccuggcuggccugcguguccgugggauugggaggaccgccaggggaugaccaacggagucagggaccccggccugaguuucccacuucagaguugaguuuuccuaaggccggaaggaaaucagaggagucgcucuccgaggccacacccucucgcugucaguuuugucccagugcggggguagagcuuggguuuccugcagggagcugcugagcuacagcuucccagauuguugaaagugcugucugcuuugggugcgcaugguaggcgggagcucaguuauuuggagccacacgucgggaaccuugggagcaccaugccauuuggggguuggagagucccauucuucuagcugcuuccuugggcuugaacucaacuguguaauagcgcugacugucaaaguuaaucuugacauccggugauaccaccuuuccuguauacagagcugcugugaagauauaaaauguggugacguguguugcaggccuuggaaagaccugcaacaagucaaaaggauuuuuaaacuuaagggaugaucuguauuuugaguuuuuuuuuuuuuuuuuuuuuuuuuuuaaagauugagccagguuugguggcacacaccuuuaguuucaggacuaagagguagaaguaggcagaucuaugugaguucgagguggucuacauauugaauucugggauagauacauaaucgagacuucugucucaaaaaagaaaaaaggcaaaaaggacaugauguuggauuuuuuuuuuuuguuguuguuguuuuuuuucgagacaggguuucucuguguagcccuggcuguccugaaacucacucuguagaucaggcugaccucgaacucagaaauccaucugccucugccucccaagugcugggauuaaaggcgugcgccaccacgcccgguccgauguggggcaucuuuaaucccagcauuugggaggcagaggcagauggagcuuuguauguauuaaauuggaggccaucccggucuacagagugaguucuaugcagagaaacccugccucuagauagagaaccaguccacccacagagcucuguggcugucaugcuuaguggucgcuuguuuagugggucccaagcaagcccuggguucuacccagaacaaaagucuaagacuuauuggugucuagaaauuugugcuuucuuugcuuuuuguaauaaaacuuggccauuuugucucaugaggaacuaacuuaugccuguuuuuguagauuuguuucaucuggagugccuaguacaaaaguugaagaauuuauuucuauucuuaacuaaaauuaagaccuuuuucuuucccaucuuuuacagacuauacccaacaagcaacucaaaggugaguauacuguuucuggucugaugcuagaagacagcaagggugauugaucuaacuugaguuuuauguauuucuguaugcuuuuguucuuauucuuuuaguugaagauuacuggucuguuuucuuguagcuacggggccuauccuacccagccugggcagggcuacucccaacagagcagucagcccuauggccaacagaguuacagugguuauggccagucagcugacacuucaggauacggccagagcagcuaugguucuucuuauggacagacccaaaacagugaguucuuaguagaacacaucuucauuucuuuaugaauguuaacuuuucuuaaaccugaacaauaccgaaauucccacauuuucccuaaaguuuuguagucauucuuuuaaaacaaaaauacugauuuguaauugauuuuauauuggacuauuuucuuccugcuuacuauuuuugugaaaaagcaaguuugcuaaagagagaaccaguuuagaaugacggauaggaaggaaauggucugcuugggaauucuugaaguuggcugacaaucugugauucacagagguggugccauuuuuaccucacaagggcaaaacauuuuucuuuccauaucagcacauuuaaaauguaguuagggccaggagugguggcacacacaacuuuauccagcacucugggaggcagaggcuaguagaucucuugaaucuugaguuggagaccagccuggucuacaaggugaguuccaggacagccaagggcuacacagaaauccugucuugaaaaaaacaaaaacagauuaaaaugcaguuuguaggaaucuuuuguguuaugauuaguggcacaggugucuagauuuaggacagauagaauggaauugaaccuuuauuaaacagugauauuagugacauugaagauguggaaugcugcuguaaucuuaguaccugggauguggcgguggagagucagggucuuguucauuuaggacugguucucaaccuuccauuagauggaauuagcuguaacccuuuaauacaauuccucaucuugugugacccccaacuauaagauuauuuuccuuacuacuuuauauacuguuaaugguaacagauauguucaaagaaagaggugucaccugacagguugagaaccacugauuuagaaguugaggcagcuugaauucugugagaccugucauaaaggauugggugggugggugcagagaugaccuagcagcugagacuggccagauacuugacuauauauuugaggauggucuugagccuucugauuuuccugccuccaaguguugggagcagaagcacguauuauaauacuugcucuuuuuguuuguuuguuuuuuugagacaguguuucucuggguagcccuggcuguccuggaacucacuuuguagaccaggcuggccuugaacucagaaaucugccugucucugccucccaagugcugggauuacaggcgugcgccaccacgccugacuauuuuuuuuuuuuuuuuuuaauacuugguuuguugaagaucgaaugaacuuguaugugugauaaguaaacacggucggcugaacuacaucucuagcucacuccccuuuugcuugagauagcuuccugauuuugaagaucaccgugaaacacugggcuagguuuguuuuaagauuaacaaauuugggcuggugagauggcucaguggguaagagcaccccgauugcucuuccgaagguccggaguucaaaucccagcaaccacaugguggcucacaaccacccguaaugagaucugacucccucuucuggagugucugaagacagcuacaguguacuuacauauaauaaauaaauaaaucuuuaaaaaaauuaacaaauuuuagcugggcgugguggcgcacuugggaggcagaggcaggcagauuucugaguucgaggccagccuggucuacagagugaguuccaggacagccagggcuacacagagaaaaaccaaaaaaaaaaaaaauuuuuuuuuuuaaaucaggaaguguauuuuuuuuccaaucuaauucuugcccugucucccuccucuuucucacuaaguagcuguguuugaccugaacuggauauguagaccaguuuggccucacacugaacagagaucugcuucugucucccaaaugcuaggauuaaaaaugagcacugcauaccuggucuuuuuuuuuuuuuuuuuuuuuaaauuguacuuauaacuuuuuucuuuguagcaggcuauggaacucagucagcuccccagggauaugguuccacuggaggcuauggcagcagccaaaguucacaaucuucuuaugggcagcaguccuccuacccuggcuauggccaacagccagcuccuagcagcaccucaggaagguaaggugguauaggagaggggaaaggccagaagguguuggugagcugcugggucucggauggacuaaaaguaaagcaaguguacuuuggcauuuuacaaaucauaauuuugguuuucauuguuucccauuuaguuaugguggcaguucucagagcagcagcuaugggcaaccccagaguggagguuauggucaacagucuggcuaugguggacagcaacaaagcuacggacaacaacaaagcuccuauaacccaccucaggguuauggacaacagaaccaguacaacaguagcaguggaggugguggagggggugguggaggugaggaaguagcuuuaguucuaucuucuuauucuccaaauuugcccauauccuaaaaaaguggcuuuuuuguuuacuugguuccuaauguuuacuguccuuucagugguaccauugacccuuuccaugaugcuucacaucccuucacuuuuguugcugaaaacugaaacaaauuuguguaugcuaagcauacaugacuacuaagcaccccuccuuacauuaaaaagcauucuuuuguuuuccuuacaggcaacuauggccaagaucaguccucuaugagugguggcgguggcgguggugguuauggcaaucaggaccagagugguggcggcggcggcggcuacgggggaggccaacaggaucgugggggccgaggcaggggcgguggaggugguuacaaccgaagcagugguggcuaugaacccagaggccguggagguggccgaggaggcagaggcggcaugggguaggugucucauaagccagggaguaccuucaguggggaauguugcauggauuuccuuugaagucaaucccuagugcaugguuaguauuguucucugggcauuauguaagggcuucaguuuguggccaguaguguuucuuuguauauucauucauucauucauuccuauuauguuuuugugagaacuugggagccaaaaaaucucauuuauagcucuugaguagagauuuggguauugguguauuuauuuccaaagaaaaagaauauacacagauacauauggauugaagucauuguuaucucaggcaagaaacuugggaguaaagacuuguuugcaggggaaaccuauucuauuccugggaaauauuagggaaacuuguucuguguauucccaugugucuuccaagggaguugguaauggcuaacuugaccucagcuucuaggaauuggcuauuuacucaucuauauucuguaguuacuugaaucaugagccugauuugcacuaauuugacuaugacuuugugugugacuugguucauuuauggggucuucugacugaagugugcagacuuucaggguaaaguacacuuuacagugguauucugcuuucucauuccacuguuuuaccuuuucuuggucaaacaucaaaucaacuuguccaaccggauuucuucuaguugaaguaaaaccuuagauuugauguuaaaacaguuugucaaaucuguuggugacuuugaagggaccuuauuauuucccuugaaaaggggaaaaugucagugguauuucuuuuuuugaagaaagguuuuuugaagaaaguagguaguuuguacaugguaaguauucagaggugggugggggcauucucaaaaccaugcaaaacuaugaaaaacucuuguugugugcguguguuuaaugcaaaacuuuaaaaagaaaaacaacuguuaugugacuguuaacuugcucugcauuuuaugugccacagguaugaaaggugacauugcaaaauacuccgcucuucucacaguguagaaggggugaccccgggggugaagggugauuuaaaaacagcucaguaguuaggauagggcuuagcugaguuugucuugcucuaaggggaaauugccuuugguuaugacuuuuuauggaaugggguugggucugcuugcugcuuucaaagcaaaaaccacaaaacaaaacaaugaaaaaucacguguucagggcuaucucagggccuggugugaaaugucuucugggaaauuugggguagaucuuuuaaaccaacugcuggguuguccaccacuugcuacaagaggaaaaaacaucuacgucagaagaacaaccaaggaaaaugagcuuuuuuuuuccagaggauauagauaaaacuuuuuaaaguaaaauccuuaacugugucugagaaauugcacacgugugugugauaagcucaaaggucagacaaggguggucaggaagggguauauuuuaguagccucuugaaucuuuuucccaaaacaacaauccauguuuggggaauauuaaaaaaaaaacccaaaaaaaaccaaaaaacaaaaaaccaacccuuuuguagccguuggaagcuucauguccuuucuucuaacuugucuucuccagcggaagugaccgcgguggcuucaauaaauuuggugguaagugaacagaguuuccaaaauucccaacucccagcaaugcuuugucugauuguucauuugcagaugucuuagcguguuaagugucaaagguuucuaaagugucuguagccaccuccagaaggggugggguagaaugccuccugcugccagaugugugcuaacuggaggccagcagggauaagcucuuggcagucugcuauguuacuaaauugguuuuacacaaguuaauaguauuauuuaguaggccucuugguggguguugccacaucuagcacuuagugaccacaccauccugggcaacugggggauguucuggaacauguggugccaacuuggcuuuaggauccuuuugaucaguguguccaaggugugugugugugugugcguguguguauguauacacaaucucccaaauguuuuaauuuagggagagggacaugaaauagugcccugcccugaagaugguaaaguugguguauauauauuuauauuaaauagugaugucaaugcaauucuacauauguacucagacaaauauauaggaacuagaucugggaaggaagguguggacuacaagaaagaucuugaguguauugcucaugggaaauaaccagguuuuacacagcacaaacuugaauucauggaaaaaaauggcaaauuugagaagucuccuaguaagcuggaacuuuucugguuuguuuaacaaaaugguuucuugauuugucuaaaaacacuuaaagccaaaggcuuggguucaugacuuaggugucauuguguacagguacaauauuuuuauauggugaauuuagauaaacauugguuaaagauggugucuggaaaaaaauaggcuguauuaugaaaacacuucuggucuguucccugggacaugcuuuuaaaauacaauaguagcuacuauguauguuauuuucauguugcuuuggggaaacaacaugguuaagaaugguuuucaagaugaaauuaaaaauuguucuacaaggguugucuuugguguaaaaguuuggagaaacuggauggaugcacuuuacauugcugguguugagcuuacuaugcuucucuugugagagaacagggccaaguuauguaugaguugguugguuaauuuaaaagaauuacuaauuccccuacccccaucugugcugaggacauuucccagcccuagcugggggaaaacagcauuuucuugaaguguguggcauuaucaauggggauucaaaguagcagaucuuaagaaagaggcccuugucuccgucuagaauuuucuccauugggaaggccucaggauaggguuuggagagaggcuggaagcaauuaccuaauacauuccaagaauuugcauuugauguuaauuuguugccuuaucuguccuuuccuguuagcuaaugguuccuuuuccuuguuuuuguuuucuuuuuuuuuucauguaacuaagguccucgggaucaaggaucucgucaugauucugguaagcccaugguuuuuauauaguauucacuuggauuuucuuagaaacaaaaaauacugcaaaaguggagagugaugggaggggcuguauaaaugcuagaaacccuggaucuggaaguuuagacuucagauucugguauuuauuauuucuaguacgucgugggucuugcuugggagcuguucuuuuaaaguugaugguguuuuaaaguccaaaaauuacuaaaccagacaauuuuuuacuuauuuuuuuggauuuuugagauggauuucucuguaugacucagaaauccaccugccucugccucccaagugcugggauuaaaggcgugcgccaccacacccggacagacaugauguuucguaccuuuauuccuaacaggaugaucucuugaguucaugucuaggccauccugcucuacagagcuaguuccacgacagccugggcuauacagagaaacuaaacucaguuuuaaaaaccaaaacaaagaaaugcacacauguaaacuguugaguaacauuagguggauaaaaagaccagacugaaagauguguuaagggaaccacuuuacuagauguuuuuugaugguauuccuauaggcuauacuauauuuaaaugugaaauuggucucauuccuuucuuuugauuuuuaguuacagucaucuacauaauuauuuugaggcaggaucucuacauagccuuggcugucuuggaacuauguagaccaggcuguuuuuagaauucagagaucuggggcuggagagauggcucagugguuaagaauacugacugcucuuccagagguccugaguucuaaucccagcaaccacaugguggcucacaaccaucuguaaugggaucugaugcccucuucugaugugucugaagacagcagacagugcucacauacagaauuaauuaaaaaaaaaaaauucagagauccacuugucucugcauccagagugcugauauuaaaggaguguuccacuaugcccuggcauaaaaaguuuuuuuuuuuaaacuaaggagucuagaaaugaaaguuuggaaacugguuuuuauauuggguguugguguuucaaggacaguaaugaguaaauguaaaauuuuugaaggaaguagauaauacuuaaauauggauuguuuuugauuauccaauaagauacuguguaacugguaagaauccugagcauuuuucuugaaagcuuuaaaaguacacauauaugguugguauaccuggcuaacuugucuuuccguuuuuucuucaaaccuuucuuuuaauguguuguugaacaagcagaacaggauaauucagacaacaauaccaucuucgugcaaggccuaggcgagaauguuacaauugaaucuguggcugauuacuucaagcagauuggaauuauuaagguacuugauaaacaguagguacuuccucuuaacuguauuacaggcucuuagauucuugccauuagaaacaagucuuagugaucucaguaguaaaaacaaucuuuggcauuuuuugagauuggaguauaauccuuuuuucaaaaauauauuuaaucuguuuauucccagcagagacaggugaucucugaucuagguucauggcuagccuggucuauaugagguucagaacagcuaggauuuuguagcgacugucucaaaaaauaaaauucaguggaauguugggauuuuaaguguauuccucuuauagcuagcaaaaccaaugguuguugcuuuuuaagaagaaaccacagaaagauaacaucugaugaagagcuugcucaaagacaguguaaaccauggcuagauuuaaguuacaugacaggaagaguaauugggaagagaggagccaaaguuuggaauaaguguuaggggaaagauggagguuugguuucuacaggcucugcauuuguagauagaacuaacuuuagaucaguuguauuuaauuugaacuuguccagauuaaaacaguauaacaaaacaacuacauaacauugcuauuuagguauaauuguaaguacugugacguuuuggugccuuguuggagauugagcccuaugaauuguggcagagaaaguacuguauccacugaguacauccauagccuauggagauauuaaagggaguacagugaauuguauguaggcuauauacagguacuaggccaagacuugcaugugucaucuaaaaaucguuuuuuuuuuuuuuuuuguuguuguucagacaaacaagaaaacuggacagccuaugauuaauuuguacacagacagggaaacuggcaaguugaagggugaggcaacaguuucauuugaugacccaccuucugcuaaagcagcuaucgacugguuugaugguauguauuaaaacuagggugggcuguggguuagggaagcagguuccauuuuguuuguuuguuuuuuuuuuuuuauuguguauggaaagauguuugauguucagacaaugacuuacagguaacaguucuuuuaagugguucauagggauggaacuugaguggucaggcuugucaucaagcaccuuuaccuguugagccaucuuggugugguuucauuuuuguucgugucccauuaguauucuauacaucuuuccaagaagacagucuuagaucuuuuggaucuaaguguuuuggaucugcaggucucagcauuuauuguguacaugggugcgcaugugcaugccauggcauaaguagcaaaccaucugggguaauuccuuuuaccauaugggcucauaggauugaacaugggucaucaggcuugguggcacucauaccaaguuaucuugcuuuuuuguauggugcuggaguucuaaaucagacccuuucauauuauacugcuuuuacagcccugucuccccaccccgucuuuugagacaggguuucucuguguagccuugacuggucucaaacuagagaucugccucuugaguacuaggauugaaggcaugugccaccacugaccagccccaaaaccuuuauagcuacuuguaaaauucuuacuuuuaaaaguuaaauuagccccuuaauuagcaccaucuuggggccucaugaaaggacucugcucuggagucagcuccaccacaccacagauguggacccuucucaaguggcacgcagcccaauucugagccugucuccuuguuugugaaauagaaacaggaguaucccauuuggguucuugugaauggcacauguuauaaaauauggcaaucacucagcccugaaccucauacagcauuagcgcagcaaaucagaauucucucauuuacucuccccaaacacaugggcucacccccuuccucuaauuuccuccccaauccaauucaaguaaauuugcuguugcgggagagggagugggacaccacuguguaaggagucuaggaauggggaauuuuccuggaaacugggagaagauuccuugaugcagaggcggcuaggaggaacaugagcuaaccaguacccccagagcucccugagacuaaaccaccaaucaaagaaaacacacggagagacucaugccuccagcugcauauguagcugaggauggccuagucagucaucaaugggaggagaggcucuugauccugugaagguucuaugccccaguauaggcgaaugccugggccaggaagcgggaguggguggguuuuuggggaggcagaggggcuagggcauuuucggaggggaaacuaggaaaggggauaacauuugaaauguaaauaaagaaaauaucuaauaaaaaaaguuaagagugaagcugggcauggugaugugugccuuuaauuccagcccuugaggggcagagggagguggaccucugaguuugaggucaccucaaauagugaguuucaugacagccagggcuacaacuccgucccaaacaaacaaauaguaaauuuccacaaagguuuucaaacauacuuaguuuugguuaaaucacccacuguuacuucuuaagguaaagaauucucugggaauccuauuaaaguuucauuugcuacccgccgagcugacuucaaucggggugguggaaauggucgcggaggccgagggcgaggaggugagucuuuuauauuuuucugguuuaaagagguuauggaacacaauguagaagaugauaaaaauaaguuuuauggaagagguaggcuaaccaaacuaaggaaaugauuaaugauugcaucuguacuaggacccaugggccguggaggcuauggaggagguggcagugguggugguggccggggaggauuccccaguggaggugguggagguggaggacagcaacgagcuggagacuggaaguguccuaauccgugaguauuuugcuuuuuuuaaaaaguucuugugugguguuaauauuuuaaguguuuggaaguuugcaaggucauguugucaaugggagauugaguuuauaguuuaccuaggaaggucaguuuuuaguuuuuggacauacuaucuuaccaagugcaugucuagaacuuuagggaguacagaacccuauuugucuuuuuuuaaagacaguuucucuuugugguccuggcuguccgggagcuuaccauaaagacccagcuggccucaaacuuaaaauauauacacccaucucuaccuccuaagugcugggauuaaaggcuugugccccaaucaccugguuuuuaguuaauuucccauugccacgauaagacaucaugaccaaagcaacuuagagauaguguuuaacuuggggcucaguuucaggggguuagaguccaugaccuuagugguugggagaauggagcugagcaggcaggcauggcaugggauaauagccgacaacucaucuugaggcaguaacugaggagagagaacuggguuuuugaagucagcccccuagcccaccuccuaauccucaucaccugggaacccaguauucaaacaugggccuaaaccuccaauugccauucaaaccacaaauaguagauacuaagagaccuauaacugagauuugaaguggguagauagugcaggcagcguaaugugcuggacagaaaggugaugggugaucauguguagauaacaguggaguaagacuuaauuucaaacaugaauuacugaaacuuuguauugacagcugaucugugacuaaccuaaaguguggaaagguugaaagguaauuguuuagguuuaauaacaacuuuuguuuugguucuuggugagaaauagguuuugaaguuuugugaauucaauuguaccucuuacaaauugccuuucauuucuuuaguacaugugagaacaugaacuucucuuggagaaaugaaugcaaccaguguaaggcaccuaagccagauggcccaggagggggaccaggaggcucucauauggguaagaagggagcagagcuggaacugagagcuccagaaagagccccacacuugagauuugcaaaggucacgggagggaagguagaagaauugaagaugauaacaugacuuuuuuucuagggggaaacuauggagaugaucgacguggcagaggaggauaugaccggggcggcuaccggggccgaggaggggaccgugggggcuucagagggggccggggugguggggacagaggcgguuuuggcccuggcaagauggacuccaggugaguaagucaaaacaaaagucaagaaaauuggucagagaucaugaggaaaucagguuucccugggaaagucagcuuagcugguuacauuuuugggaaggaagaagaaaaguucagaacccagucuuugaggcuguuuugcuuuaaagucauuuguuggguagcagagacuugaagggugugcauggguaggguaguucaguaacacguaaucuaacauaacuuuuucuuucaggggcgagcacagacaggaucgcagggagaggccauauuagccuggcuccugaaguucuggaacucuuccuguacccaguguuacccuuguuauuuuguaaacuuacaauucaggaucgcucauggauauuuuuuuuugggggggguggggcgguuguguguguaugugugugugugugugucagacuacccuaauuguaaccauaucucugguucccauuaaaaaacaucauuuuaguuaaauucuguuucccccaguuuacuuucugaagaauggguccauguuauuaauguggggcaguauuauucccccagaaauugucuugcacagcaagaauuggaauaauuuuuuuccuaccuagcaggaaguaagauaaauacauuuuuuuuuuuuccugagacaggguuucucuguauagcccuggcuguccuggaacucacuuuguagaacucacuuuguagaccaggcuggccuugaacucagaaauccgccugccucugccuccgcagugcugggauuaaaggcgugcgcuaccacgccccgcucagauaaaguaaucuugaugcaggagagaaaagacaauuugucuugugugguuucuaagaaaguaaaauaauugcuauuuucucaggaaaaggacaauacauacagaggucuaaguggaucacaucuugccuaaauccagcugugucuauaggucauuugacauuugaugcuuugaacucaacauuguguuucagcugagauuauagaauuauagaaaauuaauauagcccugaccuugaaacugccuccugggugcuaggauuaaaggugugugcccuuccuggcuacaguucuuuuaagggaaguugaacgauaaagggaaacuggugaagucagugguaacgccuuuucacuuguuauguuuaauaacaacccauacuuagcaacauuuguugaauauucaaauuaguauguagaacugaaaaccuugguaaucccagcaccggggaggcagaacuuccagcuugauugagcuacauaguaauauaauacccugucccaaagcuaacuaauuacccaaaccaguugagcaugguuauggauuucuauauuucugguacuuuggagguaggaggaucagaagaaguucaaggccaacauggacugcaaucaugcaacacccccccccccccaaaagacaauuuucccgaaaugggcaagcaucaugucucagaauguaucacaaacaguaaacugaaacaugcuguuauuuuuguguuaugcuuuuuuugagguagaguuuuucuuuauagaccaugcuggccuugaacagaggucuguuugcuucuguauccauaguauugggauuaaaguuguguaccaccaacccccagcauguaaguaacaugcuuuaaaaaaagucucauuuuucucugauuaaagacgagguguaucaucacauccaaccaauugcauaguucucuagcaugaacuugcuuuuuauaggugacacucacaaagaacagucacaguuaaaacugccugggcaaagauggguuuuguguugugguuuacaagauuacagucuucauaauguugacaagagcugaccauugauuuguaccuccacugaagguuuuuuuuuuuuaagauuuaguuauaugaguacacuguagcugucuucagauaaaccagaagagggcaucagauccuuuuuuauagaugguugugagccaccaugugguugcugggaauugaauucaggaccucuggaagaggagucagugcucuuaacugaugucaucucuccagugcuccacugaagguuuuuuuuuuuuuuuuuggauagucuugccuuuucaugccugcuauaggaguccuugaaaauaauccagggacuugggagagauggcugagcaguuagaguaacuggcuauuauuccaggaguccugaguuaaauuugcagcaaccacaucuaugagaucuugugcccucuucugguaugaagguguacacagcacauaaaauuuuuuuaaaaguaugaauccuagguggaugguggcgaauaccuuuauucucagcacuugagaggcaggcugaacucaguucacugucagccuggcuaguugcaggacagcuaaaaaaaaaaccaaaaaucagaaacuuaccaguuuucccacugcugggauuauagacaggcaccauguuggccugauuuguagagaauuucuacguuuguauagaaggugauaacugaagcauaccuuacauacauugagaccuguagcuaguaagugguuucuugcugcugaguugugucccucuccccucaacuacuauccuaagucauaaguuaaaguuugugcugaaguguaguuccccuagacuggguuuuuuuguguagcccaggcuguccuaguauucuugcucuguauaccagacugaccaccuagagaugaauuauuucaucuacagagcuagugacuagaggcaggaaauuauggcucuauuagaggcucaccugccugcauugaaggaguaggcaugcucuaaagguugaauguuccaagugcucuuugggcagugcuauguuacacuugguauaugugugggaacucuuaggcccggauaugaacucuugacaugcuauuugauguguuaauuugguuugagaagcacucuuucacauacuagggugcuaauauuuuagauuguaucgcuaauuuuuacuuuuuaaaaauucauuuauguguguauuguuugcauguuagguguggguaugugcagacuagaggacugugggaaucacuuggagguaguuauuacaggcaguuaaucgaauguugugggugcugggaauuaaauucagguccuauaggaucuaguaugugcuuucuugguauuuuuuuuuucucuucuuuuugaaacuauagcccuggcugucauagaauuugcuuauuaugaguuuguugaccuuggagacauccuuuccugucccaaaguugaaguuuuuuauuaccagauagcuagugcccaguguuugguauugguuagguuuaguuauaguaauguggauagaugaaauaaauggaugauaaaguugugacauccagugcuuuguuuuuuguuagcuuucugacgucugcuuuuagcuucauucuuauuacuuaccaggcaaguaauagccuuucaugugucucuuaacugauuauagauuuaguucuuugaauuuuuauuuucaguccuguggauugaaccuagagaaucacugcuagacaagaguucccaaugucugcacauugauuuauuuugaacagggacucuguuguacaggcugguaucgaagucacuguaccacagguuggcccugcauucaugauuuuuuuuugccucccucagcuuuuuugaauggcuggcaacuuuuauacauuuuauacaaauuuauuuuauacaaauguuacugaauuacuggaaacggcuuaucuuuuuauuguaggugcuuguaauugaacuccgaccuaucuaugugcuguguguuuacacauuuaugcacauacaugccauuuuauuuuauuuuuuuaauaaaugggaugugauuuauacauccagcccuaggacuggggcagaaucagguggauggaucacugaguucaaaaccagccugguuguaggccagauaggccuauauagugagguacuguguucugucugcuuugaguaugcuggugcacaucugcaauugguuauguguggaaaugagaggaaguguauguuauuucaguugaucuuguggguucuaggaguugaaauggcaucauguuugauagcaaaaauccuuagcuuucuuuugauaacagcugugcucauuuuccccuaugugaaguggcauaugagcauuaaccacagacuauguuaauuugcuuacaua

SEQ ID NO: 4128 - RNA, 2497 nt, Mus musculus
ucacaaaggacccuucuaauagacugugcauaccaauaaaaggcaaccuuuuuuguccucuccaaucacuaauaagauuucacgugaacuuguuaggccuuugaucccaggccuauuuaagacagggaucuaggggucaagugagauucaaaaaauuccauagguaggaccauaaauaacacuuggaagaguagcuacuggacuggggaugaaacucgguuguagagagcuucguucacccugguuuugucuucuguccacugaaugauggcaauaccuguuaaucucagcacugcugagagaccugaaaguacagaugagagaaacagaauggcccugaagcucacagcccagaguuaguaugcagcaaaaagaacaggaacuccucccuaccucaagguaagaaacagaacucuggaguuugucuucaagcuucugugcagacaugcacccguguuuauauucacacaauacgaucuucauuucuuuaaaggauaagcccuugggguuggagagaugauucugcagucguaacgacugcuuuuuccaggggaaacccauguuaaauucccagcauuguguggaggcucagccaguaacuccuguuccaggggaucugaugcccucuucuggcuuugguuggcauugcaugaaauggugcacacauaugaacagccccacccccaaaauccacacauaauuaaaaaaaaaaaaaggcuugggcugggcauggugauacaugcauuuaaucucauaacucaggaggcagagcugggcagaucucuugaguuaggccagccuugucuagacaggaguucccagagcccaaagucuucuacggacugguuuguuucuaggugccuuucuaagccccauugccuguuuuuuuuuuguuuuuguuuuuuugagauaggguuucucucuguacccuuggcuguucuggaacagccuccucugccuccugguugcugggauuaaccauuaccugguucccaucccccccucucgcuuuuuagcuugaccuggauaauguuacauguguucucaaagguagccuuuugggauaauaugggaaaagcucccaaauggggagccaggaaucauuugagaagccuuugcacuagaauggagaagccauaacuugggucuguggaauuuagguguuggagacugauuugugcauguuugguauauguucuaccacugggccacauauggccuuuggaaauguagcuuagcucagcaaaaacaucccagagaguaaacacaaauacaaauuguuuuuucaaaaauuguguauacaaagucaggagcuagauaauguagcuggaaaagauaccucagcucugcuccagguccaucaccaaguagggauguauuuccuucaaggccuggaggagggaguccuugcaggucagguuccaggauggaacaaagcugaagagcuuccucaucuugucuuggcugguggucucugcacgaacugccugguacuguccuucagucagcacacugccaugcaaagcauccagcacuccguccacuucugugacccuggcaaugagugcuugccugugcugguccacaaaguguccugaggguggaagugaaagcaguguuuaaaacugcuucaaaauuuacuaacgcaguuuuagggguuggagaaucaaggaaagccacccaccaugacuacauaggcaaagauaggcugugcaagggugugguaggguggggaggccucaccuguucuggcuguacucugagcagggacacuggcugcagcugccacagcuccagacucugcaaagaaaugccagguggaucuuuaucaacagacuuucagggguucacucccacuccacccacggugcuaaguucaaggcuacaaagggaagauuuuuuuuuuuuuuuuuuuuuuggcuauggcaggaggaacaguuaagcgccaaagaggcaagccucugcuggugugcaggaaguugaggguagacgaacaaggggacacacucaccuucuuuagucguuugcagcugcucagccagcuccuguaagcccaugucucuaagcacagucauugugagcuccaagccauacgacuccagauaguagcugacaaguuugucagugagaucuauggcguccaucugcagcagggccccgcgugggaugcgcccauagccuucucgcaguugcacugucagcagcuucaucuugaacuuuuugaguucauccccugacaaguuuucaagagcguccaggauggcaucucgugcccgccccauggcucuggggugggcagccgcggucaccuuuuacucuugcugcugcucgccugcugcagccugccugcugccagcccgccaagaccaggaagucagcugcuuaggccgaugggcaugcugggacucccccacccucuuuucuuacagcuccuguucuuuccccagcaaacuaguuuugguuuccgccccuaagacuuucagacuuggcuuuuugg

SEQ ID NO: 4129 - RNA, 2497 nt, Mus musculus
ccaaaaagccaagucugaaagucuuaggggcggaaaccaaaacuaguuugcuggggaaagaacaggagcuguaagaaaagagggugggggagucccagcaugcccaucggccuaagcagcugacuuccuggucuuggcgggcuggcagcaggcaggcugcagcaggcgagcagcagcaagaguaaaaggugaccgcggcugcccaccccagagccauggggcgggcacgagaugccauccuggacgcucuugaaaacuugucaggggaugaacucaaaaaguucaagaugaagcugcugacagugcaacugcgagaaggcuaugggcgcaucccacgcggggcccugcugcagauggacgccauagaucucacugacaaacuugucagcuacuaucuggagucguauggcuuggagcucacaaugacugugcuuagagacaugggcuuacaggagcuggcugagcagcugcaaacgacuaaagaaggugaguguguccccuuguucgucuacccucaacuuccugcacaccagcagaggcuugccucuuuggcgcuuaacuguuccuccugccauagccaaaaaaaaaaaaaaaaaaaaaaucuucccuuuguagccuugaacuuagcaccguggguggagugggagugaaccccugaaagucuguugauaaagauccaccuggcauuucuuugcagagucuggagcuguggcagcugcagccagugucccugcucagaguacagccagaacaggugaggccuccccacccuaccacacccuugcacagccuaucuuugccuauguagucaugguggguggcuuuccuugauucuccaaccccuaaaacugcguuaguaaauuuugaagcaguuuuaaacacugcuuucacuuccacccucaggacacuuuguggaccagcacaggcaagcacucauugccagggucacagaaguggacggagugcuggaugcuuugcauggcagugugcugacugaaggacaguaccaggcaguucgugcagagaccaccagccaagacaagaugaggaagcucuucagcuuuguuccauccuggaaccugaccugcaaggacucccuccuccaggccuugaaggaaauacaucccuacuuggugauggaccuggagcagagcugagguaucuuuuccagcuacauuaucuagcuccugacuuuguauacacaauuuuugaaaaaacaauuuguauuuguguuuacucucugggauguuuuugcugagcuaagcuacauuuccaaaggccauauguggcccagugguagaacauauaccaaacaugcacaaaucagucuccaacaccuaaauuccacagacccaaguuauggcuucuccauucuagugcaaaggcuucucaaaugauuccuggcuccccauuugggagcuuuucccauauuaucccaaaaggcuaccuuugagaacacauguaacauuauccaggucaagcuaaaaagcgagagggggggaugggaaccagguaaugguuaaucccagcaaccaggaggcagaggaggcuguuccagaacagccaaggguacagagagaaacccuaucucaaaaaaacaaaaacaaaaaaaaaacaggcaauggggcuuagaaaggcaccuagaaacaaaccaguccguagaagacuuugggcucugggaacuccugucuagacaaggcuggccuaacucaagagaucugcccagcucugccuccugaguuaugagauuaaaugcauguaucaccaugcccagcccaagccuuuuuuuuuuuuuaauuauguguggauuuuggggguggggcuguucauaugugugcaccauuucaugcaaugccaaccaaagccagaagagggcaucagauccccuggaacaggaguuacuggcugagccuccacacaaugcugggaauuuaacauggguuuccccuggaaaaagcagucguuacgacugcagaaucaucucuccaaccccaagggcuuauccuuuaaagaaaugaagaucguauugugugaauauaaacacgggugcaugucugcacagaagcuugaagacaaacuccagaguucuguuucuuaccuugagguagggaggaguuccuguucuuuuugcugcauacuaacucugggcugugagcuucagggccauucuguuucucucaucuguacuuucaggucucucagcagugcugagauuaacagguauugccaucauucaguggacagaagacaaaaccagggugaacgaagcucucuacaaccgaguuucauccccaguccaguagcuacucuuccaaguguuauuuaugguccuaccuauggaauuuuuugaaucucacuugaccccuagaucccugucuuaaauaggccugggaucaaaggccuaacaaguucacgugaaaucuuauuagugauuggagaggacaaaaaagguugccuuuuauugguaugcacagucuauuagaaggguccuuuguga

SEQ ID NO: 4130 - RNA, 3332 nt, Mus musculus
uuuuuuuuuuuuuuuuuuuuuuggcuauggcaggaggaacaguuaagcgccaaagaggcaagccucugcuggugugcaggaaguugaggguagacgaacaaggggacacacucaccuucuuuagucguuugcagcugcucagccagcuccuguaagcccaugucucuaagcacagucauugugagcuccaagccauacgacuccagauaguagcugacaaguuugucagugagaucuauggcguccaucugcagcagggccccgcgugggaugcgcccauagccuucucgcaguugcacugucagcagcuucaucuugaacuuuuugaguucauccccugacaaguuuucaagagcguccaggauggcaucucgugcccgccccauggcucuggggugggcagccgcggucaccuuuuacucuugcugcugcucgccugcugcagccugccugcugccagcccgccaagaccaggaagucagcugcuuaggccgaugggcaugcugggacucccccacccucuuuucuuacagcuccuguucuuuccccagcaaacuaguuuugguuuccgccccuaagacuuucagacuuggcuuuuuggcuaggcugaagaaacuagguggagguggguugguggaggaagugggguggggacagaggguggagcuaaguuguuacucuggcagguccggagaugcugagagacucaauagagcuuacuugcaaaccagcuguugcugaaaagcaaccuguuucuguugaguuucuuggagcauagagguuuagaaucuuggaaaucuagacgccccaaauuuuguuuccccagaucuuaggauccacucacaugccauugaauauuagaauuuuaacagcuagaacacuaagccccuugaauuccacagauuuggacaaaaugaagugcgaaagagagugacuaugucuucaccuuaguuucuuucagcuaaaaguuuuugucacucccaucucucagccucacaucugcuagaaggugggggaccugggcucaugauggguuggguuggaagggcuaaggcuucuugaaaccuuaccaaaugccccagcuauuaaauauuuuguagugugaugacaacuggaguguagagaccugaguagacagcuagcuacccccuuacuccugggcugguuaggaugaccuuggagccugcucuguacccagaauuccuaacuggcuuuaaacauggcugggggucuacugguccaucccaguuuugaucuagucagucuuguuuuauaccacacugccaguuuacccuuaucuucaagcucaguuccucuggaguugcuuuuucaauucuuugcacaugcuguucccuaaaccuugaaauugcuucucucucagacaaaugcuuggcuccucaacccucagguuaaauguuacuuccuccgagaguccagucuuaagaguccuccaucuacccaucuagaucauauugcugcuagugaacaaagcuacuuuuuuguagcucuugugcuuuugugggggaggggaggcuagggagguuguuauaaugcccagcaugugccaagggcccgcuaccuagucaccacuuaaugcuuugccuauuuauuuacuuuagauaaccuuguuguguaagcuaggcuagucuugaacuccugauccuuuuugcucagcccccugacugguuggaauuggaauagcagguguauucuaccacaucuggcuuaaggagccucccuccucuauacaggaugccauucuguagcccuggcuguccuggaacucgagauccacgugucugcaucgcaagugcuuggaucaaggugugugccacuaggaccagcagaguuuuaacucuugacacuuuacaacuauggauuaaguuugcagggugacagaguguccauccuuguggcaugguauaccagcagcaauuguggugagauagccaguguaccuugacucauggcuuaugguuccucauugaucccuccauaauuuucagaucauuauggccauauaugcaucuuacagccuacacaaaggauguugucccuuuccuacuccuaugaguccccagauuccucagagucaaaugucauuacuaaguaauuuucaacucuucuuuaggcugggauccuccauaagugucacuuacaugcuuuuugacaguccuuuuaaugggaaagauagccauguacaaaagggacgauggacucaagagcaccuuggucugauaacuuaucagcuuagcuucugucuuuuuaaaaauaacuggucaaaccuagggccucgugcauuuauuuguuucauuucuguucccaacaugacuuucccugcuauuuuacccucuguuuucuccccaugauguucuuccaugucucugccacaguuuuuauaauaugaugugucuacuuuuucuagagucugagaacuuaagagcagaaaccagaucuggaccaucucuggccaauacccagcauagggcuugucacugacuuagccuugaggggccuucauagaaugacaaaaguccuaauccuagaaucguagaaauauacgagagacagaggcaggagguuuugccccaugcacaaaacugaggcgaggugcaagagucugauuugcaaagaaugauaccccagauucagauaguaugcaauagcaaagagcuuuuguuccgcugagauccagcuugcaggcucugccauacgacagcauggaagauggaggcguaggguaggcuuugcaguuuuaaagccuguuagggcaggagugggugccuuuuaccuuucuuucccuugguugguugccuuugugauucucuaaggcucugggggauuuggggcacuuuugcugauuagcuauacuugguucaagcugggugguggggcagcuucuacagcuucugacugacugcccaugggguuagagcaggcucgauaauggggcagcuuccugauuggcuaaccaugagguaugguuuguuuuuuauuuuccuggaauugacuuguuucagacuuuuccaguucugggaaacagaaacuuaggccucgucucccaaacuuccaguuugcagccugucauggagucagcuggcucuggcuaaacucuguccucacaagguaacuagccuuauggcagauuuagacuggcuuaaaugggguaauugagauacaagcuagugggaacaagccaaagcuuaugaccuaggcauuuauucauaauuaaguuucagaguccuuauucugggaacaaagaggccagguagaaaagcugguggcuacaagaaggcuacauaaagaaaccuugucucaccuccccaccucca

SEQ ID NO: 4131 - RNA, 3332 nt, Mus musculus
uggagguggggaggugagacaagguuucuuuauguagccuucuuguagccaccagcuuuucuaccuggccucuuuguucccagaauaaggacucugaaacuuaauuaugaauaaaugccuaggucauaagcuuuggcuuguucccacuagcuuguaucucaauuaccccauuuaagccagucuaaaucugccauaaggcuaguuaccuugugaggacagaguuuagccagagccagcugacuccaugacaggcugcaaacuggaaguuugggagacgaggccuaaguuucuguuucccagaacuggaaaagucugaaacaagucaauuccaggaaaauaaaaaacaaaccauaccucaugguuagccaaucaggaagcugccccauuaucgagccugcucuaaccccaugggcagucagucagaagcuguagaagcugccccaccacccagcuugaaccaaguauagcuaaucagcaaaagugccccaaaucccccagagccuuagagaaucacaaaggcaaccaaccaagggaaagaaagguaaaaggcacccacuccugcccuaacaggcuuuaaaacugcaaagccuacccuacgccuccaucuuccaugcugucguauggcagagccugcaagcuggaucucagcggaacaaaagcucuuugcuauugcauacuaucugaaucugggguaucauucuuugcaaaucagacucuugcaccucgccucaguuuugugcauggggcaaaaccuccugccucugucucucguauauuucuacgauucuaggauuaggacuuuugucauucuaugaaggccccucaaggcuaagucagugacaagcccuaugcuggguauuggccagagaugguccagaucugguuucugcucuuaaguucucagacucuagaaaaaguagacacaucauauuauaaaaacuguggcagagacauggaagaacaucauggggagaaaacagaggguaaaauagcagggaaagucauguugggaacagaaaugaaacaaauaaaugcacgaggcccuagguuugaccaguuauuuuuaaaaagacagaagcuaagcugauaaguuaucagaccaaggugcucuugaguccaucgucccuuuuguacauggcuaucuuucccauuaaaaggacugucaaaaagcauguaagugacacuuauggaggaucccagccuaaagaagaguugaaaauuacuuaguaaugacauuugacucugaggaaucuggggacucauaggaguaggaaagggacaacauccuuuguguaggcuguaagaugcauauauggccauaaugaucugaaaauuauggagggaucaaugaggaaccauaagccaugagucaagguacacuggcuaucucaccacaauugcugcugguauaccaugccacaaggauggacacucugucacccugcaaacuuaauccauaguuguaaagugucaagaguuaaaacucugcugguccuaguggcacacaccuugauccaagcacuugcgaugcagacacguggaucucgaguuccaggacagccagggcuacagaauggcauccuguauagaggagggaggcuccuuaagccagaugugguagaauacaccugcuauuccaauuccaaccagucagggggcugagcaaaaaggaucaggaguucaagacuagccuagcuuacacaacaagguuaucuaaaguaaauaaauaggcaaagcauuaaguggugacuagguagcgggcccuuggcacaugcugggcauuauaacaaccucccuagccuccccucccccacaaaagcacaagagcuacaaaaaaguagcuuuguucacuagcagcaauaugaucuagauggguagauggaggacucuuaagacuggacucucggaggaaguaacauuuaaccugaggguugaggagccaagcauuugucugagagagaagcaauuucaagguuuagggaacagcaugugcaaagaauugaaaaagcaacuccagaggaacugagcuugaagauaaggguaaacuggcagugugguauaaaacaagacugacuagaucaaaacugggauggaccaguagacccccagccauguuuaaagccaguuaggaauucuggguacagagcaggcuccaaggucauccuaaccagcccaggaguaaggggguagcuagcugucuacucaggucucuacacuccaguugucaucacacuacaaaauauuuaauagcuggggcauuugguaagguuucaagaagccuuagcccuuccaacccaacccaucaugagcccaggucccccaccuucuagcagaugugaggcugagagaugggagugacaaaaacuuuuagcugaaagaaacuaaggugaagacauagucacucucuuucgcacuucauuuuguccaaaucuguggaauucaaggggcuuaguguucuagcuguuaaaauucuaauauucaauggcaugugaguggauccuaagaucuggggaaacaaaauuuggggcgucuagauuuccaagauucuaaaccucuaugcuccaagaaacucaacagaaacagguugcuuuucagcaacagcugguuugcaaguaagcucuauugagucucucagcaucuccggaccugccagaguaacaacuuagcuccacccucuguccccaccccacuuccuccaccaacccaccuccaccuaguuucuucagccuagccaaaaagccaagucugaaagucuuaggggcggaaaccaaaacuaguuugcuggggaaagaacaggagcuguaagaaaagagggugggggagucccagcaugcccaucggccuaagcagcugacuuccuggucuuggcgggcuggcagcaggcaggcugcagcaggcgagcagcagcaagaguaaaaggugaccgcggcugcccaccccagagccauggggcgggcacgagaugccauccuggacgcucuugaaaacuugucaggggaugaacucaaaaaguucaagaugaagcugcugacagugcaacugcgagaaggcuaugggcgcaucccacgcggggcccugcugcagauggacgccauagaucucacugacaaacuugucagcuacuaucuggagucguauggcuuggagcucacaaugacugugcuuagagacaugggcuuacaggagcuggcugagcagcugcaaacgacuaaagaaggugaguguguccccuuguucgucuacccucaacuuccugcacaccagcagaggcuugccucuuuggcgcuuaacuguuccuccugccauagccaaaaaaaaaaaaaaaaaaaaaa

SEQ ID NO: 4132 - RNA, 3294 nt, Mus musculus
uagauuuguuuaguuuauauguauggauuucucgcuugaguaugaauguaucucauguguaugccugccuuacgaggucagaaaaguguguuggacuacaugaaauuucagucagggaugauggagccaccaugugggugcugggaaccaaacuuggcuccacuucaagagcaacaaguacuccuaacuuuugagccaucucuccagcagagcacuauuguaugucacagggaugagcaauuuccuuccuguguauccauaagagaacauacuugcuuuaagucugggcaugguauugcauacaugugauccuagcacuuagguaguggaggcaggaggaucaggaguucaaagcaaguuucuuguauauagugagucagaggcuagcuuaggcugugugacuaauuuucucaaagagcuaaacaaaacacaacaacaacuaaaaggaaccaaaacugaaaacuaaaaaacaaaacuccccaaauacccaaauaaccuugcuuuccuucaauuguuuacuuauacacagcauccugauguccaggagcuuguagccuuccugccugcaggauuacaggugacucccagagcuggcuuuacacacacacacacacacacacacacacacacacacacgcauuugcuuuguuuuguuuuucaggacagagguuuuucuguagagcucugacuguccugaaauucacucuauagacuauagaccaggcuggccuugaacucagagaccugccugauuuugccuccuaagugcugggauuaaaagugugcauccucuuccaacagcacucucucauauauauauacacacacacacacacacacaaucucccuacuucucagguucuuaugcagccaagaucaaaguugauccucuugccucagcuucuuaagcauaagccacuccacuccagccucuugcuuuaauuguuuuuuaaaaaugguuuaaagauauuuaauguguauggguauaugguuuauguaccacauguaugccuaguauccacagaggccagaagaggauaucagguugccuggaacuggaguuaucgaugguugugagcgacuaugugggaacaaaccucagguccucuggaggagcagacagcgcucuuaaccauugagccaucucucuacucuagcuugguacuuaagacgugaagaagugagggcaucuuguguaucugucuuguuacugagagcagcaccgggacauucaggauuuaaggagaagauguaggaguuugaagaaccaacacuggaagccuggcguugagaagaggucugaggagaaaaggaaaagagcuuugcaauaucugggacugcaagaauguucuagauagagggguggcaaggacaaaguccucgaggggccagggcggggggaagggugagguacaggucagggcagugaauggggccagaugggaauaaauuguaggucauaaggaagacuuugauuuuuauucugauuaaaauuuauauuaaccaucgaaagauaagcuauuaagaaagccuggugcuuccagcggggcaagcuccaguucugagcuguagacucugguuucaguucauucauuuaacuacuuaccauucauucuccaagcauuuggggggacggggugcauuguuucagggccuaugcuagaaaauagggggaaauacccucaccugccuucccacagguggaguuagcaccauuagcguaagugguugggaaaugaauagguuaaccaacaaugucaaggaggaaggaagccagaguggaagugcuguagggagaggggcagccaugcuugcccacugauucuaagcucuagccuggccugaggaaaggacuaggccaggccaggaugucuccuacugacugcucacacuccacauuuagaacaguuucccgaaagcugugggagggaguggguaggacagcuaaauauaguucuugggccacugaacuaucugggaggguguccacuauaugccuaucaccuguugcauccacccacugccaucuggcccugaaucccugcccuugcauugagccugcugcuugcuucuugcuugucuuggacacaacuccgaucacccugcuguuagaccugaaccugacugguccuccugggagucuuuuuuggccuaaguucucccaccagacuugugaguccugugggccuugagauaugggggaggagagggcuggguauuugagagaggucagugggaggucaauuggagaggggauucuaguaaauuccagaagagugaagguccagaccuaggucacagacugaagccugggcuaaaucaguagcaaggaguuuguggaguggguaaccggggcugauaaaugccuaguugggucacauuuguuuuuaucugggcugagaauggcgauauacgugcccacucugggacgacaccacauccucuuuaccagauggucaaaaccagauucucuuccagugugggaugugagguaguuacaggauggggcucugacugcggggccacagacccaguguaggauugagcuggaauucuuguaaugggacuccucuucccaggcucaccaugucggcugcacccggccuucugcgucaggaacuguccugcccacugugcuugcagcuguucgaugcgccagugacggcugaguguggccacaguuucugccgugccugccugauccggguggcaggggagccugcugcggacggcacaguugccugucccuguugucaggcaccuacacggccgcaggcucuaagcacuaaccuccaguugucacgccuuguggaggguuuggcgcaagugccccaaggccacugcgaggaacaccuggauccacugagcaucuacugcgagcaggaccgcacacuuguguguggugugugugccucgcucgguucucaccguggucaucgucuccugccugccgcugaagcccaagcacgccucaaggugcgggacccggugaaggcagggugggacugcugaacuuucauuaugagcuucugagaauuggcuccagguggcuuaggagggugggcguggcuaggcagccagaaagggggugagggguauccaaaggccgccugcugcgccuguagagcaaagccggcaggaaccggcuaggagcugucugcagaauagcuaccuaccuugcuuggcagcgguccuccagcaagccuggaaaugccagagccgggguuuguccaaacuguugugucugacauauugggacugugaaacuaccuucggcucacacacucuugggug

SEQ ID NO: 4133 - RNA, 7544 nt, Mus musculus
ggcucaccaugucggcugcacccggccuucugcgucaggaacuguccugcccacugugcuugcagcuguucgaugcgccagugacggcugaguguggccacaguuucugccgugccugccugauccggguggcaggggagccugcugcggacggcacaguugccugucccuguugucaggcaccuacacggccgcaggcucuaagcacuaaccuccaguugucacgccuuguggaggguuuggcgcaagugccccaaggccacugcgaggaacaccuggauccacugagcaucuacugcgagcaggaccgcacacuuguguguggugugugugccucgcucgguucucaccguggucaucgucuccugccugccgcugaagcccaagcacgccucaaggugcgggacccggugaaggcagggugggacugcugaacuuucauuaugagcuucugagaauuggcuccagguggcuuaggagggugggcguggcuaggcagccagaaagggggugagggguauccaaaggccgccugcugcgccuguagagcaaagccggcaggaaccggcuaggagcugucugcagaauagcuaccuaccuugcuuggcagcgguccuccagcaagccuggaaaugccagagccgggguuuguccaaacuguugugucugacauauugggacugugaaacuaccuucggcucacacacucuugggugaacuggguggaccugcuagacugguauguuugcaugguggaggaucugguaagacuagcagacagaaaguuaaagucccagaggcccgcuguccagcugugcacccaugcacggcagaggccuacccauuccugaaacuauuaaacuugugcaagccugaaguuugcaaggggagugggaagggugaggcacuccaggccaaagcucaccauggauagguaucaccaacauuccagccuaggcuguuacuauagucuaaacuagaauacagccuuuacacaacuguguuauccugaaguugcaccaggaaaaaaauauccaauuaucaccgaauggguacacaccaaguacacaggcuccuacguaucaucuuguauaucacaaaucacgugugugcagauacuaguggauaggugcccaccuagcccaggaaggucuguuaguaaguauuuauuaggcuauggaaaaaaaaaacaaaacacccaaacccuagcaccaggugcagaggugguggugggggaacugggguccuccuccagcccagugaagcuguugccauugucuucugcugccucccaggcauugcuuucucagcacccagucuucacucucuuuugguagcaauuccugaacaaccuuuccagggccuugccucauggcccuccuuccugugucugccuuacucaguucagcccaguccuggcugugagccuguuguuaggagaccacccagcccaguuccccuuugcuaaucccugaacucuaucuaaccuuguucaucuuuaucugugaagggagacuagaacuuaugagauagaaguguaucaggcuucugggaacaugaggggcagacguggagcuccagucucugggaucugcaucagcuuacucuuaagucuuaggaggucugagaaaggagacccuaggaaagagcccgagggaggaagggaacagggagagcucuggagccugacaugaugccuggagcugaacuucuugggccagccaggcuccccgauaccuucugauggugcuuguuugucagggcucagcccugcgaccaugacugacccugaaccucugacugcagucugagccucugaccauaggcacccggaacaaccaggcuggccucacugucaacagauggugugaugccucgagcgaggaccugugaggcagagacugaccugguagcuagccaggcguccucgguucagcccugugguuuccccugggucaguauuccucagcaaaccaguaggugccaucugauugaaaugggauuguuacugcucccauucugcauagcaggaaaaggagacugaggagaacaguggugguaagaaggcaggagugaccauggcaggcaggagcuguuagcucaucccaugccagcucucagaaggguuagccuuagauuuccugaucucagagcccauaggcgcagaaaaggggcuggcuagggcaccaggcugacucugacugaauuuuuaaagauuuauuuauuuauuauauaucuaaguacauuguagcugucuucagacacaccagaagagggcaucagaucucauuacagaugguugugagccaccguguaguugcagggauuagaacucaggaccucuggaagaacagucagugcucuuaaccacugagucaucucuccagcccaugacugaauuuuuaaguaagggacgaaacccaggaagggaagauuacauucucucuucuccccuucguccaucuuccucuuucuccuccucaccuuccuuucacucuucugccuucccacuccucccuguuccuucucugcuucuuccuccccucauuuuccuuccuuucucuuccuucuucuccucugagacaagguacuagguauuauuauguagcucaggcuggucucaaauuugugauccuccugccucagccuccugagggcugggguugcagacacacacuaucauggcuagcuuccuuucuuuuuuguucacccuucacucauuucuggaagccugcugugugcauauguagacuuugcagucugguggugaucuuguguuugugauccuugcaaggaaauguccugggguuaaccgcuugcagguaaggcuggggaauuaaggccagugggaaguuaggaaauagaacaucaggcuggagagaugguucagcaguuaagagcauugacugcucuuccagagguccugagugcacaagcaucuguaaugggaucugaugcccucuucugguguguaugaagacagguacuaggaugaaguaugguuaggcccagagguauguaaguggauaggggaccagacagagggcuggagaaggagcuaacaucaaggggaaaaguacagauggcaggaggggggcauuccuaucaucucuuuuaauuugucccauagacacagcuuccacagcagaagaugcagcugcaggaggcaugcaugcgcaaggagaagacuguagcggugcuggagcaucagcugguggagguggaggugagggggcugugguggcagaacccugggacuguagguccaggcugagggucccuaggcaagagucuucucauccccaccucaggagacagugcgccaguuccggggagcugucggggagcagcuggggaagaugcggauguuccuggcugcccuagaaaguucucuggaccgugaagcagaaaggguucggggugaugcugggguugccuugcgucgggagcugucaagccugaacucuuaccuagagcaacugaggcagauggagaaggugcuggaggagguggcugacaagccacagacagaauuccucauggugagcacugaagggccucccuucccugcuuucuggccguggcucaggcuccagugccucaucccauugucacauuguucaggggacccugaagccugcaacagggaaggggcaagcuaggacuucauaucaguguugguacucugacugugguucagauuagauggugcgugagugucuccguggcaccacucacgucaugauguucuaggcuuguguguuugcugggacaguuuucuaacagguggauuuauaucuccgggauaaggaaggguaccugucucuguucacaugauaguuaaucuccaaagguggcguugaguccuggguuucuuuaggcuuuucucaucuuucugaccccacacucauuagaacgccccagaguccuuccuuucuuucuacuuuaucuccauucucauuuucucuuucuccagaaauucugccugguaaccagcaggugagcaacugucccuuucucucacugaacuugcuugcccuagucuuccagggauaccagcugcgcaccaugcuuuccaaucaugucucacaaccacuucugugcacuuugcgcugaacacagacacaagacagccuaaguccuuaucccaggaccucacauacuggugcgauggugccucagauguggaauaggucacagguaucauuucaagacugcugggagguggagggauugcugaaggagacuucccaggaggacagacauugaugcugaagcuggaaguauggacgggagcuggcgauauaacacggcaaagggcagacuggccucaagcucacaguguggccaggccuggaaugagcauucuuccugccucgccucgcacaugcuaggguuauuggcaugcuccaccaugccuggcucaagcauuuuaaagggugcauuuauguccagugguauugcaugcacucauguuuccaagggaguuuaaggcaagggugugaggugaggaagcccugaaagcccucuccaacaaccugagcccucuagucuggggaguaacucuuccucccuucaucaccucuccacccccaggcugcagaagauccugucagagucaccaccaccggcaaggcuagauauccagcugccugucaucucagaugacuucaaauuccagguguggaagaagauguuccgggcucugaugccagguacugagauggguggguggcucuucguuuguauaacuuugggguuggugggaggcccaagacacagggaaaggccucccagccccaccucagaaagccacggaagaagauacucuuugcuucugggguccuuccuuauagcccucuaaccugugcuuagagaaggaccuuugagggccugggguugacagugggugaaggccauggaaagcacccagcugaccccaggagcccugcugaggcugggucugggccacggccugugugauccuuggucaguucuugucucugaccguagagauaauggccucugcuggcugacacggccucugggagccuguggcugggggccaagggcucagucucuucuaagagcuaacauuucugggugcccacccacacacacacagagcuguucagccuuuacugccucugguccaggaggguaaauaacaacaacucuaauuuauucaagagaaaacuuuuaaggcccagagacuacaucaagacagacagaacugggcuucuuggcucuuguucuggaucuugggccuuuugugggacuuacuugguaucucccaguccugcccaccucuuacuucacuguguagccgaggagagggggagaggagucuaagguccuuugagagagggaaggcuccacagagcuagccugaccacugucuguuuuggcagcgcuggaggaacugacuuuugaccccagcucugcgcacccgagccuggugguguccuccucuggucgccgaguggagugcucagaccagaaggcgccgccagcgggagaagacacgcgucaguucgacaaggcaguagcggugguggcgcagcagcugcugucacagggcgagcacuauugggagguggaggugggcgacaaaccacgcugggcccugggagugauggcggcugacgcuucccgccguggccggcugcacgcggugcccucacaggggcuguggcugcugggucugcgcgauggcaagauccuggaggcgcacguggaggccaaggagccgcgggcacugcgcaccccagagaggccuccggcgcgcauuggccucuaccuaagcuucgcagauggcguccuggcuuucuaugaugcgagcaaccccgacguacuuacgccaaucuuuucuuuccacgagcgucugcccgggccgguguaccccaucuuugacgugugcuggcacgacaagggcaagaaugcccagccccugcugcuuguggggccggagcaggaacaggccugagcuccugccgacugggagggaggccugguccugaaggcggugggaucacucaggccaccuuuguuaggucuggauggguuggguggggguggauuucuagggccucacccucuggcugaggguggccaggaaguggguguuugucuuauagaguucaggggaguacacagguuggggugcacagggggaccgacgugagggauagagggaagauuacucaggucagugaggaaaccugaguuugggccaagaguuccaggaggaagcugagguuuagggaggcuggggagaggauaggauuuggaaaggauuuaguggaggaucuugggaagucuguggaacaauggucucuucagcccugcgauccacuccugaaggcccccuccuuuucaagguugcagauuccucauacccgauggguuuucaauuaaugcucguaucuaacugucuuuucaaagcccccagcaguccugagagggugcugggugcauggcuauaaucccagcauccaggaggcugaggcaagaggaugaaaguugaaagccagcaggacucuaucaaaaacaacaggggaaggggucagagagggcuuuuuuuuuuuuuuuuuuuuuuuuuugguauuuacuucauuuacauuucaaaugcuauccuggaaguccccuauacccccgccccccccugccccccacucccgcuucuuggccccgguguuucauaucaaguuugcagcagagagggcuucuugaagcuguagagagcuguagagauggcucgguguuaugggcugcucuugcagagcauugaggauccuccagucccaaugaguuugauggucucuuccagccucugugagcauuuguggcacacagauauaugugccggcagaacacugauacauguuaaaaaauaaacagauucccucucuaucucuauuucugucucugucugucuuuggagacaaggucuugguguguagcucaagcuggcauagaauucacuaugugccccaaguuagcuucaaauucccgauuccccucuuccgccucuggaguguugugguuacagguguaugccgccaugcucagcaaagucgguugguugugacaaguuucuaagugacccagaagcugccggucaccuuggcaucacacuaaguacacccugacuguagacuaucaguguagacaagaggcauuaagucugauuauauugccuggcucaacuaacacuuaaaaucugccugaccgagagaggagagggaauaguagaacucuuagucucucccauggccucuagaaugugguuuuguuuggacauugaagaaauccuccaugauuucuuccaagaaauccuccauggaauccuccaagagaaagaguuucacacugucuuucuuugggcccugcugcugccagcaaauaagacuuucuguggggcuucuaaacuggccucuuccugucuuccuuggaacuuugcucuguaacccaggcuggucuugaacucagaaaucugccugucucuguguccagagugcuggaauuaaaggagugugccacca

SEQ ID NO: 4134 - RNA, 375 nt, Mus musculus
uuguuucucuucuccauuccuccgccaucgugcgcgcuauucuugauucggcuucucgccaugucuucucacaagacuuuccgaaucaagcgauuccuggccaagaaacaaaagcaaaaucgcccuauuccucaguggaccuggaugaaaacugguaacaaagucagguucaacucuaagagaagacacuggaggagaacgaagcugggucuguaaggauucacacaauggcaagacugaggauuuauacugaauugucaucaaucaguccuaccagauggauuucaacauuuaaaccuggagacuuuucgugucuuaaauuaggauguuuguccaguaauaaaauauagaaccuuucaaaaaaaaaaaaaaaag

SEQ ID NO: 4135 - RNA, 3587 nt, Mus musculus
uagcgccgccgcaguuaucuugcgagucggaaguucaaguucuagauucuggaacuccgguacuugcacagucgcagaagacauggcgagaaugguauuuaucugugggaaaguaagaggcgcgugcggugcaugcugggauauguagucggcgccaagcuuagugcaguuuaagugggugagaaacuccucccggggccgaagagugaacuguugcuccuaggaucagacgccccgcgguggagucuuagugcuguccugugcuccccaacgugacuuagccacuucgcucccgguacguccuugucggcgacguucagacuugauuggcaacccucaaagcgcggugaucaauggcuccgaaagccggacugacagacucgcagaaccccaagccguuucaaaagugcuaaguucccgacagaaaggucucgccaagcgaaugaaagaguuaaaccuaccgggaaaguucgcugccacuuccuagagucucucgggcuuggggaccuuuccguuuccgguaccggccuccaagccuccagugccccguucuccaacugugcugaugaguuaaacggguggcauuuaggaaaccgagcgcuuuucggccgcaauggaacuugcggcuccagaagugaccagggagaaucuagauggggcuaagcugcuggagaaccggacgucaaaauucccgggagcccccaggucgccccuggaucgcgagaccgcgcuacaugagcgcccccuccuggcgcggccggaacaaccagcccccguggaaaaaaugcuggaccagcaguacuuauguaggucaggcucuggccccaaggaagaaaccuuugucaagaccagugauccugcaguccccaaagcuuucaaguguagggauuguggguuggcuguacccagucucucugaucucauucaccaucaaagcagccaugggugugaccgcccuuacagcuguccagagugugacaaaagcuuccggcguggcucagaucugguuaagcauuaccgaguucacaguggugaaaaaccauaccccugcccagaauguggccguugcuucagccucagcucuaaucucacuaaacaccgucguucucacucaggucuccggccgcacaagugcauggagugcggagaggccuuuggucgcagugcagaccuagcaaaacaccagcgggugcacacuggggaaaagcccuaugcgugugcugaguguggaaagacuuucaggguuagcuccaaccugauccagcaccagcgaacucacacuggugagaaacccuaccgcuguggccucuguggcaagaguuucagccugagcucuaaccuuuuacagcaccagcgcugucacacaggcgagaaacccuacuucugugccuggugcggagacagcuuugggcgaaguuccuaucugcuagaacaccagcguucacacacgggugagaagcccuacaauugcugugaguguggcaagaacuucaccaacagcucaaacugccuacggcaccagcgcacucacaauggagaaccgcccuucaggugucuugaauguggucguggcuuuagugagaucaccauguucacugaacaccagcgcauccacuugagcaaaugaccuuuccagaauguggcaaaaaucucacaccacaguuccaucaauguucacacaugggcaagaaacccuagaaguuuccugauugcagcuaguauuuuuguggacaccagccuaugcacacaagcaaaggccuuucauuugcagguuugucaagagcugcagucagauuucccacuugcucuucuaccaggugacccacaugagcaagaagaccuccaucugccccuuaauaaggcaagccuuugcccauaacgcuuagccuugucuaacaucaauggguguuccaagaugagaguuucugcaguuaucccuggcuucaaugaagggaccagaguguuguuaguuuuuuuuuuuuuuuuuuucuuuuuuucuacgucccgaaggugacuuaacuaagggccacuaaugggguucacaaauggcaucuggguugagccacaggcuagacgaacagcacuagagcugugucugccuucagagaaacaagauuuaaacacacacacaugcacacacaaaaguccuguuuucugagauuucauucagaaucuccauuagcuagacaaaaguuuuuagaugcccaaaaccacauagcuccugccccagcugcagauaggcuaaccaugacaaaagcaacaacuccuuuuucucuggaggaagaggauuacaaaccaggcaaaguccaugugaggacuacaguagccagagguuggaggaggaccaaaggggaugaucaaaggcuaugucuuggcaaaaggaccggagaauuugaccuugggauuguuacauaaacucuggguguaagaaaccauuugaggaacucuucaccacucauuaacucucucuacugcuuacacuagggugcuagagguugagguagaaacaaagaaauagauguugaguucaggauacuuuaugguauuucuaggcaggggcaaaggcccaagauuugucaucucguucuuuucuagucuucagucccuucccuugaaaaucccccugccccccucacgcccuuuccuuccuccaucaguggaagaauagugaaaacuucuggacuuuggagauucaguguggccuuucugucugauauagaggagguugcccacacaaauguauuucuacugcuaacauuauccuauaugggagcacaggguuucccagagcaccacauagucuuugagcagaguccaagcaauaagagacugcuuguuuucccgagaggugcccuugucugcaccacaugcauacaagugucuccucaaucuuuugugacaguccauccauccuuaacugcagaaucuggauccccugcccuccaguuuugcugccguuuaucaagcuugcugugucuguauagaauaagaggcuaaaagaggaagagaaucagguuacccagccucaguuucuaagugacuggguuugucucuaguugugugacucauuucuuuuucuggcucucaguuucuucaucugugaaauaugcaguguaccucaaccaggcugugacuauuccauggauauaccaacuuucaugaagugccugguuaggggaauggcuuaguaagccucaguucucaaaucuggggucuuguuuauuguaucauucagaaaacaucauggaaacucauggaucaguuucuaagauugccgaaaugaacuagacacuccuggaguagucuauuuucuaauaaaggcaccgcaacaguaauagagugaaugaugcuggcauuggagauggggugucaccuggagcaaaucugaaaggcaugaacagcucuggcucuuuaaacuguguaggggaaacuuacuccaagcaggaguaaguaauuagagaaauucuugauguguuuccaucaacaguacuucaaaaaacacaaccccuggguuugaguugaaaaucugaguauagcacaucuauaguuggcacucaauaaauaguuguuaugguuugguucuguuu

SEQ ID NO: 4136 - RNA, 7825 nt, Mus musculus
cagcaguguucaaaucucagguguuuaauuucaauaccauagugcugagucaggccagacccugggccugagcugucccuuggacuccugcacagacucugguauuggcuuuugaguuauggaucguuagaucuucauccugggauccaguuccauuuucucuuccgucccugaggauagcgccuucugcagucuucucucaggcugagagaagccuccuuuacagccaacucaucccuuggguccucucccagggaugccaauaguuuagccuagggcauaugcacuaugacucaauccccauuaccacagccagcaaagccucagugaggggcccugccuccucgccugcugcuuccacgagccccguaagggccagggcccuuuuucuugggcacugcccugguucuaguguccaucgugcacagugggcagccagccggggccggccuaaacggaauaccucgcccacugacuccgggccaccccggggacucaaguggaugcggcccacagcuucuucuagcucuuccuccagugcaggcaguaagaaucggccagcagcuucuagagcuuccucggccuuggagcccagcaggggcugaccagguggggguacgggccccagagcagccccacagccccugcagccaugcaaaugauguaagacaggccacgcugcaccaggggacaggccucgaagcggcaccaaauccaucugggcuucagcaaagcugccggauagcagggcccggaagaaaggggaggcagcagcugaagcagcccgcugagcagggagcuguaggccugaauccagaacgaagugcaggucaggagcuggggcaggggccggacccagcagagguucguagaggcaagggggaggugagucaaguuccaagggcagggcagguagagggacugggcuugcagugggagauaccaggccuuggagacaggacagggagucugcugcaaagaagaggaagaguggguguggcgcuggcugcguuagugcugugaggaggaggcggaggccacccugauccagaaguaagcggcgccacagagucggcuuccuguggggagaaggggucucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucuuucagcaagcugagggcagggcuggggucagaaggggucucagcaagcugagggcagggcuggggucagaaggggucucagcaagcugagggcagggcuggggucagaaggggucucagcaagcugagggcagggcuggggucagaaggggucuuucagcaagcugagggcagggcuggagaguugcaaucuagcucacaauccccgcaaggcacccauucccccucaccggcagaugaaggguagggucagugcacaggcgacgcgguccucaggacucccagagagcagcaggugggugagggcacccacuccaaagggggacucagccugcacagucagguucuguagcagcaucucuccugcggggacaggcacaagaggucagggugggaggcggcguuaaagagcagggugcuaugggcaagauaggacucuacgccuguaaaagggggagcauaaaaccucaguaagaaaucaacagaggagcgugaggagcacugguugaggacaggcuuagguugugaggaacuaaaaaucaagggugagaacagaaauguggaugucagccugcagaucuaggcccucaaagacggaaacagccuagagucaggcacagaagacagggcacuccuaagaugcaaauggcaguagagccuucgaggaccuggugccuuggccugagggcauaagugagugugccuagcacaguacagagccaagagcagaguggguaaagaaaugcagaaaggucagccucuaggguacuaggagccaaaccugguaccagguuaucugggccccaaggauuggggaaaguacagaaaagaacucucgguauuccagggcuauggagcagaagggaacgaucccugccuuccagggcccucaaaccccccgugccggggggcucagcagccuagauguuaggcuggagacagcaggcaagugaguaggaaggagagguucuagguucacaaaaggugaaagggccuuucacguggguagggauaggggaaacauacccagcucucggugcuggcuucgguguacaggccgggcauguggcacaggccagucaucuggugagacaccgaguaccagccaggcacgcagcagcgcugcaccauaagugcgcacaaaggccucaaggcacgcaggguuacaggugaggcgcgccaagauacgaagugcgcguggguuuggugguccuggugcaccugucacauaggccaacaggccacacagugcugggccagucaccagagcuccacuugggucaggagccugggagaagcgugacaacagcaacagggcuggccccucuuggccccaaggcuccucaggaguggcagcagggaugcggccagguuugcgaagagugcggggugucgacauugaggucuggccagggguaggacugacugacucagauggcucuggcaucggacaacgcucaggagaccaaucuggggagauaucuccagggccugcugcauaacccucagaaaucagccacaaccuacagaggacaggaagaaaaggagucugaacccagagccaaggcaaggaagcagaaucaaaaagaugguccugcgucacacgaucagggcaagccugggauagcgaguuccaggacagccuagugagacgcugucucaaaggacggaaagaaaagcagacagaugggagagagagagaagacagaaagggaggagagggaagaaaggagcagcaagaaaggccacagcucuuuacacaccuuuaagaucuacugaggagaaacagcacagcucacagggcaaccagccugagcagguaugcagugcucugugccugugauccuggcacucggggcugaugcaggguaaguuuaagaucaggcuaggcuacagugagaccccuuggcuaaacaaaacagaacaaaccuuucaugguagugcuaucugcaguguggggugggaacagaagggagagggauauggagagcagagcgggugaaccaggcaacaccacagcgaucguggcuccuuacagagaccguaagaaccaagcacagacucagaggcgagagaagaaagccuaaggaggaagaauauucuagacagagaagagcaaccaaagagacggaaggagagaugaaagcacacaggaggaagaguguucuggacauagccgcucagaaggcacugucucauccuauuuaggaacuagagaggaggcugugagggagugagaguggagauguagucagcucacaagacugacgacagucacugaccacugcuuggagcuaaguaaggaacagucuuugcaaugacuuuguggguccauaagcuguuauucuccauugcacacacaaggagucaguggcucagagaggucaaccaguuauguuuugcugaugguaacagaccaagaacuccucuagagccuaagacagucagaagagcuucaaguucaaggaaagccugggcuauauagugagauacagacagccuagacuccauaguaaaacaccacaucaaaccaaucaauggaucaucaaucaaucaaucaaucaaucaagacuuggggcucuuagcauacuacuguaagcaggacacaugccacccccaaucaacuuguauagggcccagaguucuggaugaugggguggggccagggucagacggcagauccaagucagauuagagcagagcagagacacagggaccagucucagccaagugucuggcgacagagcagaggcagagaugaggaagauggcugaggcagacacaagcucccucccccagagcaccuccaugcucaggcccugacaggacucaccugaggcuucggaagcucccucccucugccugcccagagguccguuccucagggaagucccaggaagcugcuucgauuccuuccucuuccucuucgccagcuucaccacauaacugccuggccagaagaggcacaagucccagggccuguaacuugcccaaggccccaguaucauaaaggaagccuacaagagcagccacaacacgugggugccaggcacuggcaccgggguccugcagcagacccaucagcagcuccaaaccaccggcaucccgaagccgagcccgguugauggcuucccggcauaagaggcacacagcucgcacuaggggcugcugaguagcugagcugcucccaccgggacuccgucgccgccuaagcucaccuaguaacaccuccacgccaccugcauugcccagugcaggccgcaccaggcccugagcacacagguuggcgaggaucaggauggcugccucacguauugcccguuuagggugagaagccaggcugacaagggggcccagugccccacccagacuuagcugcucagcacaggcccgggaacagccucggcugaguuccaagagagcacggacuagggccgcagucagugcagggucuggggcgguagccaggagcucagccaguggccgcacugcuccuugcugugccagggcuagacggugcuggggugagucugccaaguugcggagggcacgaacuaugcucuguaggcacugugaguccuggcaggcgguaaggcucucaacaagaaagggaacagcaccuaaaaggagaagaggaagauacguaaugagcaaggguagacauccaagcccuacagcgaaucucugccuggcccacucccacagccucucaccagcagaguggaugucccugcagcucucaggcuccauggcuaaguuccccagggcacgcgcuguccgguucuggaugcugucugucuucacacacugaagaauggucacugcaaggacaguuugucugcuugagggcucuacuguuuguuuguuucuaaucaaccaaagcaagaauguggcaaacguuuggggauauaagucagaggcagaguacuugucuagcuuguaccaaacccugagccaagccccaacaucucaaggagagaguggggagggagggagaggaaagagaggugaggguuagagaaggucuucagaagaugcuaaaagaggagcaagagcuggaggacugacugaauggauauuugcccgagggaugguaaaugguuugcagcagcuuuuccaaaugccccaggguaaaagugucugugcuaugauuucacaaagccccucaaaugccuguccaaggagucaaaauauaaaugugaaggccacagaagccaccaaagggcuuuaaggggaaugacaagauacacuccggcaacugcggugggaggguauuaccagagaaaggaauaugucaggaagagcggcugaaguggucauguaguccagguaacuuggcuugaaccaaguuaacuuuuaucccugccaaucaaaaggcaauacggcccagcacagcaggcaagguuagagagaacuuggcauuccaucaagccuacugucaaacacauuacuugcaaucuaugcaaguuuaaauauaaaaaugcuucacuuuaaaaauuaagauuuuugucaaaauugagauacaggacaggcaaugaugcaacuuuguucccaucaucaccauaaggaggcgccaaaucacccgguacacagaaaggcugauccucugcuggaauuuguuuccuguguuuaaguacccacuuaugcuuggagucugggcacuguacauuugaauuucauuuucuacucaacuucaauccugucggguagcuauuguuauuacacaaagaauucuugcuuuggagggguugggugauuugcuugguaugucugacuuuuaaacucacuuucuaacuuuuaaaacuacacuuucuggccuccugcucuuccaugugaagccuugcacagggacggguacuguccccgagaagcaccaaaaacaaaguauaagccacuugcucaaaagugaggcaggagucaguaucuacuucuggucugggcagguccaggucuaauuuauggagagagcagugacgucacauagcaucacaccugaggagaugaguggcgcugcaccaucacaaagcauguacucagaggccuggcauaauggaagggcagcgcagauacuguggguuggaaccuuucuaagaaaugggggcggagcacuuacccaaagggagaaugccuccaagucuccgcacuucggcccggcacgccccuucuguacagcaguuggcuagaaugcugagcgccaaauccagcgucuugcgcaggcgcauuggcaacgaaggcgucaagagcgacucggcagcgggggcguggccagggguagaaccagcugacgcaaccgacgaaggggcggagccagaggcugcuugggacggggcggggcccgcagcagccguucggcggagcagggcgagaagggggcggagcccgccgcgugcccggaagcgcucaauccccucugccgccuugauguggcgcgugcgaagagcuaagagcgcgcggcccaggggugucucguugguagcuggguccuuucccccaccuggccccuccccggccgccgccgugagcugcgcgaggcaaaacgagagcgaguccguaagggccggucucgcagccgccaucuuggcccgggccucaggcuccgccccgcgucucgccgguacucugagagagcggaacuggaagaggggggcguggccaggcugcuccucggaauagcgccgccgcaguuaucuugcgagucggaaguucaaguucuagauucuggaacuccgguacuugcacagucgcagaagacauggcgagaaugguauuuaucugugggaaaguaagaggcgcgugcggugcaugcugggauauguagucggcgccaagcuuagugcaguuuaagugggugagaaacuccucccggggccgaagagugaacuguugcuccuaggaucagacgccccgcgguggagucuuagugcuguccugugcuccccaacgugacuuagccacuucgcucccgguacguccuugucggcgacguucagacuugauuggcaacccucaaagcgcggugaucaauggcuccgaaagccggacugacagacucgcagaaccccaagccguuucaaaagugcuaaguucccgacagaaaggucucgccaagcgaaugaaagaguuaaaccuaccgggaaaguucgcugccacuuccuagagucucucgggcuuggggaccuuuccguuuccgguaccggccuccaagccuccagugccccguucuccaacugugcugaugaguuaaacggguggcauuuaggaaaccgagcgcuuuucggccgcaauggaacuugcggcuccagaagugaccagggagaaucuagauggggcuaagcugcuggagaaccggacgucaaaauucccgggagcccccaggucgccccuggaucgcgagaccgcgcuacaugagcgcccccuccuggcg

SEQ ID NO: 4137 - RNA, 6963 nt, Mus musculus
uaggacugcaggcugcuggcuggaagacggagaaacaccaucuagagguggaugaguggagggccacauggcccuugucuccagaaaagaaggucuuaugagcagccgugcuccaagcccaggacccagaacaggagcccagagaccaggaugaagccgagagcaacgauguuucagccacaacaggauguuaggagggcaguuuuauuuuuguauaggcaaaccucuaugaccaauuggccaucaucuugugggaagugacaaccaaucaaauggacuggaccccggguaaagaggaagggaaccgguuccuuccugcuguauucuugcccuguuccuuuucugggauccacuccaagcugcucacccuuacucuuugugaggguccaacauggccugguuguagcucauggcauccaacacccucgacuuuaugcauagaagccccagaggaacacagccacggucaucaugaguagggcauugagguugacuacucgugcccagcggggauccucacugauguccuccagccgccuggugguugccgccaccuccucgguagugggcggaggacucccugacccacucuugcucaucccacagaaccaaagcaggcaccggcggagcaggccuggagccggggacuggaccucuggaaggaauggggagcacacaguuagccuggaaggaguuagcucccagagcuccccaggguacccucccggggucggccuuaccuuccaucuccauugcacauuccuggcccccguucugcacaggagcaggggcuggaccuucuaacucaucagcauccagguccucccgcuccuccuugcugugccggagacugaaaaccaggcgauggagcugggaaguuagggagaagggaccaggugggaguucuggcugucaccccagguccaugcuggcacacagcuuugucacugucuacacacacacacacacacacacacacacaccccagacucccuucuggccugcaggccugcccaggcccagcacacucagacuccucuuuccaggacagucuuugccuucacacugaaccccgagcucuucaucuagcauuaaagucuucggcccugcccagucccguguuucaccccaaguuuuaggucuacaccgagaaucauaguucuucaguucugauacuucauauuccuauugucauuugcucugcuucccaaaaaugucaaguaaaugugcuuguccuggagaccgcuucauacugcaggccucuggccucugugggcguuccuuaaagcagacuggcuaagggggugaaagggcucaucuaucccauacaguucuuguggucucccggccccguuggccagcacuuacaugcuucugagggaugggcgcagugcacagggagauuccaagugugaggaugccagagcagaugaagagaaugauggcgaaauagagguaguguacccgacagaagagugccgggcacgcugagggucgcacacagcugcccgagccaaagaagaacucggguaugagacgagcuaggcccaucagcaggcccccaacuaguccccagaaggcucccuacgggagaaacagcguuagccuacucaagcugcccaagccucacccggaguucaaguucacgaaaacgugcccuucucaccuucucauuaacacggggcacaaagagugcaagcacaaagaccgcagacacuggaggugccagauagcuggagacagacugaauguaaucgaagagcugcccacccugagcugccugcaccacuggcagccaagccacggacaccgccacgaugaauaccacccagagccuguaguugaggacaaucagauuucacugaagccccgccuuccccauuacccuccuggugcuccgcccacaucccagggucaauaauggagcagggugggagccaggccacaccuuccaacuagcagcagcuccuuaucaccugcacggggccgcaggcgcguguagauauccauggugaagagcgugcuacugcuguuaaagauggaugccagagaagacaugagggcagccagcaugacugccagcaugaguccgcgcagaccuguggccaacaggagcugucaggccaaggccuucagugcguucaagguggugaaggguuggugaggugacccucccacaggcagucccugcaggcuuggccaagggcaauccauuuccagcccucacucaccauugggcaugagcuucaccacgagccguggguaggcgauguuagagcagcccaccucagugccacacacccgcuuacacaccucagguaccacacaugccaccucaucugcaagaaagaagcuauaagguggcuaggaaggaccaggaucuggaaacgagggucccugaagccuagugugaacggcgaaucagguccccagcucuuaggauaguagcagguauaacuggcaggcacuugaauccuugagcaaaaaaaaaaaggggggggggaucuggaugugggucacaguacugcugaggcuggggugaugcagacaguaccuggguagagaaugcggcugaucaugccuggcaugaccaugaggaacaugggcaucagcuucagguagccacacaagaugcacccagcuuugaugugagucagauucuuuccagccaggcaccgcugcacuauuaccugggauaaggggcauccagauauauaggucaucccuguaacucacaugggauaaggggcauccagauauauaggucaucccuguaacucacaugggauaaggggcauccagauauauaggucaucccuguaacucacaugggauaaggggcauccagauauauaggucaucccuguaacucacaugggauaaggggauauccagauauauaggucaucccuguaacucacaugggauaagggguauccagauauauaggucaucccuguaacucacaugggauaagggguauccagauauauaggucaucccuguaacucacaugggauaagguauauccagauauauaggucaucucuguaacucacaugggauaaggggcauccagauauauaggucaucccuguaauucacaugggauaaggggauauccagauauauaggucaucccuguaacucacagcccacaggccuugccucugcucuccauggccccuuagcacuaaccugcaaccccacucugauucauacccaaccuccagcucuacagagccccugcuacaccuccauccuccgauccugccacuggauucugacuucaugguucacccuggcaugaucuaucagcucagggccugauucaaccuaacuccaaagggcggugucaccgucgaccagcacagggcauuuagaguucugucccgggcacgugcacacacaccaucccuggcacgccuugaccuaccugaucgcugcaccaauaccagcccgagacaaugguaagccccaggagcagcgcaggccauggcaggucuccugucacagggucacgcagcaggugauaggagucaggccucggcugguagcaggugcuggagauguugccaacagauggauccuuggacaccgucagugaagucauugcucccagguauuugucgaagagacccgaguacccgcccacuucauggaaagcugugcaggcaggguugucaggggaucuggcccuccuuaggacccacauuggcagagacaagcaagguuccagccccuuacauuaaaagcucugcggcagcaaagagccaugcccugcccacaguggguaaagcccguaccauaaccagugaggaugaaggccccggcaagaaugacgaaggucugcacagugucuguguacaucagugccgccagcccuccugcaacaagccccagucaacgaaggacagcacaguugcuggccccuggcacccaugguuuuugagaccaagaaaaggacccauucuagagaacagaguuuauaagaaugagguugggcuugugcacuggggcaccgggaggcagaguugcguuugauucagagaucauuugagaguccaaugauucuuucuuggccaggaaugcuuguagugcaagucuccuauacaagccacugcuuagccuguuuucuccacugggugauaggguggggugauaaggcccaggccuuccuugcaccccguccugcagcaggccccaagcccacuuuggcaccacccuacccauugugugcaugaucuggaauccugggaacugcacagaauuuagccaaagaucucggagauucaccaggucaacucuugagacauccaagaaggccagaagcuuguaaauuauuucccgccuucucacuauugagacucccucagcacucguuggguaccugaccuuacaguccaaauccaagggacauugaaagcaaggggauuuguuuuccccagaguuaauucuacuuguaugauaucacacuucuguagcucugucucacguuccuguuucccaauagaaccaacggcuccccucuuacguugccagcucucugucaccacccucaagcuccuugccucccaccccgccacucccaugcagccaccugucacaguauaaaucauggugaugcccaagagagcgaugaccgaagcguaaauguuccagcccagggccuguugaaugaauacugccccagagaacauauccaccuuucaggagagagcauauacauaaaugagaggccaaggcagagauucagguccaaugccugccuggaaaccauccauccuguguggccauaccucaaaaacccauucuuuuuuuuuugcuguccuggaacucacuuugcagaccaggcuggccucgaacucagaaaucugagugccucugccucccaagugcugggauuaaaggcaugugccaccacaccuggcaacaaccuggucuucccaggucccgaguacuguacccacagcuuggagacuugcucuuuccaggccccaccccucaugcugauucuugcuuuucuccuuguucccgccccuuccagaggucucugaagacuucacugggugguucuaccuuucuaagcgucuguaccgcccaccacacgugcucaccgagaucuuggugaaaauguacaaaaaaagcgagagcacggacagguagaggcgaauacggugcccaccaaagcgcuugcggagguacugaggcauugugaucacaccagcggucagauacacuggcacaaaaagccauccgaggagcagcaccacgaagagcgccugugggaacaaaugacagcccgggacagcauccugagcaggccuguccuaguccucacacccaggacccagaagacacagcggaagugccugggcccuggacaggaagggaaagaaucuugacaucuucccggcaccuuaacuauauagagagagcccuuuuugcgcguacagaccaucaccucuaacuagucuccuccaaggucguuauggccccucccugucucuccagcaaaugaaccugugugcacagacucuucagacugaccucagcaucugccaggcagggcugccuccccuccuccaccuggcccaagaauuuuacccucauagucucaguucuaaggccucuuacaggaaggcucaaacccucaucuuuccaacccauccuuguuuuugcaaagaacuucaguucagccuagaguugcucacagacuacagcaucaaagaacauggagacagguacuucaucagugaggugccggccccauuucagaguggucaaggcccacgaggacugaugcuggcguauacagaaagucaggagcaggaccugccugaacccuacugcuguaagcuagcacgcgauccuugcucccagcccaaccuaacacccacccacccucagcaaacugggcugucccaacuuguucauauccccacgccaggagcuucuccaaguugugaucuuuccaggaguuuccacugggguggauuauuauagaaaagaagaccucacauuccacucaaauccagccaccgccaagccacuugcugcgccagucccugccaggcccacaaaaugaccgcugccgauguugcuggcgaacagagaggcuccaaccuggguggccagaaaugggggugagcuaggcugcuccuccagggucccucccaucccaucccccagccccucucaccggccaccacaccaugcuccguccugccaggaaguagccaccaacugugccucuauugguucugaacauagacugggaaacagaaguggggggaaacugggauuggggcacaucuuuggacuuccuuagcuuccucaacacauuccucagccuuguuucaggcugaagauuaaccagcccuggacuccccagacugcaccuccuuacccccaaccuuccccgacacucagaacaacccaggcccuaauccuagcgcaacuacuggauccuagauaugccuagauucagccuaacuugccuggugaccuuaaauauaggcugcugcucagccauaauacagacgugggaacugauacaucucuuagagcacuuguuagaacacuugaauuaaaaaaaaaaaccuauugauacccccagucucuuuugcacaauccagaagguacgaagacaaagaauuaaaauuggcuugccuacuaaaucuagguuucucccucauuauauccaagcacccuuuucucccacuccucucugaggucucccuaaaucuuuacccucaagccccagaagcauuucccuauccaaccccccucaaugucucacccacaagccaacaccaaugaccagcaggaaauaggcagcgauaaccagaaugucagcaggauuaucaaucaggaccuucugcuccccaaguucagagccugccucuacguguugcuccauucucuccagcaucugucccucaaggggcuagucccuggauu

SEQ ID NO: 4138 - RNA, 23563 nt, Mus musculus
cagggcggagcuccgcauccaacccacggcggccgccaaguucucuggaugggaccagaaguuucuagccggccaguugcugccuucucuuuaucuccuccuuccccuuuggcagcuaggaggcuauuuccagacacuuccaccccucuucggccacgucacccaguccuuuaauucauaaaggugcccggcgccggcuucccggacacaucggcuacacagaggugcccgcacuccacgaccucgugacccgcgcccuagcucugcgccccgggcggacccuaacccagcaugagcgccgccacccaaucgcccaugaugcagauggcguccggcaacggagccagcgaccgagacccccugcccccgggcugggagaucaaaaucgacccgcagaccggcuggcccuucuucguggaccacaacagccgcaccacgacguggaacgacccgcgugugccccccgagggcccuaaggugaguggagcuugccgucccaccucgacggcgaaggggccuggucgagccagggcuaugcgagucaccccaccccgcgcccugcugcgcaaggagaguccuuaaccauauccgccucgaacgggcgucgggccgcagagagccgcaggcaggguggccuuggacgguagccagcggggugcgacccgcguggugacaucgggugguuuuccacagccucuugcgaagggcgaagggcagugguggccugagcugcggugcgccgcgucccagggaagggcgaccggccugaugagcggcugaggcccaggccaggcccggccgccgccucucugucccgcgcgucccgugcugagacccugggcucccuccggugcugauggcgcacggccaggauugaaaggcugcugaguggagucuccuguggggauuucacuuucaaauucagaacuuaguugaggcuuaucuugaguuuacuggaucuuaggcauagagugacucaggaggcucgaguaaauaaguuauuuucccccauuaaacuuauuauuacuggucgaaacugcuuucaguuagagaaaauucugauacuaccacuauuuuuuuuuaagauacucuuucugacaguuccaaaacuaaagaucagacauuguaucaccauacuuagccacugccuuaagacucacacuggagugaaagaauguauuuuuaauggcgugauuccuuguuguccuuuucaaauacuggaguuuuguuaccagaaacagcugaggagucuggugaacacuagguguaugcuucauuugcauagauauucagguuuguguacuucaaucuaaaaagcaagaaaaauugaaaauacaaauuuggaaugaagcccagccugguucaggccugucaucccagcacccaggaagcuguggcgagaggaucuugaguucaagucuagccagggcuauauaaucggagucuaucucaaaaguuauuaaguaauuaaguuggaaugaaacuagccuguguugcaaaauaagaccuugucuuuuuuuauaaaaaaaaagaaaaaaaagauugagcugggcaguuguggcacaccucuuuaaucccagcacuugagaggcagaagcaggcagauuucugaguucaaggccagucuggucuacagaguuccaggacagccagggcuacacagagaaacccgaucucgaaaaaccaauaaaauaaaauaaaaauaaauaaaaauucgauugaauuuugagugaagaacuuaaaaauacaaauuuagguaggauuuuucuuguuuguuuuguuuuucuuuuuuuaaaauuagauauuuuuuuauuuacauuucaaauuuuauuccuuuccucauuuccccuccgaaaaccccccuaucucauucccccccucccugcucauuaccccacucacucccgcuucccuguccuggcauuccccuacgcuggagcacagagccuucauaagaccaagggccucucauugauuucccacaaggccauccucugcuacauauugggcuggagccuugagucccuccauguguacucuuugguuggugguuuagucccugggagcucuggggguagugguugguucauauuguuguuccuccuauggggcugcaaaccccuucagcuccuuggguugcuuugcuuuucaagacaggguuucucuguguaguguuggcugaccuggaacucacagagauccuccugccucugcuuucugaggcaugagccaccaccauccggccacguaggaucuuugaaaauauaguuaacagaagucauauuuagcauaauguucaguaauaauuuauguacauuugguccuuucaaaaugaaaaguuugguaaaguaaaugcacuuuaaaauaggacucuaucaucaaugggaggagaggcccuuggucccgugaagguucuaugccucaguauaggggaaggccagggccaggaagcaggaguggauggguuggugagcagggggaggggggaggggaugggaguuuucagaggggaaacuaggaaaggggauaacauuugaaauguaaauaaagaaaauaucuaauuaaaaaaggaaaaaagaaaaaaaaaaauaggacucuacuuugggccugaccuggugguacacagcuuuaaucccagcucucagaggcagaggcagguggaucucugaguucaaggccagcuuagucaauagagaaauguugccucaaacaaacaaaacaaaacaagaagaaauacucuuaacuuauuacuuucuggaaaaaaauaaaagcaguaaagaguuuauaaauuguuugguauuuucaaaaacucacccaauuaaaaaugcuuuauaaaucauuaacuuagaaaauucuaguuuucuuuuuauguguauggugcaagggauugaacccagggccuugagaacuucaggcaaacauuuuccuuauaacuauugcuacaacuuuaguauccagcagugagccacauacuuggcaguuuacauuuacaagaaacuaauuguauauuuauuucuggaaauuauuacuacaagaggcuguaauuugggguggacauaauugcauguaucuuugugugugugugugugucuauuucauacauuauuggguaaaagauucucuuuugaaacuagccgucuucagacugcauagggaauagaagccauauaaugugugguauguuuugaggccuccuuccucuggcuacaggcacagucuccgcccucugacacccgucacugggagugaagaucaaguuugagccuauacaugcugguacuuagccagcacgcugggauuugcuccagccacuagguagcuacuagguagacuaaguuuccuaaaucugcucgagauuaaaaaaaccaaaaggaauuuaacacugcucuuaucaagcagaaagugcgaaauauuaaaucaagaugucuugggcuuggaaaaaaauauuucaccauuauaguuuuaaacuugaaagauccuuaacaguguccccuuccuucugugugaggaaauguagaaaauuuaagugucuuccugaaggucacccauccagcaccaauagcgggugugugugugugugugugugugugugugugugugugugugugucaaguggaccgaccaguuagaagagacugugccuguucagaagucagcaguggcuuaauuuuuaggaagccgacccggacccgugcugaccugugcugugcuagccugaauuuugaugguaggcugagacuaacucaggagaaggguguccuucuccagauucauuacuuaagauagacuugccagcuugguaccaaagcacaaauagaaaaugagcauuucuggggaagaaucaaaucccucaagcuguugcuugcuuugagucugggcuucacugcuuguuuuguuuuguuuuguuuuguuuuguuuuguuuuguuuuguuuuguuuuguuuuucaagacaggguuucucuguauagcccgggcuggccuggaacucacucuguagaccaggcuggccucgaacucagaaauccgccugccucugccucccaagugcugggauuaaaggcgugcgccaccacaccaggcugcuucacugcuuuuaaauccaugcguugguugucauagaacaucccugugaccggggcaggccaacaacugggaagaccuuuaauauuuuuugggugauuuugguuuuguuuguuuguugggacaggguuucucugugucguccuggcuaucccugaacucuguagaucaggcuggccucgaacucagagauccaccuaucuuucugccuuccaagugcugggauuaaaggcgucugucaccacugccugaccaccuuuauaguuuauauuagaaauagucuucuuuauuuuuauguaugugucugcccguguguaccuguguuaguuagcuuccuuggagcuggaguuauagggguugugagccaacuugugaaugcugggacucagacucagucagguccuuuugaaggacagaaagcacuccuaaaugcugagccaucacucuagccccugaaauaagcguaaggagaaagccucugccucuaaaacaaaggccuaucugggaggagcuaagagacccucagaguauccccccuugccuaggggaugcugucagucaauaaagagcccuuugaugaguugggaugccugugaaacccucuggauguuuacagucagagaugacaaagaugagucccuuucagaaaguaggaaaucaccagcccuuggugcuguagucaguccuaagcucuaggaguugacuuucguuuucucucaugugguuauagcaaaucuucuaccgcugguuuuauacuaaaccgaugacccuccgugucccuuagccuguuccagcuggaggcagugauguccccaugcagacaccucuguccgcagccacaccaugccuccaucuuacuuuuuuuccccacacuuggccuaucuaccaaucagggagguucacaccagcugagauucccuucuguagagaggguacuguuuacuuuggacucuggagauguaugagcccuuucggacccuccccaacuucucuuucccaugaauaaacaaaggccagggacuccagagugcugccccuuacuaggcugaucauccuguucacgucuguggaucuggggauucacgauccuggcagucuccaagguuuuggcucuugguucaguucaguuuugugucuuuguggcagagcgcacgucauggcguguauguagaggugaaaggacagcuuggcaggagcuuccaccauguggauuuuugggcggaguucgacccucagaaguggcaguaggugcccuuaccgcuaagccauuuugaaugcccuccaggggaacauuuuaagaauauacacugaggggcuggagagacagcucagcaguuaauuacacuugcugcucuugcaggggaccuggacucacuucccagcacccaccacaucagguggcucacuccaguuccagggaaccugaugcacagacauauguagauacucgcacauaaaagaaacaugauaaaucuuuaaaaagaaugcacuuuguaguuacuugacccauccuguucccaccuucuguugaaucgaauucuggugauuuggguucugccauacuggccuugaaagccacaaugaccccuaccccguuugccacagagggagccuccugcuucacaucuguccugccgacacucucucagugccugguugcuggaggugacucggggugugguaugccuagggagcuuagauacccugugcacaguggcaguguaaggagacugcacuccaccccaggccuggagccuuugccucccaucugucuuccagcaucucgcagccacuuuguucuuaauucugugaggagaaccguccuuucacagaaaauuggagauguuuuugaguuaugauuggaguggaaagacccauuuauucugcuucaggcucagcagagccuccuguuaucucucaaaagauuaggucauuuugcucucucuccaucgaucaccagccccugcgccucuuagcagagucaggaaaugagcagcucuucucaccccuccucgccuugccaggcagcugcaaucaaggcuggaaaucgguguggugggaggggaucaggagcacagccacgugccucagcaggguguucauccaagaccuccauuuucccucuaaagaacagccuguguguuuggcuugcacaagaacugacugcgucucccaggacaccauuugucccccauuucgugaaguagauuugcccuuugugaggguagacuacguacacaggagaacuguggcugcguuugacguuagccaggacugggaaagcuuaaaauguuggaugcugucagggccgguggugagucagaacgcuucauaccacccgugaggccugauuagcagugucccggcuucugcaauggcaggcacauggcuuccuuauauaaaccacucuacauguuuacuacuauuuaucgacauuuaauuuuuuuuguuguuguucugguaucuuccauccaaaauaggaaaccauacaugauccagaccuccuccuccuccuccucccccuccuccucuucuuccuccuucuccuccuccuucuccuucuccuucuccuucuccuucuccuucuccuucuccuucuuuauguuuuaauuuggucauaaauauaugagaggccuuagguagaagagcugagagcuaaacacaggucuugcuucucaagagccucagagacucuucaguauugacagacacugaguauccuuguaggccugacagcuguucuccagcuccuucccccugcuuugcacauacauccacugcugccucagacuugagggaccccuuccuagccaggcaucagaucucugcacuuugcacagacagaagcucaauuuuguccaucaucuggcacacaggaguuucuuucuuucuuucuuucuuucuuucuuucuuucuuucuuucuuuucuuucucucucucuuuuuuuagccaauauuacaaagaccucccuuauuucuauguuaaauauuuuugggccuuugguagcuuagggggaagccaggcagugcaauauuguaugcguguguguguguguguguguguguguguguguguguguguguuuaaaguacucuuuaaguacuccagauagcucucagagguagacacuauuucaugaugcagagggauggaccuggcuuguggcuccacagaaaggcuggccuggcguuccugguccuguagaagugucagacauauuuacuugccucaccucucucagaccugaagcagucgccucugcucuagauaggcuugacgcugcucuaguuuggaucucuuuucuaaauggugggcucucuugcuuugcccuuuuggcucacaacccgcuugagcggguuccagguagagucuguuucgucucagcagccuugcuuugucuagcauaaucuguaggcgcaggacaaugucucaguggaguacaaacacaaagugggucuuuagaagcucuucggcaaucccucagcacagucguguugucccuaggcucccagauggcccccaggggcuuguccuguuagucacuuucugaacggccuuuucuguacagaggucagugcugacucccugaguccauccuuaacagcucuggagaggcuguuuuguucccauccgugacacagcaucuucgucaggucuguaggagggggcugggagccagcagcagccagacacugcagauccggagcugagcagacagcggccgugcguggcccuggcgaaggagucuaauuauuuuucucuuguggcuggcaguaagaucagacacccugcauacagaaauucuuuauugucuauccagaaucaccaagaaucacagauuucuaccugucugcaucagagagagccuguaucagagagagccuagaauaggagugggggcuggguccuuugaacuacggcuuccuacugaaaauuccuuaacauuuuccuuuuuccuccccgccccccccccccccccccagacaggguuucucuguaugucccuggcuguccuggaacucacucuguagaccaggcuggccucaaacucagaaauccgcuugccucugucucccaggauuaaaggcgugcgccaccacugcccagcacuuagccuuuuuugaaaagcaguucuccccuacgccaaaggaacuucaucaguauuugucaaaguaguagcguggggcuccccacuccccucaguuauuuuggaaaaauuuucuuggucacugaauaaguaaggaauggagaguuuugaaaaggcagauagugggagaaucggaaggaaggcagcugagugugugggaaggagagucgcugggggaugguuucaccucccagguuagguucucaggcugcuuacauccaagcaaggccccccucauuggaggugcagcugggaugucucccuccacagcaccccugugcuugaugauggugaagucuucaagccacuggugacucagaauggagccagaagucuuugcuugccgguucugccuuggcugggccaaugacucagcgccgugcugucgcucccugaccuggagcucauccaaacugaauguuucaggucugcgccucaguccaggaagagauagaugcuguugcucuugcucuuuuucuuucuuccuuccuuucuuucucccccccccucacaccacccccccaccccccccaccccacccccacccccggcgaagaugaaggguuugaagaggucacacacaaaugucaacacacagcaucccaggaguagcaggcaaaugcuaggggaagaguuacgucgccucaccugacagaccuagguucgggagaucuuuagcaaacgacaugcccuccauuggcauguuuucaaagcuugacuggaagaagcccauguaucuaucauucguaaagauguuaccaugaagugggaaggucuuuguagacaggcauccaagcugacuuucccauacagcagaccuggccaugugcgagucagccaacagauaggccugaagucccauuucugacaagcuugucccaaauuaacugacucucccuugguguccagauagcccucuccuaacccugaccuggacuuccugucccccugugaggguuguauucagguccacaguaaccuggaacacaguaggggaucaggugaaggcuucuggacuuucuggggccuccaucaggccccucugcuuaauagguagguuuguugauguauaccagggcggacaagaggauggaaugcaacaguguacugcauagaaggcuucuuuauucagcccuaguuccuuaagaagagggugucugcaguugucucugcaguccugagaacaaugccaggcaggaagcaggagcccagcugauggcugggaagaaggggcugagaguguuagugucagaagaggcuaaaggcucugugacugggaccauuguguuuucuuuuugucuggaacaagaucaugagaaggaagacuguggaaauguuccagacacaaggaggggcuguuaucgaucucuuuaaauucaguuugcuucccagaauggagauucagguacuuuuccaucugcauugauuaaagcaagugguuuucuuuuuccuuuuuuuccucuaacaggaaguaaguaccugauuuuuuuuuuuccccugaagcugugaguuuaggagccaaauguuccuugauugggcuucuccacacagcugugccccagcuuccccugugacuugaaguccaucucauuccuauaucugccagauggaauaccaggagagcguuucaggguugggaaagugaagagcugaggcaggcuacggguccccagcacucccuccaguagcugcuaaugguuauccuuguccuaggacagugugggcuccucugagggggauacagugaggaugcugggaugccagcagaugcucugcucccaagccaaccuucacucaguuucuggaugugugagggagccccauuccaugcauuuacacgcuguuucccagcagagagguuuuguguguguaagcuccucccccaaguagcugacuagccucuuugaaagaaaggagcucagggcuuauacuuuuuaggguacuuaguuggcccuguuuacauccugguugguuuugagcauagacaauaguagcauucuugcuaaccaaucucuaaagaccgagacaaagggucuucuaccucuaacagacucauuacuaaucugauaagagccaccgacgaacuggguuuugcaguguuaggcccaaccucuuaguccacaucaguaacuggaaugaaggcauaugauuguguagggcagggaguagcuuaguguuuacaaagaccuucucaugccuuacuucacuaugucuuucgaaaacagccaguugaaguggcacaugccuaaucccuaggcuugggagagaagaggcaggaagaucaggaguucaagaccauccucauguacauagcaaguucaaaggcaaccagaacuuugugagacucuauuuaaaacauaacaaaacaaaaaaccguuagaacccucuggaagguaagggaauuuuauggcugagaagcugagucuguuauagcaaauucuguccaaggcugaugagcuauagggaaguguugggagcccaggauggcagcuuauagaccaggacuccugcccacucauuucuguuuauauagacacagcugcaaagacaagcacuacagguuucauguucuaaaacacaggggcaucccuuuuauuaauccuaggguaaaguguuucuauuugaauaacuggcauaucagagcaggcuucuaaucacuugugaacucauagugaccugugacuggcaguuuuguguccaacacagaccuacugucuuauuuuuuaaaagauuuauucacauuuauuuuuguuuuucauuauauauguguugugaguguaugcuggugcaugugagcccacccacuugcagaggccacaagcgggcauuggcucccuuggagcuggaauuacaggcuauugugugacaccagauguggacgcugggaacuggauccugguccucugcaacagcaggcguggacucauacugcugagccaucuguucagccccaggaucuuuuugauuuuuugaguuccagaacaaaaccuaucucguuggaggugcugugaguggacuugaguagugugugggucuggcuucuuauuccaaauuugccccagaucucuuaagcccaccagaagugguagaaagccaauguagcucagggggagccaggaaucauugugagcuugguuguggcugcuuauguagcacauugauaagaagucguuuaaguggccucuuggacaaacaaaaggcugugcugaguuauugcagcucaggugucuguggaggugaaagugcuguucuacggcuccugccugauagaggcgugccaaguugcuucauuucugccgagcuccugacucuaccaggaguuccacagucucucuuucaagccucugccucucucauugguguuagaaguuuugaaguauuguuagugaaacucaacagcugaccugggugagagcacuucuggccuaaaaacccaguuaauggaaucuguguucuacuuaaaacuccagggcuccaguuggaggugcugaucacugccauugcuccuguuaccaugguaacgggagcugugguuuguaggcaucaggccagcuuuuguucuguuuugcuuuuugguuuuuuuuuucaaguccacuugauuaagagccagggcuauuaagcccauucccaagguuuggagggccaucuaaucaguguucagggaaccagcuacgguugggucaaaggccaacuguucacuuugucugugacaaugagugugccagcucaugguuugcugcacaucucccuaacaggugcccaagagcuguuccccaccaugcuucuaagacaugagggcagggggugguguuaagccuugucuuaauuugggauauaaaauuuugggguacuuugagcuccugcaauuucugacaaacucaggcaugcucauggugguauggccauagaugaguucuagcaauuucuggugcauaccucagauccuuucuucuucaugccagcccccuaggcccucucaccccagucaaauaagacgugcuugggauggagguagagccuccauuauuuuuaucuuuuccggggugcuccauugucuccuacagucugagaaccaauacuuuguagacuauuccugagcccaccccugaauuuuauagcuaagaaagcagguguguggacuguucacauagcacauggguggggcgggaggcaggccaagugcagucuuucugucaguaacuuugcauuuauugcaaaccugcagacgaguccaguacucaccaaacucagccuaccuccagacuuucucuaauaauaaugucuugugccugaaagggcacauuuuggcucacucaguauugauuuuuucccccccuaauuauuauucuggauuucccuaggaguuguguggugcccuuagauagccucaggauuuuaaugcaguaugcaaacaccaguaaaauuaacacauucauuuaucaguuaauguagucagauaagaaagccagacccugaggcucucauuuccuaauuagaauuuguaugucuuccuggcaaccucagccaaagauaagaauaacgagcuugaucugcagggaggucacagaacgagggggagguucacuggcauuugcuucguagcugugcuugugcccugccccuguugugugauguuacaagcacugccuccccccacccauauagagaagauuccugggguccccaguugcagggcuggagagacggcucagcaguuaagagcacuggaugcucuuucagagaacagugguaaauucccagcacccacauaguggcccacaacucuuuguaacuucaguccccgagaauccagagcuuucuccuggcuucugagaguacuguguacacauggugcacauucaugcaggaaauacaaacucuaaaacauuuuuuuaaauuaaaaaaaaaauaaaucaaagucaggccuggagucgcaccuguaauccuguacccuggugacucaaacaagaagaugggaaauugagaucagccugggcuacaugugaggccggcccuguugcagucagccucaccauaguuccacacggugcuuguggccugcuuuguuuuacagaaaagaaaaugaaggcuugcagggguaagggauugauccaugcucacuaaucgguaguaaaacggagcuuggauccuagcuagguuagccucccugugggacagccccacauuccccuuguaccucagccuccccugcucuucagguguuuccuguuuguuccaugcauugacuugucuaauauuugaacagggucccauguagucaagguugaccucauacucauuauguagcuggagaugaccuugaacuugugacuuuccuguuucugccucuuguuuuuuuuuuguuguuguuguuuguuuuuugagacaggguuucucuguauaggucuggcuguccuggaacucaacuuuguagaccaggcuggccucgaacuuagaaauccaccugccucugccucccaagcgcugggauuaaaggcgugcgccaccaccgcccggcccugcuucugccucuuaagugcugggguuguauauaugcgccugguuuuauaugauaguuggaguugaacccaggauuuccuuacauacuaucaagggucauauguuguugcuuugaucacuccuggggccuaucugaguaguaguuugauguucaccggaacuuguagaugaggcuagcucaggccuucuaggugccuagaucugaggaguagguaguggcugaggcucugcucguggccagaacaaacaguaaguccaggaaguccccagagaacauaugacaggacugugcaaagucugauuucaacuggaaagaaggguccuguccccaagaguagacacacugccuagaaaacauguuaugacaggauucuucguugucucuugccaguuccccaugguguacaccuccgaucaagaacugggcccuuuucucugugugaggccuggaucuacucccagcucuugggugaccugagaguuaagcaagcuaaaauaacgcugguguccugagcacguggggauucuaaucugagaguaccaagugccugucugccccucuccccaaggacacagugacacccuugccuuuucuguauucuggaggcccuccaggggcaaggucucagcaggagagaagcugaaaggggcaccuuccagggucagccaccuggugucuaaaccuguauauaaauauaagacauggaagaauuaauggucuuuucacucaaaaugcaaaccaacccucagggucuggccuuggccuuugcccaguucugcagcuguagaaguugacacccugggcucacagauucccagcuuuuuugacauuuuguuugucauuuggagagcuaccucccugaagaaggcuuacccucccaaacagagccacuaccuacucccauauccuagugggaucuguacaggugacacagccagcucccucgucuauggaaggacucuccuguucaggggacacugggagacaaaguugcacagacucugguuggagagagauguccuugcccagugaguggcugacuggccucagugucugaaauaagaucugcccagagguacaucuggaacuuggccuucucaagggucccaaaauagccaggccucuaaagggacaacuucaugugaggacacaggaaggacccccaacugcccucgggccaaacaggguuuauuguaccgaagggggaaaagguucuguggugcuucuucaaaacgugccaaggaacuguuuacugggagcccugagacagagcacugcugcucgaguagggagagaugagcucagcuggcucccuguugagcgcagacaaagcacaaugugggacagguggacagcauagcauccaaaggggaaaacugaucgaaggcaagggggagucuaaccagacugaccuagcaggauucugaccauccaagggugauggacagacaucuggggaggauuggagguggccagaccugggcuauccaccauggugggcugggaacaaggagguucugguuggcuugauuuagcuguucuuuugcaauagcuggauuuuacaaggaaacacguagcugggccuaggagaaagcccaguagccuugcuauaaaguuagccaggcggagacucuuaguaguuggccuuguaagacuggcgaguaauccccugguuuuguucucuucuugcaccacuucugcauuccagugcaucuccuuuccuacagcuuguucuaaaaauaguuccaaggagcuagcuagcuccugaaacacacacacagauuacacacaacacacagagcauacacgguacaugcacagaacacacaaaauagcacagacaacacaccacggagcauacacaacacauagaacagaguacacacagagagagagagagagagagcacagacaacacacacagcacacacacagagcacagacaacacacagaacagcacauacacagcacagcacauacacacagaacagagcacagacaacacauacacagcacacacagagcacaugcuuacauucuuuuccagaaagauuuucaagcuacauucuguauugaucaaauacaagcugugcagaugagaaauauuggcagcugagaagugugcugcuguaacuggaguugagucuuccuggggucaccuggcuucacccucugaagaugcacaggggugguuugccacuaucugcugucuacacugcugucacccaggaaaaaaaccucucucaccacugugagaaacagaccucucuuguacuucaaacugauacuuugacuccuuggugugccacgagacagguuuuaguauauagcccugaccagccuggagcucacuuuguagaccagaauggccucagagucacagaaaccugcccacuucuaccucucucagguccugggauuaaagacaugaccaccauuuccagucccccuaaaccuuaaagugccgcucacacaguagacugggacucuggagaaagcagagcaguggaguggucuggcccccugugcucagccugacugaagugugaggcccaugucacccaggaagauccgagacucucagcaccacccuccuacucagggacugcucugccacauuucuaaccagucuuuguuccuccuuacuuuauguuaggacacugcaucuucagccaauggcccuucccgcgauggcucccgccugcugcccauuagggaaggccaccccauauacccccagcuccgaccaggcuacauucccauccccguccuccaugaaggcuccgagaaccggcagccccaccuuuuccaugccuacucccagccuggggugcagcgauuucguaccgaggcugcagcggccacuccgcagaggucccagucuccuuuacguggcggcaugacagaagccgcccagacagauaaacaguguggacagaugccggcaacugcaacaacugcagcagcucagcccccaacugcucauggaccugagguaagaagagacccagagacccagagacccagucugugcugggccagcaaccugccugguaguacccagggcucauagccugcagccucagugguucucguuagagaguugguuggcggccucacauuguccccguaucuuacgccuguauuuuucagauggccagagaucacauggcuuauuuuuguaguagaagaauugacgccaacaugguaacugcaugaucgaaaugcauagcgguaggggucucacagcucagagcaacugccucgcuuccuucaucaguguuccuauucacacugggcucccugcuucacagagagcucagaguuacucuguucaguccuuucggguggacaucaaccauuuuggaccuaagcuggagauaaauucaggauggcagcucggucuucagggcgugccacuaaaggaaauccagcguuaggucagaaaggcgacaacuuuagcccugagguucaccauuucgaggucugucgcuagugaaaggguauauugcucauucgguucugaguugagguuguggccgacagaugggguaggguugcuaagcaguuaugccuuccuuuuccguccuccucucugcagcgcguccccuggguccguuggcuuuguuacugaggacgagcccucauuuccugcaugcgucauaguccugauuguuuuuagccucugcuuguguucaccuucaccaucaggggugaaaaaccauacguaaugugggguacuggagauuucuguccuuucucggagauguguuuccuacgucuguaauguuccuccgguacaagucaaaacaacaucagagauauuagaaaauuuaagccaacaaggccuuuaguagcuaaccaccuggagagcaagcucccucaaccuucuagaugacuagaagauagauuagaacagaaagggaccuggccugcacccagacacaggcagcucccagaugcuucacugcauucuccaauaagagguuaagcggaaauaaggagacauucaguaacaacaaacacagcggcccacacccuuccugugcaugcugcugccugccaacgcacaggcacagaugcagccaguuaauccucaaaguaaccgugagguggguaggcaggcuguccuuuucccauauuucaggcaaggugcagagaacggucgcgcuuccgaguguuugaacccuggcucuuuuauuuuagagcucugggagccuugugugggcuggacaggugcucucccgaggaacuguguccccaguccucgaggucuuaauauacuauauuuguuaaguggaguggugcuggagauugaaaccagggacacacugagcacagaaggacacacagcccguauccucacacuuugaaaauguuuauagcaggagagcuuugugggauguguuguccuggccagguggugucugguggcuauuuggagugccagggcagcaggaucauucacucgugcccuuugucucuugcagcgaucucagucuccagcugccucugacugcucauccucuuccuccucggccagccugcccuccuccggcaggagcagucuggguagccaucagcuccccaggggcuacauccccauccccgugauacaugagcagaauaucacccggccagcagcccagcccuccuuccaccaagcccagaagacccacuacccagcucagcagggugaauaccagccccagcagccuguauaccacaagauccagggcgaugacugggagccccggccgcuucgagccgcuucuccauucaggucacccgucagaggugcuuccagccgggaaggcucgcccgccagaagcggcacaccgguucacugcccaucucccauccgugugcacacagugguugacaggccucagguauggagagucauugguugacagaagugcagauggcuaaggcaggcugagagguucugcagaugcccugggauuccucaaagcucagucucaucagcauagcacagcuggagacaagcagaauucuagaaguuucuggucaggggcuguugaaccgucaguagucuccacggcuuuuuccauugcagcugcucuaggggcaaaggggggagccugugguaagguugucagucacucucaccucuaugaccaaguuccuuaaugugcaucguaccuuuccuggucuuucccuccccccgcucucacuccaaccacaguguacauuguuucucuuucucuauuucucuucuaccaggcauucucuugaucccucugggcauuugcucaggcccuaguuucucccuucaaggcaacucccuccacgccuugcaccgaguuccuuaggauucaguuugugauuguuuugugcagaccagauggcccucuuaucucuuaagcucugagccugacagcaagggaccuugucugagacauucccccaccccuuuugcaguaggguacugugguucccggcuggcacauuaguggacaguagugaaaagccauccugguguguuggauaacaugggcacagcccugcuuauccugcagugaagcuagggagagauguuagggaaaccaacagccugcagcucagagggcaggacacucagugucacugggcucccagcuguaacacugaacagucgaauugcucuuugucauaguuuugaaaaugaaaucucccugcgagagauuuccaaaaauccaaauguggaaugucuuucucuuacaaacagugauaauaucuccuccugggacaggaaacccuccuuuuuguuuguaucugcacguguugugcaugcauguaugugguacauguuuugggcguguacaugcacauccuugugaaagcccaugguugaugugagucuuccuugaucaguggcuaccuuuuccauugacgccgggucucucacuugaacccagcgcuugccagugcaacuagucuaacuggccagcuugcuucaccgguugguuaucuuaucucugcuucuugagugcugggauuucagguggaccaccacacccauccagcugucuccugggugcccuggggaaugcaaacucuggcccucacacgugugcagcagguguuugaccugcugagucaccuccccugugcugucuuuagcuuuuuuuauuuggaaacaauuucaaccucucugaagaccuguaagacucauacacagaagaccugugugcuuuucagaguccucuguugugcuuggcuuuguggagccagucucucauacagcccaggcuggcuccagacuugcuguaugucugggggugacuuugaacuucggaucgcccugcuuuuguuucccucgugcucggguuacaaggugcaccgcuggguuggguucacguggugcuaguaucaaacccgaggccuuuuacacacugugcaaacacuggcaauugagcugcauccccagugcccccugccacccccggcaaugcucgcugcugucauuuucugucacuucuuccucuaccaucugcuuacuugaacugcaggagacuuacuugcaaauaucauggccuuuuacuucuggacacuucagcaaauauuuucccuaagaaauacaaccauaguaggauggccagauuccggaaauuuaaugcucuuccaauagcauauuauccaguuugccauccacuuucaaauuuccuacccagcacuuucccauguugggaccugauccaggaguggaaacacugacuuuagaugucacuucucuuuagucucuggcauggucccucagccuuuuaaugcuuucaugaccuugacauuucugaagagcaggggacauccuuuuccuaaguuuacucucacacagccauccauugauuuuaaaacccacagugggagggcagccgagaggccuggugaggagugagggcugaugaugcugggcagaaagcguuugguggaaacagcacgccagugagauagccacccacucaggguccauccuuggauuuuguaaucccaggacagggcugcccauguuuccuguagucagugagggaguauuuaguccuaguucgaccucuauugaccuugaucaagguagccuuucuuuuacaucuuguucaaagaaccuuuuuuuuuuuuuuagaacuuucaaggauuuaacuuaucugaccauuaaaauagaauuaauacuuuuacuugggaugaaguagcgcaacauuuccucccaguuaaugaagcuggggcauuguaaggguuuuggagucuaaguauucauucagugcuagaagagcccuauucgguuccaguuuggagcauaguugauauuuuaaaauaugaccuugaucuccagucccuggaagggcugugcagccaaaugccaggguaaggcaucaauuauaucacggcauugcaucaauaugcagggccugaauuccuccaggguuaacuauuucaagcaucuagcuuauuuucaaaaaacaaacaacaaacuggucugagcagaaaccacuaggcuguuacaggucaccuugaaagggcaccugggagcugagaccuuauacagcaagacccgaggcagcaucucuggcccagggcugaaaugcagucagucagagauugcucugagcaaacccuacugagagccagcaugcuguuucauuuuugaaaauuacaguggcguacuuuuccuugucuguaaggcugucaccucucuacagaagacaagcagguagcgagccaaucaguggaggcuuagcagauaauuuggucgcauucauaaucaacauccaguuugcauuucagcuauuggcugccuuuaaaaagaucucauuaugggcauagagaaauggcucagcucuugauuaaguuugguucccagcgccugugugggugccucauaguuucuuggagcuucaguuccaggauaucugacucccucuucugacuuccaaggauagauaacauacacacagaucacauauacauaaauaaaaaauuuuuaaaucuuuuuuuuuuaugaacaucauuuucuaagcucuguggauaaagagcuugcaagccuggcagccugaguucaguucccagaacccacauagaggaaggguagaaaucucugcagguuguccccugagggccauguggacauggggcacaagauccugcaaacauaccaaaaaaaaaaaaaguuauuuccagcuuucuugcuuuuauuucuuuuuuauuucuucgccugcuauuaaccacgaauuauugcuuuagacaguuauuaaaaguugauguccucuuuuucucaacagcccaugacccaucgagagccuccaccuguuacccaacccgaaaacaaaccagaaaguaagccaggcccagccggaccagaccucccuccuggacacauccccauccaagugauccgaagggaggcagacucuaagccuguuucccagaagucaccuccuccugcugaaaagguagaaguaaaggucuccucugcuccaauuccuuguccuucucccagccccgcuccuucggcugucccuucuccccccaagaauguggcugcagaacagaaggcggcccccagcccugccccugcagaaccugcagcccccaaaucgggagaagccgaaacacccccuaagcauccaggugugcugaaaguggaagccauccuggagaagguacaagggcuggagcaggcuguagacagcuuugaaggcaagaagacugauaaaaaauaccugaugaucgaagaguauuugaccaaagagcugcuggcccuggauuccguagacccugaaggacgagcugaugugcggcaggccaggagagauggcgucaggaagguucagaccaucuuggaaaaacuugagcagaaagcaauugaugucccaggucaaguacaagucuaugaacuccagcccagcaaccuugaggccgagcagccacuccaggaaaucaugggugccgugguagccgacaaggauaagaaagguccugaaaacaaagauccacaaacugaaagccaacagcuagaagccaaagcagccacaccuccaaaucccagcaacccagcagacucagcuggcaaccugguggcucccuaguguccccugggaccaugcuguagagacuuuuaaguugcaugcacugcgggacuugcagucagcuggcugccauuauucauagccgcuugguaugcaguaacuugggguggagguaaaacacuaacaaagggggcuuuucuuccauagucuauucuguauaaauaauaaguugccuguuccagaagucuaacccuaaccccucugguugucugggaccccuuucugugcaugggugcaaugauuuagccauggcugugggcuaucuggguacaaugauuuagccguggcugugggcuaucugggugcaaugauuuagccguggcugugggcuaucuuccuguuagccuuggacugaagggguuuuaaguuuugagggguaggaagagaguuacaggaauagagaaccuguuuuugagacauguugucauuuugaugagauaaccuucaucucguuacugaaauaucuaacuucagcuagauaugagcuaugcaaggagccauaggaauagcuauauguuggaauggcuuuaauguuguuacauuugaggggggauggaaaauaaagugauuauauaacucucaaaauguuuuuuugugguuucuaaaaguuugaagagugacagauggcaucaagguuauuccagugggugaagcgaggaucccauauaagcacucaggaggcagaggcagggggauuucugaguucgaggccagucuggucuacaaagugaguu

SEQ ID NO: 4139 - RNA, 86352 nt, Mus musculus
ggaggaaccugggaggaggcggagucuagagggagccaggaugaacuguaggagguggagucucaggauagggggcggagccuagguacaggaguuguggggggagggggaaaaggccucccgggccucggccgcccaagcguguucuuggcccgcgggucaggcccccgagugcuuccccacucuguucuuccgugggcuggguccucggagucuccuugaggcacggacucugguggucucgguggaggaggacuccagcaucgcuccagggcgggccgcugccgugccugggccgggggaccgccgccucccggagcgcguggggccggcauggagcucuuucaggcuaaggaccacuacauccugcagcagggcgagcgugcccuguggugcagccggcgcgacggcggccugcagcuccgaccgggugaggcgcgcggcgcgggcuggguggggcgcgcgggccagcuggagcgcggggggcgcggcccggccccuccggccccgggaucgcgaggcugggcgggacgcuuggggaugucagcgcuaguccugaggggagcggccgccgcuucggggaguccuccugccucagggaggcggggaaggccggucacccccuuuagugcaccucuuccaguaucuggggccuggggugcggggauagggucccuuaugaaccccucguaggccuccaccugcagcgucuucucacgguccagcgugggaaguucuggguuccagucccaucaguucaguggaaccuaaugcgggacacuccuucuugacauccuugaguuguucccggucacuuauuaaagagugacuucaggacgguuaccucacaggacuugaucgaaaacuaguguaugaauugccauuuucaagaagaagucguguuggaugucugucacacacaguuaggagaggucaaagucuccagccaucaguuugcuuuagaaaacuuuguuugcaguuaguuggcuuaaauaguagcuccuguucucagacagcugcggucaguuaucgcucggaggaguuugggcagcuucuacuuaguucuccagugcuuuuuuccuucauuggucaacacuuuuuuacuuuaggaaaagugagacuggaacucuugaacgagccacggcauuggacguuuuccugcguucuuugaguacauccaguagaauaacuucaagggagcuuuuuaggucauccuguuaccucuuaugggauggcuucugaggacagguccuuucgugucuuagugccaauccccacagcagccugaaagaguagggucaggaucuucuuucucaggugaggagagaagugugagaucccagaaaguggagcgguuuggugacacuuuucaucaguguccauuguguccuuacggagaccugcaaaguuacucugcuagagcggugaagaacaacuuuuuuucuucuucagaaauauggcucugguuguauuuucuugccgcuguauuuuauuuccucuuuucagaauggaggcacuacgguggccacaguaagacuuuuggugaccuuggaauagaugaugggccacuuuauucuaaucugaccacuuuuccuagccugucacccugcaagguguaaagcaggggggaauuuagcuguaaaagucccgcgggccaaauuccuggcagcuggaaugcauaaauggagggagcuuggaguccuucucagcucaucagacaggacuuuucaucuccgcaggucaguuuucucaagcagaaaguuuagccgggcccuuuccuggagcuagcccugagguuugcucuuuguuuguccaaaguucguaucagagagcaaguguaaaacuuuucaccauuaucaaaaguuugguauagcaucacaguucaguguaucucauuucguagauacguaucccaucacccacaaacguagguagcgccuagaggaaggcagaggccaucauaguucagauuuaacaggccauuggaagccuuagaaaguauccuguaguuauugacuaguuuaaccuauccaguauuuaagaucucaaauacagcuauuuuaguaauauuuaauugaucugaaugcuguuuaggucuuuuuuuuuuuuuaaucuauacagaguuauuucaaauucucuuuauugaacauugucuucucuuuguggugaguguugcuguuguuuaaagugacagaguuaaaaucuuuaguuuuuuuuucaucuugauuauucaagagccgaauagacuucugaccaaguuugguuuuuuuuuugcuuuuguuuuuguauuacaagugguguuauaggaccaaccagugcugggauugugauuuuuacacacugaaugaccagaaacaggaaguuuucuuuuuccuggagauaaucaggaaaaaaaaagugauaaugauauuuaagguuaaaauuaccacuucuguagcuuggaauccccgugacuuucugucccccuccugccuacuucucuguguaagacucauauucaaggcugucugcccugggcuagucuggcccucauccauggggcaguuauuggucacauugauuuucuuucuugacauuuugcguacuuuguacauacuacaguuauaacccucccuauauauuuugugaugauaguuugugucuucuccaguggacacaggacuccucagcacaaggccuugcuuuacuaauacuggugucucugggcuaaagaguguuuaugauacagaacauacuucaugacugaguuaaccugaauuaaauauaacucuaaguuuccucacacuuaaauuauugcuguggaaaaaaaaaaagaugauuuaggccccauuuugaugucuccccccuccccaucuugcuguguagccuaggcuagccuaaaacugacuauaguuggucucaaauucaacaauacucuugccucuaccuccuccucaguuuugggauuacagguguggccuaugccaccuagcugaaucacucuuuauucaggcaagaguggaggugaccaagccaggcggugguggcacaugccuuuauucccagcacuugggaggcaaaggcagguagauuucugaguucuaggucagccugguuuacagagugaguuccaggacagccagggauauacagagaaacccugccucaaaaaaacaaaacaaaacaaaaaaagaguggugaugaccaccuugaaucccaacacucaagaggcagaggcagguaggucucgugugaguuugaggccagccuggucuacauaacagauuuugggacagccagagcuacauaauugagagguucugucucaaaacagaacaaaacaaacaaaaaaauuuauuuaauaggguggagaaucgacaguucaagaaauguuagaauuuacacuuguauuuuuuuccucugauacaccagcaucugcuccccuacccaugggugugugagugugugugugugaguguguguaugugagauaggauuccuuaauuuuugacaauguuaauuuuuaaaaauaguauaaauauuuguuuuuauuuuccuaacaguggugaguagucuguuacauuuuuguaaagcauugauuuuuauuuauuuuuuuuagaugcuuaucacaauugcaaguuaagagacaccagaaaaaaaguauuuagcuuguuuuaacuucucucaggaaagugaucgagugcuguguacucuccagagaguagaauuuaacugauacuaugagagucagacacugggaauuauaguuuaaccaaaaggaaaccgggagaaggaaaaaagggaguugaagaaggggaggguaaugugacaugcgugauguuggaguagaaaagagguucugggaggugggucaagagaagaauggggcaugguggggaugagggaggugggccaagagaagaccagggcauggugggaaugaggggggagggggagggaagaccagagguaugguggggaugaggagggagagaaagcaacagaaaauguaaaaaaaaaccaaaaacacaaaacccaaaaaccaacaaaaaccaaaauacuguguguguguuaguugaaaaauaaauauauauuuuaagaggauuguaguuuaacaaauucaaaaagaauauaauacaauauauuuuugggaguagccauccagucuuuuccauuuuagaacuucuuccagucuuuagcuuugugugaaggggcaguguuauguauuuuauuuuauuuuauucugagacugagugaccaugaacgaucucagaucacgugcuguacacacagcauuuauaagcauauagucuguguguagcaaaaugaaacuuuaaaugaugacuagcaguggacauuuguuuuucuuucuuuucuuuucuuucuuucuuuuccugagggacuacuaguuaucagaauccacacaaaguuuucuugcuccucuuacaguuuugacaaugaaauuauuguauuuuuauuuugggggaaggggcauguauacacacguugcuuuguacuuguggagaucagagagcaacuugugggcccguuugguucuuccacuuugcggauccuaagggucaggcucaggaugucaggcuuagcagaaauccccuucacccaauaaccuuaccauuaugccagccugaaguuaguuuucacugucaaauuaacccaacuugaaaaugagagauuauuguggaauugaaaucuacauggaauauguauuucuugagaaaugcauauugaaauacauauauucuuuuuacauugugugaaacucuauuuaguuugcuuacuauuuuguguucugucauuuuacuuaaaaacaaaacaaaacaacuaacuuuuuuuuuuaagacaguaucuuauuuagcucaggcuggcccugaauuccuccuaauccuccugccucaguuuccugagugccaggauuauaggcauaaaccaccaugccuggcauccucgucauuuauguuauuguugcagccagguuuacuagugucuucagucuuuaauuucuuuuuaaaagacacuggauuuauauucuguacuauuucuguuacccuauguagucuaguguuaauaagguggcaguugggcucacuagcuagucuuuugcaucuucacccaagauuaauaccagcuuacaauaacagccuuucaccuguggagcauuuucugaguucuguguucugauggacuguauaucucauucaguuucucucgaaguaaaacucugaggauagauuuauuacuagucuaugauuauagaugaggacguugaagcauagaggaauaauuuguccaaauucuugaagaaagagagccaaggcuucuaguccaguguaugccuucaaagccacguucuucaguacugacauuguuguuuuauaaggucucucuaccuuguuggcuacaagguuguaagauuuauauuucaugggcaccuacagcgcuauaauguaaccuauaggggaauaaaaagccccucacgugucaaagcccgcacucuaaggaaaaaggucaccggcugauaguaggggcuucucauuugcuuuugucccugugccugucuuaccucauuuccugcaaaauuaguuuauguagcuauaagaaacuccaugauguuguuauguaauagccuuuccagccagugccaguguuucagguuucucuuggguuuuuagagcguuugcaguagaagaaggggauagaucauggggcagaucuuugaggagacauugauauauacuggguaggaaccuaggaugagcaaucugaaaccucucuuaggcuagcuuugcaggaauccgagauccaguuucagggcaaccuuuuagaguacacagagcagagauagaguuggaaggggaagaaacaaccuuuaaagauggaggaauuuuuguuuuuaaucccugauuccuagauacuugcauucugacuugguucuaggagaguaccaucaagccaggacaccgaggaaggaguggccagggagaaaagacuggcgcaggguagaacugccagguggcagaccucggugaccucggugugguccuucaggaaucuggcugcauuaugcucuccaagaagcccggcaucaugggccucccagcuagcacagcucucgaauggagggagaaugcacuugucucuagauugcuaguauaggucccucacaagguaucugcuggagucguauugaaauaacuaucgucccuguucaccuuguauaguuugagcaucaaagggcuugaugggaggauuaaauagagacuagaacauugacucagguccugugcucauuucucauugacauuuuauuuagucaugggagggggguggggggugcagcuuggaaaguugugaaguucuguagaucuguuuucuuuuuaaaugacauuaagugggacacacagacacuuuauuguucccuggcccuggcccuucugccacaaaggcugcuuucgcugauuuugauccuuggacuuuaugauggaguaggcucuugucuuuggacacagacacuagacuauugggaaaucaagccaguccuccuguacuguugauucaguaugugcucauuuugguguggcuuuauggggauuuaaguguguaaggccuuuacaaccuguguugcuaucucugugugucuauuuuuauagauuguucuuuuccuguucaaauguuuuaaaacauaacucuuuaaagucuagccuugcuuauacaagccugggagguaacagugauaucacagagccuuugauaaaucaugacuuguuagcugaucucaguugugaucaucaugugucacuggccauaagugaacugagaaccccugaaccaaaggcugucgaucaaaauaggggaaauguuauuucuaguugguagugauauauaagugauaauguauaacuaguguuuuaaaagugaggcaaaauauugaccauccagcauuauaguacucaaaacacacaggcaguguuaauucaguugcaugcuuuguaggaggauucauuuugcagaugacccuuaagggaacugcuuccauucauuaaaaaaaaaaaaaacaaaaaccugccauuauucuccuugguaaagcuaguugagaaacacaggcggauuuuaggucccuugguauguuuucucuuaaaguauuuucacaugccuuaaaccuagaauuuggaaggugcaggcaggaagguuagaagucaaggcuaucuucagccacaugaaacccugucugaaaaacaccaggacguggggaggaguggagggugaauaugaugaaaauacaucuuauuaaauucucaaagaauuauauauaaaaauugugucauauauauaaacauuauauuauauuaagacaggugugguacauacaccuuuaauccugguacuugagaggcagaggcaggcagaccucugaauuccaggccagccagcaagagcuacuuagugagacccugucuuucauacacauacauacacauaugugugagauauuaaaaagcagcaaauuccaaaaacuuauuuuaauuucauguucuuucaaauuuauucuuacauuuccuuaccuuaaugguaagauauaucaagauauacuagcuuguuuauggaaucuuauucuuuccagacaucuuuuuaccuuuuaaaagcaacauggaccaggcgugguggcgcacgcccugaaucccagcacucaggaggcagaggcaggaggauuucugaguucgaggccagucuggucuacagagugaguuccaggacagccagggcugcacagagaaacccugucucgagggaaaaaaaaaaguaaaaguaauauagaccuuuaaauuuuauaauuuauguaacacuaauauaucucacuagauaacuuuaacaucuaacuguaauguacuauaauguuaaacgugugugugugugugagaguauguguuaguauaagauuccugaugguucacaucauaaaacaugacuuuuaugccagauacaaacguucccuaugcugagcccaaggcaccugucuuugcuaggaagguuguagucggcacacugaagaguuucugaggaugguuggugguggguguguuagccuaccuucuuggacucauuucuagagcuguggcauuuccccuuguaacuuucaaauccuuucauuucuugaagaagcacucucccauuuaauuuagcauuuuuuacacacacacacacauuauauauauauguauauguauauguauacacacacauauguguauauauauauauucauucuuuuuuucuuccuaucugaauuuuauuuauagaucaaaaguaacaguuauuccuuuuuuuguuuguuuguuuguuuuuguuuuuuuaaauauuuuuauuagguauuuuccucauuuacauuuccaaugcuaucccaaaagucccccauacccuccccccacuucccuacccacccacucccacuuuuuggcccuggcguuccccuguacuagggcauauaaaguuugcaaguccaaugggccucucuuuccagugauguccgacuaggccaucuuuugauacauaugcagcuagagucaagaccucugguuaguucauaauguuguuccaccuauaggguugcagauuccuuuagcuccuuggguacuuucucuagcuccuccauugggggcccugugacccauccaauagcugacugugagcauccacuucuguauuugcuaggccccggcauagucucacaagagacagcuauaucaggguccuuucagcaaaaucuugcuagugugugcaauggauauucauucuucugaauuacauugugaugucauuuagucuuuuuuaaguguugcuuagggccuggagauguauauaacucaguuggcagaauucaugccuagcaugcacaaaacugggugcuauccuuaguacugcauaaaacccaguauaaaaugguggugcaagccuguaagccuagaauuugggagguagggggcaggaagaucaggaguucaaggucauccucugauacuuagggguuugaggcuccugcaugugacaugagaaccagucucaaacuaaacagaagcguguauugauuggaggcugucuacccaguuugugccaaaguaggaagaugaguaguucugcuaccagaccagcaggaugugugggcuggugcaggagacacacaggguucuagagacagauacuagcauagagcccuaacacauaguuauaugcaagauuugaucugagucuuuuuguuuugagacagggccuccuaugcccuagcuguccuugaacucagugaguaccagaggacaacacugccucugguucccuuuccucugccuucccagugcuggggcuaguggaaauggagugcugagaacaccaugccuggcucauuaauuugagucuugagguuugaggucuaagugguuccuaccccauccccugggagaaucuguuuucuuccuaauaaaaugggaagaaagguguuguuugguuuaauucuaugaacuuccuucaccuguaaauucccaguggucauaucaccuuauaaaagugaaaaggccuuuggaagguacccugagcuguggggauuuuaucuuaucaaaaauaauacuuuuuuuuuugguuuugucuuuguuuuucuuaugauaggcccugacuggccugaaacuuccuauguagacuggcuggucuuugacucacagaaaucugccuuccaagugcugggucaaaggcgugugccacccaguccagcugaacuaaugcuuuuuauguacaauuccuucauucuaacaggauaucagagaagacagggaguuuaugagaacagaauaggauguaacuggccagacuguaagaugggguacugcuuauccacucccuggucuugucuugucuugucuugucuugucuugucuugucuugucuugucuugucuugucuugucuugucuucucuucucuucucuucucuucucuucucuucucuucucuucucuucucuucucuucucuucucuucucuucucuucauuuauuuauuuaaaucuggaaggaguuguucaucugaggccaggugaaacaucaacuccaagacaauaaugauggguuugaaggcagagcuuuugugagggcccacaguauacacuauacacacaauccuagaacaagauacaaaagaguaaauuacuuuuaaauaaaguuuuuagaaaaaauauguaauuauuuaaaaacagcugagagaaagguugcaucuauuuaauguaagaaguguagcuuuaugcaucuuuuuaauagcacuguuuaaaaaugagggaagggaaauaccaguguccaucuguuuugacuuaccucucaggaccuucccuccuccucuaccccuucccucucucuguccccucuucccccucccucccuccaacuggccuugagcucaccauguagacaaggauaacucgucuacaccuccugaguacuggagugacagaaguacuucgcccgcuuugguuuauguagcacugaauauugaacccugggccuugugggugcuaggcaagcucuccgccuacugaguagguaaucaccucucguuuuuggauauguuuccuuugguaccuuagaccagccuuuaugccaggucacuguauuagggauuaucugugcaauuggaucuuuacagcuuccauguauuacacgucccaugcaucauuugugagucagacugauagagucaaacucagcuacucaaauggauuauuucuagagagcuguaaccacuuagguauauaaguacuucguccucauguacaucugcacaccagaagacgucaucagacaguugugagcugccgugugggugcuuggaauugaacucaagaccuucauaagaauagugagcgcucuuaaccacugagccaucucuuuagccucagcaagaaaauucuaaaccugccucuauguuagaaucaucuagaggacuuuaaaaauuauauuuaugcugggccccaucuuggccgguuuaaguccaccucugcgagaugagcccaggcgucggcaguuuacagaacacuuagaugauguuacugagcugccuggcuugacagccauuggcugagcuggcuuugcagugggaagucaccacaccuuugcuucugaauuggaugaauucuucagcuugcugccucguagagaaauaauaaccacuguggaggcugaggaaaugaggaucaaacuuugaacuuuaagcuggcaccugaaugaaauuauuacuuaccccgucuuuaagccucauuaaauucugaggaugaaagcaugacaugcuaacaauuggagcuuucaguuccccauccuaaagcucuuuucuucauccuucugauuuugguguuggugauugucagagcaauaauagccuuugucuuuagcaggaagugaaacuggggucugauuagauaugcauaaacuaucugcccccucuuuaaagacacagaugaaacuugcuuucaaacuguguaaaaccuaugcuggcuggcucuugcuuugagggagugcucucacucugggaucuuggaaugaaugacucaugcucucugcaggcacacagugcuuaaucacuuguuuuuuguguaccaggaagagaagggcauuugaaaauagaagcuguguaccacugccagauggacuugaaguuaguggaauuguugacguaguggucaaacaauugagcuuauuucaauuacagacuuugguuguauguuucuuuauuucacgaauuagaaguuagaauuuggcauuauuuguagagugcuagcuauacuuguguaguuuguaauaguuauguaacuuugacaacauuaaacuuuaaaauguuucucuuugaaugugcuugccaguuaguauacuaguugaaggacagguuaaaaccugcuggagcaguucacuuacauggcuguucuccguggaggaauagcauaaggcaggaccacuuucucugccauuaggauccuuucugccuccagaauagccauuuaaaaauauugacagugucaaguccuuagguguugcauaugcccagacaaauaacaucucuauacauucucuauacauuaggcuugcuagugcuaacuuguuuucuugguaaagaauaagaguauaauguauuucaaguuuaccuaaaaugugugcguguauacacauacacacacacacacacacacacacacacacacacacacacacuguucauuucauauuguacuaaacaguaaaguucagcagcuccuaaaacccaugaguccuucauucccuggucaguuacauaaccuguucaugucucacuguuuccugucucuuuggccauuggucuaagaaaguaagugcauagaguagggauuuaaagacaauuuuugcuuagguuuuuuuuuuuuuuuuuuuaaagcuuagucuugauuacaucucaucaaguauuauuuucacugauagaccaaugcuuuuuuuuuuuuuuuuuuccccaaugucucauucgauagcccuggcuggccuggaauuccuguguagacuagacugcccuggaauucucagaggucuuacugccucuaccucucaagugcuaagauuaaaggugugaacuaccuugccugaucuaacccauuuauagauugauuuuguuuuguuuuguuuuguuuuugagacaggguuucucuguguagcccuggcuguccuaggacucacuguguagaccaggcugaccucgaacucagauaucuaccugccucugccuccugagugcuggcauuaaagauguguaccaccauugcccuuaauauuauuuguaaaagguuuguuauuuuuauuuuguguguaugaguguuuugccugcauguauguauguauguaugcaugccuggcgcccuuggaagccagaagagguugccagauccccuggaacuggaguuaaguaugguuguaagcugccauauggguguuaggaacuaaaccuggguacuguguaggaauagcaaaugcucuugacugcugagccaucucuccagcccaucaaugcacuuauuuuuaaaagugccaggauaguauagcaaagauugauauuuugguguuuuuuuaaaaauaauaaaaucuuggacugggguugugauucaguguuagaauauuugccuagcauauuaauauauaggcccugaguuugaucucuagcacuaugcaaaaacaaacauccuuaaaauguuagucuugcucuaguaguuuauaaaaauugccaguugcugggagacaucuguuuuacccuuuguaucuuuuuuguuuguucauuuaguugagugacuguugcugcuucuuagguaccaaacacuaccccagucacaagugcacacagguaaacaaaaugggauuuggguucaguagcuuacauuuagcacaacuacuaauaugcuauuucugccauuuauuuauuuuuacauuuauuguguucuuucccuuaccuguuuuuuucugucuguaauuggguagcucagacuuuuuucaggugucuucuguugcugaugacagugacacuugugggcuguggaggugguggcucacuggguaaaagugagcguugcuaacccugauagcuacaguuuucauccuaagagugacaggaaagaaauggcuccugugaguuccaugucagauuuugcuuuuuuuuuuguuuuuguuuuuguuuuguuuuuuucaagacaggguuucucuguguagcccuggcugucccgaaacucacucuguagaccaggcuggccuugaacucagagaucugccugccucugucucacaagugcugggauuaaaggugugugccaccaugccuagccucuacaucagauuucuuuuaaaaaauaucuuuaaauauuacauauccuaaggucaaauauagcaggagaauaagguugucaaggcuacauaguaaaaaccugggccaagaauguauuuuagugguagaguacuugccucacgugcacacaacaaaaggccaucaugggaacaugguucugcacgccuuugauuccagcacucaggaggcagaggcaggcggaucucugaguuugcaaucagccuaaugaaaucuugucucaaaaaagaaggaagaaaaaaaaaaaccucccugcacauucuauucauaucccuuugugguuuuauaagacuugggcuccaguauuuauuuugauguauguaauuaacaucaccgauauccaugacucucccauacacagcuuccuccuuuuaggcugggcuucuagaugcucccauggaggagaaggaggaggcuggcagucacgcuuggaucauugcugccuugcugacacucagccuggauguucaguuuuaaccugcaucagagcaauagcucaguguuucagauucugaggaaauagaauucugggauaaaucuaggcauagugauaucuccauaaaauaucaccugaagaaggcuuuaggaguuauagccucacucuaagauuuaaaaguauaaaacuuuuaaauuuaaauuaaaaccauuauauauguauauauauauauauacacacacacacacauauaaaaauaauuguuuuguuguagguuuuuuuuuuuuuuuuuuuuuuggagacuuguuguguaauccuggaauucaguguauggaccagccuggccuuaauugccuuaaacuucuugggauccucugccucugccucccaagugcugggguuacagaugugugccacccuucucccuacuuuaaaaaagcuuuuguagguucuuaaaauaaaaauguacaggcaaauuguugggcuaugagauccuggagucuuaaauauauacauauuucccuacuugagcugaaaguuacugacauuauuacuauuaucacaugauucauuuauccucauggaaaccuuguaaguuggauagcauucccaaagcaaagcugaaggggcucaggcugugguagagcuagggucgucggccuggaguaccauacggaagcugugguggcuaugccacaugcaacuaucuuggcuguccagcuuuuagauguuacucagcuccaaggcaccuuggucuguuccuaggaguuaccugggucucugguuucaagcucgaucucuuuuguguguugucugcagacucauucuaucucaacuguaaaucuagccugcuuggaggcaaacagcuccugaauuuccugccuugaguucuuacaacucuccacuucugccgucuggcccagcagaacuuacaguguuuuaagagucuuuugugcauccaguacguucagcacuuguuauuuguuaaggaauauguuggauccuagcauuccaagcuacccaaaacauaaaagaccaaccacagggacuagcccuaggaagauagccuccccucccccccccccccccccaacguaagcugugcuauagagacagagacaggccaaauaacuccuccuccucagccccacccaguagugcaggugcugcuucugaccccgacacagaaaggcacuacuuucccuuuucucguuguucugucucuuuuggaugcugaucagaacucacauaugcucucucugcuacuucuccuuaacccucucugaagcuuucucugccauguguggcucgucugccugcuauggaaagaaguacaguaaucaucagauaucaaggggacagaaccaauaggucuugaugagaaacaaaggcauuucagguggcguguaggguuuggcucggucagcuggaaugaugguggugaccucaagcuccaugcacauacgagaguuguacauuggggguauuugguaaggaaacuuacggugauggagguaugcuagagagaaccuccuuggguggagaaagggaaaccguucugguguuaaccagcuggaugauggugacaguggcuuuauggcaucaggcuugauggucacaucuguaauaggccacaugaauuuaauuuuugucaguuuaaauaguaaaccuuuacaaugugguuacuuaaauauuaucugacugcaguaaauuucuuuccauucugaagugccugucuagcucagagccuauggugcuaugcacugagaacagaaagcugaaccuugaaaggucucugaguuuccuguuuuucaugagcuccugugugaucaaggaguuagucaagucaauaauuacaagcaaggugcugagauagagauuugcuacacaaauguacgauuaguucuaagggugggaggagugaggauugugucuugagaccauuaacccuuguuuugaggguagaaggaagagcgggcagaaguggguggggagcagcauuccagacccagccugaaagggguagagggugacuucaggccaggaugcugaguguggagaaggguggacaggauagccuuucuucuaauuauuuuuuauauuuuuggugggggggcccagguuuucucuauguggccuuggcuguccuggaacucacuauguagacuaggcuggccugcaucucacagagauagaccuuaucucuaccuccugagugcuggaauuaaaagccuguaucaucaagcccccucccucccuucuucacuuagcuuaaaagccuuucuaaggaauuuggacuuuguuuccaaggauguguggucuagaaguaaugauugaacuagcaguguucauaguuauccuuuuuaaagccuacuguguuucuuuggcguuaauguuaaacuaggcaaauauucccauuggguggcuuacaaccuucuagccucagugggcaccauuaugcuuaugcauaaaacacacauauguauacauaaauaaugaaaauaaccuuaaaacauguauguacauaagcuuccuggcguguccucugagguguuauaucucuuuuccuauuauuuuugugauacauuuuaaaaaauauuugguuauuuuaggagagagagaaggagagagaaagaaaaugugugugugcacuuaaugcugugugucuguguggaagccacagaacauuugcugacuuccgcaccuaugcugaucuucccauccugcugccauggccuuucccuugaugaaggaggaggacuugggcucccauuucaugaaguuagugccauuugaugugcucaucugcuucucuguugcuauaguuagccuuucaucccuuuuuugcugaguuggaagaagaaaaaaaaacccuuccuuuccaagguuaacuuuauaccugugcuucagauguuaccaugcacuuuuucuccuuuacuguuuccucuuacuguuguauuuuugagguagagagucuugaacucaccacuaccauaauauagcaaugccuauguuaugcaauucuggggaugaacccugggccuuguacaugcuagauaggcauucuuccaacugagcugaucucaguccucaguguaaucuuugguguaaaaucauuauucucuccugcccuucccagccgagguguuacaucgcuuuuccuaguaauuuuugugauacauuguuuaauauuugcuuuuuuccccccggaaugugugguauaugaguguguuuauguccuguguaugugugugccuccuguuguauguguaugcauguguuuguuguguauguauaaguguuuccuguuguguguauuuguuucuugauguauguguguucacuuguguguguguauaugcauguauguuuuguauuguugugucuguaaguagaggccagaagagguuaucaagugucugcuauugcucuuuguuucuuaccuuugaggucagcucucugaccagaccugcaggucccccucucccugccacagcuaaaggaccgucaggaaaccccagucauccccuugccagcacugguguuacagguguaugccacugggcccugcuuuuuacaugguugcuggggagucuggacuuaggucaucacgcuugugcaguaagcucuguacucacuaagccaccccaaccuccucuucagucuuuuaaagccuuucucuagauuauuuauuuuguguguaugaauauuuugccuauauguauguaugugcaucucaugcaugucuugugucuggugucugcaggggacgugaugccucacaagucugcugccuacccaccucccaagcucauuugucauuucuuuuuuugcacuaacuagcugcuuucccugcucccaguccccauucaggaagcuguauuucuggcacuuacauauuugaauguauucaccaggucauggugugaacaguauuuuucaauguggacuucaaacaauugcaagcgcuauuuaacuuuugggugagcauucauugugcuaacugagauaaaaccccuggcuguaaucguguuucacuuaugacauugccugccugccauagacucuaggaagugugggcucauugcccuuuauuuauuuaagucucuccuuagcuggccucaguuuacugccaguccuauucaaauuuccacugaaccuacugaucuuauguuaccuagaaaccacucuauuguuguugcugguguuuuaaauauuuauuuuuaauuaauuuauuuguuguuugugucuguguauuguuuaaaaaaaagcuuuuccuccuggccacuuaguucccagaaauaacaacucugauucuaauuauuuauuaauaaaugccuaggccauagcuucagcuuauucugaguugcucuuaauguacuaucccuuuuauucuaacuggauucagcuacauggcugacuuccucuccuugucuucuuaugucugucuccucagaguuccugggccaaucuauuuauucuaaccugaguucagcuacuugcugguuuauguccaucuccucaguguuuguggugaaucucccaugcuucugauuauuucccagaauucucuuuauuucugcugaaugucccaccuccuauuuucugccucagcucauuggccauaagcuuuuuuuauugacaggugaugcuuauuaauagauucucucuacaguguaugugugcuuguguggggaauagugaagugggagguuggcugcuuguaucugugcacauacagagaccaggaaggagacuuuuguauagucuucuuuuuugguugaccuauuccauugagucagggucucucccugaacccggggcuauguuuucuuagcuaggcuaggagcuagcaaacccuaaagauccuugugucuccaccuucacccccaaauugggggcuggacacccagcuuguuauguggguccugggauucaaacuguagacuucaugauugaucagcaaucacucacugccuagucauuucuccugccccuaucuggacuuagagcaagcauaccuuugaaugauaauccccaccuugcuucuuuaguucuguaucuucugagcuugaauccuugcagguauuugauaagucuuucccuaacaaugggacagauuccagagcacaucuucaauagucccucuuuuccuuucuaugaagcuguuacaguugugaccucuggaggucagagugucaggguuaaggaagcuggugcuccuucuucagcaggaacaucugugcuggcagaugugagacuugccaugucugauacaggcuugacagacuggucacuggaguaaagguuagaguaaagcauuuaaaaguaacagagauaaaagcaguuaagccacaauugaugcuaggcaaggaaggcuuuuuuaagcuuugagauagauuuguauaaaagauaaaaacacagcaucugcaaagaagucaaagauuuaaaguccuaaguacacaaaggauucauaggucaauaagaaaucuacucuagggcuucacauuugcuaguguuaaucccauuggucaagaauaagacccguuuacaauuuaaagcuaguuuuaauuaaauacucaccaagauugacucuagucauguccagaaaauggccacaagucauguuuuguaggggcguaacaaggcaaaaccgaucauucauauuuucuauuaguuccaguuagggacaagcauacauccugaugcauuuccugcccauguaccucccacccacaugugaucaagcacaucccaucagaugggucaaacaaaccuaggaaaaacaggagcuuauucuuaauuguaagcagaacucucaaccugcaggucuauuuuuucuguuuuuuaaagauuuauuuauuuuguuuauguaugugaguacacuguccuacugcugucuucagacacaccagaaaagaucccauuacagauaguugugagccaucaugugguugcugggcacugaacucaggaccuuuggaagaguagucagugcucuuaaccacugagcuguuucuccagccccuccuguuuuagucucacagggaaauuaaagauacaaacaagaaggccaaagcagggggauggcauacacgaggagaucgguguagaaggaggaaagcagcuacuuuuauaguuaaauagaaaauagccuauuucuagguaauggaugccauuaaauuaagagauuaaaagauccugguaaauuuuaggccagguguaguagggcugcauacuuuuaauuuaaucucaguauuuggaaagcagaggcagguggaucucucugaguucaaaguagccuagguauauagugagcuccaggacagcaaggacuaccuagagagagauccuguguguguguuuuuaaguuuaccugcauauauauguaaauauauguacauauauauauauauauauuauaccuauaugcaggaaaauuauauauaaguaaacuuuaaaguaaacuuuuaaauaugcuuuuggcagaaaucaaugugacauaacauuuaauagaaguaauuugguaaugcuugagagccuuauuuuuuuuuaauguugugacuacuacuuucauuucuaggaaucuaucuuaaugcuauuaaggauggagacaaauaaaauauuugcauaaaauucaucauuuaucacaguauuuuuauaauagaaaaaaucuuaauuaaagauuuaugugaaaaaguacuuccuuaaauggaaaauuaugccaggauguucuauuucuuuaaaaaagauuuuuuauaagaucuauuuauauuuuauguguuaagucuuuugcuugcauguauguuaguaaguguacuccaugugcagugccguggaggucagaagagggugucagaugcccuggaacuggaguuccagucaucuugaggguucugggaacugaucauccuuuguaagagucacaagugcuccuaaccgucgcaccaucgaccugcacucagguccuggcuguucuucacugguagguucugaacagaccaggagaucagaaaacagagaagaugggaaaguugaggcccaggaggucucauauaaacuuugucuuaucucagcaaguuuauuuuaucauacauacaucauauauacgguuugcagggaaaggagacagaagaaacuuucauaugaugguugaagucagcuggaugcuaaccaagcaaugcuucacaaagggaacacaggacacuucaugugugucacagaacaaguacgcaugcagcauccuuggcucugauaaccauaacgcuuuaggucagugguucucaaccugggggucaccaccacuuugggauugacuaaugacccuuucauaaggguccccuuagaacaucagaaaacaaauauuuacauuacaguucauaauaguagcaagauuacagugaugaaguagcaauaaaaauaauuuuaugguugaggucacuacaacaugaacuguaugaaagggucccaguguuaagaggguuaagaaccacuuuagggggaagaguuggguucucaggauccaaaacugaaguuuccccaagacccaguccccaggccuuuucuauauaucagggcuugaagagaguauagcagaucagccugguucucaccacagcaucucucuagcccuugaaaaagacuuuuaagaggagguaguucuguguggcacugcaguuacuaugcaggcagagaccugaaacgagacagacuagucuuaccucaguggccaguuucccccuccgucucauacugauacuuuguaaucacaugcggcauuuaaaacuuccuguuucaguggcucacugcgcuguuuggggggggggggggaaggugagguguugcagcagguugcugggguguacaaccccagucagauaggcaggccucuuugguuuuguuuauuuugagaaacagucuugccauuagaguaggguggccugaaacucaagauccucuugccuuagccuggacaacaucagagauuauagcaugcacugcuauuccuaacucuauuuauuuguuuuuuaaauuuuugagacaggaucucaaaauuguguaggccuggcuggcuuggaauucacuauguaggucaggcuggccuugaacucacagagaucugccugccucuaugccccaaguguugagauuaaagauuugugccacuauaccuguuuuuaauuuaaguuuuuugacauuuucaacuuacgcuuuugaggcagagucuuauuauauuucuuuugauugaggcucugacuccugucuugugggcaguuugacuguuauuuuccuuuuuuuucccucuuauuuucuuuuuugguuuuucgagacaggguuucucuguauagcccuggccguccuggaacuuuuuaguuuuuaaguaaauuuauuuauucauucaacuuuaccuaccaauauuagccucccuuuccucccaggaccaccuucccgcagcuccucccccauuccucccuccccuucaucuuugcaaagggggagccccccucuaguaucucaccccccccccccccacacacacacagcagaucaaggagaaugggauccacaggcaggcaggcaggcaggcaggcaggcaacagauucagggagagauuccuguuguuggagagcccacaugaagaccaagcugcucauugacuacacauauacagggggccgagguccaacccaugcuugcucuuugguuggugguuuggucucugggagccuccaaggguccauguuaguugacucuguuggcccuccuguggagucccuggcuucuuugggucccucaagcaacucuguuauuuuucuaagcauuauuucuucacuuguaaacugggucaccuaaugccaaccucauaauguugucaagauuggaaaugaggguuggcaagauggcucacuagguaagggcacuugccucaaaagccuggcaaccuggguuugauccccggaacccaccuggaggaaggagagaacugacuccacgaguuauccucugaccuccacaugugcaccuuggcacauuugugucccuacuuugacacauacaaagcaagaaauauuagaaaugaugauauguauaggaggagccuuuaaaauguuuuuaauucuugcaauaaaacaaugaaguugaggugugcauguaggcugcccaucaugcaugaaacccuagucuuauaauccuggguucaccccuagcaaggcaaaauagccacaaucaacugaagaaauguauugguuguuuuguuuuuuggugaaaauauaacaguaaagauggagaagaaauaacagucucaguuaugaagucugaggcuggaggaucaccgugaguucacagcuagccauggcuaauccugacucaagaaauuaaugcauagugaaaaacuaucaaaacugaaaugaguuugaaaacuaaacuauuaguguauuguuacuguaugaaugacagauaauauuucaguaaaauuaaguuuaugugguaauaauuaaaaugcaauuuuagcagaaaauuauauuuuaauuaauuaaccuauuuauugagacaggguuucucugucucugugcaacaauccuggcuguccuggagcucacuuuguagaucagacuggccucgaacucagauaugacugcuucugccuccugagugcuguuaaaauuucauuuauuauuaacacauguggaagucagagggcaacuuuugggguuggucaguccuucccccguugguucugggcauuaaacucugcuuucauguugagcacuuccacacucucagccaucuugcuggccugaaccagcagaaauauuaauuuuugguaaucuuuuucaguuguugaacuaucagaaaugucacauuuaucacuauguguguagcaaucuuuugcaaccuugauugcagaagaguuaaauuauauccuuuguccuuauaccuguuuuauauguaauuugcuucucuucugggugucuagaguguuaguaauuuaagaaaugugaaaacagugccacaaaucacuguagucuauucugugguucagaugagggaucggugcaguagcacucaguaacuaagcaguuccuguugguuuuguccuagaagucacggauaagaaaagugacuuucuggauuccuuugucuaguaguuucugagucuuuggggaagggugcguuucaguguaauccccuaagcggacagcuccauggcccucaccaugccuugucuuggaucuggggcgggcgggcugucccuuuuuguaguguggcagcuucuuucuuccacucaggaaguggggcuccucaguccauccuacccuuaacucugcagguuuccagaaucuuaaugaagccugagaguuaaugcuuugccacaaaguuauuaaugguuguauguuuagugggggauguuuauuuuauaacugcuuugguggggggggaguguugaucccccaaaauacuuuaaaauauuuaauuuuuaaaaauguuuuaaacuaugcugcaaaaagauagcuugacauuucuggugaguguguucucacgauugcuucucacuuuauuuuagccacggaucugcuucuugccuggaaccccauuuguuugggauuaguggaagguguaauugggaaaauucaacuucauucagguauguuuuuauaaacuccuuacacuuacaaaauguaaaaugcuauucugugauguccuuuuccagguugcauggaaguucugguaugauauugguuacuuugucauaauuuugggucuucucaaagcauauguauuuuuacuuaaguuuagugaaaugaaaauaaagcuuuugagaagaggugacacaguguuacaauuguuuugcuauuuuguuaaagaaaaauucucacaaagucccuacuuugacaaagccaggaauuguacuacucagccuaacaauugugaucccaaacugaaccuuucuugccugcccagagcuuaguucagagggaaagacagagugcaugaccacggugguccacacauggucccuggguguggaaguggguucuguuaagggacgguacagcaaguuccuggacaggaaggaaguaagaagaacagagcuggaaaggugggcaggggcagcugugacugccuggcuuuggggucagcugccugauccugagucagucacuucugccagggaagagaggagucuuuugguguguaguguggcauuuucuugggucucugccacggcaggcaaauggauggaaagcuuaagucauucacuggauccucaccugggagagcagaugccucuucuccugggugugaguauguaugcuacauauagauggguacccgagguaggcagccagaagaaagucuuguuucccuguagcuggaguuaaggcagcugugacccagcccauguggcugcugggaacuccaagagcaggaaguacccuuaacuucgaagccaucauuucagcuccuucauuuguuucucagucuaacccaggcuggccaagagcuuaagauaagagucuaggucacccuugaauuuugugucuguugaaugcuggguuuacaggcaugggccauucauuacaccuggcuccucuagugauaauuuuaguaugauuaugaauuauaagaggcuuugguauuguugcuguguugccuaugaagucaguuacaucucuguagugugcccguugugacugucguuuguucuuuuuauucuuuaaugauuauugugugagcagugugugugugugggguugguuuucucuuucuacuguggguucaguggguggaacucugguuuucaggcuuguguuuacccacugagcuaucucacuugcuggcccuguucuuuucuuugugugacagagucucauuuuguagcccagguuuauuuugaacuguuucuccugacacagccuuccaagugcugggaucauagguaugaggagcuaacacagcuguucuuaaguuuaaaguaagauucuugagcauuuaggcacuggguugauuuuugugaauuacaaaaauauauuacuagagacaauguaguuuucuuuuacuagauucugaagugggaauuuuggaauuuuggauucuuuacaaaacacagagcuguuaucaguauguuucuguuuuaaucccaggugugggauguggggcugcuucauaguguccccagcagcugacugugauuugccucaugcucugguuggggugugauuuugccagcugcagcuaguuucugcaauuguaugguguuuggaauucuggggccuuuucagaggguauauaaaucuagggccccaugagguagauuguugguugguugauuuugguuguuuagggagguugguuguaguuuguuaguaguccuguucaaagaaacaagaagaaagagauuauauucagagaucucucucuguccucucuaucuuuccuuccccacugucuagugauaguggguaaaacgacgugggugguggauaaagggugggaaaaagaugaacccacaaagaccagcuacaggauucuuuggccauauuuuaaguuaauuuccuauuaugaaauauuuuuauaaauaccuuaggacuguuuaugacagguaaauaguauaggguguuauaaagugugcguauuuauuucuuauccagauuaagaagugaggcaugacugugacuucagagcugucacugccauuuuuuccaaguauguccuuccuuugaaggaaaucaguucuuuaguuuuguuacuccauugagaauuauuguuuuucucagauauauauuccuaaguaguaugugcgaauuuauauuuuagagauuuuuaugaaaaucccauuaaauuauuuguucugucugucucugucuggaauguaugugugugucuguguggguguccgugcaugcauaugcagacugugugagggucagagaucaguguguguaucucccuaggcccuucacuuuuuuuuuuuuuuuuuuuuuuuuuugagauagggcuuggggucucacugagucuagagcugauagagucaccugggcugacuagccagugggcucccacaucuugucuauguccucccagaacugggguuacagaucauuuuccuuagcuuuugcaugaauucagacacagcccguguucuguggugauaauguuuaugugaggaucgcucuuacacucuuuugaucuuuuuuuuaagagcauaaauugcuuuggccauuacuauuuaccagcuaaccucuuauuuuuaaauauuuucuuuuuuuuuuuuucucacuugagacagggucuuaccauguaucccugaguggccugggauuuucuauguagaccagacuggucuagaauucacagagcuaugccugccccuauauccugaaugaugagauuaaaggcauguuccacucuacuuggcuuuuucucuucuuucuauuauuuauuuuauuuauuaguuauuauuguuuugagauagggucuaacuguguagcccuggcuggucuggaauucacuguauagaccaagcuaaacuggccuagaauuuacagagauccaccugccuuugccucugaagugcugggauuaaagguguugcacuaccacaccuggcaguuuuauuuauuaucuauuuuuuaagaugaggccucaaacuugccgaccugggauauuugagaccaucauaacaaaagaugaccuugaacucgugcucuuccugccuccaccuccugaguucuggguuuaugugugugccaccaugccucuuuccuucccuucguuuuauuguuaacauuucuagauuauccuguguugauauauggagcuagcguuccuugcucuuccuuuauuugagcauuucaugagcugccugucuucccucacugggaaguucuuccaggaucuuuauuucuucuucuuucucccuguuauaaauaacauugcuugaguucuguugugugcucugucuuuggugggcuuuaaaaaucucuucagcauaggcaggcagugguggcguauccuuuuaaucccagcauuaggaagacagaggcaggcugaucguugaauuugaggccagcuaggucuacagagugaguuccaggacagacagagcuacacagagaaacccugucuuaaaaaauguuuuuuuuuuucagcacagaggagaaaagcauucagccauuguguaaccaugcuaaguauuuuaauaacacucuccuaccuguccacauuuacauauauaucucuuuaauucauuuacauacugacaagauaauuucacagcuggauguucugagcuaaaauucguuuucuauuauguaaaugacguguaugaaacuucugauuauuuuucucuaauuucagucacaucucagagcagugaauaaaucacugacaucagucaggagacuaagagcaagcucuguuuguuaauauuuauuauuauuauuuguuaucgaacucuaccaucugcuucacugucugcuguguaaucagcccuccuaaaggcugagugguuuaagacagcagcagugugcagucccccggaucugugggcuuggccuagguugucacauuggacuucaugucuacaucucuccauggcucucuucuuacagggccucuuuccugggauccucauucuauucuggugcccuguucuuucuccuaaauaguggcgacaucuuuucagggaguggcugggagccaagaaaacaacaaauaaggucaagggccuuauuucuuaagcaauaaagcaagaaccagaguaauuggccucauuaugugcggaaugagacaguaccugagggcucuuagucaauuacaaggcgucuuagcaaggcucucuuauacaaaucuaucagcuuaacuuacaggggaaaaccaauugacuggugcaaacguacuuuuuguaagaacccaggaaacugacuauggauaugggauaggaugugaggucugucacugccaguucucuuugcacaucuccuucaucuguuucucaauucuuuuuuuuucuuuuuugagauggagguuucauguagcccaugccggccuuagacuuccacauagucaagggugaccuugaccugcucuuccugcuuuccucgggaaugauggaugagauuacagguaugcaccaccauaccaaguucagguggagcugaggccugaacccagagcuuuaugcacgugaggcaaggacucacuaccagccaagcucuauucuagcccuaguuuacauggacaaaaagaauucugcucuaaagaugguguucuccuccuccaagccuaauuugagguucccuguaaucaggggagacggacuagcaaucagaucugcuagggagggagcguggcucacacaguagagaagguuauugguccuugguccuccaaggaccuuccaggucaccugguucacagggccacuuaccuugaugaggggagcagucagagcagcacggaguaaccuuggagagagcccugaguuggcuaaauugaacuuagugccugccgaccuucucuccugugccgauggaugcaggucugugguuagccuuguguaggcaguucccaccauagaaauggaaguaguggaagagggagucaggaggagaguaaacuggggaaagaaaguauaaaaauggaaacggagaguaaaacaagucucucaauuauuguacgccagucuuauccauaucuugucccggucauggccacuuaacagauuugguuuuaaaagaaggaagccauaggagaagcagauggagaucugggcccucuguugugcuuucucugcucucccauguucccacaguccugucuucccugugcugcuccacccugcuccucacugagggaaggagaucugcccuucucuucccuuucauccucuuccuccacgcugccucaucccuccucugucuugcucagagucggacuggccggaaggagcugcgcuccuuaugugucagaauugagcugguauuuuggggacauuuucucauggggauaucuuaucauucgggggugaugagaggagaugagggaacuaagacaucuguauguaagcuccccuuuucucuuuccuccuacugacucuacauauuaaugcgugcacuccuguucuugccuagugugacgggaacaugauuuuauuugaacagaugucauugucagucuaaaaguggcgugggugagcugugcugcugcucaugguugucacugaacucuggacuccaaggaauauagcagcagcuuucgugacuucuagaacgauacagguucgcuagguugugggaggcauuaaacaacagaauuucaucuuccuauaaugcuggagacuaaagagcuagcaggacugguuucuuccaggaccucuguccuuggcuuauagauggcuguggucccugucuucacgugggcuucccuuccuuuguaccuuugucuuuaagguuuuuguuuuuuuuaaauaauauuacuuguugggcuagagguggcucagcaguugagagcacauacucaggccgugcagaggaccugaguuagauuuccagaacucaugucaggugacucaacagccaccagcuccaggggauccaaugcuucuggacuuuuugggcauugguauccaccuguagauauacauacuugcauaaauuauacauaaccaaaaauaauuaauucuuuaaaaaacaauaaauaaagccagcuauacuagauuaaaguccauccuagagaauucauuuuaaugugauuccucuuuagagauugucuccaaauaugguuacauucuaaggugaagacuucaacagaagagauggcucagcccucggcaggaaccuaauguucguagaagcacuuacuguaaagcauugcagggaauccucuccagucccaauuaccucuguugcauggugacguuuuucaaauguguuugacuaagcagugaggagguagacuagaccugaaagaucacaugaugaccuugaguccaggcucugcaugaaccucaaguaccagauggccaugccuccaaaacagucggacaggcugaguucuugaucuaguaaucaccaagaaugacugaucucacuuucuucuuucuuuuuuccuuccucugucuuuucuuucaguuguuuguuuucguucuuacuauguuuuuccacugaccuggaacugucauucaagacgguguugagcuuguaauccugcucccuccucuugcaugcugggauuguguagacacugcugcugugcuucuuugcuuggcuuucuuuuguuuuuccuuuaaagaaccgaagaggcagccuacuacagaaccaccuaacuucuauguacauaggguuuuuugggggggguguaaagguauaauuguaauguuuugcucaaauuaauauuuacugauacugaggugaaauuaauaagucaccagaaacuauuaugagacuacaaagaaaaauuuuaguaguaaaauaugaaaaaaauuuaaaguauguucaauugugcuuuuauuccuguggggaaggacuaagucucauuauauauuccugggugaccuggaacucacuauauacuuuauguaugagcucagacuggcuuuguacucacagaggugcaccuaccuacugccucuugaacacugagauuaaagguguaugccaccaaacucagcuauucucucacucacucuguaagguccucuaaaaguuguucuauuagccuuggaggccagaagauauuuauguaagcuguuugcuuguuuaucauuuggaugcucuuccucugauauuuacaggcaaguguaucuucuagguuuaguguacuguaucugacaguuugacagucuggcuuugaguugagcaguugagauuuacugauaggaaagaacagaaacuauauagaaaguauguguguauuugcuugccaaauugaagaaaugcaaagcaccaugaaaacuaucuuuacuggggauggagagauagcuuagccauugagggugcugacugcccuugcagaggaccugaguucccagccucacaucaggcagcucaccacugccuauaacuccagcucuaggggaucagauguccuccuuuggccucccaggccacugucacacacaagguauauacucacucacacaggcaggcugacagacagacagacacaucaguaaaaacuuaaaaacaaaucuuaaaaacaaaauaacuuuuguucauuguaauauucagaaggaaguaaaaacuauagugagauucuuacuguaauuauguugauugauucauuuuuuaauuuauuagcuuguuuauuuaucugccaucuaucuuucuuuauguaugauaagcuccagaaaaauaggggcuagagugcuguggaguacugugguuucacugggugugucucuguguccuggcccauaguaugggcuauucuuaaauuuucaguaggugcuuauugauuuaauagauauuuaagguguucauacugugugcuaaggacuauaguuggacuggaggcuguagaauggacaaaacuugaaaugccuagguucauaaacuucaacuaauaauauauuaaucaccuagucaaacuguuuuguccuaagagacuuaagcuuccaggguuugggugcugugugccucacuggaucaaguugggucccgggauggagggcaucuuugaggaagugauguaugacuuaaggucagaaaaaugaguauauaagacauaggcuaguggggaaggcaguggagggguaagaggcaaggguagaggggccauggcagaguaaguaacugcaaaacacauucgauggacauuuuuauccuuuauuuucuguauacuaucuggaguacaguuauaucuuuaugcaagcaucuaugaaaagauugcuuuaggcuggaaauuuaaaaugggucacaaaagcucuucaaguuaaaauacauuuugaaguccaagaagauaagcucaauuaagguaagaacuaacuaaauauaaaaaguacagagauucauuagcaaagauacauauugcaugaaauaucagaaauaguugaaaagugucuugguuaauuugacaaaucucuuuguuuaguaauugaaugaauuacuccucauaguacugaacaaucacagacagaaucacuuacauagaucucauucauuaaaauaguacucaccaucuguguuuuccuaguuuggaaaugguaaauauaucucaaucauuaagauggcaaaauauauugugcauaugguuuuuaaacugacuauagucuuuauauagagggcuuccuugcuauaggacuaaugacaagaaguauuucauaugcuuuaauauugaguaaauugagugucacuagcauuguuucagcacuugccuauaaagccauugaaaaacucuauccucaagggcauuagagacaagagccugugcagagcucucagcucuguggagaccugguuccuaggacaacacuuuagauaauauguaccuuagccaguguucuguugcugugaagaggcaccauaaccauagcaacucuuauaaaauaaagcauuuaguuggagcuugcuuauaauuucagagguuuaguccauuuucaucaugggggagcaagguggcaggugggcaggcauggugcuggagaaguaacugagaguucuacaucuggaugcucaggcagcaggcagggagggaaacugggaguggcuuuggcuuuugaaaccucaaagcccaccucaguugacacauaugcaccaauaaggccacacuucuaauccuucuuaacuaaugccccucccugaagaccaagcauucaaauauaugagccugggggugggucauucuuauuuaaaccaccguaguaauccaauugcaacaugaguuucaugucuauguacauuguaccaagugggaauaaauuuuuauuaucuucugacaagucacauuauucaaaauauguaggaaaacugguugaggugguccaugucugugauuucagcccuggggaggaagggaggaagaucagaaauccagggucuucuacagagcagguucaaggcuggucuggacugcauaagacacugucuuaaaaacaaaccaagaauuuggauugugauugugaugaaacuuuuacaacuauggauugacuaagaucauugaguugccuauuuacaaguggcuuguuuuuuguuuauuucuugagacuaggucucauuauguucuugguuggccugaaacucaauauauagaugaggcuggccucaaacucacagugauccacuaucuucugccucccgagugcuauauuuuuagcuuuuaaaauuuuauuuuaauuuuuaaauuuaaaauucuuauacuuuugcuuuuauuuuuauuuuuuacauuuaauuaauugacuaauuuagggcauauguuuuguaugcuugugugugugugugugugugugugugugugugagagagagagagagaaagagagagagagagagagagagagagcgagagugagagugagcgagcaacgugcacaugccuaagugaguggguuccuagacucauguggucaggcuugguggcagauaccuuaaucuguugagucauuuggcaccauuuccuaaaugggcaaauuuuaugguauauaauuuuuauuucaacaaagggccucagacucauuaaagcugaguauuauggcaaaucccuauaauuucagcaggaggaucaugaguucaagacuagccugugcuacauaaugagcaauuucaagccaguggaggcuacacagagaccuugacucaaaacagagcaaucccuuccccuguuguguggacauuugaauuguguggcugucaggacaccugugggggcuaccaugugggucauaggguaugaacucaaaucaugagguuugguggcaaguaccuuuacucuuugaaccaucuccccagcuccugauucacuuuaacugaaagauacgggcugcagguggugauacacaucuuuccuuuuagcacccaggaggcauagguagguagaucucugaauuagaggccagcuuggucugccuacugaguuucaagacagaguuucuacauugugagacccugucucaaaagcaaacaaacaguaacaaugguaaaaacccagugaugaugugacacauugguuaagaguacuuaguccucuugcagagaaccugggcgcaguuuccaguacccacauggcagcagacaaccauucguaacucuaguuccaggggaucugauaccuucugccaaacgccucuggcacugcacccacuuggugcauagauacacgugcagucauaauacucauacacauuaaaaaacgaaaacucauuaaaaauagaaacaaaaaauggggcugagaugacucacacacccacacuaaauaauaaauacacacaugccuaugugcauacauaaauauauaaauaacuauaagcaaacaaaaccaaccagaacuaggacuagaaacagcccaguggagaacaugugcuuagucggcacacacugcccuaggcuccacaguggcacaguaaacaaaaacaaaaauucaaacaauucuauuuugauauuuauaggucauuacuccuuagacucaaauuucucuagaauauuuuccuuaaagcaguagaauuauauacaguauaaugucuacaaauauaaaugauguaaaauguucuucaaauaaaacuucuuaauucauuuuauuuuucacagguaucucagaauuauuuauuuucauccacauguaagauuuuuaccaguaaguagguuccugguuaauuuuaaaagaauuuugggccaguuuugaaaggacucagcaaguaaaggcagcugcuuccaagccugaugaccggaguuccagcucugaacccacuuuggggaacaaccaacucuugcuggcugucgucuuaaugcacucuaaguaaaaugugaaaucuggguuuggcugggcuuaguuucccacgugcuauuaguagcucuguucuagaagccagaaacuaguugcuagucuaguuacagucugucagccuguuguuuguuuguuuguuuguuucuuuucuccugucccuccuauuccccaggugccuaggcagggugcugaaugucucauccuuuucuuggcuccucucagcuugugugauucuaugugccagaguuucuuggcucccuuaagacugaugugaacucuggucucuuggaugcagaugacuccuccucugccauagagcaaugcugaaugugacacauggcccugagcccccagagguuguuuacugugcagguagccuaucucuccuuugauagcagaccaggcagcuugccuccugcacacuguacuuaccauuccuuuuccuugagcuccaguuguuuucuucagugcauucucugggcacugagaguaaguuuauggguugacaagauggcuccaaggguaaaggaggcuucccccaaccccgaugaucugaguuugaucccugggcacauacacacuaaguacgauguaaguaaagugugaaaagugacaacucuaguaaucaaguuccacgucccagaucuacugagguggaggaccugccccaguucuucuccuacucaggaaggaccaugagccuuggaugcugaguguccauguccuccuggcuuuacauaaaagccaccuggcuggugaaagccagucagccauaguccuccuuuuagaaaccgaagagaaggaucucgugaugucagaaccaucuuuggagucauucuugccuugcuuugaagaauugugugcauuuucaccaaaugucugcuugcucuauggaaucucuaaaguugguauucccccccccccccccccccaaggcugcugguuuuccugccagcauagccgggucuacucaccuauaccaauuucuuugccacacagaugcugggccgcaguguuuuuuuccagagugcgccuuucuuacaguuugcagccuggauggguugagaaauagucaauucucuuaaaaguucugcuucugcuuuuuuuuuucuuuaacuuuuuugcuaacaauugugccuuugagucauauuugucuucuugaauuuuaccauaaucagucaagaagagucauuuagcaaugacauuuuacuuagaaauagcuucaucuaaauaucuagcuccauuauucuucaguucuaccuucuccgaacaguagacuaugaacacgccucgaagacuuccgucugacaaagccgguccucucgccguuguccagugacauguguccaucucggacuuccuagaacugcccuggagucuucugagcagacugagucuuucucuucggguguuuaguuucugggcugucucuugaauuaccuuuaaggguucacucaugacaguguugguuuuucccaguguguaccuccagacuuccagccccucuauuacccaguccaaucccaaaacucucuccacaguuuuagggauuuauauuacagcagccucugcuuuguugucaagcaccuguaugagccagggcucucuagagaagcaaaacagagguagggaagugaagagagaggaaagauucauguucacuggagauccagaccuaccaucugcaagccugagaaccagcaaagccucugaggugguuccagugcaggcccaaguacagaggccuggaggaacuaguacuacccggccugcuccagacccaaucucucaggccccgggucagccagaggacacacuaacccuucauuuuuuccuuuguucacuccagcucucagcagauuauauggugcucaccaacacuggucuaccauuuuaaaugcuaaucucuucuugagauagcauguacccagaaauguacugguuaucaggauauuacuuauuucaguugaauugacauaucaaauuaaucgccaaaggaucacauagccagguguaguggugcacggaggcagaggcaagugaaucucuguaaguuugaggccaaccuggucuacauagagaguuccagaacagccagggcuauguagagagguccuaucucaaacaaacaaacaaacaaacaaacaaacaacaacaaaaacaaaaauaacaucaaacaaagcuaaaauaaaaaacugggugccauuguuaguagugauggagugcugccugacacaacuccccucuuuuguccauaacagccuuaggggcucuuuuucagagaguuaguucuacucauggaacuccucccccaccucucugugcccuaugaaugccugugaacauguguguuuaugugccuaugugggugggagauggauguuagaugucuuccuagauugcuguccacuuuuuuuuuagcauuuuuuauuagauauuuucuuuauauacauuucaaaugcuauccugaaaguucccuauacccuccaccgcccugcuccccuacccacccacucccacuucuuggcccuaguguuccccuguacugaggcauauaaaguuugcaagaccaaggggccucucuucccaaugauggcugacuaggccaucuuuugauacauaugcagcuagagacaagagcuccgggguacugguuaguuuauuuuguuguuccaccuauaggguugcagaccccuucagcuccuugggugcuuccucuagcuucuccauugggggcccuguguuccaucuuauagaugacugugagcauccacuucuguauuugcaaggcacuggcauagccucauacgaaacagcuauaacagggucccuucagcaaaaucuugcuggcauugugcaauagugucuggguuugguggcugauuauaggauggaucccugggugggguagucucuugauaguccauccuuucgucuuagcuccaaacuuugucucuguaacuccuuucauggguauuuuguucccuauucuaaggaggaaugaaauauccacccauuggucuucccucuucuugauuuucuuguguuuugcaaauuguaucuuggguguucuauguuucugggcuaacauccacuuagcagugagugcauaucaugugaguucuuuugugauuggguuaucucacuaaggaugauauccuccagauacauccauuuuuccaagaauuucauaaauucauuguuuuuaauagcugaguaguacuccauuguguaaauguaacacauuuucuguaaccauucuucuguugagggauaucuggguucuuuccagcuucuggcuauuauaaauaaggcugcuaugaacauaguggaacauguguucuuauuaccaguuggaacuucuucuggauauaugcccaggagagguuuugcuggaucuucugguaguauuauguccaauuuucugaggaaccuccagacugacuucaagaguacaagcuugcaaucccaccagcaauggaggaguguuccuuuuucuccacauccucgccagcaucugcugucaccuuaauuuuugaucuuagccauucugacuagugugagguggaaucucaagguuguuuugauuuacauuucccuggcuguccacuuucuuuacugaaguaaggucucuugcugaaccuagauagucuagcuaaccauuuuguccuaggucuaugccucccaaaccuugggauuacagaagagccguuauaccagcccagucuuuaaaaguuaauugugaguuacgguguauggaacaggcuuggaacauguaccuugaccggagccauaucucugacccucugcccagcuuuuauuugugggccucaugcuugccaucucccuaacuucuuuacuuuguagcagaagccaguaugaugcagaguuagaguuuguuaagaggagauuuaaauagcuuuaaacacaggguuaauaggaaauagaggugcuaaagagaauacaugauccaggccuguuuggugugggcuucuuaagagagagucaggauugagugucugagauagucacauugcuuucauggcuucugaagucacauuuugggaggcuugcuaagggcuauuuucuuuucaauauaaugcacuucagauggggucacagcugauaagguaaauccuaggucauggggcugcagagaaguuaggaugucuuuacuauaaacaaagguucagauucguuugugaaguucccagaaaaaugucuaggaaaggagaaaggccacacuugagagucauauaggcuuaggccuuuaggcaugguucauugcugauuuaacauuuucuuuuuguauuacuguuaucacucuguucguacacauacaccaaaacacuaagaaggaaaaaaauacauaaaagcaauuagaucucugucagaagccuucauaccaagcguggguaacugugcugaaauucuugcuucucagcuggcuaggagcuuuggcuagauuucuuuccccuaucccacccuuucuuuggaaaagaaagagagucuuaaguagucaaauacuaagauacgugucaguaguaugucuuugaaugaaaagaaaugguaggguucuucagggacuguagagguauagcucauggauagagagccucgugugugcaaggccauggguucaaucccuagcaauagagcaaaaaagaaaguucuccagucaaaagagaaaugguugcuccuggaaguguggggauagaggaaggaaugaacgucugugggaaaggaauuugcuaaauguaaaugaauuuggcuucauauggaauuuaaauuuaauguagaaggaacacacaacaauaacagcaacauuacaggauuuaacaagaagaaagagggagaagaggagaugaugaugaagguacaacacaaaaagcauuuuaaaagguuucuauuccaggauuauucuuucauccucuaggaacugguaaagacucuaacuuacuuuuagguuuaacagguuaagguucauuuccuacuguauaaggcaaacaauaauaaaagauuguaaaagcuaucagaguaggaaaauggguuaaucauaguuaaagacucaaugcaagagaaacuaagaaaguaaaaggcguacuuggagugacugacaggaguaagaggugaugggauucuagacacacugauguggcauuucauaacaaaccagagacuuuguaacacuggaaaaccaaaauccauuuacaugcugcuugcaagauaaauaccauacauagucuguacauaaaggcagaaaguaaagaguugugacaaagaaacugccaccuuuaaucccagcacucaggaggcagagguagagguaagcagaucucuggaauucuaggcagccuggucugcacucagggggcacaagugacaaacaaaguaaacaaagcacaaucaacucggccaggccacucuuucuggaaaagucugugcaccaagugccacguaguccagcaagcacacuuggccaagaugaauucugucuuuugugucugacauaguuagguggucuuugucucaucccauuggagggaguaugacuucacaguuugucuugauuuucugauccacacaaaguggaagaggaaggguuaggaaauaugaguccucgccaacuaacuaccugucauugaaaaaaaaauguuucuuacaauauugaguuccaggccagccggggcuucacagugaagacccugucucaaagaagggaaaaaagugcacagauuagccuaguaaaaccugauagagcugucuuacuaucagaguagguuuaaggcaagaggcauaggaagaggacaucucaaaacucacagggugaucacaucagcagaaggguaauuaaaagccacaguuggguugggcugucgcucgugcacaaggccccagguuagaucuucagcacuggaaaaaaguggugcaucugagcagcagccuccgaggauaguaagagcaauuuagucaucuggcucacauuucuucccugagaugucaguuugaaaugacagagaaacaugcaaauguuccucuucuuaacuucacagagaacaaaggaaaggugaauagauuuuuaaucuuuuuuuuccccuuuaccaguauauuuucauucuuugaaaucacugguaaaaugcagagaucuuucuguagguaugugagguauaaacugcagaagcccuucaggaauuugagacuuugacugcugggguggcucucaucucuaguccuagcauuugagagguggaggcaggaggagcaggaguucaaggccauucugaguugauggugaauuccaggccugugugggauuuugaaucuuuguacuuaaaucuuaugcuauauaagaauagcugauuuccacccaucuuuggauuccugugaugcaaauguaacuucucuguguggcugguugucugguccucaugaccacaccacugugugagugcuguauuucucggagggguaacuggcucaggagucuagccugcagagcuaggacauaaaguaagcaagccugugagacacagcaaaaacuccuggucggcaucucacccugguuauuacaggguugcuuauguagagagagaaagcaggaagcgucuaaacaagcagcugaguggggccuacgaaauaaguaaucgcuguacuguuucuuaagcccucaagcaacauuugaaggacuaacaccaggaaaugguaaucauuuucucugucucugcgguucucacaugagacacuaacaaaguagaggcuggagucaagggaaaacuuuccauagaguaagggaugaugguggcaaucaggagaacguuaauuuuaucuauaauguuuacaucuuuagaaaaaaaaaggauauauuggggcuggaggcacagcguaguaguuaagagcgcugcucuuucagaagaccuagguuuacucccagagcccacaugguggcucauaaucagcugcaacuccaguucccgagcguccguuuucuuuucuguguccuaaaugugauuauguuuucaacuugccauagagugguuugccccuuacauuucguguugaguucccucggauucugguugacuggagcauuucuguucuaagaacuggaacuagacucaggccauuuuuuaaaaauguucuccgagugguggcgcaggccuuuaaucccagcacucgggaggcagaggcagguggauuucugaguuugaggccagccuggucuacagagugaguuccaggacagcuccggucaacccugcuugcucuggucaacuccacuugcucagucccugcccgcuauggcccaaagauuuauuuauuauuauacauaaguacacuguagcugucuuaagauacaccagaagagggcgucagaucucauuacggaugguugugagccaccaugugguugcugggauuugaacucaggaccuucggaagaacagucagugcucuuacccgcugagccaucucaccagcucuacuccuuccuucuuaugaagguguguuagguucaguaucucuuuuugucucuggagggguaugcuguauccccaguggaugcuugaaauagcacauaguacuauaucucaugugcauaggcauguguuguuaacugugugagaaaucuggaauuugauuucuuuaaaaagaauauuauaagaagaguuucauguuaaucccagauaugggauggggcugcuuuggccuccguagcagcugacuaugguuugccucucacucuagcagagaugugguuuugccggcugcagcugguuguguaacauuuggaauucuggaaacguuucagagguuauaugaacguuggagcccuaauaggcaggauugguggugguuggauguuugguggugggaguguuuaagguuuguuagaagucaugcucagagaagaaacaaaaggaaagaaauuagacucaaagaucgcugucucucucuucaccucugucuuucuuuaucuccuaguuaugggugggagagauaaaggguaggaaaagaagaacccaccaaguagcaaagaccagcuaccgugaacaguaacauuuuggucaacaguaagaugccacagggguccaguaagagcauguaugaccuacuggcaugauagcugucuuagucuggaaauacaucucaaauguucucacaugaaaucacuuuaacagaacacuucucagaacauauaccccaucauaaacaguuuauggcuguacuguauuuuuuuucugauuguaauaccuugauaagucugaauuuucaaauugggcuuaauaagagauugacaguagugagaugaagucagauaaauggcaacaacacuguaacagcauuaggguacuguguguggcuacuugaacugugcggauacugugcuagcccgucucgucugauaguccagcugaguacuacaggaccaaugggcagguaacauauauagcauuaaacaaaggggggggggguugauggugcacagugugaugucacgugacgucauuauacuaguaagaguggucacgugacgucauuauaauaguaagaauggucaugugaugucauuaugcuaguaagaguggucaugugacuucauuauacuaguaagaauggucaugugacgucauuauacuaguaagaauggcaugcuauuuauuuauuuauuuauuuauuuauuuauuuauuuauuuuugaagugcuggggauggagccugggacuuuucacuugcuggccaauuguuugccacugagcuauauuccaacucuuuuucuauuuuuuauuuuaaauuuuauuuaucauuuuauuuaugugugauguguuugauuuguguguguguauauacuuacacacacauaggauguguggaaguuagaggccaacauuccuuuuuccaccauggagucuuggaaucaaacucagauugucagacuuuuuguuuguuuguuuguuuguuugaggcaggguuucucuguguagcccuggcuguccuggaacucacucuguagaccaggcuggccucuguuucccgagugcugggauuaaaggcgugcgccaccaccgcccugcuagauugucagacuuuuguggcaagugcuuuuauccacugagccaccucacugguccuuacuuaauuuuaaaaaagauuuauauuauuuuuauuuuauaugugucucuugccugcauguaucucuguucauuguguacuagacaugccaagaccaaguucucagcacagaggagguuuauuugccccaaaaggacaaagggcagggaauaagagacaaagacaggagguacgggaugagggagaaggggaugggaacaagggagagggggaaagauauuaucugaagaacaaaggacugccucuggauagagaagagacagccaauguggcccauaggcaaaauggcaguuuauaaagggaaaauggggaacccuguguuaggaugaguggguuaauuuugauuggguauauuaauuaaguaccacaaaggggacuuuugauuccuggacuucaguacuuugaccuugguaguguccagugucugggggaggaaguggccaaauaagggauuagaccuuggugggucgcuuuaggaauguaacuuuagaguuuagcaaaacagagggaaugggggagaagguaaaagaaaauacuguuugccaugcucuggccugcuagagcccuucaguggcaugaggccagaagugggcuuagaucacuugaaacuggaguuguagauggucauuagcugccaugcaaauguuauuaguaauugggucucuacaagagcagugaguguucuuaacugcugagccaucucuccaguccccuggugccuuccuuugcugagauguccagguuggucuugaccucccaguccuccugccuuagcuuccugagccacuggaauuacagaccacccccaugcccaccuugauggccuaugauugaaaaccuucuaauuguuuaguucugacaguucccauuugguacuuuuagaccagaguugaccacaggagacuaaaacuacagaaaguaaagcuaccuugguaccaaaaauaaaauacaucuuaaauuaucauaaugcaguauguguugcuuaauaacugggauguuucacaagcagguuauaaagugacuucaucauuguaggacuauuauuaagagaccagccucuugauauaaaucaagucacuugacaaagccuccuaauuccggccagaguugugauaaauccgacauaaagaugugauguaugaggugccgccgccaggguaaucuugaugugauguuuuauagcaaacuuaguaacuuuuguuucauuuuguuuagauuauuuuguuuuauguguguguuuuugccugccucucucucucucucugugugugugugugugugugugugugagugugugaguacacacaagagccagauguauuccuagugccuguggaagucagaagggaucucagauccccagcaacuagaguuauagacaagcugcaaugugggugcugggaacugagcccaaaucuucugcaagagaagcagguguaugaauaaauuugaagugaugguggguaggguaggacugaugacgcagcucaguggaugggcagagcacuggacucagugcuauccucccaaaucaaugcuucucaaccuucuuaaugcugugccucuuuaauacaguuagcuccucguguuguggucacccccaaccguaauauuauuuucauugcuacuuuaaaauuguaauuuugcuacuguuaugaguuguaauguaaauauuuuuggagauagagguaaggggucucaacccauauguugagaaucauugccucaaagcaaauaccccaugauaaaucaguggcaaaugcauaacacauuguguauauucaauuaaguuuuucauucugaauauaauuguauauuauacuuuuauacuguugacaacauaguaaguuuguuuauaccagaauuccuuaucacugcaaacaugguuagaucagaucagaaugcguggcacacugagcugugccauucugucacuaggcggugggaaucccccagcuccauuaugauguuauagaaacaugucacuggaugcaucgcacaguguagcacagcuguguuauguacaugaguagcacaccuacgcuuuucacuuauuacaugcacaaaucaucauaaacuacuuuuacuuuuuauaggccucauaaguuguuuuuccaguuguguccauugguauucugucagcacugcuguuugagaguucauguuuucucauagucuagccacaaguguuugcuccauaauuuacauugcucugagugagacuggacaucuuguguuuagggacuuuuagugucuuuauugugcauuuuacauuuuguuacuguuggucccuucaccccaggccagcaccacucuaugaacaccauucauuuauuagaauuuucucuuucagaucuuccaugguggcuuauuuuaauucggcagaaagcguugguaggcaaacucccaggagaccaugaggucuguaaagucaccaagauugcuguauugucacuuucugaaauggaaccucaggagcuugagcuggagguaaggugacaucaaggggacugucacaaaggcguuugauggcagacauguaauuugugucuucaaaccuugcagcagacccuucacgacccaugaauugcaguguauaagacagaagcugagcugcuuuaaggguagagggaaagaucaucuuuaaauaacaugaaaaugaggccucccucaugccauacacauauguguggaggaggggcgugcaugacugugcaagcagaugcucgugaaagugcuugcaugugcacauauggacgacaggucaacaucagauuccauucuuuaccacuuacuuuccuugcuuucguuugggggugggguauagaggguuugagacugggucucagugaguauccccaacuacccuggaguucccuacauagaccaggcuggccuugaacucacagaggugccucugccuucugagugcuuggauuaaaggcaugugcuaccauggccagcuuagcacuuauuuucuugggauaauuuuucacuaaaccuggugcucacaggucagauagacggcuguguggccagcauguucuagggauccgccuuuucuaucuucugguggcuucuaucuucugguggcaggcuuacaggcgcaugccuccauccauggcuucccgcacgggcgcugagggcagauucgucacugagccaccugcccagaauaacugaauaguuuuagaacgaucagguuguuugagcuauaguguuuauuaaggucaccaaagauuaugcuucauguuaggaauggaauauauguugugaccugggcaaauuaggggagaggguaacacuuuuguggcuguccuacaacaccaugaccaaggcaacugaaagaguuuauuuggacuuauggucccagaggacuaagacuccaucauggcagugaguggcaaacauuguuguuuugaacagacgcucagagcucuuuaaaccaccacauuaaccagagcguaacucuggaauggcauggauuugaaaccucaaagccugucccagccauauagcccaagccuccccaaaacaccaccaccagcugggaucaaguauucaaaugccagagcuuauugaggaucaaacgauccucacugaaaccacugcagaacuauaaagaaagcaucuccauccuugggugaaugucuuaggaauuauuuccacgcccccuucccuuuuacuuuuaauuuauaucacaguaagggaacuuugcaacagugaguagcaggagaggcaaggguaggugugcugauagucaucacauuucuucuaaucuucggauaguaauuuaugucauccucuccuuuccuucuguucauguaaacacaauuaaaaggagcuuucccccuuaacgccuauugucuuucaugggaguacacauaagcacuuguuaggugaagcuggugaggcuggcgugucucccacugcagcacgccccucugauuugaagcccguuuacuguucugugugauccaccacuguccuccuucuccacagagagcucccgcugcucaucaggucagccuccuccauuugcugcagcccgcuucucuucuguaauuggagcagaaauuauuuuauugcagauuuuaauauuagaauuuaaguuucuuucucagugguguugagagggguguggcuuauuggccugccaguuuacuugugguagcauuugucaguacuuuauuccuuauuauugucaaauaauauuucacuucaguugaugaacauuugaguugcuuccauuuuuauacuauuaugcauaaugcugugguaagcaguuuguaacaugcaagcuuuugguaaacauagguuuucauuucccugaaguauagaguuccuaggucauuuugguaauucugcuuaacuuuuuugagaauugccacacuguuuuccaauauagcauaucaauuaaaaaauauauauguuuauggcuaugguggaacucuggggcucaaaaaugagaagacaugcauuaugcauuuugagaaauacccuuaaaguguuaagggcuucuguuccccgccugcuuagcacaugugcuguaucucauugcuguaauagagagcagcaccguuuuccacuuucccaucagaaagcuguuuaaaauuuuaucucagaauggauauagauaacaaaauugaaaguaaaaccauuuguuuuccuuuucuucagcaacaucagcuuuuaaucuugguugugaaauauaacuuguaagaggaauaaaaaaaaacaaaacugccguuuaugguagugaauuuuuuuaaagaauaaucaaagcuauaauaagggccuacuguacacuuuagagaccuuagaguccacugggaagggaagaugauccaagugcccauauccaaggauaauguuuaacaaaguaguuuaugacuggaaggguccccaagaaaucauuuucuuaucauuauuuucugacagggcugacuuuuagcucaguaauuauauagaagauucuagaauauucauuagugugaccuuugcuuaagguaguucagugaguuuaugcuuuguuccauagaucuguaauuguuaucuaaauguuuuuuauccauauuuuuuuacaguucuguuuuuaguugguuuugugcacagacuugcauguaauaucaaagauguauuggggaaaaaaguguauuagccagacaugguggcacacaccuuuaaucccagcacuugagaggcaggggcagguggaucucugugaguucaaguccagcuuaaucuauagagcaaguaacagacaagccagggcuacacagggagugaauaagucugucugucuaucugucaccccuacccucagaauacacacacacacacacacacacacacacacacacgcucgcgcacagagcauauuaguuguuauucuauugcugugauaaaaauacuauaagcaaagcaaauuagaaaaggucugauaguggcucugguuucugagccauaggccaucgugucagggcacguauagcaacaggcagggaaaacaucucagcaggugcaaggaagcugacugaucccaauucauccccacccaggagagugaggagggaagagagagagagagagagagagagagagagagcagggauggggcaaggcuguaaaacugcaaggcccagcccaguggcauacuucagcuaguagucuccaccucuaagagcuuccaaaaccuucccaagcagugccaucaacuggggacuaaguucaaauacaugagcuaauggagggcauuucucuuucagaacauaucagaaaguuuauuccauauaguuaucuaugccccuaacugaggcuuaagucuuaucccacaagacauuaguauuuccugaagaaucagaugaguauuuauacuauauauuuuauauauuuauauuaaauacucauaaaucuuuguguuaaauaguaaaugaugagugucauguguucucagggcauagcuuauacaugcacuccuuuuaauugauaauuuuuauauguaugauuguuuggccugcuuguguucuguguuccauaugaauguaugguacucuuggagacuggaugaagguguuggauccucugggacuggaguauccaacagccacguaggugcuuggaauuaaaucuggguccuuaggaaaugcucuuaacggcugaauuaucucuccagucccuaugaaaugaauuuuucauaaauuucaaaaauaaauguucagcucucaguucuuuggauuuucugaucagaagcuaaaagauaguagacccaaguaaacuccccuccaagcugagauaaaagcaaaugaaggcaauaaaaacaaagacaguugucuuaguuacuguucuguugaccuguugaucaccaugagcaaggcagcuuauaaaauaaaacauuuaacugacucacuagcuaucauucuuuaacugucuguccccuguucuugccucaacacauccagauuucauuauuguguguaaagacaggaggagagcuuguugaaagguccagcuuuuaagauucccaguagagcagacucagggaauuuucucaaccaaagcacucagguaguuagcacaaacaaauauuuaauacggauguuuguaaugaccuugaggcauagcagauguguauuuugcaauauuuuauucuuggaugccaguuuucaaagcauuuauaaccucgaccagaacagaacauuguaucccuugaacauguuaaauaagaauaaacuugaaccuggguuuucugccuuuaacccuaaguaugucuugccuguauugugaauuauuuauaguguagcuuuuaauuauugaaaccauagcuauauccugccugcuuagucauuucacuaauucuuagggucuacuuuuaacccaaaugcccaagcaguaguguucacuucuguacucauacuugaacaucuaaaguagauaauaauuaauaaugaaucauccuuuuaaaaaauucuuuagcucuguaagaagcaucauuuuggaauuaacaagccugagaagauuauaccaucuccugacgacuccaaguuucuacugaagacauuuacaaauaucaaauccaacgugucugcucccaacaaaaagaaaguaagacuuugauugacgugggcuuugaauccaucaucgauuagccauaaguugaggguaaauaaauccaucuggaagcuuuuuuuuuuuucuuuuucuuuuuuguauaucagaagacaguccuguguuuggggauuguccuaacuugaaggcuugcuuuaccuauuaauuuaucguuugacuccugacuuacagauugacuucuuacagguuaaagaaaguaaagaaaaggagaaacuggagcggcguuugcuugaggaguugcugaagauguucauggacucagaguccuucuauuauagcuugaccuaugaccugaccaacucggugcagagacagagcacuggggagagggauggccguccccuguggcagaagguauacccacaaggcggagcggugauggcuccugaccagugccuguuugccuuuuguaggaaauuaaagugucccugagcugaucuuuuucucugccuuucuagguugaugaccgauuuuucuggaauaaguacaugauccaagcucucacugagauuggugugaguagacgcuucuaaaacacuguuguugccauuguuaugcagaggucgcuugauuugggugaauucugagauuuuguuaggagcuucuccugcagaggagacucauuuaacuaaggagaugaaggcggugccuucaggugguuuauagcccauggccagucuccucagcacucuguucaaugaaugugaugucauacaccuguaagagaugugucacaugucacaagcgucagguccucugggcucuguaaauauguucaacuccauccaccuucagaaaaaaacagaagugggggcaguaguaagcagaucucagugcuguacguagugaguaguaggacccagugaugcccauagagugccugaaaagggacuccauugggaaugcaggagccuagcuuucuguagugauaccauuuugguuucucugcugggguuuggccaguauuacagugguuacaaacugcagggugugguggugugauggcaugacugcauggaguucucucugguuuuguuuuuacauuguauuuauuagugugugcacgcacacgugcauguggugaggucagaggacaacauuuggaguugggucuccuccccauggccugcagggauugaagucagguugucagauuccucggcagcugcguuugcccucugagccaucuugccugccucguucuggaagggugguuacuuucugcuuuccacuucugucagaaguacuugaguacagugacuucuugucacugagauaauggugucugagaugggcggguugagcagagaagaguuuuauuauggcuggugauuucaacacaucaucguggguggggggggggggaagcguuuugccguggugggccaggcaguagggagacagagauacggauguucacuucccccuuuaugcugucugggccucagacgauggaugauaccaccuggguacgucuuuucuuuacaguuaguucuagaaacagacacaaagaugcacccagaggucugacucuuauucuaggugauucugaguccagucaaguugacugaagauuagccaucagguccuauuacgcauguuggagaauuauggcugagggcucuguuugcugugugcuuuagacacugaacacgagacaaaaauaacggaauggggucaucuguuagcuuccuuagccuuucagcuauuuuucuuuccccauuucuccuuuacugaugguucauagcaguuacugaaaucuuaacuagugcauuuucagccagacaccuacugugagguugaggcauagggcguucuuagcuuucugauacugaucaugcaguaagugacccucaaacucagugacaggagacaaguaagggcguugauaaugaguauuuguuuuuaugaugacaauguggaauuccaguguuuggugagcuuugucagacacuuucacauuacugugaaaagcuaaaguauaaguagugagaauaguaguaaaaugaagacuguaggcuaagccuuuaccucauuguugccaucgccauccuucugaaggucugaguuacagagaaaacaccaagugaaacuaagcccggaaaugaguaggaccaacagugcagagaacagaggacagagugggacccauagugcacagcacagaggacugggugggacccauagugcacagcacagaggacuaggugggacccacagugcacagcacagaggacagguggauuuggaacugauguugaagaggggugugauagcacacgucuauaaucccacacuccagaaauugagacaggacaaucuggaccacacaagaagacccugucucagagcaaagugugugcgugugucuguggaugucagaaagcgacuucagaugucguuucucaggugccugguuuauguagagacaaguucucucacuggcuuggagcucaccaaguaggcuaggcuaggcaagcaaugagccccagggauccaccucccuccaccuccccagcacuaggucacaaagcgcaugucccaugccuggcuugacguuaacacagaagugcuuuagacggagccucuccucagucuuacucugcugcuuuugcaacaggaccugaucuaguccaguccauuuucaaacuuaauacguagcuaaagaugacacugaacuuccuaccauguuuccuccuccaagugccugcuuuaaauucuuaauguguuucguuuagaagaacagaagacucucugaauagggcucuccuaauuaguuagaugacauuuuaaaaugagacauuuauggaaauccucucugcuguucauuuacuauuugaauuuuaggcuggugaagaaaguguuucucuaaagcagguugugaaguggagcugagcugaggcagagcucagcugcagaaugcuuccauggcaucccuacaaaugacagcaacagaacugggcaugcuagugugugcccgccgcccaguauguggggguggagguagcauguaccugccagccgguaccugggggcugaggcaaggccccuaccuaacauuccaagccugucugagcugcagagugaagcucugcccaaagaaaaagggggcuggagagaugguucagcagguacaagcauccggugcucuuggagagggucuagguuugguucucagcaccauccccaguaaccccaguuucuggggaucugacgcccucuucuggccuucgcagcaccauaugcauggugcagacacagacaggcgggcacagcuacauaauaaguggguuucuuuauuauuuuugaguagugaacuguuuuguaauggauggaucgggacagauugcauuuuguuaugggcuaaugcaagugaacuuuggaacucagcuuuaaagcuuugccuuccuauaucuaaaggaacagcuaucagagcuccgugguuaacuacuuguuggcaggcagugcacuuuacuuuacacaugcuuauauacagccuuaggaggccccaguagucccauuccacagaggacaucgagacauagguaagcgagcacucugucaggugguggaguuugaguuuguguggaacagcuuggugcucgggcauguucccugucaggagaaagucauuguaaaggaaagggaaggccucguccuccccugccguccugugaguagaacaugagguugagaaagggccugugcuuguggcaggcugacuggaggcucugcucagucauuuggauuuaaguaaguagcagugcugugcagaauauaaacaacgauguuuguucccauccuagacuccggauguggacuucuggaucauccccauuauccaggguuuugugcagauugaagaacuugugguuaauuacaaugaguccucggaugaugacaagagcagcccagagacgcccccucaggacuccacuuguguagaugacauucacccacgauuucuaguggcucuuauaucucgaagaaguaggcacagagcagguaaguaagagcaugcaaaugaaaugcaggcaggaguggaggagcugcagauguguggaaaugcaaaugacaaucauggccuugaaagcacuguuagcucggaacuccaaaggcugggauacaauuagagacggauuucugcaguggaggaacagggcagacuuagcaagucaaacagagcaggcugcaugcacauagacgauaaggaagucacuugggaugugucugaggacaguguuccaacuaaaagccugugucacagugauaaauccuuucagagugcuaacuagccccuuugggaaaaccguuaccuuucauucaaaggauucaacuuagcagugcuggguacagccguggucuugguauguuguuguuguuguuguuuaccucucggugugugggcuucccagguuuuccuguagauagguaauuaagaagcacaaucuaaucagacagauuuguugagaguuuugcuauguagcccaggcuggccucgaacuuucuauucucuugccgcagccugcagaacauugaaauauuaaguguguguuccaguaccaagccacgcugaauguuuuuuuaauaacugucacugcauucuguuuaauuuucuuucaggaaugcgguauaaacgaagaggaguggauaaaaauggaaauguugcgaauuauguggagacugagcaguuaauccauguucaucaucauacccugucauuuauccaaacucgaggcucugugccggucuuuuggagccagguuggguaucgcuauaauccaagaccucggcuagacaaaaguaagcacgccagcuauuugguuuacaagugaagauuucgaugagaauuuuuaaaaaaucaggugccagggcuggugagauggcucagaggguaagagcacugacugcucuuccaaaggucaugaguucaaaucccagcaccacauggugacucacaaccauccauaacgagaucugaugcccuuuucuggagugucugaagucagcuacaguguacuuacacguaauaaauaaauaaaucuuaaaaaaagaucaggugccagauagguaugaauuugucucauuuaaaacaauaacucucagggcugggauaugacuuugagguaugguuuccugaccagccugcuagaagcccuguucaaucccuguacuaaaaacuacacaacaaaagccaugccucccacugugaggaaguagccucaggacccgguccuuuccuggauguugcaguuucucagcaggcugauaaagcgccucacuucacagagucugaacugcuugcuuugaaguuuaucuucuagaacauuuaacccugggaaagaaugacuguagccagugucuguagaagcagagaguguauuaacuagacacuagugcacaggaaaucagugagagauaggguuuuuuuuuuuuaaacauuuaagaguuauuuucuuagacuauuuuaacuuuaguaucaaaccaucauuuuaauuuuuuuauuauaauucacauaaaaccuuuacugaaagguaggguauguguggguguaugcgcauguaugcaugugugugugccugugugugcauuuauaauuucauaguugguacuuucagauauauuuuagcucauucuaguuggaaaaaagaaaucuuaauuuaaaaugaugguuagacaaucuuacauuuaaacuguuaaugaauuauuaaaaaguaagaaugggcccugcaguaguagugcaugcccuugaucuagcacucaggaggcagaggccagcggaucucuggucuacagggugagcccuggggcagccagugcaauacagagaaacccugucuugaaaaauaaauaagaaaguaagaauaaagaugggguagguggggcuggagagguggcucagugauuaagaacacugacugcucuuucagaggacucaguucaauucccagcaaccacaugguggcucacaaccaucuguaaugggaucugaugcccucuucuggugugugugaagacagcuacaauguacucacauauaugaaauaaauaaaucuuaaaaaaaaaaaaagaugauagcguaggcacgcgucugucucagcacuggaaggagaaauggauuuuguauugcuucuuugcaggugagaaggaaacgguugacuguuucugugcccauuuugaagaacaacugaaaauuuacaaaaaacaggugggcuuuaguauguaguaagaacaauuuccuuacauguggaauuccaugaauaaaaaccauguacuguucauaauuaaacagccacuuuuagcgugaagauuaaacaugaguaagcuaagaauacucucgaaucagcugcuuuagcuguuuggagaaaaugaaguagaugcuggcaguugucacagacuaggauaggccucucaggaccuugugugcucacacguggaguacaguuaaauaaggcagaguggacugaaacccucuugguggaaaacaaggccaauaauuuugauaugagaguaauauaugaaaguaauguucuugucucuuaggaaugaccaaucugacuguauaaugacaugggagucauuuuuuuccuggccagccuggucuacauagagaguuccaguccagcuagccaggcaauauggugagacccugucuuaaaguaaaggagaggagaaagaugcugaguuccugcuucaggaauggacagacucagugcugcaugucuuccguucuucccagacuagugucuaguucauguagcuucagccagagacucauaggcaacaggaagaaaaaaaaguaggaaagaaaaacaaucauuauuuaauaaucauauucaaaauuuagauaguuuuauaauagauaaaagcagguauuugcuuuuaaaaauggaaacucauauauugcuagcaauaacacaaguugguaaggcacuuugaauguaauuaucaauuaaaauaaaacaugauaauacuuaacuauacuuuucuuuuugauacccacuacacacacacacacacacacacacacacacacacacgcguguguguguguguauaauucugagaaagacucuugaucugaauguaaaagguuaaacauuaaagauuucagaagacagcauaguguuucaaacugagucaugagcaggauuuauaaaagcaguuuccuuaucuuucuuuguuucaaauguaugauugucuaucacauuuuauuagucacuugauaaagaauaaugcccaaccaggaaauaguuauuuuugggcuggagggaugucucagcgauuaagaguauguacggcucugcagaggaucuggguuuggucccagcacccacucacacaaagagaagagaagagaagagaagagaagagaagagaagagaagagaagagaagagaagagaagagaagagaagagaagagaagaggugacaugacaugugucuucagucccagcacucugagccaggggcaggaggaucucugugaguucgaggcccugaauguguaaucucagggcucuuaaggagagcuuggacguggagaaaggagaauccuagagcucuguaggccagcuugcuguaaccaauacagacacugccccaaacaggauggaagacaaaggccuacaucuaagguugaccucugaccucugcacaugugcuaugcuguguauucaccacacaaagauacauacauguacaaaacaacaacgcuaaccauaauggaaagggacuaacuugauuuuuacuuuacgauuuuuuacuauuuguuauuucugguuaugcacaauugaaacgcaugcauaaaauaaauacuuuuuaaaaaggcauuaugaagagaaugaaagguaauucagagauuaggggaggcuggagaguuaagagcucuuguagaggacccagguuccaacccuagaauacauaugguggcucacaaccaugaguaaguccacuuccggggaaucugacaccuccuuuugagcucugagggcagcaggcacacacaugguacacacagguacauguaggcaaaacacacauaaaauaaaucuuuaauaguuaagauuuggucuguuaucucgcagcacauuuaaaugucuucuaaacccauuaaaaaggauguacaauacaaaaaaaacuggacagaauaauguaacaggauuuuauguacaaggauauuuuauaaagucaaauccaucagagaaggugcgucaucucauuaaucaucagggaaaugcaaauuaaagccaugacucacacacuggggagcugaggggaaccgcugagaagcgucaagucugggaaaggaugcagagcaauuagcacuuaaaucggcaaacaggacuccaagugugcucagucacgggugcuuaugcaagagccucacugcagcaucagagccagcggcugcugagggcggcaugaaggacuggauguggucaggaaugauuuggucuuauucugcauugaguuccuuaauaauguguugauucguguugauucaugcauuauugauauuccuaauuguaaguagcauuagaaagaauaagccauauuuaaaugcaacacaaauuguuaaaaggagcaauacugaggugugcacgccaggaaauaaccucuucccacacuugucccugcuccccguugacgcacgucaauaucuagaggcgggcgcugagcagacaccuccuggccuccagcaggagccuggcaguguucauuuaucuguguuaucuguguccuucuccuggguaauugcuuucugcgaugaggggcccacggucagggugacucauccguguggcugcauugcgcuagcucauaauugguuuaggcuggagcuguuugacagaaggucugaugugggaaaagcuuccugcucuaauaaaagauauaccggaacccacagugccccugaggcugcuuugucaggauuugauguuagggacuuuugcaucugucucaagauggugaaugaagcagucgggcguuuauccagugugcugcuggggaagcaaugagggaauggcagagggaaaggcagaaagaacccgaguccucagugguuuacugaagucacugcacucagccuugcggcuuccaggcuugccuugagauuugaguuagcaaucuauuguuuguagcaaggucaccugacacccgcacauucaccaugggcugaagucacaaagagcuggcagugcacauacuguucugcagugaagucucuggcuguuagucuuuuccccagaauucuuagguuaggcagugguggcacaugccuuuaaucccaacaccuccggaggcaaaggcuggcagaaaaaaggaaaaguucuaaauugggaaugaugguguguaucuauaaucccagcacucaggaggagacuauagagguuguaaaggggauuaguccagccuaggcuauccaguaaauucaaggccugggcuauauaagaacucaguuugaaaaaacaaauugguuauaauggugcacaccuuuaguccagcacaaagugaguuugaggcugaccuggcuuacauaccaaguuccaggacagccagggcuacauagugugacccugccucaaaaacaaaauaauccaaagugaagagcuggcaagauggcccaucaggucaagcacuugaugggcaagccuuaucacccauguguacauuuucaucccuggcacccacguaagggggcggggcgugagagcagacgccauaaaguucucuaacucugcccccugcacaugcuuauacaugugccccccaccgagaguaaagacaauuuuaaaagucuaagaauuagggaacuuguuuuugcagaaugaauuugugaaggcaaacuuguugaauuaaacagcauauacacuuaaaguugauauuuagcauucagagauacugcaccagaagcacugaaaauccucagacuugcccugcccacccaacacaagcagcaggaaauuagaaaccguuuuuaagggaucacacagcuucuauucucaguagcaaugggaccccgcuguuguuuuucauguucaccaaugcugacucuguucaguuauuuaaauuuacccgucaguagguuaaaaccucuuuuauauccugacauuugcaauuuacuguuaguagggacuguagcaucuugcucacuggggucuuuuguacccaguuuuuucuuacucuguuuaugguacucuauaaaguguugauuuucuguggcaaguacauucucaugagaguuccuuguuuuguuuuuuuaaaccuuugcugauaaugucacuuguacacagauuuaaauuuuuccuguugucacaucggaaacaucaucuuugucuucugguuuuuauuuuaugcuugggaggucaugcuuccaccuacagcugugcaaaaacuacuacuuuuuuuguggcuuuuuuuuuuuuuuuaaauaacauuuaggucauugauguaucuagaguuuauuuuguguuucauuaaagagauauagggaacucuuuuauaagucucuuuuccuuguagacagacaguugucgucccagggccccugauggucaucugugcuugcucacagcagugugcuuagcuaccuacccuuccugccucaguggacucaggucuuuggcccucagccuuguucuccucugucaguugccuaucuuuaguuucacagucuugcuugcuacauagacuauauagaauuguuccagauggggcaaauuucucuguguuuauugcuuuucauuuuuuuccaaauauuuacuuuuugagaauauuuacuuuuuuagaauuaaguuaucuuuuccaugaaaagauccugguugaauuuugauugggaugguugaguauauagauuaauuggaaagccuugauaucuuuacaauauuggaccuugagauucagcaacaugguacauauuuaugucuauucagauuuccuuuuacauauuucaguaguuuuaugcuaucucauuuguaggguuuuuuuuuuuaaacuuauucugccuauucaaaauaccuacuauuuagguuggacucagcagucaagaccaugaagguccagaaggauccagguucaauucccagcacccacauacaacugucuguaacucaaguuccaggggccucugaugccucugacccccagggcuggacacagacacagacacacacacagacacacacacacacacacacacacacacaaacuuaaaaaucuuaaaaaaaaccuuugcuguuaaaaaagaagcauguuuuauuuuguguuuugguuggcuauugcaaauuuacaggacuauuaccauugauguuaacagcucucauacagcuaaacuuauaugacagauauuuuaauuuuaugguaaaauuggugcuugaguagacuaguuucuaacuaagcacagcuauauuuguaaaauguaauuccaaaugaauuguuccacuggccuuccaguucugaggucugguuaauauugcuacuuucuugcucaucauuaccacagguuauuguuaacuugguagaccaggcuggaagggagaagauuauuggugaugcuuaccugaagcaggugcugcucuucaacaaccccaagcucaccuaugucuccuucgauuuccaugagcacugguaagggcguccccagagggaagcggcuuaaccuucucugcucuuucccuuccucucugcucagaagggaaggaugugagguuuaccugcuguucaugucuguggccuuugcuuuaagcuguuugccuuuaaguuguugcugaaguuuuuacagucuuucuguuccaaaauguacugggacacauaaucacagcggcugaaagccacagguauccuucuggcugucuucauacuguuagcaacaccucuguccccaggauaacuccuagccugcucuggauggucagcuauuggugaauccuguugcugacaucuuuaauuuauguuuauucugaaagcaggauccacuuugccacaaugcuuguucugccugugaauuugccuagguuguaaggaguuguggggaaagaggcauaugcaugcauugcuuugguguuuguacaugugcuuucaagugcaaauagguauagaauuaccuauacuuauucuuuuguuuguuuguuuuguuuuucgagacaggguuucuguguguagcucuggcuguccuggaacucacuuuguagaccaggcuggccucaaacucagaaaucugccugccucugccucccgagugcugggauuaaaggcuugugccaccagacccggcuuacuuauucuuuuuaagaauuuugagcuacuuauuaaagauccuaagaagcuggcgagauaguuggauggguaaagacaucugcuaucaaguuggacaaccugauuugaucccuggaaucuguauggcagagagaaccaacuuuugaaaguuguccccugacuccacgugugcacaccauggcacgugcgccccucacuccacaugugcacaccauggcacgugugccccucacuccacaugugcacaccauggcacgugugccccucacuccacaugugcacaccauggcacaugugccucucacuccaagccuggacacacagagacuaaguaaauaaaaugugauuuaaauauuaaaaaaauaucuuaauaagauuuuuuuuuuuuuuuuuuaguuaaggucucacuauguaucccuggcuggccucaaacucacagacagucucugccucucagauucuuccauuaaaggugugcccucccacacucagcuucgguugguuuugaugaugcuggcauuaaaaccugagcacacuaggcaaaugcucuaccaccaaguuacagcccuggcccuuuccucuugaguaaauuagaauaugauuuuguuauaauacuaaagccgguucuuugcuuucuguuuuggggaaugggguuuagccgaggaaugaaguucgagaauguucaaacccucacggaugccauucaugacaucaucauugacaugaagugguguugguagguacuggacuuaguuacuuuucuacaguugugaagagacgcugugaccaaggcaacuuauaaagaaagcauuuaauuugagauuccugauuacagagaguuagaguucguggcagggagcauggcagcaggcaggcgugcauggcacuggagcagcagcugaguguucgucugacucauaagcacaaggcagagaggagagagagggagauguuaacugggaaggguguaggcuuuugaaaacuuaaaagcccaucuagcaacacaauucuuccaacaaagccacaccuccuaguccuuaccaaacagguccaccaacuggggaccaaacauugaaauauaugagccuauggggcauucucauucagcauucccauucaaaccaccacaguauuucacaaaacguuguuuugacuuuuggucugugaaaucauguguuuucugccccguuuccuuccuuuuugggagugccaccauuaggcagugcugcuugugagcagggcguggugucagaggguuggaaaaugaaguggagcagcugcugcucuugaaggacuuaagugugucccucucacucuguggauuccauuuuguuuuccuccuuugucaucccucaugugggaagggaagcuuaacuauauucagacuucaggcauuuugaaaguaacagagaaggaaaagaugcccagacucuaggagguaggcgaaagagaaagaauauggucuuagaggccaggagagaacaugcgauuggaugugaagacugcaugauggccugagacuagagggcacaagcacgacugcacgacuccuuaccauccaguaaagccaacuagugugucuuugagagguccacuuggaguuagaaaggaaggcaagacaagaugggguuuuaaauguucaugguugugugcaaccccacugccccgagagggagggaagucgguuacucucucagucucucggaucuuggcuuuugaguucuuaaauggggauaagaaugccucacugccaaguuauuguaaccgacaggaaaguguguggagcccuccgugcugucugacauuuaaggauguuccuacacaguugccaggcagugcugcuguugccauaguguuaagaguugaauugaguuucuugaaaacuuuuuugaaauuguaaauuaaucccauacuucuuuugacaaggguugaucaagcuggugugauauguaagcaagaagggauuuuucgaguuaauugcauggacugccuggaucgcaccaacgugguccaggcugccauagcgcgcguggucauggaacagcagguaaucuggaguccuuuugauuucaaauacucauguguaaguaaauagugaaacauauucucaaaguccaaauauuuuguggaaaauuuuuuagcauguaaauaucuuguuacauaaaaacccgagaaauguaacuuagaaguaaguagaugugguagcauuuucuuacauauucaaccugcaaacauuuuaaaucuguuggggguuucauguguuuauuuuccauuguucucugaauuucaaaacugcccuucuguauuuugggcugggagucugcacaaugaauuucuguuagccugcccuggcacugugagguagggauggggcugcagggggcgggaauuagaggagacugcuaucaaggauggaaagccacaaagcccuuugccuguugcaccccuguuaauagccggcucucugggacucaauggucccuuccccuguccccagcucugaggguggcggcugcugcucccuccccuugcuuguuuguuaccucagugcuccacuguaggucuuucagauuucugacaccugcuaaacaacuuccugagcuacaguccaaaguggagacucauacuguccuucuggcuugcuucccugcccccacagagcuuugugacuauucuuggaggacuucguucugucuuuugaaguaaaagucaguaaggcuuuugaauuuaagcucugucuucaccauguggaagguguugacucuaagagaccuccucagaccugagccuuaacaacuuuaaugcaggguaguuguggugguuguuguuguuguugugauaaguaaaugagauaauucacguuaaaaaacaaaaccaaaacaaacaaguucccccugcccccaacgcuugaacucugcccgggcaccugguuaugauucuuggagcauuuauuacucaccuacugcucaugguuguuucuuugugucauucgguauuuguuuccacuucuuagguaaauuuaaaauaggcaaaauauaguaguauuggucuauacguuaaaaaaaaaacacuguaaauguuacauuuauucagcuauaguaauugauagcaguauuuauuuaauaauaauuguuuuugaaacaggacucauuauauaucccugccuccacccacuucugucuugugagugaugggaccaaaggugugcgucaucacaucgggcagugcuguaucuuuaaaaacaugucugagcugggcuugcugguacacuucugucuucucagcacucaugagcccgagucaagagggucugggacucuaggcuagccuuggcuacauagcaagacucugucucaggcauaaagccugagggaaccagugcgauggcucaguggguaaagcacuugccaccaagccugaaaaccugaauuggcuccugggacacaggcgguagagggagagaagugacuucugaaagcuguucucugaccuccauguucucagccuggaguuaagaaagaaaguuggaaaacacuuccuuuagacaaaggucccaaauuaugucagcuuucccucuuuuucuguaauacacaguuaaugcuaugguuucucauauauuauuuacccacuaauguguuuauuuuagcuuaaaaaacuaggugugaugcccccagagcagccacuaccugugaaauguaaucggaccuaccagauaaugugggccaacaacggugacuccaucagcaggcaguaugcugggacugcugcucuaaagguaacuguuuguagcaggcauugugggucauucuaucugaggaucaaaacaagcuuuguuucucucucucucucucucucucucucucucucuauauauauauauauauauauauauauauauauauauauauauauauacauacauacauauauacauauacacacacacacacacucacacacacauauaugugugugaguguguguguguaugauuuaucucuggaauguuuggcuaugacaggagucugcuguuaggucagguauaggcggccuuugugggccuggccugagcaggagggcucugucgcucucuggagaaggucgcucuuuuugaggaggucccauuuugcuuuaucuucuaguuguucaagggaaucuggaaauaagaaguucuaugugcguuuauuuuuauuuugagacagggucuucucuuacuaugcagcccuggcugucauagaauucacuguguaggccuagcuguccucaaacucacagagauccuccuauuucugccucccugagcaccacuauaccuggcugugcauccauuuuaaaacuguauauaaacaaaacauguuugcuaguaccugaccugugugggaauacuuuugucuucucugaguuugacucuuaagccugccucuuacucaguacaaccuugggcagucauuuauccacuuuguuccacuaguuguucaguggaaguaccaggccuucugugacagauaguuauaggcuguaaaggcugggacuauuuccugacacugagugugugcuaaaggaacgcuuuauuaguuuuuuguuguuauaaauuaaguuuuuugaagagcucacaaagccucacagaaacuuaaauguaaauacagucccugguaacaaauucucaauuuaugggcacucuuuaugggcaguaggaauugguugagucaguuuaaauuagguuuacguugauuuccuuucaagcuccuauuugaccaggggccauaucucuuuaacaaaguguagcuugguuggugaagcccuugcuugcaugugugaggccuggagcugauucccagcaaacccaaaccaaacaaaacaagugcucagaagacaucagcuucucuagguuuuaguugaguaauaaauauaaaaaacuuguuuuguuuuuacaacagggccucuguguaggccauaucggcccuguacaucuucaguuagaauuacuggugugagccaucucaucuggcuuggaguaugucugugugucucugugaguuuaugugaaucacauacauuuagauaccugaggaagccaagggaugucagcuccccugguacuggaguuacaggcaagugugagccaugugauguugguuuuggaaacugaacccaggcccucugcaagagcagccaguccucuuaauuacugagccaucuccccagccccacaaaaauauucuuuugguuuuuugacacagggugucuguguguagcccugucaguccuggaauucagguuggcuucaaacucagagaucugcccgacugccuccugaaugcuggaauuaaaggugugugcuaccacugccuggcucaaaaacuuuuuuuuaauaauuaaggaaaauaagcucuauaaauccaaacacuaucucauuuucuuccucugaguuauuuagaguccacaugcaugguuuucuauuuguacauguugcugaacuaagacucugaaaguggccagcuuguugguaauauuuuuccuaaauuuccuggguuauguguccuaaaacuugcagugaagaaacaacaccaugauuaaaggcaauucuuauaaaaggaaguauuuauucggagcuggcugaugguuucagagauguuagucugcuauccucaugauguggggagcuuuugaaagcagaguauggcagugcaugccuggaauccuagcucuugggauguggaggcaggaggguugagaguucaaggucauucauggcuacagaguaaggccagucuagguuacaugugacugucucaaauccuuuucuguccccucauuuuuuuuugaauauuauaaauaugagccuugaaaaaucuuuuuuuaucuuuuugguguuuguuauauaauuguauuggacuuagaaauuucagaaauucuacaaguugcuaggaauagcuuuguccuaaaggggcaucuaacugaaggcucgaugccaugaauaacuauuacauauaacuauuuauagacaagcuuagaguuaaauacuaguacauauuuuauuuaacugcaauacuuaggacuuuuuaaauuuauaauuuggaagccuguggaguucuugucucgaacugaaagucccaaaugaguuuugagaccauucuuacauugaauacauuuccacaauuaccuuuucuuugauagggugacuuuacaagaacaggagaaaggaaguuggcaggaguuaugaaagauggcguuaacucggcaaauagguacuaccucagucgguucaaggaugccuacaggcaagccgucauagguaaggagcaggagggccgcgcguuccuucugugagcgguaguuuacagaauucugcuucuugcauuuaccaugcuuuauaauguacuuguguuucuaauauauuaaauucacauuuucacaagcuuagcauuugacaaauguuuuuggcuggagcaacaaaggaacauauaauuacauauguauuagucaguuguuacucaagugauugaaaagcaggauugaggcugcuagugugugggaugcaguacccaacccaguaugcucauuuguucucugguggcucaagccauguaauuauaggauuuucuuuuccuguuggucauuuaucauucaaauacaccauucuuuuccauaaucaugauuuagcaggaauuacuaauuauccuaaccaacucacuaauuuuuagaagaggaagcagaagagagacugcccauacaauuccuauauuaacauguuuauuuucaagaaaaaguuauuuuacgggauuaaagugaaaguagaauguucuggauuagaaacaaacaugacauagaugaucuguggucccuaagaauauuuuuaaaaaucuguuucuuucaccugauaauuuugaacauguaaaauaagccuagccacacucuagguaggaacuggggaaaucuaauguagggagguacauucagaacuggguuguaauucaguuuuggaguacuuaccuagcaaauuggagacccuggguuuaaucuccauaaguaaagcagaagguuugauuccuuugucagaaauaagaagcagguaguauaagcagagucuuggauguuuucaaacaggaucucagccuaucuauauugcuggcugaccuggagcuggcuacauacaccacgcugaucucacacucagagauuaaccugucugucucuugaguuccaggacugaaggugcgcaccacaucuggcugcgauugagaguuuaguaggauauuuaaagggagagaugacuugcuuccaccagcuaaugugccuauuuacucacgccacugagaaccugggcucugggccugucuccguucaguugucugaucgucuuggucggauguucagucuccucaagguugagggagaggccagcagcaguagaagcucauugagucugugaggccaguggucagcagaucuucuuucccauaagcugccucagaucccaguguccagaagaccugcauaaggaauggauucaacgguuuuuacagcuuuagcugcauaccccauagggaggaaguuagcucaucuauuaagauuuuugcuuguuuuaagauuggauaugcuuuguauugcugagcuguuaggaguucuuuguguauuaagcaugcauccccccucacaagaugaacaguuguaaauauucucauguauuuguggacuuuuucacuuucuuuuuuuuuuuugauuuuuugagacaggguuucucuguauagcccugacuguccuggaacucacucuguagaccaggcuggccucgaacucagaaauccgccugccucugccucccgagugcugggauuaaaggcgugugccaccacgcccggcuucacuuucuugauaauauauuuugaaaugcaauuuguuuuuuuaucugaaaaacucacuccauuaaaaauuggcagacagggagcuggagagauggcucagcgguuaagagcacugacugcucuuccgaagguccugaguucaauucccagcaaccacaugguggcucacaaccaucuguaacgagaucuggugcccucuucuggaaugucugaagacagcuacaguauacuuacauauaauaaauaaaucuuaaaaaaaaaaaaauuggcagacauaagauagccuuggauucacuuuaagaucuuuuucauugagcuuuuccccuaguuucuaucaaauccacacuaacuaaggagccagccccucauuagcagguagacaguaucuuccauugaggauuggguggugugcaugguaucgaucgagcuggcuucucaugagacccagaaggccaguuccuucgucaucagguccagccuagaaucugcaucagguccaugccgaugguuggccucaccugcggccaugagcagcgcucuccuuugcaggaugugugagcagaggguggguugcugccaggagaagcuucaucuuccuuagccccacaugcucgcuaugcauuaucuauuccaacuggccuguucccugggggauaauguuugcuguuacccagaauacggucuuuuuauuagagcuagcugugaccaaucagaaugcauuccccaacuauacacuauaaaguucacaucugagaugagguccaucuugaaauauuuguccucacaugcaggggcuggagagaaauaaauaaggcagagccuugugagaaaaguacaaagugcugcgcacacaguacagagcaggaaguggcugcuaccauggcuaacugucaccaagcuccagggacggcacacaugaagccagggaaagccaaguauccucacucaugagauguuuccagaaacacagaaguuuguaauuuugaugacaucugauccagucuaaaaacuugagccugcuuuaagggggaaaagauuuaagucucugcuuucacggaugaauucuguuguuuuaggucucaggaucuguuuucuagaagacacauuacugaagcuaagauggugacaguguuaacacuuucuacccuagaucugaugcaaggcgucccagugacagaagaccuuuacuccauauuuaccaaggagaaggagcaugaagcuuugcauaaggagagccagagaagccaccaggagcucaucagccagcucuuacagaguuauaugcaguugcugcugccgggugacgagaaguuccacgggggcugggcccugguugacugcgaccccaggugagcugggcuagucuaggauucagccugcuucguguucuggguugauaaguugucacuauuaacacuggcucuugucugcaaugugugggcacggaugcaucaagcauggcugucucagugcaaggcacacucacauucgguaugaaguuaagggugcuuaaaaagcaugccagcugugaaaagaaauacuuagaugugacacuugauuuuaaaacacuucaugccuggagugguagcucacuuguaaccccagcacacuagaggccgaggcaggaagacucccauagccuagccuuuggugacuucuuaaagauccauacuaggcuuauauuguuucauauucauuuccugcagcagucaccagauauaaauacacugucccuuaggucaucuucaagagcagacuugagucagguguccugucucuaguucaccauuagacucaccccucuuccugauacagugcugugucuucuaauucucccuuggauggucagucaccaaaagugguuaugggaguauacguuucaucggccagagcuccuacuguuacucucuguccucuaggauguuaguguaagccagacuggguguguuugucagcucuuuaggauucugccuugggucgauagagggcauggggagcuccaugcugccccgcacagaagggcugucugaaggaaugauguguugcugcugagagguggccguggcacaaaggaucagagcugcagacuuuuggaauggguauauggucugcuccucugacauccagggcugccaaggcuugacgcucuccacuuagaccccagagggcucucugcuagguuggccauguuagacaggcuguauugcguaagugguugagguauuugccauuuuccuccgucugucacuguuguuagaaacugcuuucuuugagguucugcugggauggaaggacugauggggaagaaagugagcugauauuuuagagccaguaguuucuugaucacauuucggcuugaguaggcugagugcuugcuuuuugagauaguaucuuauguauccccgacuggcuucaaacucacuuuagaguggagacugacuuucugaccuuccugccuccuauuucccaggugcuaggauugcaggcauacacaaccaaucccauggcuuaaggcuucaugaauguuaggcaagcacucugccacuugugcuauauaaagcccagcccucuguuguuuuaguuucuguuuuuauaggagguguaagaacuucuaugaaggcucaggaggcucuagguuugcgcacaggcuuaggagcaagggccagcguggcucccacugcucucuucugcuugcucuucugaggugucacuuucucagagagugggucauuaacaccuucacaucucauucugauggaucacucucccuggagacgcuaaccugagaguuuagcugcugccauuuuauuuaacaagcuuuucugugucucucagugauucuugucaucugccuugucaugucaucccugaugcugcucuuucauuaaaugugccacugguauuuuccuuuccucuuuaagggucuguguguguguguguguguguguguguguguaugcauguguuuccucuuucuccccaugagaaacaugaucuggacauuugaguuuccuauagaaucauuuuguauguuugcugacugaaugcagacccagauccagaacuuugggguggggaccagauagcucugggaguggccgcacggcacugggcuuggggccuuuagcagucaccaugugccugccucagcuauccauuccuugauggaucucuaaaauuaaaauaaaaauuuuuugauagggguggguugacaggguuucuuuguguagcccuggaacucacucuauagaccagacucagccucucagagauccaccugccucugcuucuccagugcugggauuaaaggugugagccuccacugccuaauuuaguuugguagcucuuguuuuuaaaaaaauguauuuaggccagaugugcuggcauaaucuuuaaucucagcauugaaauacagaggcaggcaggucuaagugauuuugagaccagccugauuuuccuaggggcuuuguuacucagugacgcaaccaacaaugcaauuauuauuuauuauuauuauuauugggggguaugcgcgcgcacguguguguguguguguauguguguguguguguguguauuugugugugugugugugugcgugcgugcgugcguguccguccgucgucguccauacacgacugugccggugugaaagcucuccagacuugcacgguaagugcuuuucuggugguccuaacggcagugcuuuuuuugucuuuuuguucuugaacgguaguuguuuuuucuuuuuaagaccacggcuaggacuagggacuggggagaaaggcaggacugugcaaauacaggagugggugucuuuacauaaacauuugauguuuuauucucuaugcuauugugguauuuguauuauuaaaaauacugcaguauugcacuauccuaaggacuauuucggcagugcaacagauuuagcuucauucacugcaguaucgguaagguaauguaacacugucugggaagcaguuuaccacagccuuacgcuggggaggccagaagcgguauugggaacuguccagcgcggcaccgugccgcgguagggacgcagugcggcaacgcagcguucagcgcgcuucacgguccaucccggcagacaccggauagaagcagcccuccucaacuguguguccuuccugccugcgcucucagccaccucauuugccacagaccagcuggacuuuagcgccuggaaagaggcuuagguucgaaaggaacuaggcgagcugcaucaggacccagagcaccugcagaaacgccgacucuaccccggucaucuauccuccgcaggguauugcgacuaucaggaucgcggcaaagauaacagcuuggcagcccucugcccaucaagccgugguaaaggcucaagccagaagcccucccacccaacagcuccaccggccggggucuuuauucuccguggagggcgcgggaugcgcaggauacaaugcgcacgcgcaguggcagccugccgcagcggaagugggcgugacuggaggcgaguccgcagugccauucucugcaggcgcgaggugcgguguagacagaggaugccgcgcucccaucggcagccgccaccugcgccucgcgcuccagcugccaacgcugcggaaccuaaguccgauggcguucucgccaugacuuuuaagauuuuccuucuuuuugcaggacuuaugguuaaagugccaguggggcuguauuuuuccuguaaauuacuucuuuuccaaagcuugauguuaauguccccggaagacagcgcuuuuuaugcgaccauugucuccgugguugggcugcauguaguuuuggcaauuuuuguuuuuauaguauggaaggaagguuugccacaguggcgggaaaacaaaaaugauuagggcagcagcaaggagcugcaaugcagggggugggugggguuauacauaaggguuuuuuuguuguuuuuuguuuuucuuguccguaccaaaugugcuuuuucuuuuuuaaaaggguggggguauggacagggagggauuauuuacugcaccuaagacugcaguaaaaauggggugggagggggaaaaaggccgacaacacucgaccgcuuguuuugugccaaaugcuuuuagauaaggacauaauguuuuugacugauguaaauacuaacucuagaauaggcaggauggaagugacacuguaggguuuuuuguuuuuuggguuuuuuuuuuuuuuuuuuguuuuuuuuguuuuuugguguguguguaaaaauugugucgugauggaauuuuuggcguggcucggcucaagcagcaguuuucagaaugcaguaaguaucaugcguaaaacucacuuccauuuaccauaucauucugcuaugcugccaggaucucuggauuuauggucuucucuuacucagauacuggcuggcagaaugagucuauguuuuauuagguacgucuguucauucauugaggucuagaguguaggugaaaacugaggaaaucauuucagauuaaaaacuguugaauuuggguugcaaccagguggugcugaugcggaaagccgagguacaggcuuugguaaagccgcaguccucggcagugccgucuggcagugaccucauucccaggcacgcuugucaguggcuuaaguuccauccauaauugauauuuccuaucugggucuuuuuuuuguuugcuuuugcuacugcuuuuauaauaguaagagccagcagaugagauggguuugagauccuguggcagaaaaaucuuaugguggaaucuaaagaucagcaaucagaaucugcaguuuaacagacucggcuggaaaggcuacccaugccagauuagaaauuacguuaaaauuuucauuugaguuuggguuaugccugcuuguugauuauuuguaucuuuuaauccuuggccauuuccuuauuagaagcaucucaagaugugcauuuuacuauagucuugauagucuugguuuaaaaugguucaacaauucaccugaauuccauucuaaaauguuucaguggugguagugguagugggguguguguguguguguguguguguguguguguaugagaaagagagagagagagaauaugaaugaaugggggggggcagggagggaaggauaaugcgacaaaauggccauaaggcagugcuuacucauuccuugaaagccaagugaaaucuauagugagaaaaauggaguguggcuugccuucauguucacaacaguuuaucuaagacuauuucagaauagcuguuuucuaguagugcaaaaauauacucagcgucuaguaugcuauuuugaauacuggcaaaugugagguaacauaugauuucuccuucugcgugucacguuuuucuuucuucuucccaguagccaccucuuucaccauuuuccccucuuacauuaucccuuuccuuugaggacugcgcccccuucuggucaugucuggaacagaccucccuuccgcucgggcucacaucggcucccuccuaauggugggaguggggagagguguuuaaguuuuuuccccccaaaauggauguagauugcuucuguauuaaauuuaacuucagaaguacaaucauuucauuuucauuuguuccccugggcaaucuuuucuuguaaguaggaauaugcuugcaaaaauguggauaaaaauaauugaucaggaaucguaucuguacagccucacugacgcugcgcacagagauguggaagugcugcugcugcugucuaacgcugccuacuauguggccuaguaagucgccauugauuuaaagcuuuuaguuuguuuuuugucuucauguauauaugagauuucauugagcccuuuaaauaaucuuucaaauuuugaguuauuuaucacuguuuuagcuuaguauuacuuggaauucaucacaaucugggcaucacgcacucuguuuaaucacagaggccauguaucauggcuugucuuacuguauuuuccccauuguuugacacugaauucccugcagcuuuugccauugaaugauucagcucugcagaugcacagcuuguaugugcgcaugugugcacgucaguguugccaugguuacaagcauaugauuaugcgacuuucagcgucuccuugguuacaagcauaugaucaauuaugugacuuuggugguuuauuagcgccaucuccaaaaaggcaauuaucugugccacuuccaaagcugagugcucgcuuguuccaugagcuguccaggaugcaggcuuaaugcauuuccugaguaaaauguccccuuuacuuuuucagcuugguuuaagcugccguuuuccugucauuccauaugccuuuggcucaggucaugacaguuuucuucauugauuugggaucucagacccauccgcuguacauuccuuagcuaaagcguuccaauguauauugccuucauuuuaggcuuguuuauauuuuguuuauaaaacugaaauuauuucuuuguaauuuucuuuauauguaaaauucucuauuaguuguuaaauuauguuacacuccucccaccccgagacagggucucucuguuauguagccuuggcuggccuagagcuccuucuauagaccaagcuggucuggaauucacaggaguccacaugccucugccuccugagugcugggcugucccucuuauuuauuuaauauauacuuuuuauguuucacuucauucuggaaugcaugcuggaaagauuugacuuuaagugcaugugguagcucauaacauucuaccucagcuuuguagccagagccaaacccuugcuuuuaaccuuuguugugcuugccuuucccuaguuaugaugacgaaguugauaaaguaaaccaguaucaacgacugggccuagaagaccuggaaagaauagaaauagguaaaugcuagcacauuaacuaacccacaaaagaggaugcucuaagccaucugugauggcagacuucccuuuucuuuagagacuaauaauggguaugguugcuuucaucuugugccucuugagaacuccagugaucaaaaaguuuaaacaauuacaaccgaagaaguguucuuauggccucaaaaucuuauguucaugauaaaacagagggcauaagacauggcugccuuguuauggucaggacacacacaugcaugaaaugucaagauucacacacuaugaaaacauuuuuauaaauggcuguaaguuuauaucuugauuaaauuaugaauagaaauaugcucacagucuggugauauauguguauuugaaguaaaggcagagaguguuaugugaaaaacaacuuguaacacacucauuuguguuagguccugaaccuacucuuuucggcaaacccaaguucucgugcaugcggcugcacuacagguguaaagaagcaggcgguuacuuccauacgcuaagagcugugccacguaguccugaagaagauggcaaagguaaggaagggcaaaccauggcacuuucagagauaaucaaguccacugcaugggacauuguagaacugauuucuagaaagauugcucaggaguagcuuggauucgagaucucuacuccuauuugaauggcugugaagugugucaccugcucccagaggcagcaccugcucccagaggcagcaguuccgaccacuuuaccaggucccugugaguucuaagauguuuaugugcuguucauuagcucuuuugaucuugucuguuaaaaaucaucaucuaacaugcucuaugaaaaguccaaagauggagauggugguggcagcggcagcucgccguuugcccuuauacagcaggcuuggcuuacugcaaaccacucagggguagauuuauccaggaagugacuccuucccaaaggcugaagaaacagauauaacagggguugaagaaagucauuccagacacagcaaccugggagaaaguggcugcucuccaggcuccugcauccaguuaccagggauugcuuaauagcugcgccuuaugcgcuucaagaugcccuuacuuaccucaucccaaccucugcucuggagucucguuuguuuuuauugacaaagaagucuggagagaccgcagcaaaguuuauuauuaauucacaucccaaauauuuccaaaaggguauagcugagccuccuauacugugcuugcugccugagcacuuugaaccuuagacugaagauguaagugacgcugccugaaggaaccaaucagacucaaaagccagagcuccaguggacguucugucuagcucuugcaggcggugacucuccaaccgcucggagccccuccuggagcauggggccauuuuauauggcucaguuagcaucaaguaaaaauagcuaagaacgcuuucucugcuugaugguguugugauuugaguguaugauaugcacaauucauuuucugcucuagcuucacccuggaaucacaagugaggcacaacugcaggcuuauucacuuuugucuuguguaauggcaaaggaaguacauggccucuguuuuuagcauuaggugugagaaggcagagccagauaaaacaaacuuuuaaaaaaagucaucaucuagaacauguggaggacagugagcaaguuagcaguuuucuguaaguuacuguaggcaguaaacuaguauuuaagucuguggccacaaauucacuucaggcugugugcuaguguuuggggcgaccgguaagaccuguguuuggguuccagacacucuucagugcaucgcagagaugcugcagaucaccaagcaagccaugggacuggacguuccuaucauugagaagaaacuugagaggucaguaucaagagugaagauagcguucaacaugcauuaguccugcacuuaggacggcagccucaugccaccugaggcucuggccuuugaaacgugaccagucccagcucagguaugcuguaaccacaugacuacacacugaccacugugcagaccucaugcaaagggaaaaaaaaccaagauacagauauuuuuauauaucuguugagguacaguauuuuauauguaaguaaaacuuuuuagguccauuuuuuuuuuuguagcugcuagaaaguuucaguuauauuccuaacugaaaacauaucuaccauccaacaucuuuuggauaguagaguuuuaguguugacuuguuauuuggauuuauaaguuagcaagcaguaccccguacuuccaguauuuuggauuccacgaggaauuaauuuuuuuucuuuucuaacuuacaggaaaagcaguaagccucaugaagacaucauugguaucagaucucaaaaccaaggcucucuugcccaggggaaaagcuuuuuaaugagcaaauuuucaucucuaaaucaaaaaguaaagcagaccaaauccaaugugaacaucggcaaccuacgaaaauuaggaaacuuuacaaagccugaaaugaaaguuaacuuucuaaaaccaaacuuaaaagucaaucuuuggaagucagauaguagucuugagaccauggaaaacccaggagugauggguaauaagguccagggggagucugauggggacauuucuucagauaacgacucguaccacucugaugaauuccuuacaaauucuaagucggaggaagacaagcagcuagccaauucuuuagagagcguagggccaauagauuacauucucccaagcugugggauuauugugucagcaccucgauuaggcagucggucucagucugccagcaguaucgacgucagcacucaugcccccucagaagcugcugcugguccuggaagugaacuugggaaaggccuggagucuccccugaagaaaagcccuucugcugacagcauacacacacggacuggcuucacaaagcccauggauguuuacugccagagauuugugcaggaugcacagaacaaaaugaaugaccugucagagaucaggucuguagcucagaagagugaggagggaagucacaagacuaaccgugugucuaaugaagaaacccagucagaaccaaugggacagacgccuccucgacccucucaguuaaacgucucuuguucuguggcaggcccaccauucuuaucaguugaaccaguacauucagugcuaucucagaagacgcccagcuccggguccagccuucuggaacuugaggcagggcucugcguaacucccucuucagagagcagcagcagcagggcagucucucccuuugcaaagauccgcagcuccaugguccaagucgcuaauauuacccaagcugggcuaacucaugggauaaacuuggcgguugccaaaguucagaagaguccagcagaacccgaagcgguuaacgaaauucaacaaaaugaacuuaaaaauauguuuacacaaugccagacacgaauaauucagauuuagauuuuagucacauuccuuugucuuuuauuuaaaaauucaaaaugaaguuuucaccuuucaggcuauuuuaaccuguacugaaucuagggauuucaaauucuaauuauguuuauuggcaauuguuuuacaaggagucugaaccuuagcaaauuuccagauauguaagcuaagacuacaggcagucauccuggaauauggaccagaguagcaaacacuagaauggucugugcaucucacuugggaaggagcaggaaagaaaccaagcucgugucuagagggggagacacucucaagcaggugugguguggacaucuguuuauggugguagcauuuuuuugcucugucaguucauuccucaauacugcuucauaaaggaaauuaugcauuuagauuuuagugauacuagugugcauuaguaucuaaauuaaaaaaguagucucguggcuuaaccauucucugaaguugagaauuaacaaugguaaaacuguauuuuuccuuugaccccacucucucccguauauacauuuuuuuuucucucucucucaaauucuuaaguaugggcuugcccgucauaaaauaacuugcugcaggaauauaagaucauguuuauugacucuagagaucucuagaaaagucguuugaacucuuucaagggggacauuuagcaucucuuguagguucuagaacuauggaaaacaucaaaguccagguuaaacugguuuuauucaguaacuaaccaccaagaaccucuucuguaacccagagugagaaagcuguaggcauauucuagcagguaucaaugucucuggcauccuuuagagccuuacucugguuaacugacucucaguuuaacauuaugucuguuaaaacucugacaagcauuccgauuuuguuauuuauuagcagugucaagucuugugacuauuaaaagaaccacuguaauucaaaacaucagcguaugagaauuucuuguauagcauuuaauaguaagaguugucuucaaagaauucauaaaugguaaguuugcuuuaaccaaacacuuguuuugaacuuucaauuuuaaaaaugaaaacuguauuuuaaaucccagacauuaaaaacugaaugcuguagccuuuuuuuuuuuuuuuuuuuucuuuagggucuucagaguaguuaaguauuaagccaggccagaugggaagauaaugcauguuuggguuuccaaagaaaugacccaugaagagaugugacaacagaaguuaaagcaaugguuauuuccaaagagaccuagcugccuggucaggguuacaaucugauccagacccagcuacagaugugaacaugugugugagggcgagggggagacgguggcugagaaagcugcagagcuacagaagugaacauguguguggcugagaaagcugcagagcccgucucuuccaguucagcuugaggaggugcucuccuguauuucuaauucaugaaaaauggcccaugguccuggcaauuuggaaguuuuauuuacuggacaggguuauuuacgggaacuuuucuguaagaccaugcaaaauuaugacuucucuuugguaaauuacgguuuacauugguacaguuugacaagauaaaacuaaaaaauuuguucuaggacaaagaaaaugcauuuucaaaaaucuaugugaacauuuuauuuucaaaaguuuaaggaagaucugucuacccguuauaaaaaugaaaaccaguuagaauucuaguaugaacauuauuuacauuaacuuauaaaaauagauuugcaguuaggaaaagaaugcugaacaacuaguaguuuguacuuccuuucaucaggcaacucccuugauuuaucaaggccgacccuguuuccuugguuagcagggaagaaucuaagggaccacugauugaucuucacacacagcagaugagauuaacagcaagguucuaacuuuucugaagguucuuguuacaaucgccauuauacuacauuaacuugcaaauuauaacuacuaacauuuuuguucauuugaaaauacacauaucaaaaugaauuggucagaggaaaaccuaccuguaacuggauggaccuuuacugcacuaguaaaugguguuacuuauauuaaaagcucaaaaugcaguacauucaucaagucaguuaaauaaugaggaaaaugaaaaacaucccacccugcacagcccggggauguagcuccagggagacuacacuucucuagcauguaugagaagccaggguuugauaagcagcaccaaaaaaaaaaaaaaaaaaaaaaaaaaaa

SEQ ID NO: 4140 - RNA, 44058 nt, Mus musculus
cgagcuccacccaggucgcuggcagcgcggucgguggccgcgauuucccgccauugugagaaguggaggcuaggacggucucccccccaccccuccggccgcuggccagcagcuccgaggcgcucgugcccgucaccgcagccaccucuccuugagacgcgcggaggcccguggcucgcgacgcccccgcgcgugggagggcgcggacgaggagcggccgagcccccgagaagccgggcuccgagcgcgcucggcccgcagaggagcgcccgccgcacgggccgcgcuggccccggcccucagcgccaugcccuguggagaagauuggcugagccacccgcucgggaucgugcaaggcuucuucggugaguggcgcguggcgagcagggccgggaggggagcggaguuugcgggaccaggcccgccgcgcggccgcacuccggacgacgggccgggggaaucacugccgagggcucgcguggccccgggccuggaagccgagcagaagcagccgucuccggccgccggcgcuggcgccgccgccgccucccgucaccugcccgcugcccggccgcggcucgcuggcggcggggccgcggcuccgagcgcuagcugugauugacggccuggcuccgggccgguggccuacguagcccgggugcugcagacacggagagguccccuugcccacggagggcccuuagagcggccgcggagagaagccacugccugugggagccugcgggauauuucaaaacuuccgggguguguaagggagugcucgagccuucgcucagaaguucucucuguuucccuugacauccgggagaaugcuucuucuuuuuuuuuuuuuuuuuuuuuuaaauuauucuuccugcccuguugacauuagaacccgucugcucuguuaccuguucccguaccagggcuagcuagaaauacucaacuacuuagaugaguugccacagaacgggagccgagagugcuguaggcaagcugaguaaauucuagguguaauugucaucguugcuuuuuuugguuaaccagaccuccgauucccacgcgcaucccagauuucggugcguuuaaugacuggccugugccaccggucuccguggaauguguuuucuguaguaacgcucccaccggaucggauucauuuuaccuagaauucuaacuaaucagguaguuucccagggugaaacuaaagccggcagauagaagggcuggguagacaugacgauuauauagccagugaacacacagugucuucaacaggggcaggggugugcaagcccgcgaaagaguaaaccacgggcuugggguauuauagcucaguaguagaaugugugccuggccugaugaauggucugaguacagugcagguggaaagaggcagauucaaaccuagccaucuagggugguuaucaaaggguguguguaagcugcuaccugugauucugucauuuggaaggcagagcccuucgcuaagugcuaguaauugaaguucaaaauauuggacccaacaacuggcaugucgagacuaacaaugauucccaaaugucaagccaggguucaguucuguacugggugaaagugcaaauguguagauaaauuuuuaggggaaaaaaaaucucuccguaguuaaagguuugggacuuaaaggguuaaguuccaaugaccgauaccagaauuccuuacccuuuaguuugaggcaggucccuagcccuagcuggcuggcuuggcgcucauggaaauccuccugccucauccuuuggaguguugcgugugccaccuuacccagccagaaucuccauuuaugagaaauaucccacuaccacgguccugcuguagggaguucggggaaaauugcauuugauuaucaauauuuuauaaauauuuuggaauguuuuggaaaggucacugcugcccucugaaugacucuuugggagagaaguguauaaccugcucugcuguauuucugcuguguuuuccugucgcagugauuacauuggguaccuuaaagcuggagacucuuuggucuguguuugauuuuugauuuccguacuggggguugaacccaguacaagcaggcaaauaguccaccacugaagcuggucuucuggcacgugccuccauacccagucucuguaucagcuuuagauauuaauuaucucuugacccuguccagaaaucuucaucuccagcacugcugucauagcccaggaucuuuagucacguuuuggauuucugcaacagccuccccgucucucuugcacuuucuaugccagaaccaguggcuuccgguugguuauagagacuucccccccuuggguuuuaguuucacuaguauccccagguugcccuugaauucuccauuuuuuaccucagccucugggagauuacaaacaaacuucacugcacuccuguugaccugaguauauuaugaccuuaguaucugaccuacacccuuuuuccuccucugauacccuguauacuguauagcucuguacccuguacccuguagcuccagcugcucuugagcauuugccuccaaauucugggauuacaggcauguaccugcucuucuggcuuuuuuuuuaaagaucuauuuauuuauuuuauguauaugagugcacuguagcuguacaugguugugagccuccauguaguuguuugggaauugauuuuuuuuuuuaggaccucugcucgcuccggucaacccugcucacucuggucugcaccgcucacucaguccuugcucucuccuccggcccaaagauuuauuuauuauuauaaauaaguacaauguagcugucuucagacacaccagaagaaggugucagaucucauuacaggugguugugagccacuaugugguugcugggauuugaacucaggaucuuuggaagaacagucagugcuuuuaccuacugagccaucuugccagcccacucuucuggcuuuuaccuguaugucuucugagguguuuuuauaucuacuugugcguuucucugaggauaggaguccauggacaaggugcccuuggauaccagaaguuacagcaguugugagccuucgguggucugugggugcuaggauacacuuuugacucuaguuuucuucuuauucuucauuuguuuccuuguguuguugagacaauguuuuguguagcucagguuggccaccagcucacuaaucaaagaugcuucagccuuccaagugcugggaucacauccauguaucccuauguuuacccccacccaccccauauuaauaacuugaauuaauaccaccuccuccuccuccuccuccuccuucuucuaauucuucuucuuucuccuccuccucccuccuccucaguccucccucuuccuccucuucuuccuccuccucuuccuccuccuccuccuccuccuccuccuccuccuccuucucuuuucagagcugagaaacaaacccagggcuuugugcuugcuaggcaagugcucuaccacugagcuaaauucccaaccccauacccacuuacuuugagaccagcuccugucauuuuacccaggcuggcauccaccuccuggguucacgugacccuccuuuugcuucuaaguagcugggacuaaaagcauaggcuacuaauccuacccauaacaacacacacaugcauguguguccggaccagcggacagcgcguagaaaucacucuguggacaucaagugcucucucucccucggucauccuacuggccacacaacugcuucugaguccaggcugcuuguaaccagcugccucuucgcuuuagguguuucaguuuuagcuuaguuugguuccuugguucauucaggaugaggcuggcaagcgugugaagggcaaagugugagucuaaucacaaguguuuuccaaaguucaaagcagugauaagaucaguagaagcugcucugaucuugucaucaguccacugucuugucugaacccagcuuggagcucuucuguucuaccaccccacucuugauaggcacuaaagaauaauuuaugcuaaggcuggagcccaaggaaagggccugggcauuuugaggaacagaguagagucgaguccuaggacuaagaagcaagaggauguccagguggcucucugcggacacucagcuuucuguauuaacuugcucuuuuucucuuccauaucaaacaaacucacuuguucucaguuccagcccacacuugccucaucccaaauucuagggcuagagaauguacuuggcccaggguggacucugcuguccgcucaugauucuagcucugaugggcgugaggguugugugggacagccauagcuguugagacaugcccugacaguggggagguuucaaagaagucugaacugaacagccauggcaaaaugugugaguauuuaacuuacaaauaaacacuaacaugugguuaaaggccaauacaggucuguuaaguaaguuauuguauguucucccaucgaaugaagcuccuuuuguuuuguuuuguuuuguuuuuucuaagaugggaucucacaauguagaccaggcugaccucaaacucacaucuauucuccugccucugccucucaagugcagggauuaaagcuaugaacagaaccuuuuuuuggguuuguuuguuuguuuguuuguuuguuuguuuuucgagacaggguuucucuguauagcccuggcuguccuggaacucacuuuguagaccaggcuggccucgaacucagaaaucugccuagcagauccuuuucaacuguucuacuuuccagugguuuguguggcuuuuuaaaguggcacaacaucuuuaauucagauauaauucacacaaaacuuaucauuuagagcugggcagugguggcacaugccuuugaaccuagcacuugggaggcagaagcaggcagauuucugaguucgaggccagccuggucuacagagugagcuccaggacagccagggcuacacagagaaacccuaucuugaaacccuaucuugaaaaauccccccaaaacaagcaacaacaacaaaaaccuuauaauuuaggaauguauauuugaucgggagguugaggcaggaggauugaguucaaggccugcccggacaacuaaugaaaaucugucucaaaauaaaaagaagccugcgaauauagcugaguguuaugguggggcuuuaaguuuaauaacuacuaaauuauauaaguaaauauucaaugaucuuuaguauuuuuaaaugacauuuagugugagagagagaaugaaugagagcacagaucauguguggaggucagaggacaacuuguaggaacugguucuuuuccuucuacuauguggauccccagaggucagacucaagucuucaggcuugucagcaaacaaccuuaaccacagagccaucucucuagccauuuuuguuuguuuguuuggauuuuccauuuguuuuguuuugguauuuuuauagugggcacugccauuauuauuuccaucauccuugaaagaaaccccaaaagcuauuagcacucauccccccaacacacuccagugcucuaucgacugccacccuaagccuguuguaugucaggagucauaugacaugaggcugcuuucuuucauuuaauauauugucaggcaucagccauguugcaguguggcuaaaaauaauauuccucuguguguaauuguaaauauucugcucagggacuggugacuggaugcucuuccagaagacccagguuggauucccagcaccacguggcguucgcgccugucuguaacugcaguuccuggagauaugaugcccucuuuuguccuccacaacacuaggcacacacaugguaccccgcguaccugcaggcaagacaccccuguacauaagaaacuaaaaaauaauuuuuaagaauuaugauuuuucauucaugccuucauggccucuguauccucuguuuccugccuugagucugugcucugacuucccugaaugguggacuacgaucaauaagaugaauuaacuaaacccuuucuuccccaaguugcuuuuggucacaguguuuuaucacagcagaagaaaccuaaccaagacacauacauucggauuucuccagaucuuucuggagaauuucuuuuuuauaauagccauuugggugggagugagguuguccgcuacugggauuuuuuuuuuuuuuuucuuuaaaugcagagcacuuaacaaauuuacguugucauccuucuaccggggccgugcugaucucuauauuguuccaguuuuagugugugugcugcugggaucuuauuuuaauuuuacuaauaacaaauaauaucuuguauauuggcauuuggguauucucuuuaaagaaaugucuguugaaaauauauguguaauguugcaugccuguaagcucagcacuuggaaggugacaggagaaaguuuuuuuugcugcaggucaguuugaggccagccagaaccacauaacauagugagugcauuccuacaccauuuuuuguuguuuuguucaaguccuuugcagacagugagugguggggaggcaguauuucagauacuccaggcuguguucaugcuucaugaacaacaacucuagcugaugagcuaccucccagacaauuuccuuuuuuuguuuguuuguuuuuuuuguuuguuuguuuggguuuuuuuuuuuuuuuuucgagacaggguuucucugugcaguccuggcuuucuugaaacucacuuuguagaccaggcuggccucaaacucagagaucugccugccucugccucccaagugcugggauuaaaggcgugcaccaccacugcccggccugacgauaucuuuuuuaaaccagguaucauaaauucuuggccaaccccagacuuacuauguaggcaaggcauuuuguuuuguagacaggauuucucugcguaaacagcucuggcuagccuugaacucacagagguccauuugucucugccuuucaaugcuagaauuaaagacgugugucacuaccuuaggcaaagguuuuaguuaucuuuuuucuuguugaauuguggaauuuuguuuucgucucuuucuggcccacaagcauagccaaggauugaaccuaggucugugugcuuguuacagagaauuuucucccccucagcaauguggccaugaauuuuuaauuuugguaaagcuucauuuauuuuccuuuuuaaaaaauuuugggugucuauguauuugcccauucuguuguauuuuuuguuguuuuguuuuguuuuguuuuuuaauguagugugagguagggaaguuacucuuuugcauauaacuggccagcuuucccagucuaguuuguugaagagacugucuuuuccuuauuauaguuuugccacauuuguuaaaaagccaguugaugguaagguacguuuuauuugguuuccacucgguggucuguaugcaugcucucuccaugccagagcuguaguagucugacugcuaugacuucuuccuauuuuauuguggagacugguguguaugugugucugucugacugaauacguacagaauagacaucaaaggaugacugagguaucugcucuaucaagucacucugucuuacucucucgaggcagggucucucacucgacccacaguuuggcagcuuuggcuaggggagcuggcuaaccaguuccuagaaucugccugucuccaccccaacugcugggauuauaggcucccauaccuagcuuuuauauuugugugcuuauauuugcauuugaguccuggcuuacuuggugaucucugggucagcaggagucccuauuucaaaagauagcugucaaaaaaugauacccaauguccuauggguucauacacauauaccuggaauccacucaagagguggaagcaggaagaccaccaauuucaaggccagccugggcuauauagugaggcucuauuuuuaaguaagcaaaagcuugggugagaggguuggggacgaaggcaguagcuucaugauggagcauaugcucgccgcguuugagaccuggguguuaucuccagcauuuggagaagagacagccaaacaccaacuauuauuguuuauaaccuggaacacuaccauucuaaacccuguuugcuuuuacagucauuggagacuuuucuguccauuuuaaucuuguugcucuuuuuuuuaagcaauuuauuagaauuauuuuuuaaguucacaggaaaacugagugaaaaguaaagauuuucuauguaacaucuccacuuucuccaaauggugauguuucaucccagagaaguauauuugucccaguuaggacauccuuauggagcugaggugacucaguggcuugcuaacuuaaugacaugagcucugucucagaaccuaugucuaaagguggacgagaacaguuguccucuggacccgacuagagucacaguaacuacacaggaacuguaacuauaaccaguuccaugggcucccucuucuguccccugucagcuuccacaugguauguauguguauauauauauucagguaccacauuuccauauaaaauaacaugaugauuauuuaaaaaguuguccugugaccucuguucacaaggcccugccccaaauguacauauuuuuuaagcaaauaggcguuaacauguuauccagaguccauaguaugcacugcuagggcagugugauaggaauauauuuagcuuaguggcagacugacagacuggguucugcuccccagcagcagugaauggaaauugcuguguuaacaacgccuacugccaaggcagagagagcacucugugcugauuugcaucccaggguugccuuuuuggcuucuuagguuugguuugguuuuccuuguugguuuuccugggguugggggguuacacagggugucuguguagcacuggcugcucuggaacucagaguuccugccuccaucuccuagugauaacaauugaagguguaagccaucaccaaauggccagaauuuguuuucuuuaaagaucaguuugaacacuuucucaucuacauauagugugguuaguauucugucuguauuuucaucccucuguaaugguguguguguguguguguuuugucugucuguguuuccuuuuuuucacaguuuccuucauguaacagaaaaguaguuaagucuagcuuauuauuuucuuuuguggaaugugucucugguauuuuauuuaaacaguuuuagccaaacaucuagguuuacuucugugugauacucuguuaguuuuauaauguugcuuuuguuuguuuaguucugugaucuauuuuaaguuaauuuugugauuugagguaauuuuugcaguguuacucauuuguucugauauuguuucuuacaguucuuucuccauuguuuauugaacauugcuauauugcuuuuguuccuuugaaaguucagguggcuacaucaauguugauaagcuuauaggcuauuuauuuuguuccaucaaucuguucuuuuggcaauacuaugcuugagguuuuuuguuuguuuguuuuguuuuuuuuuccgagacaggauuucucuguguaucccuggcuguccuggaacucacuuguagaccaggcuggccucaaacucagaaauccgccugccucugccucucaagugcugggauuaaagccaccacgccuggcuuguuuuuguuuuuugagacuugaguaucauguaguacaaacuggccuugaacuuauaacagccaaggguggccuugaauuugauuguccucccugugccuagugcuaugauuacagguguguaccaccaguccuuguuuuaugaagcacugggaaucaaacccaggacuucaugaaugcuaagcaaguagcccuccaccagagccauguccccaacaccuaugauuuugcuugcaguuuuuuucccucuugaauggcuuccuagaaauugugucuuauuuuuauucucuuucccucccccucucccucccccuccccaucucaucuccccuuacccccagcccuuucuagucuuauguagcccaggcuggcuuugaacuccuauuuucuccugccucuaucuccuagguacuaggauuaugaauguaaacuaccccacccagggauuugucuauuuuaauauuagucauuuguguugguguuuucguuuuccauuccuugauguuugcccuuaguuuuuugcuuuucuaucugcauauguugauuaguagauuauucugugucuguuuuuucuugguauuugauagacacguucaaaguuauuuuuucucuaaaccccacuuuaguauuccacaaacacuaauuuacacagauuagucuguaauccaucagggaaaauuuggaacuauccucaaauuccuaaaguguugguuuauuuggggaaagagguuuguaguaagggacuugugguuucaggacuuucuguuuuucucuuccuacacauugcuuaugggcagugagcauaaugauaaaucggauuuucauugaguuuuccuaaauacuaaaacagacauuuugggaaucugucauacucuuuaagaagggucuguuucacugcuaagaaaggaagaauuuccucuuccccaaucuguaaaagucagcuuuuucguccuggcccuaggcuucaagaauaaugacucugagacucaaauauauuuauuuuuauaagcuuuggcuauuccccaauucaaucauaacuuaguaucucauuuauucugaucuuaaauucugccacauggcugguuaccucugcucagcucccgugcuucugaccuccuucauguuccugggccaauccuccugccccuggcucucucccagaauccucucuguccaucuucuauuuccugccucaguuacaggucaaucagcuuuaacugacagguguugaauccauucaguacacaagagauguucucuacaccaaucccagaugcucagccuuaaaaauaauaccuauaagcaacaguaaauggacucaauagguuguacuuauguaccuauugacacacacauacauacacacauacacauacaaacaaugauaguuaaagaauaaaaagucauaaauuugaaagagaguuuacugagagggauaacaggacgugggugauggauggagagaaugauguaauauuguguguguuguuugcuugcuuguuuuuugagauaggguuucuuggcuggaauuuacucuguagaccaggcuacccuccaaccuguagauccaccugccucugccucccgaguccugggauuaaaggugugcaucacuauuaccuggacagccccaaguuuuaaaauaguuuugaaagcuguuccgagaagaaaggaagauacacauggcuuugcaguaggucuuuucauaagaaggcaugacaugcaugcaccagcugcagagcuucagacugcccgcacaaacggcgagcuggagugggccacgugugcagccauagcugcagggcuugcugcuuccauuaguuggagaauuaguagagcucuuaaagcucugagugccagcuacgcaggcucauuuaguauguucaccuccccgccccagaacacgcacuguccaagcacaugaggaaccugggccaagauaaaucauucugaguuaugagcgaguaucagcagacuucagagaagggaagucauuguguguguucugucuguaauaagagaggaccggaaauccgaaagaugacaaaaauucagacuuguagaacacuuauaaacacaguagaucaaaaagaaguccauauaaaacuuaaaauuguucccagcuacacaaaaaauggaaauggaagaacauccucuagccaggcagugguggugcacaccuuuaauccuagcacuugagaggcagaggcaggcggauuucugaguucgaggccagccuggucuacagagugaguuccaggacagccagggcuacacagagaaacccugucuugaaaaaauaaaaaaacaagaacauccucuaaguacaaccagagacugugcuguguauguauggaaagaaggcuucgagcauuguguccauuuaugaaaucagaaaugcgaacugaaacccaaggcacauggagaaaaggaaagcaaauaaugaaggaagaacagaaauuaagaauugaaaacaagaaaauagcaaaucaaaagccgggcgugguggcucaugccuuuaaucccagcacuugggaggcagaggcaggcagaggcaggcagauuucugaguucgaggccagccuggucuacagagugagugccagggcagcccgggcuacacagagaaacccugucucaaaaaaaacaaaacaaaaaaauaaauaaauaaauaaaaauaaaaucuaaaaauaaagaaaauagcaaaucagugaaauacuugagacaaucuuauguacuacagacugccuuaaagcucacuaguaugugaaggugucuuaaacuuucuaacaacuuucuauuuauuacacugcaggaaguugcuacgcuuugcaggcagugugcaugugguggucagagcagcuuuuggggcugggcucuuuuccuccucaagggacugaacucagugauccuuugggagcaugcaucucugcucaguggccaugagcgcaaacauuccaauccuccugccuccaucuccuggguguaggcaugagccacugcaccugguuuaugcagauagauaccaccaacugagcuacgcgugcagccccaccccccccacccccccacccccccccaccccaccccccgcuuugcuuuuucuuugagugugauuagagauuuguguguauguggaggggguguaauuggggauugaacuacugaacuaaaucccuaaucuuuuauuuccuucuuauuagcaaaacugauaaaccucuaagcuagacuagcaaagaaaaaagaagacaaauuaccauaccaggaguaaggagguaaugccgcuguggacuagcuguauagauagaacagaaggcuugggugcauauaguccagcacuaacuuauaccacacagugccuugaaacaauauagauucauuacuuuacagcucuagaggccagaagucugacauguaucacuggcuuuguaaaaaucaaguugccagcaggauuugcaucgccaucuggagguucuaagaacaaaucuaauuccuugucuuuucugagcuuuaaagagucugguggucacacugggaaacaguucaguugggaaacuacauuggcuugcaagcacguugaccugaguucaguccccagaauuuacauauaaaagcucagcaggaagugcagggccuuacucccagcacuagggagguagaaauaggcaaaucccuguaguugguuggcuagccagccugccuacuuagcaagugccaugucagggaggauccuuuccaaaaaaucagugggcaauuccuaacaacauccuagguuguucuuuguccauugugcacgagcacgcaugcagaccgcgugcgcacgcgugcgcaaaaacacaugccccugcuccaauaaccaaaaaauucaacuacuuuccuaucauucagacuugguuugucauugguucuuaguguguggucugggcuacucuggaacucaggugccuccuaccuuaccuugacacauuuucuucucagucuuccuuccacagugaacccucuuugauaauuuccuuguuuuaagguuacuaguuuuuggcuuaguuaugggaaguaagccccgccagggcauuccuugcaccauaaucacaaacuaaucaccaugccuucccuccagccucucccacaaugucuuuaugaacuggccugguuuaguucccauaguaaguggaaccauccugucugucccuucuguguguuacauccuccucagcaaagucuuuucaguggcuauugcugugacucugaacuuucuuuuucuuucuuccuuuuucuuuucuuucuuucuuucuuucuuucuuucuucuuucuuucuuucuuucuuucuuucuuucuuucuuucuuucuuucuuuuuaaucaaagaacacaggaacccauaguaaaggauguucuuugaaacacugaacauugauaugcaaaaguuagaaaucucaaccuaauccucacccuucauagagacugauugguuguagaccuaagagcagaaccugaaguauggcaccaaggcuuguuuuguucauuuuuuuuuaaaaaugaacuaauuaauuaaugcauauaaaugcagguagcgcacuuauggaggucagaagacaauuuggugaaucaguucucuccuuccaccgcguggauccuguggucaagcuugggcuagcuaagggaaaaauguuuggacggucugcuaaagcaggauuuuuguguuuccgacaggcucaucuacaucacaguuagaaacacauuccccucauucgccaucuacuuaaggcagccaugugacaaacacgaaagcuuguaggcauguaagcuggggguucaguccacaagaaucuguguucuguggguuacucccucuuuggucuuccuuuucaucuccuguaagcuaccccugcagguuguuucuucauugugagggcaagaagcccucaauauguguaguggagaacuggcugccacuuugagugaugagccucucugauaagagggugacagacauaccgucuauauguagcacuagaaggcuaaaacaucacuuacauagcaguauaauugguguugaaggacagaauuauaguuucgguuuguuuuuuguuuuucuguuuuguauuuauuuuguuugagauggcucauguagcucaggcuccuauauagcugaagaacccugaacuucugauccucugacaggccugaugauugaccugagcuagauccccaagaaccaacuccugcaaguuguucuuuggccuccuugcccaugugaaugcacauacacacacuaaacaaauaagcagaugugguuuaaagucuccacguuacauuucacgguguguuacuguaucugaaaguauuugagccaaguacuguauauaccgagcuugugcugcuaugucugggugaaccacauacuguuccacagguucggcucucagugguuaauggcagggagcuaagggcaagcagccuggguuugcggugccuggugacuggugcccggugcccggcaggaaaaccccuugaauaccugugagugucccagcugcauauuuuacucguacuaacuauucagcuuacguauugcugaccugaacauaaucugcuggccuauauugugcuuugaugaccaaauuucucuuucagcacaaaauggaguuaauccugacugggagaagaagguuauugaauacuucaaggaaaagcugaaggaaaauaaugcuccuaaaugggugagcuuccugcuguugugugaguuggcuggcucuaguuucucucagcagagcagaccgccccaccagccacgugacuagaaguagcgcagugagugcauacagcucuuccaagucuguggugaaaauaaaggggcuuuggucugaugcuucuguguugugccucuagauggcagcaaaugacuguucugcagaguaaagugugcucuaagagugucuuguuccuuccuaaaagaauuggcaugugugaauguugagaggaacccaucaaagcauaugcuuuccuguuggcugcaagguucacaguccucacgguguugauguuuacagugugggggcuuaggaggcugacacgagaggguucugaugaguuuggggcuagccugggcuacuugugaguuucaaaccaugcugagcuacaaagugauacugucucaaaagaaagcaaacaugggagcuggagagagggcucaguuguuaagaacacuggcugcucuuucagaggucuuaaguuaaauuuccaacaacuaccuggauauucacaaccgucuauacugagaucuaauguccucucuggcacacagaguauucauguacauauacauguacauacauaaaucuuuaaagaaagaaaacaaagacaaaacaaaaccaagaaaacaaaacugaaccaaaagaaggcagucagggagauguuacacauacuguggaugcuuuuagaaggaaaagcaucgugcuagagucaaguguugucacacgaacuuggaagaauugagaggaaaguucuuccccagcagauguuauguugagcagugagcacacacagcggggcagggcuagguuuugaagaugugucucuuccagacaacagcuuugcuaaucugcuugccuguuuucuccgaaggugccaucgcugaacgaagugccccuccauuaucugaagcccaacagcuuugucaaguuucguugcaugauucaggauauguuugacccugaguuuuacaugggaauuuaugagacaguuaaccagaacacaaaagcacgcguauguauugcuuccucccugaaccaugcugucuauaauuuguaauauuaaucacauuuaauaauacuuuguccugcguuuuggucauagguucuucauuuuggaaaauacagagauguagcagaaugugggguauguauccuuacagugucugaggcugguuguaagcacgaguuuucuaccuaaaaagagaauuucucuuucuuugguugguuuucaguauacuugucuuguauaugagugaguucuaaaaaaaucaggcagaauauuuuuuuuuugccuuuaagaauuuuucugacauaaucuuauuauuaucuuugaaagauuucuggcaagauuauaaaugacaggauucuuccuuaguaucugugaauaaaaguacagggauuuuuuuuuucuuuaaacaaaagugaaagcuuaacuuaaacuuagcacuuucucaacuagauagaauuaaacauuugcuugcucguuuuguaaagcagaaggcugcaccgggagaucuaaggccguugcugcggaucccgggccaucaggguuggcaggaagcaccuuugcccgaugaacuuaccuuacacuccuucagucgaauacacugagccccacucuggcuuucuagggaagguugcugggaguggaagugagagguaaagaaguguagcuaccauugaacacuuccuccgacucgagaaccugcccuuuuggaugaggcucucacuguguagccugacuggccugacguggacuugugucugcccugcuucuuucugccugccagcuguugggauuacacguguuuuacuaucacguuugacuuuacauaugggcuuuaaaaccaaguuuucaugggcagaaagaagaaaugaaagcauagugacagggaaagcacagaguuuugggugucauguagcugugaaaggguggccacucuacuguguauaggguuccauaaaugcuaggccccacaggauaguguggaggcagagcuuuaccagacagcauuuguaaagggacucugaacuaucuggcuucuguuccuuucugugcauugcuuuucugauacuaggagaaaaagacuucacuuugaugcuuguguaguauguggugucuuagcuaggccuggaaacagcuuauuuuauguuaacaguaaaaaaaaaaaaaaaacauuagcaagucuaaauagaccagauagcuaguaaugucuccucucucauuugcuuugugcuuuucacguguuuucuauugaaaaacacaaacuuuaauuguccauuuugggaaaggaaaugagaauuauagguaggggguuaaccagguaggucaguaugaaggugagaccucugcuguuaccuuuucugggucuggcucucugcucuauggaccuagaaccuccaucaucuuaucuggagcuuuuaacuuuuuuuuuuuaaccucuuacucaaauuucccgagaguugauugauaaccauauuaauauagcuacaauuauacaauucagaagagucauuccuaguugaaaggaguacuccauaguuuagcggguucauggaacagaacaccagcuuuaacugggaagcuacaguguaacuccugacaaugauuuagaguagugggcucacuuaaccaacggaucucccuauucucacacaugcuuccccuuugucaugugucuuuucuuuuuaaaauguuucuguaagacaaaugugauaccagguuaauggauugacuuuaucagugcuucucuaagaaguuacaauguauuggugaucauauuacuacuacagaggagguuuccuccucuguguacaauagcaugaauuacaaguugguaaucuuggcauaacacugccacgggcucagagagaguuugugugucugccauagauagauagauagauagauagauagauagauagauagauagauagauagauagauagauagauaacacugccacaggcucagggagaguuugugugucugcuauaaauaaacaaacaaacaaacaaacaaauagauucucgagcugagugguggugguacaugccuuuaaucucuguacuuggacggcagagccaggcagaaucugaggccagccuagccuacaaagugaauugcagcacaggaagaacuacacagagaacccugucucaaaaacgcaaaaccaaacaaaucuuagaugaaggccccauuccaaugaaagggaccuugccccuaggggaaaacagauaaaauauaguuugaagauggagacuauaacauacuugccuagcaugcaugaagcacuggguucagucucaguacuugggaagugaaucagacauucagggucauccucaguacauacugaguuugaggccagccugguauacaucagaccuuguuucaaaaacaaaacaaaaaaucaguuuccagcuuaaauaugaguaaaguacauguuacauguaugaaaaugauguaaugaaguuggugauuuuaugugugugugucuguuaacaugagggacuguuugguugguugguuugguuuuugagacagggcuucucuguguagcccuagcuauccuggaacucacucuguagaccaggcuggcuucaaaguuggugaucuaccugccccugcaucccacauccuaggguuaaaggcguguaccaccacugcagggcuuuauuguuuuuuaaugguagcuuggagacugaugaagugauucuguccauaagagcaauugcugccaagccugaugaccgaguucagucccugagacccacuugguagaaggagaguaccagcucuggcaggguguccuugcacuuccguauguaagccuuggcaugcauacauaccauacguaccccucuuccccgagugcacagaaggaagaaagguauuaaaacuggaaguuagaaagcugaauggaaugacuuauuauaaucccagaauuugggaggcugauacaggaggauugccaaauguuagagcuacaaggugagacacacauacacacacuccacucucaaaagagaaagaaaggaaggaagggagggagggagggagggagggagggagggaggaagaaaggaagggagggagggaggaagaaaggaaggaaggaaggaaggaaggaaggaaggaaggaaggaaggggaagggaaggaaaggagguaguuuuggaagcagaguguguggugguggcagcaugucccuuacaaugcuucccaauauuugggagucugaggcagggggaucaccaguuucauuuuagccagagcuacauaaggagaugcuucuuugcuuaauuaauugcuuauuauuuacauuaacuggagguaacauuuauuaugauuuuauaaugugaaaauguauuuuuuaacaaaaauuuaaaaauauguuucuguauauuacagccucaacaagaacuugacuugagcucuccaaggucuaccacuucggaaagacagaccuucuacuguguccccgugcccggggagucuucgugggucaaagagauauccuuuaucuaacccucacuguucacugcaugagucuuuuuuuuuuuuaauuuaaaggaucaaaauccagauuuuagauuuguagucuuuuuaccuuggcaacauuagcuggaaaaaaauguauucauauacauguauuuaguaagacauauuaaucacagagcaauaccuaaauuaugauauauuccuguagugaaauauuguuaaaauagguugagauagauuuauagguaguuaaauauuaucacaauaauaaauaaguaguuucaaauuagaauaguuuuuauauaauuucuauuuuuuaugugcauugguguuuugccugcauguucgucugugugaaggugucagaagcccuagaacuggaguuacacacaggugugugugugugugugugugugugguuuuuuucauggacacaucaugcucauaggagcucauugggaauuuggaagaggguuucacauccuuuugaacuggaguuacaaugcuuauguagguucugggcacagaaccuggauccucucuaagagcagccaauguucuuaaccacugagccaucucuccagcuccagucgacugagccucugaacacuuguuucagucaguuacuuaaaacuugaguuuugagagguggcggguuugguuugguuuuuuggugguggauguguuuugagugaggucugauagagcucagauagcuucagguccugauccuccuccagaugcugggaugacucccagccuggccaaacuuggaccuuuaagccuuuuccaucuccuuuagugcgguggguucucuggcuugcuugcuuucauccuuagugaugcugcuuuguuuuuucugcccugaucuguugccaggaguuugucaggugccuugucuacugaccucugcuuccuuccuuuuauuuuacuuugucuggguuuagcuuuucuaccuuuuccuuuuuacagagcugagguuugaacccagcccccuuugcaugcuagguaagcacuccucccccuggccuguuuuggguaugguauuccugguuucuugaguaagacacucaguuacugauuucagauuuucucguauuggcaguuaaaauaaauaaucccacucuagcauuagagcagcaagcucccucucaccacugcccugcuuucuguucuuccaugugaucucuuugaucucugguuguugcagcacuguuguuugauugucucccucccucucuuuguguuauuggcaucauguauuucauuugcauguaaacuauauagagaaccugugcuauuuguauuuaucuauuuguuuauguguauguuguuguuguuguuguugacugaaugcaugccugugcaccaaggauaugucugaggcccuuggaggccagaggagaguaucagaugcccuggaacuggaguaggaguuuaaaacuguuacugcccucucucucugggugccggggacagaaccaaggcccuuuugaagccagugcucuuaaccacugagccagcuaucuuucuagcucuauuuuaaaccagucagucaauuuaucuaucuguuuguuuguuuccuuuaagauauaucuaaaagaagucauugguuacccuggaccugcuguugcaggugguuguuagucccaggaacgagacucugguccucuggcucuugacggcugagcugucacucuggcccgugugcuuugacuguugcugucuucuccagaaaccgagggagagcccacgucauuuauacuugugaacaccuucacuaucuccagcucucuaucucugcucuuuguguuuaugugaaaugauuuauuucccuuagaugccuccuccccuuuuuuaaaagaacaggucucaggguggugaauuccuucaugaaaguucaacugaaagucuuuucagcuuccuuuuugaaugacauuuucacuagcuguagagucugugauuggcauacguuccucuuugcucgugugguaaugauacagcgccguugucucugccuccagucuucuuuggugaaaggugagcuaucacucuuacuccucuuauauaagaugucuuuuguacucuucuuuauaccucuaaaauauucuuucucuuuugcuuccagccuuuuacuauggugucccuggguuuaggaguauccccuacccuuuucuuuuaaaauguacuuuucuuaauuggguuuuguugaaccuucuaguuguggauauuuuucagaaacaauuuuaaucauuucuuuaaauauuuuuuucugucccaaucucaguauguaaaacacagacugaacugugugagugugugugugccccgcugggauuuguuguuuguuaaugcaggcucuugggaggcaagcacguugacugagcugucuucccagcccuguuuuggaaugucacacauaauuauaacacaagucgaucuuuucuuuugauagccuaaacugugcucauuuuugcuuuccuguuucuugcuuguuuuuuuaauccuguugcuagaaguugggcacaagcccuucaaagccgggcugggcaauuuccugcuuugaguuuccccuccuuguuucccccucauuuugcuuuaguugaaugguuagugcugaccuguguucaauuucacugaguuucuuuucuccaucccuaaucuauugacccccaccccacccacccccgugugugugauugggacuggggcagggucagagagagagugugggguuuuguugcuucccuuguuuuccaucuuuuauuuucagaucuaguuguccaucugguucuuucaguauuucucuuucucugugaguacugcucagcucuuuccucauccucuuucugguuuugagacaguguagccuagccugggcuguguuugaguuuggcuugaauuucgaucauccuacuuccaccuccagagugcugggauugcaggcauaugccaccacaucugguuuaugcugccagggauuaacucggggcuuccugcaugcuaggcaacugagccacaucuccagcucuguccuuuauucuugugagucgcccacuaauuccagagucuguuaucuccggguuuuguuuuuuuuuuuuuuuuuuuuuuaagucugauaauaggucaguuuuucuguuucuccacucgacuguuuuauuaacugcugaaaagcaacacugggguagaaaauggaauuuccugucuucagaaggguuaaauuuggcuuuggcaguugguauguuggaucagguuguucuuaucaaggagugguuugaaaauuuaucaauauuauauuuaauuacuccuguuccccaaggaauggccccuaaauaacaaauggacuguuuagcucugaaaugccugggauguucuuccaguccacaugugcuuauaugugcaguucuccgcuaggccaguaggaaugacagaguuugaguugcuauccuuugucuaccucuggcucuuucuucuagauauccucuuacaacuugcagcuuccucuguaacccuaagcuauguaggcuuuguuuccuccaugaacaagagauagucuauucagauucgcuacaguuuacaggguccuccuauaaccaaaaggaugugggguuuuuccuuggguuaugucuccuuauucaaggaucauaaccucguccucccugugccuguagacauuggcuucgucugugcuguuuuguugaggugggacauggaauacaaccucuuacuuucauagcugugauuugaacagguauggcccccauagacuuguguguuugaaugcuugguccaugggaaguggcacaaguaggaaguguggcccuguugggguaguguggccuuguuggaagaagaaugucacuguuggagcaggcuuuggggucugccaugcucaaguuaugcccaguguggaauagucuucugccuuuggauuaagauguagaacucucagguccuccucuaauaccaugucugccugguuacugccaugcuuccugccuugaugauaauggacugaacccccuaacuguaagccagccccaauuaaauguuugccuuguugcuuuggucacagugucucuucacagcaauaaaacccaaauuaagacacugaccaaaacuggaaguuuagucuucuuucaaaaauauuguaagagcuaaaaagacaacucagccauuaagacacuggcugcuguugcagagaaccuagguguagucuccaguagccacauagcugcuccaaguggucugcaguuccaggucgagggaaucugacacugucuucuggccuccaaggguaaugcaugcaugugguacacaaacauauuucuaagaaaaauauucauaagcauaaaauuaaaauaaaucuuaaaaaaauauauccucuuaacugaauugucagauuggugcuauuuauaccccuauaauuagccuaauuuaggaugguuugguucaaggugauuuucuucuuaaccuuucguuuaacgccuaugucaaugcgaaccaagcucgagucagucccucgaccuccuacacucccaguaggcacaagaggaguuaugaagaugacgaggacauggaccuacagcccaguaaacagaaggagcagcauccaggcucccggcaagcagguagugugcacgcucggccuccuccugaccuuagguuguuccuaggccuguucuggaucugggaccugacuggaugguguugcucggguugaagcucagugguagaaccuuggccuugaguauaugagccucuggucuaacgccagcaacugggcguuucauagugagugcuucuugaaagcugcucacauggaugcguucagucucaaguggucgucuggaaaaaaaagauguauuucugucuccgugauugaugauugcuguccugacuccugaacaaugaguagcauaugucacaccuuacccuaaagugaccugaaaugaccugaaaauauccuaucuugcuuucuuuuuggaaucaugguauuucuguugaacuuugcaaggcuggaaauagcaaaggaaaaaauguaaaacugcaagaugaauuuguaauuucuuuccuugaguacagcugguucuuucacuuuguugcccaggcuggccaccugccugugcuuccugagcgcuggaauuagaggggccaccaccaugccaggcucagguccagauugauuggaugugauuuucuccaguuuccucaucuguugcaaagagacguuuccuaggugaagguugagacuacacuugucugugguguaaggacaacucaaagacuguuguuagggauuaugcuguuuaguaaauuaguggcuauagguucuccuccagugaccaugaugucacuagcacuggguaguuagcuguguuuccaguaccaggcauugccuuccucuuguugagugagccuuaaguccaauuagagaguucuugguuauugcuaaggugugugugccacuacggaaucuuuaggcuuauuguauuguccugacccuugauuugguucauacgugucauagcuagauaggaugaaauuagcuuuuaaaaguacuuccauguguugggcaccaugauuuaacaucugagcuccuaauacuaaguaaggcaagaggaugaccuaaggaaggaauucaauauuuuagguguguaucuaucuuuguucugguauaagucaaacaauauuauuaacuggacauuggcauuuucaaccuuauaaacaugauuuaugucaaacuugaaaagcucuuuggaauguucuuuucuuugggcuuagaagugacggcaugcacuaaaaaaaaaaaaagaaagagaaaaaaaagccaggugugguggcgcacgccuucaaucccagcacucaggaggcagaggcaggaggauuucugaguucgaggccauggucuacaucuacagagugaguuucaggauagccagggcuacacagagaaacccugucgcuaaaaacuuaaaaaaaaaaaaaaaaaaagaagugacugcaugcaauacuguuuaaucuaggaggccucgggggccuucacuggugcggagagccaaaacgcuuagaaacugaagcuuccucuggacagcagcugaacaccuugaaccucucuuccccguuugaucugaacuuuccucugccaggagaaaaggguccugccugccuuguuaagguacagccuuuccuagcucuauccacagauguuacugucucagaaagaaagcauuagaaaagccucagcauuugcccgcauugucuuuugccacaauaacaaaucauuccagauuuagcuauuuacaacaaaauaaguuauuuuacaggcuuaggccauaagucugacaugagaacuguauaaaaucaggguaucuggaggcugugcugacuuccagaggcucuagaagaacgguaaggaggacaggagaugguuuguuuggucuuuugccucauuuagcuuuaagaggcugccugcauuccuuggcuuguggcuucuucaucuugaagacagcaauacugcaucuuucugaccauauuuuuuauagucacauuagcaucaaaaaaggcucugucuuugacacugauccccacuucgaucauucagggguaucaccacuucaggguccuuuugcacacuugcaaguuccuuugcauugugaauaacauacuuggcauuccagugguugggcuguaacuaucuuuuagggcuccuuauuuugguuacaacguucuugaggaauuggccagucuggagcuuagugugguggcauaugccugagauccaagugcucgggauagaggcagaagggucgagaguucaaaccucuccugagccacauagugagacccugugucuuaaucuggguuauuauugcuuugaugaaaaaccaugaccaaaagcaaguugagguggaaaggguuuauuuagcuuacacuuucauauuaguucaucaucaaaggaaguugggauaggaacuuaaguggggcaggaaccuggaggcaagaagcugaugcagagggaugcugcuuacugccuugcuccucaaggcuugcucagucuccuuugauaagucaaaccuaggaucaccagcccagggauggcccuacccacaauaggcugggccuuccuacaucaaucacuaauuaagaaaaugcucuacaaacuugccuacagcccagucuuaaggagaaauuuuuucacuuguggcucccucuugacugaugauucugacuugucucaaguugacauaaaacuagagcacacacccuguuucacagagucagaggguaaaggucacauucagaagugggacaacuuuuaaauucaugucuacuucuuuucuaugucauuucuaacuucauguuuuauuucugcuguuuuauauuucuuuucaaaacccaauucuugauuguuuuuaaaauaaaauauugaauguggcaucauaugcccauaaccccaccauuuuagaggcugagauaggaagauuaagaauccaaggcuagccugagcuacaguagcgugacucuggugcaagaaaaacaaguuaaacugauguuagugacuuguaccaucaguuuuagcacuugggaagcagaagcuagaggaguacuuugaguccaaggucaaugugugccacacaggaaguaucagaccagccagguagacccuguagacacacugggcucugguguagcaagucccugugggagugugguuguucacgugcuugcugacugaguugccuggcuagcgaggacgugguugcucuuggugugccauucaggguuaaccugguuuuguguucucgucaggucuacgaagauugggauugcuucaaagucaaugauguccuugaguuauacggugugcucucuguggauccuguccugagcguacugaauagugaggaaaggugagucugucggcaggcuacuucucguuggauuuaacuguagaacagcggcagaucauuacaaagagcuucccuuccuacuucagacuuagcaguucccgccacccgugucccaugugcuugucauuacggcuguuuguggagagcgguggcgcacaucauucaagauugcuguauuguuugagacucagauuuucccagacuuaacuaguaggggccaccaugagcaaacucaaggucccugagcugaccucaugauuuucaguauuuauuuucugucacauuaagccacuuggacguuguauguaccagcuuauuauugccuaguuuuucauuuuuuucuagugagggauuuuauuuaagucaagaguaaauacuaacugauaauagauugguucauuuuuggauccuauucuguccucauaccugaggucauccacucacagggagagucggcaugugccucacggcugcagagcuucccaucacauaugcuggguccuuuugcuccauguggagguagcgucucauagggggacgugggaaacaaaugcucaucucguggcuaggcuaugaaagacaaagaagaaaaccccaguccacaaagcucaugaaggcacuccuucaguucucucaagagcucuauccucucugcuucuucagaguuguauuaccucacaggacuucugcgaucccauuugucaggucucaaugccuccuacggggcccugcacagaaagucuuuuccugagccccuaaguucaagaguuuucccuccuugauucauuuggaguugaguuuugugcaggauaauagauaaggauccuuccucccuccucccucccucccccauauuaacauuugaaacuguauuucuauauuuccuuuaaggaacugugaauuuccugugcaugauguacacacacauaaucucagcacuucgaagguugagucagaaagaacugaguuguagaccagacugggcuacgaaauggaggaagacaucacaaaaaagacaaagcccugaguucacacuccuucagcacaagcucuccuucucauuucccccuccuguaguuaaagagccucaucauuagaagcucugugugugcccaaugucuuuguuuucuuuuuccguacaucaggcuggccuugaacuugugucagccuccugccucugccugcagagugcuaggauugcagguuacaccagcauccaguacucuguuguuuuacagugaggcuuugcauucagugcuacacuccacuguggccccuuuugauucugguauucguuucauguagguucauuugugggguuacauuucacuguaucccuucagaagcaggacuaugcuaucccacaagugcccaagaaugccuuuguguguuccacaguucuuuuggucucucccugcugggaaccagcuuccuagucucuggcugucugucccuccuguauuuauacauagcuaacuagcuacguguauauucaucaccacccuucuuuugcuucaauaagggauaguauaguuguauguuuuuagacucuuuuuaauuacauaacaagacaugauaacauagaccuuguucuaucuuuccuuuggccaaagggaaggaaggacuuuuuacaagcacaccuacagcagacuuauuggauaccacgugaccaucggcuuucuacauagcaagaacuuaaucauuuucauacuuagaggaggcauaggcaggcagaccucugugaguucaaggccagccugauucuacauagugaacucuaggauagucaggacuguauggugagacccugucgggggugggggaggggggcaagaagaggaggaaaaagaaggaaaggaaggaagaaagagaaggaagaaagagaaggaagaaaaagaaaaaggaaacaauaauaacacaaaaauguuggcaaaauauuuucuuguuucaagccauggcuaaccuggaauucacuguguagaccagucuggcuucugccucccuaauguuaggauuuuaaaggugugugccccacaaucaauagcuuuccuuguaaauuacuugauuacugaggccuuuugguucagaggggaaggacacagacuggggcagauuuggaauggauuugugaacuugucucaugagaucugacaguuuguauaguguggucuuugugccuaguagaguugaagacuuuacacauauuggucauuuguucagugacuccagagcgaguaucacguuugaguugauuagcaagccugaauguucacacuguucuaaucacuuguucacacuuucgagagagguggaauaucccaucagaauaaaauuuagcaaagaccauuagcaagauaaaagugaguggucuccacacuaaauaauaaagacauguggacuuuggagaaaaagaucccaauguuguuaggugcugagaaugcaaggagcaucugcuuugaaguggucuugugaaugacauccucugucauguacccggcacuguccguggcaguaagucagacaccucagucuugggcaguagaguaacccagugcacugugcguugaccuggcagaugugagugauaaagcccuuuagagugaggggccagggccuccauuggaggauggagaaucccucaagcaggauucugagugucuacagagugcauguuauuuucacaacaugccccucucuccccagggaugccucugcacugcuggaccccauggagugcacagacauggcugaagagcagagagugcacagcccacccgcuucacuagugccaagaauucaugugauuuuagcucagaaguugcagcacaucaauccguuguuacccacuugccuuaacaaggaggagagcagaagcugucaguguaagugugggcccucaccugcgcagaugcagucccugcucagcagaggguuuucuagucauucugugaugagaccuaaacaacaaugaaguguguaaguugucuuuguucucacauuuauaucacugagacaggguuucucuguguagcccuggcuauccuagaacucacucuguagaccaggcuggccucaaacucagaaaucugccugucccugccucccgagugcugggauuaaaggugugcgccaccaccgccuggcuauaucgcuuuuuaauuuuaaaaaaaaaucacauuuacuugugggaaagaguaccugcaugugucagggcacacaugugcagguaaaagaagaacuuagaagaacucaccucugcugcugcuguggggcuuggggaucaagcuuagguuaucacacuugguggcaagugccuuuccccucggagccaucuugccccacccuaauauuggcaucauuuguugucuccagaacuguagcgcucccuccugcucuuguauaagaugcuagugcagagcuggccugacacucucauuugccauuccuuccuucugcaguuguguccaauuucaugucugaguugucuccagucagagcagagcugcuuggauuccucacucacgcacucuugggagauaguuuggcugcugaauaucuuauauugcaucucaucucuacaguguaagucugcgcucuuccugggcguggggugugggauaaagaggggaacagcugugaugucuguagaucgaucggcuugaucuucagggacuuuuacaauguugcgcccagcacaggucccuuucuccacuucacuuagcgucacauagagcauuguguuuccauccuccagacagagcaugccugacaguaagauaagcuguucuuuuuucuguacucauuuuauguuuuauuuugugguaauguagauuaaacccaggaucuuguguauacuuugaauguaucucugagucucauuccuagaccccuguuuguuuguuuacauguauguauguguguaugauguauguauguauguauaaugucuguauguauaauguauguauguauguauguauguauacuucuccagacucugcuuauaaaaacaaugaagucugucuguguacauuuaauuuguauauugacuuuaaugcuucagcccuuuuuugguuugguuuuuuauuuuauuuuauuuuauuuuuuuuugagacaggguuucuuuguuuagcauugguugucauguagcuguguauaccaggcuaaccuugaauucacagagcuccuccugccucugccuccuaagaccuggaauugaaggugcacaccgcuaccaccagcuagugccucagccuuugucuccaccauauuggguuuuugauuugguuugggguucaguuuuuguugguuuuuguuuuguuugagacaggguuucacuguaucccuggcuaucuuggagcucacucuguaaaccaggcuuucccugaacucagagauccaccugccucugccuccugagugcugagauuaaaggugugcaccacuacucccugugguucuuucuuuuaaaagaaggaacaggaagaaaacugccugcucucacaugaaacaguuucuucccauuuaauacuugagcauauucuuugguuuauguccauguguuguguucaguacugugguccaaucaguucugguugaaguccacaucuucccugcuuuuuacauuuaauauuuaguuaacauaucauaauacuuuuuuucuuucuuuuuugagauaguguaucgcuauguagcccuggcccggaauguucuauguagaccagacuggccugguacuccaucgagauccuucagcuucuguuuccugggugcugggauugagggcaauccgucauacucagccuccuucauaaacuuucuaaugaccaggcguucuuauauuauaaaucagggcaauacuguaaccauuucccaaaaugcuaggguuuugcacuuuuuuuuuuuuuaaguaaaugcuguuacacuacgcaucuuuccguuauaaucuucuuuccccugguggcaucuaagauaguaugcaauucuuggguucccaucaacgcucugucguugcuugacuugacaucccugauggaaaacccuggaauucugggagguaugcagugccugagccauagucacacuguugcggucagccuguaaggcaggagccaccagcuuauaucacgcacaucuugccagugacgucugcaaaugcuauaaagggucaagcacuucaggucucagcauuuuagauaaggugcucuacccauacugccauucugauagauaaaaauguucuuuaaaaaaaaguuuauuuuuaguuuauaugugugacuguuuugucugcauaucugugugugcagugccuguggaagccagaaaagaguaucuucucccuagaacugaaguuacaggugguagugagcuauucugugggucuggaagagcagccaagugcucuaacugcugagccaucucucucugcuucugcaaacuuuguagugauggugucucagugucuuaccuuugguuuuguguucuuucccuucucccagguauacaagaagagauguacuuccucuaggaaaauuuacaguuaaccugagugguugcccgcagaacaguaccuucacggaacaccucuaccggaucauccaacaucuugucccagcaguaagauagcauugugaaagcaaugagcaugacagacccaguuauuuuccacucaccuugaguacuaacucuguguuccuugugggucucauuuacaagggacaagaccugucaacugacaucauuuaaaaugcacucuuaacauucacacugauugacccagcacaaauuuguaaguucaaaaauuaaugcaauggcagugacucccuuagaauuacacuuccagucuaugccaguuuguuccuuuggaugcauauuacaccugaggucuaaauaagcuuuaaauuauaugaguccaauuccuucagcugagguaaugaaguggcccaucuccaugucgcaguguuaguugcuauuuggaagcaucuggaaugcacauuuguguuagaaucucagguacaggggacuucucugauaaauaaaaauuuuggccacuugggacuuaagaaaaugaagccagaucuucuaaacagccuguugcgucuuuacuucaagcccugcgagaggccugaggacucugagccacuuacucauugggcugggcuuucacugauuucugacauuagcugaagaagacauguuggauaauucauuaggaaaugguuguaaaauggacgguguuuugcauuuugccaggcucucgagugucuaauaggagaccccuggguuuucauuucugcuucuauauuugccccugcgguucuguguuuuuaucuggucgguuucuuagauggugacuaacugaggugugugaucugaacgccugucuguaaagcucugucuuuaaacaugucacuuucauucauagacccugcaguaggaucuuggcaguucccuaggcccacaucuccugaaauagcuucucuguccucauggaauuuuuuguuuuugagguacaucaagaaaguaauugcuggugugugcuuuaaaaauucucggcagaacacugaaacccuggaaauggaauaggaggcacugccaguggacacgugcccaucucuccaguagggucugagacuuaaucuggagagcagaacugguggcugccugugggggcauguccuccuacauggagaacuggagucagucaggagcagcaugggccuguaagggcugccagcagaggcugcugcaguuacaucucccagacacaagauggcgccagagaccaucuuucucagcugugcagccaggguuacauccuuacauggggaaggguaauuggaggaaggggcuuagagggucacuuccuuauuuugcguuucauugaccaucuccucucucaccacccuuagugcacuggcaccagcccuucucagugcucuucucucggaucagagacgcggcuuuuacugcuuguuacauggccaagucaggcucagccccagcacauggucacuuuugaaaaauguauaugaguguuuggcuugcaugucugucugugccacauacacaugucugaugccuguggcguuagguccccuggaacuggacuucuggaugguugugagccaccauauaagugcugggaguaaaacccguguccuaugcaagaacaaguguccguaaccacugcccuccuuucuaagaguauuugagccaaaguagaaaagucucuaaauuucagcuauaucucuuccuucuucucucacugcaugcuuuucugaaggcuggaacaugcaugauuuccaugcaacuagagcagacagaaggaguugagugugguggggcuggaggcaagguuguggaaggucccugcucugaguggaaguguugauaaugaggucugcagugucgugccauagucuaguuuaauuuacagagccuuuucucuucagcgacuagaauuagcagucuuugucuuuuacuagcuccugucucuuaaugaagucuucuggcuagcugauguuuggcuaucugcagcugucuaccaguuuguaucucuggcuggccuucccucuccagugugcacuagguuggcugaaacaugggacauaagcagcuauggguguggccuggaguuuggccacagaguugaaaagaccauuugucucauuucuuagaaaugauaccauuccaugugagacacaagcguuuugucucuaaauacguguuguguguguguguguguguguauguaucugugugugugugugcguguguguguguaucuguguguguuguguaucuguguguguguguguguguaucuguguguguguguguguguguguguguguaucuguguguguguguguguguguaucuguguguguaucuguguguguguguguguguguguguguguguaucuguguguguguguaucuguguguguguguguguuguguguguguaucuguaagaagccuggaucuuugcuuauuacaauuucugucucagucuuuucgucuacagaugacaauagaaaacaugaaccaguugaagcucauuccccacaaagacuacacagccaaccgacuggucaguggccuccuucagcugcccaacaauacuucccuggucauugacgagacucuucuggagcaagggcaguuggacacgccagguaugcacagagaugcucgcugucuucuucuggcugugcuccgcuuagccagaucuggcaguggcuucuaaggcaaacuuaacauuuaacaaauauuuuaaaaauacgcauuugacuaaagcaugugccacaaacuguacaccaguuguuuguugugaccaacuguucuguuggcugccuauuagcucaagaaaggauagaaaagauuuaaugcaauaguuuguacaucccaugggaacuuucuaagcaguuuuuauaguuucuggaggaaaaauagaucguaugcuuuaaacuaacuucaguugugaaacuuguuaaaaaaaauaacaauagcacgcuagaucauguccacaugaagagagggcagguaacccuguagcaagccacagaaagagauggaaaaacaaugaagagugggaacauguaaggcaaagaggaacaugaaagucuagcagaggugguggcacccauuugcaauucugucaccuggaagucagaggcaggagaaccaggacuucaaggccagcuaggcuucaucagauccugucucagaaauguguaaauugggaaaauucaacaaccuuacuuucuaaagaaaugguuuucccauauuacuauagccaugaccuaggaaguaaugaacuuaccagaguccacaaugggugaguuuuggcccccagaaaguugcaguuggccuaauacugucuguggaguucauuacauaguuaacauuagauuuacugacauucuccuuaagauugcuggcuccugugucuuuuaucuaagcagcagaaaacacaugucuuaaguauaugucacaucacugccagucauggucuuucucuuccagguguucauaacguaacugcccugagcaaccugauaaccuggcagaagguggauuacgacuucagcuaucaccagauggaguucccaugcaauaucaauguucucaucacaucugagggaaggucacuacuuccgguaugauggcugaggguuaaguggagggagguuacacuguaaagguuacugcugucccuuuguccuuuuuuaucgguuauauugucuguguaugcaggugcacuugugcacauguaugucauggccaggggucacccucgggaaccaugucgccugcauugugagacagggucucuuacuggcuugaacuggccaagagugaguguagcucagugggagaacauuugccuaucuuguguagggccuuggauuccauccauagauuucaaaaaggagacugaaauuauuauuaacaaggaaaucugauauuuucauuuuaccuccauguaaaguaguguaacugucaagaaccagcaaaucccaagauaaccgaagcagggcaggggcaccucucguaucucagcagaguguaggagaugccuaggaugguggugcacaccuuuaaucccagcgcucaggaggcagaggcaggcggaucucaagcucaguucagaacagugaguuccaggacagccgggucuacacagagaaaccucgucuuugaaaagcaagcaaacaaaaaggaguagaacugauuccccguaauaauccaaacuacuguccuuacugccuuuguccgucugucccugucccuguccccgccccaaguuauauaguguucgguaaguuagcaagaaauugauucccucugggcuuguugcaugccucuaaucccaggacugugaaagcugaggcuggccagucucaaguuggaggccaucaugaguuaugcaguaaauuuauuauuugaauguuuuccucuuuucauucaucguuugggguuugggcagugcaccagcugcuguguaaaggcuggaggacagcuuguaggaguugguuccguccaucuguguggauccucagaauuaagcucggaaucacauugcaauugguuugugucuuaauccagacagauugagcacacuaagguuuuaaaaauaucccccuccucaacucguguuuccuaauucccuuccacgcugagagccgccgccucugagguaggcagcugaaggaacuuggggaucauggaucuuccucuuuccaggcagacugccagauucaccugcagccccagcugauaccacccaacauggaggaguacaugaacggccugcucucagcugugcugccguccgugcucaacaaguuccggaucuaccugaccuuguugagauuccuggauuacaaccuaucagacgacauaaccaagguacaccuagucaagcaagacuccuguuaccuucugggguucaugcaacuuacugcaguuacuugcuaggcaggguuaguguugggcaacucuagucuucauugugcucuucuguuuaaaagagauuucauuuuuugugcuuuuucuuagcagccuccuuucuuucugcauuucgguuguuucuguuugguugguugaaguauuuucacacugggagccagccagccccuuuaugucagucagcaagugcucuuccucucaucuccagcuccugccgcagccuuguguugucccucacuuaggccugacagauggguucacuacauuaacacaaacgaaucugcugcuuuccaggcuguuccacagccccccagucacacuaggacuuauuucacaggugcuagccagugucacaggacacuuaguguaucaucuuacuaauuaucacuuugugcuauugucuuucaaaccagaggggaaagcugaacaagaaaauacaguuuguguugcccuucugaguuguuugugguuuuacuguauagccuaggcuggccguagacuuagaagaaauacauggcuauaggcagacaucaugcauagcuuuacacacuggucaggauuuccuugugcagcugccuaaaccaagguugugucuucugugacaacuucuucaagcuuuuucugugaccauucuuuuuuuuguccauuuguuuuaugaugcuggguuucaaacccagggccuucacugugcuaagcaccuaccacugcucucucuucugaccccacugaucccacugugcagaucaggcuggccucaaagucagagagaucugcugccucugccuccuuagugcugggaucaaagcucuuagcuauuccaucgucuguucccuucguguuccgcucccccccccacccccccacccccccguucugucagcaguagcuguacuccuuacaaacaugccucuaaaacccagaggaguugucagucccgagauccuauugucuguccuacugaguuugcgugcuucuuaaugugugcauuauuuuggucaagucuuuagcacccuguuaaagaaauuguuaaucccaauccagguuucugccuggccuuaaucauuuaguucccaauaaagccucacacaaccuuuauauuuacaauaagcuuuaaauaccacaagagcugggucguuaucuacccucuaugccauuagaaucuaccuucuaucguuaaccccuuguuauuacuauguuucaucugggaugcucuuaauuccaauuggccagcccucagggccacauuuucaugacucaccuaacucauggcaacuuuaccucccuucaccgucuucucucccuccugguucuccuccccgcccccccaacccccaccgcaggcccaggagcccugaaaccugccugugccucuucugcccagcuacuggcuguagacaucuuuauucagaaauaacuugagggcaaggucacauagaaucacuugggucuaugugcguagggacucuagggcaaccagaucuugaggaaccaauauuaguauuagaauacaaacugcgucaauccacugcagcagccuucaaauuuuuaggggccauuguuuuugguuuucugucuuuuuuuaguuccuuccugcugcuuucucucccacuggcccucauuacacuuacgucaguacauuugauggugagcugcggaucuuugaagcugcggucauuuucccuuauuuuucuuucugcuucagucuaaaaagcuuuuguucaccuaucuugaaauuugauuaauuuuugugccugcucaaauuuucuacaauuauugcuguuaauugccuuauuuuuuauuuauagaauuuccuguuugcuucuuuuucaacauuauuuccuuauugauguucucugcucggugaggcacuguucacauagucuuuaguucuuuauacaauagucaccccuuuccaagagugaugcaugcuugagccccaggaagugcuuuuaacuggagcuaguaccuggucucacguacacuauguaagggaaacauaaugguguauagauaagcuuaauguauauagcaagcuauucgugguaacaacagaggaacagcgauaacaggcuucaaguaagauuaggaaaggcgggcuggugagauggcucaguggguaagagcaccugacugcucuccgaaggucugaaguucaaaucccagcaaccacaugguggcucacaaccaucuguaacaagaucugacccccucuucuggagugucugaggacagcuacaguguacuuacauauaauaaauaaauaaaucuuuaaaaaaaaaaaaaaaaaaaaaaaaaagauuaggaaaggcagccuugcagaucagagcagcagcgcaggaacuccagcccugccuagaggacaucaccugaggaggauggaguguguaacaagcucagaugucacagccucaauacucuuaccaagagccacuguuuucuuguauaaaugguacccaagauacuggcaguuuccaugguuuugacagagcugagugcagccauuguacuugcuguauugggcccaggcaggucuguaaguuaccguccccccgcaccgucgccgcagagggugcuggcugcuaggcuuguucggcaucucaaccgggccaagcugaauguagaauguuuuccguguugcauuuuguaaugggccuuaaguuuuguuuuuucuaccauuauuuuuaccucaaucaaggaucauguuuccuuuccucuaaaaaguaagggaauuguuuugaagggacacuuuuacaaguguguugcucugugacacaggcgguugaagaugauuuuguggaaaugcguaaagaugacccucagagcaucacggcugaugaccuccaccagcugcuugugguggcucgguaagugcgcugauccaggucaccucagcugccggcugugugcauuugaucugcucagcagugucugaggcagaauucuaaaaacaaaggaacuucuccuuccaaagacaucgagaauugaacagauggacaaagcuuuugucugaagauuguaguucagauccugcuuaaaauuuggguauguguagccgcggccacaaggaaucccagugcagacacgcuggccuagucaugcuggccuagucagacacgcuggccuagucagacacgcuggccuagucaugcuggccuagucagacacgcuggccagcacugagcucagugaaggagagagagugguuggagaagauuccugaugucaggcuuagaccaccauaaaggcacagacaugaaaguuaaaugaaaagacccacccagugugagugcuuguugaggguuacucaguagaaccuuagcgguagaccagccuugcucucuaagcuugucagagccagccucccucuaauucuagcucuucagggacuucuuugugaggucacacuuggccuuuauguggaccaagcauuuacucugauagccuccugauagcuuucaaagcuuuccuuguuuuuuugguuuguuuuuuuccaagauggcagugagguagggcagugagaaagagagaaggggguggacacagagaagaggaaaagaagagagugaguuuuccuaguuccuuccuaacacuagguaacuuacuuuaaaccagauuccugucucugagcgucggucagacaacacucuccagagagcgcuggcucagagcaaagcagcuggagcucuccaggaaggcccggcuucagcagcagaagagugugaaugggaacgagcuuuagagcgccgagcgugcagggaacggcaagcuacggccucugugcgugcaguccacaguccuuuacaccacauuguuuuauagggaauuuguauccaaaaacacagugacuuuuccugaaaucaagucuggugacaccuaaaguuuauaugauucucuguaaggguuuuuaccuuacugguuuuauggaguuuuggaguuuguuuuauaauuaguuaugauguacaaaaauguauuugauauuaaagguuuaauaaugauaauguugcugaucacaccauuuucuuagccacagcuacaucuuaggccagacuaugaagugccagcuuccucugcagaguuauuugaagagcuguguuaauucagaacaggucugagcgacaaguucgagauaugacuucuguagugucauuuucuacacagcugccacagacgcaguuucccacgucccagcuguaccagccggcagaacuggccuuucccagaacagguggcgguuccuggcuuucagauuucauagacugguaauaccuuucugagguaggggugccaauugauuuugccaagucauuugaaagaaaaaaagaacaaaacacacugugaucacuauuuuguuuucauaaaggacauucucagaacacgagcaucuuuuaauggaauaaaugcagcuuugugaagaccaccacauuguccuuaacuuuucucaucuccugcaucugucaucugcaacugacauauuaugggauugaggggaacacugccccauggacccugguccagacaugaaaaaaaugcuacuuaaacagucaaguuuucgggguggggaaccaucuuuuuuuuuuuuuuuuuuuuuuuuuuuuuuggugcugcuuaucaaacccuggcuucucauacaugcuagagaaguguagucucccuggagcuacauccccgggcugugcagggugggauguuuuucauuuuccucauuauuuaacugacuugaugaauguacugcauuuugagcuuuuaauauaaguaacaccauuuacuagugcaguaaagguccauccaguuacagguagguuuuccucugaccaauucauuuugauauguguauuuucaaaugaacaaaaauguuaguaguuauaauuugcaaguuaauguaguauaauggcgauuguaacaagaaccuucagaaaaguuagaaccuugcuguuaaucucaucugcugugugugaagaucaaucaguggucccuuagauucuucccugcuaaccaaggaaacagggucggccuugauaaaucaagggaguugccugaugaaaggaaguacaaacuacuaguuguucagcauucuuuuccuaacugcaaaucuauuuuuauaaguuaauguaaauaauguucauacuagaauucuaacugguuuucauuuuuauaacggguagacagaucuuccuuaaacuuuugaaaauaaaauguucacauagauuuuugaaaaugcauuuucuuuguccuagaacaaauuuuuuaguuuuaucuugucaaacuguaccaauguaaaccguaauuuaccaaagagaagucauaauuuugcauggucuuacagaaaaguucccguaaauaacccuguccaguaaauaaaacuuccaaauugccaggaccaugggccauuuuucaugaauuagaaauacaggagagcaccuccucaagcugaacuggaagagacgggcucugcagcuuucucagccacacacauguucacuucuguagcucugcagcuuucucagccaccgucucccccucgcccucacacacauguucacaucuguagcugggucuggaucagauuguaacccugaccaggcagcuaggucucuuuggaaauaaccauugcuuuaacuucuguugucacaucucuucaugggucauuucuuuggaaacccaaacaugcauuaucuucccaucuggccuggcuuaauacuuaacuacucugaagacccuaaagaaaaaaaaaaaaaaaaaaaag

SEQ ID NO: 4141 - RNA, 1181 nt, Mus musculus
ucuuuuaauacuucucaguuaucacuuauccgguguuaaauacuuuagcagcccacggagucacacguacauggcaaacauauuuuucuguuugcagagaaggcacuggacacaggucugguuacugcuuugcugaaggucuuucauuuuucaaggccaacgugaggggguugggauacaaauaccagaugggcaggaacagcgauccucugcagagugggcuagagggcacucuggugccugguggcuccagucagcgcugacuuuuuaagccaggcuuccuaucucugaagaggcuagcaagauacugcaggugcuccagauaagcagagagagugcaggggaagggacagaaagguacaggggcuuuggaagaaaucaggcuggaggcaggcucggcucccacucucagcucccacucucagcucccaguccucauguuggacggugaccugugacccuaucuggaacgguuuugcaggugagcaggacugauuauuucugucaguauaaaaggaaaggcaaaucggaagcaagugagcaagacacaggccacacugcccagagucagcucacagcaaacacagagcagaggccaucagcuccugcaggcuguguggacaagaacccugagcugugagcauccuuggacagugacauuaucacauuaucacagccggcucagcacuuaccuagugaguguacaccaggugacaaacuggcagggagaagccacugacugucucaucagggaagcccuggggugggcauuugggguacucugggcacaggcuccuccccugggaaggaugugggauagcgaaugcauaggcaagcugucucacugaagcuggucucgcugguguauguggcuuucucuugccuugccaaggucucagccgagaagucagccugccuggucuccagaugcccucuccaagggauagcacacccgccaccugccugagcugcagugagugaccuuauacacagguggggaaguugggugucaggguccccaguucuuggucuagucauggcagcacagagagacaguggucuuggccucaagccaaaaggauaugccccauuccuauuucuuaaggaaguuaggcucccgggggggccuggaucuugguuaccuagcaccugauacucugugugacucccuaagucuacug

SEQ ID NO: 4142 - RNA, 1265 nt, Mus musculus
ggagucuucccuuggaaagagcacagcccagucuggagcacaggcacagcucaggaggggugcaaggagccaugggaccucucaggagagaggaagaaacaaaacagcagguccaggagggaacuuggaccaucagcaacaaaagaggaaacauugcccuucacuaccaaaccucaauccaggacacagaaguaaguguacgggaaugaaugaaugaaugaaugaaugaaugaaugaacgaacgaaccaagaaggcuguacagcccccagggagccauagccgugaaggcugauauaaugcaguguuuggcacacauuucaagcaaaacuuccacucauuucaacucugaccugcgcuuuucauuucuuauaaggucucaauuguuuuuucaaagccucaaauuuauuuuuccuacuccugggcuucaguacugggucuuugcuggugaagaaauaaaaggccugacauaaccccucuugggaggcaaagacugcagggucagacugccuuagucagaaccauuccucugcaauaaagagcagugcagucuuagggcaggucuacccaaagcucagucuccccaucugccacccaggcaacagucagacucauuaagggcaguccugagagcaucucuccagcaggguaccugaccagugggauguguucaagagaggaagguaccaucaacauagacgcagcagguccacacucccuccuuccuccccgaagggugugccuccccccauauacacacuucuccuucucccagacugugaggacaccaguagaauggggaucaagaaugaacacagcacagacgguagcaagugaugggacaaauguugacgagcacacaggauguacuaggcacgaugcagacauguuuucacaaagaacaagcaagcacagccucuggugauggcuggaauacgguucaucucacaaccucaagcugaagugcaauccccaccaagacauauuuaaaggcggcaccagguggcaccuguaagggcuaauuaaagcucugcccucaggaguggauuaauccauuuaugcaccuaauggauuaauggauuaucuugagaguggaucuguuauaaaagccagucuggcugggucucucacauguucccagucucuugucaugugauguucuguacucguuuguuacuuuggcaaggagaaggcugucaccagaugcaucccuuugaccucaaauggagccaccaaucaaaauaaaccuuuuuuuuccuuuguaauu

SEQ ID NO: 4143 - RNA, 2017 nt, Mus musculus
ggaaguguagcccagucaaaacaguaaaugaaccuccaaccaggccauaaaaaaagauagaugaauuaucucacaagaaaugaaaaauaaucuucuuggaacggguugugggcugcagaccuacacucccaacacugggaaguugaggcaggaguucaaggucacccaugguuauagaggaaguuugaggccagucuauuaaaacgaacaagcaaacaaguaaaagaaucauacgguagcccacuaugccucagaagagcacagauaucugguguggaacagccuguaauaucagaagacaggcugagacaggaggacucuaaagcacagaaaaagaaggccauggccauauuugcccaucccuuccccuguggggaaggacuaccucagucucauaccucuguguugacacagccccucagaguuccaaaggagaagccaagggacuggaaacacacacggcuccgucccucaguaaggcagauacuggaggagccaacacggcugucccccacaaccucucacucacagcagagcauccccagcaggcaacaccagaagagagguggccaagcccagaacaagucugaagccaggcaaaggcagcugaauggcagagagcagucccacaggucccauaugguguauuuaugcaccaagggccaggggagcagguauguaccguuucugucccaguuaggguuucuauuauugcagcgagacaccaggagcaaagcaaggcgaggaggacagaguucaucuugcuuacacuuccacaucaugguccaucgcugaagaagucagggcaggaucucaaacagggcaggggcuggaggcaggagcugauacagaagccaucgaagcuugcuggcacggcuugcucagccugcuuucuuacaggacuaccagcccagggcugguaccacccacaaugggccuacagguuugcuuacagccugauuucauugaggcauuuucucaauugagauucccuccuuucaggugacuuuagcuugucaaguugacauaaaucugaaucuagccagcacaaguaccaacucuggaaggcuucuaagcaacaagcuuccuaacuugaaagcauagaucuggguccagucuccaguacugcacagaacaggccacugcggcccccguaaccccagcacuuggaagguagaggcaggaggaucagaaguuuagcgucauccuuggcuacaaaaugaauuugaggcuagccugggcuauauaggacugucucaaaaaacaaacaaacaaacaaacaaacaaacaaaacaaaaaggaagagaagagaagagaagagaagagaaggagaaggagaaggagaaggagaaggagaaggagaaggagaaggagaaggagaaggagaaggagaaggagaagagaaggagaagagaagagaggagaagagaagagaaggaaagagaaggaaagagaaggaaagagaaggaaagagaaggaaagagaaaugacaccuuaagguggcuucuugguugcuggagagaaagaacagggccaaccuugaaacucuggagcuagcauggacuucauguggccuuggccacaagcaaugucacaggaagucagcacuggacaagccaccugcuuuguggugaaucaaaaagaaccgauacuacucuguaugcaugucagacacagacaaacugagcagaucagcguuucucagucuuggagucuaaaaugacucugccucccugggccuucugggacucuuuucuaagauguguugcagcucccccugguggacuuccuccuccacugcaaaaccugcccaaccacaccuggugcuccuaguguuuggcuagaacaguggcuucuacgcaauccugugcauaugggcauauaaaugacuacauucagacauuugccagcaaccaauuauggagaaguugauuuugaagcaauuuugguagacauauuugaaacuauguuuggugacauugucauuuauuaaagaugaaagcaaauuugcaugcua

SEQ ID NO: 4144 - RNA, 49552 nt, Mus musculus
cgggagcggugcccgucccccuggcgcuucgucaccgccgcuaggccaaugggcuuaaccguacggccgcgcacacucgcacccgcuguccccaagaccccgacacaccgucccgagcgcgguuuuucggcugugguccagcccguggccgucggagucgucaugcagucccugcguaccacgcuccugucuuugcuacugcugcugcuagcggcuccuuccuuggcguugccgucggggaccggccgcucggccccagcugccaccgucugucccgagcacugcgaucccacccgcugcgccccgccgcccacggacugcgaggguggccgcguccgcgacgcgugcggcugcugcgaggugugcggcgcgcucgagggugcagcgugcggccugcaggagggucccugcggcgaggggcugcaaugcguagugcccuucggggugccggccucggccacaguacgacggcgcgcacaggccggccugugcgugugugccagcagcgagccggugugugguagcgacgccaagaccuacaccaaccugugccagcugcgcgccgccagccgccgcuccgagaagcuucgccagccgccggucaucguccugcagcgcggcgccugcggccaagguacccgccccgcccugcgcugcacuccuggguggcuccccacucucgccaacucagcccgaccagucaggaccgucgggaggggaugcggaggugcagagaagcacugcgggguguucuaggcauccaguuagugggagagagagacgauggggcucgggguagcuguguuucaaaggcucccuccggcccuauuucugcgccaagcaucgggucguuucgagaaacgccaagcaggugcuuugcgcgcuuugguccagcacccccuggccggggugacuaggcaucgcgcuggggaaagccgcguaucauaccagggaucuuggcaauguugagauacauggcuuugggaucgcaagaacucuugucgccuucccuuccuucucccuuucugcugaguccucucuucuuggaacuaucuaagcaguguuuuucuuauagaaccucuucgugaaaacuuucacuuuggggagagggaacaucucugcucaacucagcaagcauuuuucucaccccgccuccuaagcagaaaacgauuuaguaacuccggcccucuuccuccauugauuuaaaucaacuuuacaaaaacgcccacgauuugguccuuuuuugguccuuugguccuuuugccugaguucaaccagguaguggaccgugaaauuugagguagaggaggggcccacuggggaugaagaaaaaaaugcacccucuacccucucucuccuugugggaccuuucuguacccacaagagcuggacguggugguggcgacaggguaaaggggcuuggagaacugcccagcucccugcaggaccuuccagagaaaagcuucgguuaaauccagagauacccuguggaaaaacaguaaauucauacuggccacuacagcgcuguggggaccagccagcugggcuccaguacauuuggcuucagcuacagggcuccugcccaaaccuagcaccucccuccccuccgcccccccaccccccaugugguggggaggacaggaaagcacgggagagggaaagagagauugagcuagauuuuucuuuauaggaauauggucgccuaugaccacuuugaauuuggcaaaacuuuacucgaaugcacaggaaaguacuccaggugguguaggaagaggugggcugguguuuauauucuuaccacaggagcacaggacuggaccucagucccaggaaacucagccuccauagagagaagaaaaggguuuuuguuuguuuguuuguuuguuuguuuguuuguuuucagagaggacugaucccggggucccuaccuacuaagucccagcccaugugacaagugaguuauccugugacucuauuuggucuccuagacccgggaggaggaagcuccuggccucgucuuugucuuagaugagguggaacuggggaugaauaacuuguccaaggucacucagcuggaaccugaaugcuggcaaacucagaacaggccagagcuagaccucaaggcuaugggaaaugggcuuccagggggcuggaccagccaacucaccuuggggagagguagagaacuauguagcuccugaguggauacuuugagguggagaauagauugguguuaguuaguuaguuaguuaguuaguuaguuagacagacacgggcagaagugacccacagugguggcucagaguccccuggggaggaaguagugugucacacgugcagauauccuugaguaguucuugaauaggcucuguucagaggagggcuggcguagaacuagccuagagggggagggcagaagguaggaaucugggcuacuuucaccagaaucugagugugcacaggugacauuuuuuuuuuuuuuaaaaagcacauuuuggugggaaaccagguagcugucacucuuuguagucuugcugcacaaggccaggaguuacagacaucagcagaggccaaauacuuggcugguugaguuguauuggggagacagguccuuuguuggccagcagggccccaguggccccuaaguguggagacagccacagaugaagcauagagcuggugguagccaucuccccuccuuuuguaaauaucuguugcucuguaucacgucugacaugugugccugguacuuagggacagcuaguuacgugggaggauggauagaaagacaggagauacuuggcguacacagccgacccucagccuggcuucgcccugacucuccaucugaggcugucuuaaggucccaggagcagagucugugagucagugagcugcuuucauucagucccuuucuggcccccgcuuuuagcagcugguguccagggacagcuaguguacuugaugucacccuugaguaaggagaacuggcugccugcuucagagcaaagugcaggugggaguggcguggaagcuggguggacgaagagaaguaccccugaggaggacaugaagggaauccacugugagaacacacugaggccagagagguccugaggcaggaucugggcagaaagcucaggagaugggugggaauguggggggaggcgauguccaaggcguugcuuuagggggucacgauggccguuuggagagagaagaugccaucacucugcguaaaacucuugucuguaaguugguuaaugaaaaaucagagaccauaucuuguuuggaaauagagagaaauuaccagugcuccagaguguggcugagacaugcacaaguauaccagaggacaaggaucuguuauuuacuacugaccagaacauaagaagaaauaaaaaaauaaaugaauguggugguucacgccugugacucuggcaagagcuccauggguucgaggccaguuucggcaacagauuaaggcccugugucaaguuuaaaaacaaaguuauagucauauaggguaacagcaacaaaggugccaucugauucguacuucuucuucgggcaccuguuuaccaggccguugguucugcuaacagugccaaugcuguaauucucuuggugcagcugaccaucacacagcagcaccuugagcucauguguggaucgugaaccuguucauagccaccgcucugugcuguugacagagcaacggagauuacaaaccagauccagcuaaguagcagcuaagagcugaaguaaacagugcuccagauggccauggcuuugggacgacgacgagggaugacucucuccuuuaccaggcacagaaaucaggacaaaguugccuuuaguuacugccucaggagaagcccagaguauaagcaguuguagaaaagauguuuccagcaagacucccagacggguaaacuguucuaggguaagaagggcccuuuuggauccugagacacuuuugacuaaccaacaugugaggugcugcaucuaagaaaccaggaaaaagacucuguggauaggagaaacuuagucuacccauuccuuauuccaggaaagccauuccuacccaagacauccaaacugacaagccuagaggucuccaagccucauguggggcagagguggccuggagagggagagcuagagguuuucagaaguuuccccuccuggccucaccccggagccucugauggcagagggcacagaacagaacucuuggaggcaugaacuauuuauaaaauggacuuuauuuagguaguucuuuuaugugagccuugagcaggcugucacugugagcuuuagugccuggccuugcuggccucagaagauucaagaggcagcauaaaaucccuccccugaggaagcucguaguuaacacagugcgggcaaagacagucacucauuccuggagucuguuuucuuucaucuacagugcaaguuuugcuauuggcaguuggaugcacuuuuugucucuuaaaaaaaaaaaggauaugggguggagaugaaguuucaucuuaggaucggguugguagaaagcaugaaugagguuucugccauccuaaacuggcuuuugaacagcccaucucacuggcugguaucuuucuucccuuaaugcucugaugguuugcuaaaguguuaaauagcaaggcuugauaaaauuaggauggaaagccaggcguuuaguuuacuuuaucccaucccagggagcaguaaauacauugccuuggaacuugagcgagaucggucagggacggcgggacugugagcuagcuggccagaugccugagcacggcaggaugaauucugaguugguuuggagccuggugauccugggcaaauucugugucuuggauucagacaucagauuuuccaugggcuuacauuucucauggacaaagcucuggggccggaugcugugagggaguagucacacuuggcuuugagugcuuugaguaccgaccccuggcucuggccugugugggucccagcuccucuggcuuucagggccacaccagugaagggucugggucaguguuuucugagaucccuuuuagugaggguggccugugagucuuguaaggaaaccgccagucugugaggaggcugugcuccuguaucccuuucaaaggcuuggaugcccucagagaugcucgccgccuuaaauuaugauggcuagagccaaguuuggcauugaagagcuguccccaucuugaccgaagccaccuuuacuucagcuuucagucaacuuaugagucuuucugugagucagugggagucauaugcccacucccaagaaccaaugccacaggguaauucauugcuccucucugugaccuugacccuuccucuugguccuucugguuaagguuccuacugagcuguuucuuuggcuuugccauuuuucucugacauuagaaaagcaaaaugcauccgacagagaaaccgaagaggguaguagaccacuugaauguuucccuaaagacucagcaacuuuuggaaaguugaugugacucggaccuguuaaaugaccacgggauuauguuagacgggacagcaugcuucagagacagacaugagugguaauggggguggggcaguuagaguaguggaaggacagacuucagcuuucagccagugaugaacaucccaaauccauccaaaacuuacuuacuuucuuuccuuccuuccuuccuuccuuccuuccuuccuuccuuccuuccuuccuuccuuccuuccuuccucccucccucccucccucccucccucccucccucccucucucucuuucuuucuuuuuuucgagacaggguuucucuguguaguccuggcuguccuggaacucacuguguagaccaggcuggccuccaacucagaaauccaccugccucugccucccaagagcugggauuaaaggcaugugccaccaccacccggcacuaaaccauuucuugaacaaugucuguguacucagaaguauggaaaguauagggaaugagaggccaaauuggcugaccuuuuuuauugaggcaagaggcuuucauggcgccugacugugggccaagcuuccuucugaguuucucuuucugaauaugugacugguuuccccucuagucaaacaaucguggcaauaaguguuugcucacacuucuuagugcuauuagcauggaaggaccucguuuccugaagugguuaacaccaucugguguacuucuagauagaacucuguccugucagcuguaaugauaacccuggucaugaccaucccaucaaagcuccagugagguagucagacagcucagaagaaagggcuagaaugucuguccuguggaacacuucggauugguaaauuggguggguuaggaaagaugcacagagaaggggugauggaaacgcauccugaggcugacauggaguuugcuugucuggaaauguucucuggagucaaaggcugcuuuuccauagccucugacgguccagucccagccauuaccccagcauuaaucuucugaaaaguauaugggcuuccucugagguggcugcauguguggggaaccugggagugugugugcgugugugugugugcgugugugugugugugugugugugugcgcgcgcgagugugcacagagaccaucaguacauguuaagcauuuuccucugucauguucccccaccuuauauuuugagauaggaccucucauugaaccuagaguucauagauuccgcuacauugccuagccagcaagccccacagacucuccucagagcugggaugauagagguaaggcuuuuucacaugggugcaggagauggaaguggggcuucaugcuugugccucaguuuacugaccugagcauuuccucaguccuuacgacuuuuauaagaacuauuucauuuccuaaguuggggccuacaggagauggcagucaacagacacucuaggcccuucuugaaccugguuuuguuuuuauguucuggaaauuccucauagggaaaaaugugucaugucuuaaggaaagaggggaaaaaauaacccaaacaguuugggaguuuacaaaugcccuauuauuuugauugcuaggacaguuuguugaguuagcauauuucauacaugguccuguauagcauugcuugacagcaauugcucccuagccacaggacaggcacauuugugcacugaauucucggagggcugguugucgugguuggaauuuucgauaauuuccaaauuugaauaacccaugucuucaugagucagagccuugugcaauauuucagacuucaggaacgucuucuucccugguugcgcaaugagcucucuagaaggaaggagaugcuaggcugccuguguaaugaguguguuugucucagcguggaugagauguagaauucccuucuacacagccuuggacaagaugcuaccugaccauccaauacucgggcaucucacacccugugacuaaggcaaguucucuauuuggugcccauacucaaagcaggagucaucacucuguggacagauggauacagauuguugccaguugggguugccucaguacaugccagccagcuggauaugggagagggagggcucaugcagaaguaaacaucugcuuuuuacacacacacacacacacacacacacacacacacacacacacacacaugcgcacacacacggugagcuacuugggucaggaugagggaaaugucaccaaaccacagugaucuaaagagugaccaccacuguucuaacugggugacagaccuugucuuguuccgugguagauaccgggaaggccgccuagcuauagaaacaguagagguuccaagagguuucauccaccuggggccacccacuaaggagagagcuaggauuugaacuuggagccaccucacuaccagacuggggacuuccuugacucgggcuguuuaaaagcaugcugauuaaucuucaaauauuuggagugcuuuccagccuccucccuuuucugacucucugguugaguucugcuguggagaacaugcguggugauuuccgaucuuuuggauuuauugggguguauuuucugaccuugacuguggucagcuggugacugcucccgcugugcuuccgaagagcguguguuccgcuguuguuggcuggaaucuuccaaauaucagcuguaagguauugguggugcuguucagaucaacuagacacugacuuugcaccucuguugacaggguccgagagaaggacgccaaagcacccucagcuacagucugucuucugggacuccauuuuaggaaacuggaccuccucagccccacccccaccccggcacgaguuacucucuguggucuguuuccugguguguugcuuaaggauaaugauacuggccuggggaacaucagcaggguauuguggggucagauaaacuaaugagauagugaaugaguuuugucaacugggacuaugaaugauugacagauaccuggacugcuggacaguagguccagacucuuccagaucucuugcuaacaaacaaacaaacaaacaagcacccaccaagacugauccagaaaagauagaaaaguaaggggcaugcuuacugggucacucugucuacggucacugucaaauaccugagacuggguacuuuacaaaaaggcuuauuccccucacuuuucgggaggugcaggcguaagcucgagucugguagagaugucauggugggugguaccaugggaaugugaacuggagagaucaugagacaacauggaagucagagaggcuuguaagagcuaaccagggacccaggaaaacugccuuauuucccuguaagggccagacccucccaguuauccaguugcuuccuuauaaggcccugucuccaaaauguuccacguuaccuccuaacagcaccgcauggggagacacguuuaaaccacagcacucacucaucguugccaccauggagucugcuguacuuuccgcuacucaucucuagccacaccagcuccucauuuucauguucccuuagcuuuuguggaccaagacacugccuuguggagacaccagaggcuggccaaagccaccaccuaauuguggggaagacaguaucccagagcaggugaccuggggcugaaaggugcuuccggcuuacagcuccauuccucacacugugggugggaaagcugaggcgccggaagggaacucacaagcuguguuauuagacuugcuggaguuggagccuggguccuggcagccuuaacaaacuacuuucaggugcauguucuuaauaggucaguuaaagacacaguagugaaaagcagaaauaagauauucaguguggccacauggggaagaaagaauagcccagugacccuuccuguugauccgugggaauucugacaugagguuuagauuuauuuauuuauuuauuuuaaaauuuuauuucauuuauaugaguacacuguaggugucuucagacacacaggaagagggcaucagaucccauuacagaugguugugagccaccaugugguugcugggaguugaacucgggaccucuggaagagcagucugugcucuuaaccacugagccaucuuuccagcccccaauguuucgauuuaaauagagggucagagguaugcagcguaagcaguccaggucaugguguggucccaccaucacugacccauuauugucucugcuccagucuuacuggaaagaugcucucacaugucaggauugugugaaacucuuuccggaaggcaaguuccuccucuggauagcacugagcuucacccuuuuucaucucucagcaugagauuccuggggacauuccaacuccuugggaaccauuguuucuagaguaggauagccaaagguggguagggugggguaaggugggauguuacacaauagacuuuuuagaauaucugcauaucuggggcuggagagaugcucaguaguaugaauuucuuuugcagaggacccauuggguucucaguauguugggugacuuggaacugcccacagucuggauaauccaauaccucuucuggcccucaccugugcaaaccccacacacaugcacacagucagaaugguuccagcugcguauauaugugcagccugguaggagccgacccuaagaacccaucuucgcagccuccuucuggaguggcgguuagguguuuggaggaggcugggguccacaugggcgauuuucccacgaggcccgaggaacaguaggcguucucacucagucucgcuuuucaaaauggcaucgaagagaucuuauuuuuuccuacuugaaaagaugacggcaguggacugcuuggcaauccgugugguaacugacuucucuccucaggcauuuugaggcccuggaauguugauugcaaugcacuugccucagggaaacaucugcacaaauauccuagugaaugagucagugcugaggagccucggugucuaaaccuaucuaugguuugaacuuggucaggacgagccugcuuucuucucuucagacaggcuuggcuucuuucuuccauguuauuuagccaucgugggacucccuccauauaucucaugaugaucuaaaguacuacucuaccagcuuuuaggaaucagagucauaaucacaucaaaauacacaagggaagagauucauguuccuacggacucaggcuucacccccccccccccccgccucaccucuggagaccauuguugcauuguuguuagcaggucaaagauuucauuuuaguguguugaacucuuucaggacagacaguaccaaguaugguagcaggagaggaguggauagguuugcuguagcccuugguauuuauugucaaacucuuuucaaaggguugcuacaguccauugucaccagugaucaaguguuuguuaggagggagugugaaugucugugucugggauucuuauguacauaccuauuuguggugguccugaguucaggggucaaucuuggguguuucuuuuauuuaaagcuuuauuuauuuagguauuuuaguguaugagugcucugucuacauguacagacagcacaccagaagagggcaucagauccuaugauagaugguugugagccauccuaugguugcugggaauugaacucuggaccucuggaagaacaaccagugcucuuaaccgcugagccaucucucuagccacuugggugucuuuccugagugcuaucuugguauuuuuugagaccugggucucacuggccuggagcuugccauguaggcuagacuggcuggucagcuugccaagggguccaccuaucuuagccuccugggcaucugucccugucuucuuguggauucuuggccuugcacucagauccucaguguuuguguagcaagcauuuuacugacugagcuaccuucccagcuguggaaggucaccuucccaaguugcugaaagucuacaagacauucccuugaaggaacuccuucaugauaaguggcagauguggguccugagccaguagaaccacucagucuguagguuuuccuguuuguugccugucggcaccuuuaucuccagguucaucaccgguaaggggaagucguguuugggguagaaugagcacuuaaagagauuggaauuaucuggguucgugaguugugaccauagcucaucuaggcugaaaaggggcuuguggcagccacaucagccuucugguuggucgcuuguauuuucgaugauguguuuuugaggagccugggucaagugaggggaugugaagguccagggacauuuacccaguguaugacagaaaauggaagucgcugggugcccagucagggcuuacuaaguagaacuuucuagaugcuaguucuuuccaggauguggacuaaggccagaguauuucuguuuugaaaagugaaaaaugugcuuauucagauguuuuggacgcaugcaaggcuguaaugugagccacauaaacucacuuugcuaguucgauaguuccauucaaaaagaaaguagaaacaugacauuauuauuagcuuugauuuuaaugacaacauuuucaagacauaauucacauauaggguuuuuauauguccuuggugauguggacguaucaucccuaguuccagaauauucucacuaccucuaaaauaagcauagcacccauauuucccuuugccuggcucuagccagcuaccagcuuacuuucugucccugggaauuugccucuccaagacauuuucuacaagugggguccuauaauguggucugcugugacuggccucugucagauggcaucauguuaucauuuuuaugacuaaaaaaaaccuucucauugugugguuaugggaagacaucucucccuguugggggauacauaaacucagcccugaaagucacuuugacagucuaaacugcucagaugguauuaauguauuaguggcuaugaaaccaaaauuaaauauuccauaaggcugagaaucccacauugaaaagaucacaaacuguacuuuucagguuauuagaacauacaacuuuuuuguaauuaaagaaagaauguuggaaauggucucgccgcuucccucauuuaaccagcaagagaccuagaaagaggaagugcuuuguuucugaacccagccccccaaccccaacccccuuuccuucugggguacaucucagguuuguaagacccucugcugucuggcuuguccacaggaacugcagcucauuggcaagcgggcauuggugcuucucugggcucuagacccaguuuuccugccucuagagaaacagccuccugggccccaccucccaacucugccccggagguuggaguuucaggggcugagcaucuaggcagccccagacaaaacaaccagaggaaucaagagcaggaagagagcucauuugagaagucugugagggucaguccuggagccagacucuuaucagggaaagugguuggagguuguaggaccugagcugucagcuguuuuccugcaguuaauaauagacacuugcaggcuguucagagacccaagcauucaccaugggcacacgaacaagguuacuaucauuuucuuucucuuguccucgagacggaugcaacuuguuuuuuuucuuuuuucuuuuuuaaugaaagcaucauuuaacguagacacaugcuucuauaaaaggcaccuuuccccaggaaagccaaagcuacagaauuagguugagcuugugagucacagcacaauuaggggcugcgggccaacuggccagaugcccccaguuggguccugauguggccgguggugggagacagccuuagucuuguuugggugacccaacccccuuccuucuaccugccaugagugaguggcugggcaccugggcugcagccuuauccuagcccgugcaagcagucucaugcacuaccuucagcagucacagccugaggucuggcauagggcaagcuuuucccacguggagccgucugggagacuguaccggaaagaggggcugccagugcuuggaagugccagugugggcuggaaaucaaggccaagcgccuuggcuccaccuccucuuccuucuuuauucguuaggaggaaagaaagaggucacaggaaacucuggaauuuuaugcaaaagacaggggcuggugcucucccccucucucccucugcccuccucccuuccaacucccucuccccuccccucccucucccccucccccucucucuccccuccccucccucucccccucccccucucucucccuuccccucccucucccccucccccucucucuccccuccccaucucucucacagggucucaaguauccagguuguccuugaacucacaauuuacucaugguuggucuugaauuuuugauccuccugcaugcaccuccugugugcugggauuacacacggugugugaauuggagauuaaacccaggacuuugugcauacuagacuguagagagaauaucuuguguauuguauggaugcaucaccugucaauuaaaaagccuguggccuaugguuuaggcaggaaauagaggcaggagauuggccaggaagaugugaggagacugaccaugguaccugagcacagguuagcagucacguggcagaauguagauuggaauaaauggcuauuuuaaguuaugaucaagguauuugcaaauauauuuugaguccgagucuuauuucugggcgcauggggcugggaggaagagccaggcccaacuuuaacauuucacauucagccaacuacauuuuuugaugguaggaaagaaaaaacaaaaacaaaaacaaaauggaaccagacaugguugcaaaaauuuguuacccuaguacucgggaggcagaagcaagaggauugccacaaauucagccuggacuacgcagaugacugcccccacccccaguaaaaggaaaaagaagaugacucaguggacaaaauccucauugcauagacuucacacccugaucaugaaggagcguguuuuuccuguccccuucuuguaccggaugacggcacaggguuuuggugucagguucaucuuagaccuccgcuggcugucucugcucuuuuugugucuuuucucugcccaggccccucucuucuugcccuuauccugugcucaacaaccuggaauguacagucacagugccacucagaaaagggauucuggcuuccuggaacguucaaggucuucuuucuguuucugcugccuucccaccucagacccagcauuggauccaggcuggcuggugacccuggaauuuaacagagugggacauacagaacacagccauccagacugcuaugggcuuaugggccuggugguucaucuucagugcgauucccggguuauacucuuucuuauuuuucuuuccuucgggcacaggaggccuaucuccuauccacuuuauaccuccucagcucuacagauuucccugaccuucagagaaagcagcccaaggucacuggcagagggagagcccugugagcuucccuuggacccaugccucuccuuggagcuuuccaacccuccuccugauucuucucggaucuggacuuuggcccuuggccucccaggccauucucaaauucagcaagaacucucacaaagggagcucuuucuuggggacaagucgcccgucccacuccaugauggugcagcaugccccuccccaucugucccccucucuggcuuuccagcacacaccccuccccagccgcagguucuggucuugucuugacaugccacccauacccgcuugagucucagcugcuuguauucuaucuugucaggaaagucccgggguuugugugccauguaaggacaucucaguguuuucuuuuuccuuucagggacucguugcuuggugcccuuggugucaguugauuugauaccacagguugcuccuucucccugcucuguaagaucucacucagugccucuacacccccagcagagaaguguggggaugaguagagcgcuugccaaggaagccuaaagacugagcuaacucagcaucuaugucaaaagccaggaagguggcauaugcuugcaaucccugcacuggggaggcaggcuggauaggccagccaaccuagcaaaauugauaagcagcaggucccagugagagacccugccucaaaaauacaaggugauggcucuucugaaggcuaccauuugugguuuaccucucgucucugugcacaugcgcacaugugugagcgauggcacacagagagagccggggacggggagggagcaggcagugcauguauggggacuuuggcuugaguuggaagucuggggccuuggcugaaguugcacgccagccccagcugcccuguucugcacugugcuccagcaggcaggaacacuugcagauggaagucuggagugaggugugucuuuccucuugguccugcauugacuuaguagcucuuucuaguuccuugucauuaggucaugcuuuggacugaccaaacuaucaaauacaacacauggauuucagauagccuaaagauggagaagaggacacacccaauaugugcccacuuggcuguggauucucagcagcgggcuugucuguauuuaagacccgcuggcauuucaagguugccaccagaagauggaucucacagggugaugguuaacuguggaaaggugcuggugacagcuguagacuguguccuaucccuucauaccuuucccaaagauaacugcuaguuucuuccacacccgcagggugcuugcuauguuugucugugugguuuauaauugccuugccuggaggagagcacuuccuuguaugcugggagaaaucccccagacuccuaggaaggacuucaggcugacagcaaccagggcuccagaugauauucuuccagauaacagcuucucuucgaccucagguggucaaggugccuucccaugggaaugaacacaguuaccacuggcuuccucuccaccuucuguacaaggcuuucuggauccuuugagaggacuuguauuacuuggccaggccuacauggcagaaggaagccauucugaaguuaaagucugugggaggaagauguuuucccuucauggcccuguccugccucuuucaucccccuuggccuccugcugagcaggcucugguguggucccuguggguuuuucucucccuuccuaucucuccuuuccuugaguccugguuucugccaaaacugaccugagcuuguauuuguagucuuugagguaggaauucuggugugacugccugugcuaggauuuggaguugaagaaauuagggggaaaaauuacaguugauuugcuuuagcugagagggaccagggaggccacccaggagaacgcucucacugugacguagaggaacaccagucugagggcccugccugugcuuguguagcuugccucugccuuugugcacuguccugacauugaagaucaccaaggaugaggaaggcuucccggcucccagcagacggauccugugugagccaugugugagauggucaaugaguuccuggguuccauagaguaagaaccuuccaggacccuagcauggcucuaaacucaguugaacuugacauguuggcagacugacuccuuccagcaugggucugucuaaucccacggguccaguaacuauacucagaggguucuaccuguuugaaugcucugcaguuaccgccuugagauucguaaucuuuggaacaaaagcuucauuuucauuuugcccuggucccugcagaagaugaaaccagucuugaaugugggucaccgcacuaaaugccaagcauuugaucaaucuguacuugcgacugauuugaauuuggggaacaggccguuccccgggaauaaagaaggauucauuucuuuucccucgaauacacuguguucuguuuuccaaauuugcugugcaucucaacucugcagauaaauuagauggcuggauggauuguucuugcuggaagcaaaggcugggccguuggacuugcauccuguccccgaucuuucaguccggaagugcgaaucaggaucccacaguggugugggauguagggagcugaaaaccgaggcugagaagggaggcugcagauagcagagauugagcugagagucucugcauggcccagcuuccugcugugccacucgccagcucggaggcuuuaugagggaaggcagggagcagguauggaaccuccuguagcccaggcuggccucagacuugaugaugacuaaggucuaggaugaccuuggacuucgaauucuccuguccuuaucuccuaagcacuggaguuacaggugcagucccccaugccuggauuacugugugcuaccagggauggaacccagggcuucaucuguaccaggcaaacacucuuauuaguugagccacauccuuaguccaguucugggccuaugaaccacacacuuuccugcuguauagauucaagcauaagggccacccugaaggcuuugaggaaaaacuagaggaaacaucugugucuagcauuguguuuaagcucacagucuuauuggcuaguaucgccuaguauuuuacugccaauauugaaggcugagcagcaucugacuggcuguugggaagaauaaaguguuccaggcaggaagcaaaaugguugugaguacagagagagggcuggaguguuuuagggauuccacgggcaccguguuuuggggacugagagggaggagacugaaguucuuagaagauucugaagcacaggacgagcccuaggggguuguugcgaggcacuggccgcagaguugggcuaagcaggagccuggagaugaucgcagagacuucgggcugagccgcucucugugcaguacgucacuuaggauagcugccauaugacagaaggauagagccuguggcaucuguuaguguuuuuggucacugugacaaaacacuugguaugaauaacauaaggggggcuggugagauggcucaguggguaagagcacccgacugcucuuccgaaggucuggaguucaaaucccagcaaccacaugguggcucacaaccaucuguaacgagaucugacucccucuucuggagugucugaagacagcuacaguguacuuacauauaauaaauaaauaaauaaauaaauaaauaaauaaaaggcaaaauaaaaaaaaaagaauaacauaagggaggaaagcggguuuguuccguuuugguuuuuagacaaggcuuuaggaauccaagcuagcguuggacucaguauuauagccaaggaugacuugaguuucuaguccuucugccucugugcaauccugagaguaccagcuauuguaccccguaacuuaggacuaccuucaugucaggcaagcagucuggcaacugagcuacgucuccguugccaagggagggaagauuuaugguuaacuggcuccauuucagugggcuugugaggcacuuggaggaacugguggcagaggggucugcucaucucaugccugcugaggaggggauggcuccagggaauggagggaggggaaaaguaaagagcuagagaccagacaccuuucuuaaaaaagaugcacccagugaucuccucucaaccagguccaaucugcuaccuccuagugaugucaucagugauuaugucaucagugauuaugucaucaguggauuaugucaucagugauuaugucaucagugauuaugucaucagugauuaugucaucagugauuaugucaucagugauuaugucaucagugauuaugucaucaguggguuagcccauuggggaagccagagucuuucagugauuggauccaucaacagucagagaucaagucuucaacauaaaagccuauggcgggguuacaucacguccaacccuauagcuugucugugcuacuuuguggguucuucuuuuuccccacccuuuauccccccacaccccuauguuucaccccuaucacuagauaggagaaaaugaaggauagagggggagagagagaaagauucuugaaucuaauuucuuucuuuuucuuuuuucuuuucuuuucuuuuuuuuuaaagauuuauuuacuuauuuuauguagaugaguacaccauugcugucuucagacacaccagaagagggcaucagauccaauuacagaugguugugagccaccaagugguugcuggaaauugaacucaggaccucuggaagagccgucagugcucuuaacugcugagucaucucucuagccugaauuuaauuucuuuuauuuuuuuuucuuugaacacagcuacuaacacaccucaaacaacuccccccacccccaacaaccaucaaccaccaacccugucuauugagacucuaguauuuauauacugucugaaaaguucccagaauuccaaaugucacacuauugcagaaacuagcugcagcuggcaaaaccacaccucugcuagagcacgaggcaaaucauagucagcugcugugggcaaucagaagcagccucauauccccacaccuggaauuaaaacgaaaagauauucuuagaauauuucuguguuugaaaaagaagccaaaguucuagaguuauuacuauacagcccaugauauuaaagcaacugcagcuaaugaaagguuuuaucucuguaaguuucccacauguuaaugcuuugcuacagcucuugccugagacaggagaccuuauuuggcugacuuucacuauacauugucucugcucuguaucuuucacacugauguagggauucaguagcaucagaggucccagacugucuuggcacauccucuccuuccaucacaguaucacaguguuucaugacauucccagucccaaagaacaccaaagaguuccauuugucaagcaguguuauacaaacaacuugucuguguccuuacagcaugguaggcauuagggaaaaacaauuaccuuucacucacuuccccuuagcacuguuugcuaugaauagaacacacacacacacacacacacacacacacacacacacacacacacacacaccccuaccucuuuggugacuuuccugguuagcuucagguauccacaguuaccugagggagucuuacuugggagauuaguagucaaauugguuuauggggcauuuucuuaauugcuaacugauacaggaccacccauccacugugggcaauaccauuccuaggcaagggguccuggacuguguaaggaagcuaggaagaacaugccaguaaccaguguccuuccaugguuuuuucuugaguccugcucugaucuccuugaaugauggauuggaacucuaagaugagauaaaccauuuccuccucaaguugcuuuugguugugguauuuaaucacaacaggaaaacaaacaagacuagcgacacuugacccuuccaguauuacagacaaauugaguacgacuuccaccauuaccaguguugacuaauuuuucuguaaucuguuccuuuuaucaaagcaacugccagcagccuuaccuuguagagauagggggucauccaaggaauguggugacacaaaguuuuaaaacugucuucucuucuccuuucauauauauauauauauauauauauauauauauauauaugcaugaaaaacacuuugcccuucccuuaagugaaggaauguaucuacagauuuggacaucugcugaggaccuggaaaccccuucaucccccaucauugcugagggucagguugcuaaaccaggggcccuguucuuuccaguaagcauucuguaaugggaacuguguguuucucucuuugcuccuaaaaggaaguuguuguaaguggcuaauuaaaaaagggaauggauggugcauacuuuaaauuaaucacagcacucaggaggcagaggcaaccuuaucucuaugaguuugaggucagccugaucuacacagugaguuccaggacagccauggcuaugaagagagaccuugccuaaaaaaauaaaaaaaaaaaaaaauaagagaaagugguugauaauacugucuguaaacccccagagaugaugacuuacuuuuaaggguucaacauuuaugaaguggugugccuauuaguuuauaacggagaaaggcagaccauugcuuuuuaggauugaauucuggcagccaugagcucauaaagcuauaagaaauuguuggcuguacuuaaugggccauuuguuguguuaaaaucaguaauacuaaauauuuauuagccaaguggaaagauuuaucucuguaaauugcugugacucaucuuuccgcuugcugauucugguuauuuagauuauuuuuguuuaaaaaugaaguccuguuguaagccauucaguguuuccugucugagacuugcuauguauaauaccagucuuuaauguugacauacauuuuagaaguagguuaucauuuucuacuaaaacuccuuagguuuucuauggauguguauuuuaaucuacacauccacuggggggaauugaaaacuuagcagcauugagccccaagacugcaggucugguauuuuucugcauuuaagucucauuuaacuuguuuuggagcauucaagggacaguucuuacacaaccuuguacuauuuuccccaaguauuuuuuaaauacuuuugaugucauuaugguauuuguaaguuuuuugcuauaauuguuuauugcuaaauacacaaaaucuaauggauucuguguauugaccuguuuuccuacggcaccacuaaauucacuucuccuggcauuuuauuuuuauauuccuaagaguuuucuagaaagaccaucauaucauuugcaaauaaaggcagucuuuauguuuuccuuucuaaccuccaugauucuaauuuuccucucuugccucuuuguaugugggccauugccacagggcagccaguuccagcucugugaucgguauagccauggaacaauaagaaagggccaggcucagccccacagucuuucaucuuuguaacuugcaggcuaagggagcaaggcgggauggggaguggggaguggggguggggucaugcuccuggacuugccuucugaugggucuuuccauugcggucgagugcccaucuggguuacaguuugggcucgaucacauacugaccucuggccucuucugcaaagcugugggggguaacuuugugagccaggaaauggguaccgguugugaucagaaaaaugagccuguucucacaucuacccaucagccagugcagcaguggccauagugaugcuguuggaagcuccagaacuacuugaguuugcauagguugcaccucggccuuccuccucucccuguuguuucauugauguccaaagcacucgcaucugccagagucuccugaccagccauucucuccuuaaacuauacucuguggcuucaucagguccucccugggaugggcucuucauucucauccuguaaagcaagcacuaagcccugugcucuuauccucacauucuuuucugacaagggauuaagcauagaggaguagagucuggugauguggcugaggccacacaguagugggugcggugcccagagcuauaagugaccaucagagaucagagcuaguguuugguguucuucccuugaugagggcucuggaugcagcuuugguagagccagccuggcuucaccuauggagugggugucuuuguguggguugaccauucuauaaagaggucagaagcagggccaccagagugucugcggacacaaggaggcuguaacagucacccccuccggauaagugaaacagggcagggccccuaauuugcugccuuuacaucuaaagaugcucugaaaguacaggugcagaaaucacgagucucuucucuuuggguugacacuuugucgaucuuugagcaauuagugggcaucccugugcauaguuucucuguggaugucuacuaggugauagcgguggaagucagcagcuagcuugucacuguccucuucccugcuccuucugccccaacuagccaauggacgagcccuguaucaaucuccagagccacauacccuguuuugaugccuccugucaugcuaauaggacauggagacuaaccuguggacugaggaugggccucagccuucacgugccuaggccagauccuucuuuguagcuuucuugguggaccgacguuggagcugcuuugccuucugugucugagaaagguaccugcuucucauuggagccuguaaaucccaaauuuauguucaccccggugugggcagaucaucuuaagccuauuucagcacaccagaaagaagaagaagacaugaguuaauuauucuucaaggcaggaaucucacagcuggugguuucagaauaccacgagcccucugguugggagccagcuggaguuaaaccucuacuugguccuugucccaggaagcccagauacacuuguuuacagcugucucucagugauguuugccagacucugcucaggaggaacguuuccacugccauagugcguucugucuuucauuuggguguucagggggacgcgccuauucaucacaacucccuaggaaccugggagaacuguggugguuugaaugauuucccccaccccacccccacccgggaugcucugguauuuagcacuugguucucaguugcugacugugcuugggaaagcuuaggugguauaggcuugcuggaggaaguacugucacugggggaacgucaccggggguaggcuuugagcuucccagcacucccaguuugcucucucugguuuguacuugugguuaaggauaugagcucuuaguuuccuguuucugccuccaccaccauagugaacucuuaucucccuggaguguaaucccaaauacacguuuccuucuaagaguuaaaagagccuuggucauggcagcuuuucacagcagcagaaaguaacggaugcagcucugugugaugccucugcagaaguggaaaugggaugcauuagaugaaacuacagccucggggguggaucccagaucuuccuguuauuuacgugugucauuaagaccauuuaguauccauggagaaauccuggccucaguuuccccaaauauagcaugguagcaaugcucauuuucaaagucugcaacaaaguagaaaauuaaaaggcugugaaagcagacuuaauaaggugauucugccauggauuugucaaguugguuugucucccuaaaaguugcaguccuuucccugaaccugggaacaucaucacaccaugggaaaagagaucagaguuuguggcuguaucaagcagcuucggguggggaacugggcggauggaggcucccuuccuuucaguauaggaagcuggucccugcaugucccugugcucaguugcauccaguuggaguccugcagacccugauagaacaagaauaagucacagaugcccuggagcuuuugggggagccuggggacaugcagcugugaugggucacaagaggacuggaaaggucccaguucuuacacaaagcccagagccuagggaaugauuccccuuccacagagaggcgcgcgcgcacaugugugcgugcaugcgugcauuuauguaugugugugcaugugcagauguguguaugcgugcauaugcuuguuaugugugauuacauaaaugcgaauauguguccauaugcucauguauguucuacacaugugaguauacacacauauauggaagugcuuguauguguaugaguuugugugcuugaguuagucugcaugucuguaaguguguguugaugcuuuaaugcauuuuuggcucccucuaucccacgucuuguuccaggccucagcacaggcucaguagcacuaaacugucucaucucugccuuuguccucagggcaggaagaucccaacaguuugcgucauaaguacaacuuuauugcugaugugguggagaagaucgccccggcugugguucacauugaacuauaucgcaaguaaagaggccugcccuguucccucacuaagaaauagcacuagagcugcuucugaagcacauuaaagugucaggaaugucacugggcagauucuuggguuacgaucaaguucucugccuuagggaaaguucccuauuuagaccuauaaucuuggcccuuucagcauuuuaauaacuucuagcucugaagugauucccagggaauauuuccuaaguggaauauuuuuugaugcauuccaaaaaguagcuuagcguuauuuuuaaaauguuaaaugcuugcuacaaugugugugaguugcucuugcagagucauucccuugugugugcaaaugaguucaagcucaacuaaugucuguuucaggcuuccuuucucgaagagggaggugccaguggccagugggucaggauucaucguaucggaggauggacugauugugacaaaugcucacguggucaccaacaaaaaccgggucaagguugagcugaagaauggagcuaccuaugaagccaaaaucaaggauguggaugaaaaggcggacauugcgcuuaucaagauugaccaccaggugagacgcaucuggggcccgagugccuccugggccugcagugcccagcucucagaaggugagguggagauggugaggacaucagagcucccugguacccacaaaaugaagcugcagggccagacaggucucaucaaagagggaccugagcaggggaaaagggaggagggggggagggaggagggaagcccuuggaagaagcuggcucucagaucagagguuuuaaaagcagcaucuucucuuuauaaagcaacaggcuacaaagaacuuaauggguggcuggugagaauggaaacuccaauccuugaugaugaagcaucuauuacaaaguuauguuugucuccacugaggugaccuggauucuccauggcuacagaaugggcuuugaaaagaguuuuaaaaauugucuuuaauuauguguuguguggguaaauggguaugcaccgagagauguuggauacccuugccuagaguuacaggguuaugggccacuagacaaugggucucugcaaaagcaguaugcucucuuaacgccaagccaucucuccuuguuaagcacuuguuuguuuauuguauguauaugagugcacugucgcugucuccagacacaccauuccaggugucccauuacaggugauugugagccaccgugugguugcugggaauugaacucaggaccucuggaaaagcagucagugcuguuaaccacggagccaucucuccaggucaagguuuugggaaccuuaagacaaaauuaacaccucucucuugagacccuaagaauccuuaauauuaugacaugaccauaguccccucaaaagggcugcaaugcauuaucuacccaaauuauagccuuccauuagccuguaacucagaagcagggccaguacaaaacuaagacacaguaagagugagcucaauuugaaaaaugcuuaugugaaguugcucugcgaguuauuggaguagcuacuucuaguccuaccugaauuuuauuuuaucuuauuuuauuuuauuuuuggauauuuuugagacaaggucuuaaguucuagcugucuucgaacuuacuuuguaaaccaggcuggccuugaccucaaagagauccuccugacuuugccucccaagugcuaccacaccaacagcaauuuuuuauuaaagaaaaugaaagaaaauguuuuuaauuuaauauucugcuuacagucacauuugcuuagcgaagucuuuguugucuuaggucucauguggcacagggugccuucaaacacaucuauuaucuguggauggcuuugaaccuuugacuccccugcaucuaccuucuguaugugaggguuauggacauguaggaccaagccagguuuauauaauauuguggaucaagccagggcuuugugagagcuagccaaguacucugccacaucucccacacuuguuuagcaaggccuucaugccugaaacuacauacaguucuuacuggaucaccagcaaacguucccaguccaccucauguagaucacauggugaugugagguugguuugcacucaugcugagacuggaguuucuguuuucuuccuguuauuggaaauuccuucagauaaaaggcagaagggucagugggaauuuugugguuggugcagaaaaaggugugagugggguggguaaugaaguguagccuuuucuugugacuucuugcuugcuucucaucugacugugagcuaugaagucagcuaggugugaaguccuacuguguguuccagcuauuggauggagaaagcucaggguacuauuggggcaguaggauucuggguccuuuuaucuccuuuaaaauagcauuaggcagcuguucagaaucuccccccauacccugcuugucuccuuaccuucucagaggcugggguggugagggcuggggcugaagguuguagauacaggcucugugcccauguaggugacaacugaccucagggucacaguuguguguuauuucuguuaaguuacugugaaauuucuaucaagagcucaucuuucuaaauguguuuauugauaccaagacaguugguccaggcucugacuucucaucuaaccauucuuuaguauauagaguagccguguuauucccauuuuauaaaagaagagggcuggugagauggcucagcgguuaagagcaccgacugcucuuccaaagguccugaguucaaaucccagcaagcacaugguggcucacaaccauccguaacaaaaaucugaugcccucuucuagaguaucugaagauagcuacaguguacacauauaauaaauaaauaaaucuuuuaaaaauguauuuuaaaagaagaaagaaugcucagagaccacuccuccaucuuaucacccuuagccuccucagagccaggcugcagauuccagguaccuaacuccauagccauuagcacagggacaaagccuggccuucacaugggauggaguagccugaccuuaaauagcccauggaaagguugguguguccccuuuuaggaaugcugcuagcaaggugucuagaauucgguggaggcaccggaaggagauuggccagaauagcacagucagugaccacauguaggaccuucagacucaguucuuggaaggcagccagcacugggggccuccuggccaucugcaggcagggcucuggccugugugguuugugagcugucuccucaaguaauuucauguuuggaaugcgugggugcauaccacgugauugcuuccaguccagggauauucuuuucugauuuugagccaauguggagacaggagaagccucaugucaccucuggcauaaccaagcaaaaugugaaggcauucccugagugucuagcucuuuaaccagaagccugcuguuugacauguacugcacgaacaacccccaccccccaccauguuuggaaauguaaaauugaccugauguagcuuuugaaaauggaguuggaaaugcaaggcuauuacauugcagacacccacaucaaagccugauuccugccugcccccaaccccugccaccccucuuuccuguuugucccuguucuggugagaguuauucuagggagagucuggcuuguaacaaagcuugauuuggaaggaacaggcuggccauccaguugaauuguguucgagcagaauuuaccccauagugugugguaugaucaaggugcguggugggcagugaugggcuaggcacuugcuuggcguugcgucguccuaggggcagcaaccaaggaacaggucagggaaggucagagaaggcagaguaggauugugggugugguggugcauacccacaguccuagcauuugagggaggcgggugugaagguaggaagaggagacaggagcuuaagcccagugacuaauucaaggguuggccaucuaggcccaguuuccuaucagcaugaguugucugugacucacacuguccuuuuuugugaaauggaaggugcaaugggcaugcaaugucauuguucacuugauuuuuaucccaccugcccccaccuuuuuuauuuuuuuuucugagaucaccagccaucuuuuuuugggggcagauccaccauuggggagcuuggggguuggggguggggaaguuguccuaugccacagggccucgacccgcauggcccaaguguggugagcgcaugcuaccccuuagaaucgcaaaccacugauggaugcugcucaaggaaaggacacaucgcguaaggccucuguaaucaccgccacagagcaggcccuucccaaguuccuucacuucaucccucucacagagaugcuucacaucucuaagggauuggagcugcuuggcuugcaauugccagagagcuuucugggcuugugaccaaaagccucucuuuuguuucucugcugagcggacacaugcgcaugcacucugccugcugcauuuugaggcucugaagaacucagugggaaaggcucacacaggguagccaucugugguugggacuccuccuguuccacccccuggaggggagaggaugaccccuacaggucucaugggauucuccuguccucgagcugaagcuaaggguccucaguggggucaguauugaucuggagguggggguggggcucacacauguaaauauuuuaauggaaagcagcuuugagggcaaacuaguucagucugagaugcaaacuauuuccaaauguguuugacucgagccacuggcccuguguacagaauauuuuuaacuuuaauccaaaggcaguuuuugucucucucucucucucucucucucucucucucucucucucucucucucucucucucucucucucucucucuccuuccugagcaguuuaagaagaggagagagccucaagagauggaggaaauguaaaaugucaaccuaucagguguccugagucuggagcagaggcaugggcagagagauggggaaguguucagaaagcaccagggaaaugucgucacgcagcuguuuuuccagcuguuguacugauuccuccagaugcugucucaccuaugcuggagaaauccuuucuuucacagcagccguucucaaacuauggguugcaaaccccuugggggucgcauagcagauauuuacauuaggauucauaacaguagcaaaauuauagcuacgaaguagcaaugaaaugacuuuaugguugaugggucaccacaacacgaggaacuguauuaaagggucguagcuuuaggaagguugagaacuacuguuucagagugucuugacaacuccuuccugagacccacccgcucgaucuguagccccuucccucguccuccuaccccucaccaucucugcacagcuccuugagguuuagagugcucuuucugccuggccuucccuuguccuucagggaugcagucacauccugcuuuagaccccagggacaucccuugccugacucacugcauaaaauaguuucccacaucugagucccccucacgcuccagcccccccccccaucguucugcauuugcccuccuuccucauuuaaauaagaauuuguugcuacuuguugcuguuuaauuuuucauuauuuguguguguguguguguguguguguguguuuguguuaauaugcugcucagagaagccucaaacugcugggcucaaguaauccucccguuucagcuuccuacauaccuaggauuucaggcaugugacccuguaccuugcugcccuugauuuugauuucucuaucucuaucucuccccgucucuccgucucugugucugcuuucuaucucucccuguuuaggugacagcugcuuuccaccuuacucucugagacaugguuaccugucaaaccuggagcuuauugacgugguuagagcaagcuccaaggaucccuuuagcuccagccgccccgugcugggaucacaggugugccuggcuuuccauggccucagagaaucaaacuuaggucggcaagcuugugcaggaagcacuucacugacugagccaccuccccagcacuuccucuguguucagacuccacaucaacugcuagaguauaaaggacacauuucuuuuggccuucaggucaggucuuggguacuggauagcuaugcuggccagucuuaggucaaguugacacacaagcuagaauuaucuggaaggaaggaaucuuaguugagaaaauaccuccauaagacccagcuguaagacauugucuuaaucaguuauugacggaggagggcccagcccacugugcauggggccguccccaagccuggguucuauaagcaagccaugaggaauaagccaguaagcagcaucccuccaugggccucugcaucagcuccugccuccaggcuccuccccugagugaguuggacuuccuucgaugaugagcagugauauggaagcguaagccaaauaaaccuuuuccuccccaacuugcuuuuuggucgggguguagaacauggacaauugaaacccugauggagagacagcaucugcucggagauuagccaggugaucauggcuauaguguuccucugaaacagcuucagauaaagagggcugugcagcagacugacugugcacucuugucucccacuguuggcuuuggccagauacagcccgagccaggguuacacugagccuguggucuugguaccucugagugcugaggaagcaaggagagacuuccuguggguucuuuucccugacgccaaccaccagguaaauauuuggacacagccuuuaucccagccugagguggcuuucuuucuccccucaggccuaccaauguagguaggugccuggcuggccaccuuugucccaccagucccacagaccuguuugaaguggcugaggcauagccucugagugccguuguuuuugcuuacugaggcuccucuuacugcugagccugcugagagggccugaagucugaugcuucaccucagaguucagagcagggucacuuagggggcuguggggacugggacuuucauaucgaaaccucccaugauuuggcccugccuguggagagucagccccugguggccggcugcuggagaugacucacucggguucuccucaggccacuugacugucagaggaugcugacuaagcccaugggcucuuccaaaagcaaaucagauaaaccaaagccugugcauccucuggaugcuguccucuucccguaaagcagccugcagccuggaguaggccacacugccccggaccuuccuaucuggcugucgugaauguccacuggcgcuuguacccguccauuuuggaugcuuucugggcuuuggcuugcuguacuuuucuguggucuucucucucagaacuaggagggcuucugcugcaguugucagagaugcccgagagucugugcaaagcuccuguuaccagauugauuuuuuacuuuuuaaauagggaggugagcaucaauauuucaggaagaagugcagacugggauguggggaugcggaagguggcuuuuauucugcagcgcagguccucaauccagaggcgaacggccgcagagccccuuauuguucugauuguagucauuuuggcaugugaaaauguuucacuuccccaaacucagaacuggagcccuguguguucucuggacccauuucaagaacuucacugaugguugaggaaauucuuuggcucuauuuuucucuuaauauggcaaugccuuuuuuuucccucucuggcacccuuugcagggaaucagaaggaggauaugaugguucaggcaaagcaagucucaggucacugggagucucuccuguccuucucaucuggggggggggggcguguugcagaaugggauuuauuugacuguugugagcaugccuguguguuagucuagauuggccaucgguauccucuugccauaucuaauccccaucuuuuuuuuauuguaaacaguuuuaucagaacacacccaugacuguucauuuauauagucuauggcugcuuuuauucuguuccaaagaaguugcauacuuggccuggagaccauauggcaagggaagccagacauuugguuuccagugcuuccuagugagaguuaaccagcacuaguaacagauagaaucuuuguucugggggagaggcaagggucugggaagaacgugugaaauagcacacagcucagugaaacaccaagggaccagaagaagugagggccguguagcuagcugacuucauuugucuuucuucugggaggaguuugccuauguuagaaugaggcuuugguuuugccggacugagcagagagaggccuuaagucucucauuucucugcgguguugguaaacaggacuuuacuagaauuauacgauguuuccagguuacuauccaacuuuaagcccaccuucauuugcuuguguuguauaugcuauugaacaccugccuuggccagacauuguuagauuugcuuagacaucuaagguaaacugagguggggcguagaguuggugacccggcacuuuucucugaaacaaagcuugauuuuguagggcuggcaagaagcucccuggggcugccaaagagggggaggggaaucagguaugcaugcucauacauggugggugaagcaaguuucaacaagcuccaaccacuuuacauauacacauacauacauacauacauacauacacacaguuaguggauggagcacaguuccaaacaacuuuacauauacauauauucacauauacacauauucauauauacauauauacacuuacacaugucugcacagguagcaauagugggcgcaagucauggagcugaagauuagugugcaagacaggagugaaauggagaggagacagaggggaaaaggggcaagagccugccugaggcuggaaggcuucugcaaauggaguuuauuugcagaagggacaguugguuggucggaguugaggugccuugagccagccuuggggacaggugggaaaugacuagugaagcuuuuuaauucuccuuuucugccuagccuggaugaucuguaucucagacuacggcaaacaggcauuuuccagccacuuuaugauaacuuguaaaucacaaggccaguguuucucauuagcugcuaucucuuuguauugucuaagugucuugcuggccuacuccucuucugggaacuuccaaggccuuuuagacacucaauuuccagagaggcucagaaugaaaaggauucuuaauuaucuggacguagaacacaguuuccccuaauugauugcuaaaucuccagaccucuauggucauggaaagguaacaccuugugguggauugaggacugauuguuguacuaaacccacugauugacaagacacuaguuaaaacaggacacugaaaucucagagcaaguacacuuuaaagagaauugcaaaccaagacauuucaggucaguuaccauggccaagaugcuaggccuuagcuaauaugaggauugccccacucccaccccccauuuccuugcuaagagucuaacggaucuuuuaagcucauccauugauuuuucuaaauauuuauugagcauuugccaugacgggacacugcugcagcagccaugcugaggucgguggucaaacggguugauguagcuggauuugaucaacauccuguuucuucuccugugggugccacagaauauguauggcuguuggcucccauauagagcuguugacauuuuguggucuagaacagagcaagaggauauuugaaaucgugaacauuucuugauauagcucacaggaagacuaaauauuauggugguguucauaaacagugaggaggaaggagguugcacuucagcguuuacauuccuucucuccuuuugccuccuguguucuucuccucccaucuucaucgcucucaguucuuccaucucccuuccaaccagcuucucauguguccugcaucccuagacaccaauaacauguccaaugaggaaaggguugcuggugacaccaaccucacgagccuguauacauugguagucguaguacccauggagcaggucccuccugcccuagccucucagcuccuagguugcaucuuuccguucaucacagccauccuugacucugucaagguucuacacuugaccaugcugccauucauagccucuuccuuaauugaaauucuaggugucucacucuuuguccacuuggcagaugacuuuguuggcacgugauuugugcuuuuauaacccauggacucagagaggucuuauguucugaggccacugucccaauuugaucuuugaauuugugucuuguccuagauucucaaugggacaguggugugugcucagugggcuuggagucuuggcucggguaauucuugcuccucauuccuccucaggauagcuccuggucuucccaguacugugcuacagggagcucugaccuugccugucccccucgccugucuguguagugauuguaauuauggcccaugccuagaagacaucccgugcccaaaagaggcaugggccuuggggguacugucacacuucacagaucuuagggcugggaguuaugcaggacuuggggugacagacuaauggcaugccccauggaucaccaggcaagggaaagcuucugcucuggucuagguacccaacacaaucccauagauaugcauagagguaguaaugccaaagcccuugaggucauccaucaucucuggguugagccuugggaaggagagaugccaggcuuuucuuccuuauuccaguugguaccguguggagauacauagccgguggcagagcacuggguuugaggccaauugggugucugcacuugccaaucugggaauuuuuuuguucuccaaggaccaaagauaauacagaacauuaagaaguggggagagcauguauuaaacaagaaaagauccuaugaacccggggccauguuuuauuucacauugccuugcaaaugcuauaccugguccucagcaaagcuuuggcucacuugauucuacagcccaugguuguaccaaccuugcuggucaugugccagaacacucuccccucucucuuauaagcaaguucuuggaugauaacauccccuuuccccaaacccccucugcuuucuucuuucuggguagggggccgguguacacaguucucccuacugcauaguuuuaaagaguacgagugguugacauaacuguuuccagaagacauguugaaucacucaguugaguugcagccaguggcugcaacauuagccuuugaugaaaacuucggccaacaugaggcccagccugaaagucccagcccuaaacaggagugugccgggcgggcagcuggcagacacagagaacugcaggcucagcaacaaaaauauuuuugcaaccgaggaaccugucguacuucuccaaggagaaaaagagaugaucgacuuggcucauuagguuaaaaaaagaugggcaacuuucccuucauuuugguuuugucgguucauuucauuacucuugucuuuaaacuucagggaaugaggugagugcauggccugguagugacagcugagcuggcgaagggacuuggcuuucugcuguccuugcugaaggaugacuggucaaacaaccaccucacgaguuccagacaucuguccacuugauguuugagaugcugcagcgaucuugagaccuugauggagaguugugugcaauuugaggcucccccuuaccuuucugguuucacccauuuaacuacugcuaaugggauuuucagcaacgaccacauauggaaagagcccuaaucaucaugacugacucuagacucaacuccuuuuuuucuuggaggaaguaguaaaauccagggaaaucaaucaaguaacagacugaguuaauauaagagccaggagcagagagauagcucaguagggaaaggcacuugccacagaagccuaaugaucugacuuggauuccagagcccacgugaagguagaaggagagaacugacuccacaaagauguccucugaccaacauauauguccugucacacgcgugugcgcgcacacacacacaaauaauaaaaauuuaaaaauacaggauuccacccaaaccaagaugucgguucuccuguaaauauguaacacacuagaaguaugugugccugugagcguguuuugauuaaucuuucuuuggcaccagcuuguuugauguuagaccucaagcccaaaugagccaucccuuagcagggucuccauuuuccugcucuguggaguucuggcaguuauaguucauccucuguucacuaaugaagccuacagcacaugacacccugaagccaaggccaagcuuaccagaugaagaaagauucucccaaagauaccaugggguaagcagcaaggccagcucuuuauuugagaaccgcuagcccagccccuguuggcugguccaucugaugguuuuguuuuuuaauguccuugugauagggauagaacacgaggucucgcccaugcuagauaagacuaccacugagcuccaccuagucucugucaugguucuuaaacuccucugacauugcucuguucuguuacaccggcggcugacugcuccccucugugcauagaccauuccuucccuccuuggucagcuuugugcucugaacaucugcauuguccugcagacacaauuccugugcagcaaagcaggaggaagcacgcacuugugugaggugagcccagagugagcuuaucuccuguggccgggcuucgcuccgucaccugcaucuucacucagcugagacacgugcugcagcccagaucuugugggaccuuucauggggauggaacucgguugcuuucaccuggugagcugccuuacugguucucucugugcuucugaggagucauggugcuaaagggcgccuugucuuuguguggugucuguagugguggcggcugccuucugacugagcgagcgagcacgcgaaguugauggagaagagaggaggaugcgcuuggaccuuaauguuguccuucagcuuuugaagccuggccacaacacauggcugugacugguuuggauuuggcuucauguucccugcacgugagacacacacagagccuuacaguauaauucugggcugguauuauagacaguccugugcccaguugcccgcagcaagggggugggcuccuuuccucuucccucuugagccccggugguucauccgugcucugcccaccagacaggaaaccuggggagcuggacuggguauguugcuccuugaaguccuaugccaggcacugggaagacaauuuguugagacugucccccucucagguccuggggguaaagcuucugggccugcuuggccugguggugauaaguuaaccaaccaggaagaccuuuuuagaaccauucuauggaccaagcccucaacuuacuucauaauuaacaaccagcuauggcugguguuuaguaauuuaugaggauacuggaagccuggacucuauguccagagucacugacacugucccuugggcucauucucuaccuacucaggugacgcugugcuuauaacuugggaauuaugauuuuuuucuucuuaaguugugguguguggcaugcagguuccuaugcauaugugugcaaguguguauauggacaacuuuuuggcgccucuucuuaucuuuuaccuugugguggcuugaaugaaaauggcccccuguggagagggucacuauuggaaauguggcauagguguggccuuguuggaaggagugugucacagaggguggcuucugagauuucagaaacucaagccaggcccagugucacucucuuccugcugucugcugauccagauguagaacucuuagccaacuuuccaguaccaugucugcuuaccuaccaccaugcuuccuaccaugaugauaauggacuaaaccagccccagguaauuuuauuuuuacauauguauauauaagaguugcccggggcguggugucuuuucacagcaauagaaacuuaagacacaccuuguugaagaucucucuuguuucugccacuggcuugcauguaauuauccaggcuaacuggucuuuaagacgaugcuguaucuccuguuucugucucccaucuuaaaguaggagauagguggcacuguguguggcuuuuuucuuuuuuuaauuagguuucuaagaguagaacucagaucaucuggcugccuggaggagccaucuucccggcacuaggaauucuucucuuucucuagucucucucaugacuuugaugauacuauuuagcaugaggcagugcccugaagauauggugguuauacaucuuccuucuucauagcuuucucuucugcuggccucucaggcugcuguuucucuucagccuggugagaacucccugugagagagugaccguaucuuccacauccuacagagcugcuggcccuccugauagaggcggagggcuccuucuuggcuuuaggauauggaaccucagagccauuuuuccugacuucaucucaugacuuuauuaugcuuacaaauugccuuuucgcaucuccucagcuuugaggccagcaggaguggcgggugggucccuuccuucuccucagccuuugcaacugucaggaccguuguuugucccguuuacuucuucggggagcuuugaauugauggauggggggaugugggacggggcuguugggaaaagaguuggucucuuggauggacuaugguuggcauugcuucaaagggagccccagacagagcgucugcagccaggagccuggagacggcuuugaugugggcucacggggaagcagccugcggacacagagcagggacccugaaguguggcagggugcccgcaaggucaaggcugcagcguggcugugccuuccagccuuguacauauauuucaucuccucuguccccccccaagagugugacugucuagacagggauagaauuaaaagcucaauuacugagcaggaauuuggccagugaaagcuuagcuaccgagcagacaggccugggugaggauuauggcagagaaugagccccauuuuggaccuaaguaaggcuagcaagccugaggcucacggccagccagcaccugcagggagcaagggccagaagggccccucaaggcagcuugaccucauggaguuguaaaucuggcuuggcagccaccuccgcaccaccucacucucccauacagggauuucugccuauaauuggaguccggcaauuagaauuccugccuuauggggauggaggccuguggcugggaacugguucuccagcuuaaccaggcuucuuauggcugagagaagcucuuccaucuugagccucaguuucuauaucuguaaaaugguggguuugugugagugugaggguauguuauguccccaaaucaucagauugcucugaaagcacuuugucaucuggcagugaagguuuuguuccuuucauauaaauggagaauuucaacugugauaucccucuccugacccagcuacuaugugucugccuguuuagcuuucaugugcacagucacccuucaugauuuauaacauauauuuaaggagacaugcucaucgggacugcccaccugggcgggugugacagagugaucacacggcauccuuguggauucuuaucauugguugucccccuuguccaagcccaauauggacaccuuggugacaguggaugagaccauuguucuugagccuggcguguccucucaguguucaauagcauagaggccucugucuccugccauuguagaggucucugccaucuguccauauagcuuucucccaaacauuugucucccuucuagcauccgcugggccugagcucagacuugggacagaagcacuggacagggugucuaaaggcuguaugaguuaaaccugcaucucuggaucuccuccagaggcuguggcuggaggguguuacagccagaugcugauaaagauucucacaucggaucaccucagaccugauuuaauccccacuguguagcuggccccacugucccaugucuaagcuugacucuuaucuguguaguucugcuuccugggauguccagacugcccugcugcaggcuguagccgccucucuugccuguccuucacaguuauccccggagcuucaaagacaggacuuccagccagccccaggccccaaaggaaugguacuguccuggugggccucccccaguguggacagcacucaccagcagccagacucugccccacccugccaugauugcugaggucauucuuggcagagcuugcuggcagggauuguuggcauccacccaggacaaacaugucgugcugagcuugcugcgugccauuggauguugagugggucugcguagggaaugccauagacuccggccucaggugaccuuaaaguggaagggucauagccaguguggaacugugucuggcaaggugacauaccccuggcuugucacagcacaguugcuggaauccuucauuggauuuucagucauuugaauacuagucaauagcugacccacuggccaagcaggcuguuuccugagaggcauucaggcuccuaauucauuguuauccuaagucaucauccuaacagaccagugagauuagugggcugucuuaaucccacugaucagaugaggggcccaugcuugucaugcagaguuucaguuuggcagccuggccccagccccagauggcuggguuacccaucucaccaucccaccaucccaccaccacccacacuggcuuuuuuuuuuuuuuuuuuuuuuuguaauuuauucuuuuucaaggugaaugaguuucccuuaggcagccagcacuagccuuuuuuggacuuuaugagcaaugcauagaaaauucaggauuucuaggcuaugugggaggaagaaagcaggcccugggucauguuagugggagaaggcagcccguagcccuuuuccccagcccuucaaccuccaugguccuaucuuguucugaggaguuauuuagggcuccugacucugcccaguaucuagagggcacaggagaugggauguccucagcugaauccucagccugcauagucugggagcagguauagugauagggacuuucccagugugcacaagagagacaguccaccauuuggguccugggugcugccagccccucugcuugucccugugccucacaccacagggugcacaagaaaggcagugugagugucugccucagggcuccccacaucccaggccuuaggaaggcuaugugugugguaaaguagacccuugauuucuugauuccuccaaggcacaugggcucaggauuucugucugggauuuugaucuuuaagucuuaaaccuagguugucucuccauguucucuguccagaugcacagauguagaaacagucuaucaccuuuucccauuuuccuugguacaauugucuucuguuccauugacucgauaaugaccugugguguguggauuauaugguaggggcuugucccucaggagagggguguccaccccaagcucagcuccuagggaccgggacuguccuuuguauuuguauuauucagcuugcuaagccacagcuccguuugugcuuacagggaaagcugccaguccugcugcucggccgcuccucagagcugagaccuggagaauuuguaguugccauuggaagccccuuuucucuucaaaacacagucaccacugggaucgucagcaccacccagcgaggcggcaaagagcugggacuucggaacuccgauauggacuacauucagacagacgcuaucaucaaugugagcccucugcccccucuaccugcugggcuggggacaaguuucgagcagaggaagcugggcuucuucuuauucgcaaaccuucuuguagucugcaugauuucccagaacaucuaugauguucugguguuaggagaaaugucccacuuggggcuguacagaguugaacuaugggguucugaagugaguggguagccagucucauccgaggaggagguaaaaguggguuuagcuacucacaguggucucagaacuaaaucaucucacuguggcgcaucccgagcuuugugaaaaugguccagauccauuuucucaguuaaauauuaggugaucagagacaaagccuggggaaggccccugccagcugcuucuacaaugcuuugaaaucugggcagagacgaugauugggcgguggugugauacagagccaaccuuucccuuucuguuccguuucaguauggaaauuccggaggcccguuaguaaaccugguaaggcuuuccaguaucugugcuggguuuguuucgucugugggcaugucuuugcuuucucuuugcaugugagcuugucagaacaagcagucagcuuuauagucagcuaugugaaugcccuguuccuuugcaccuuaccccaccagcccuuucuggaagcaguaagguuagaggacucuucuuguguuucaagccacagguggaugccauggaguucaagcccagucuaggcagaaaggggacugaaaguccccacaguacugccagcugcagaaagguaccuucagccuugaggguugcugagcggagaugagcuggccuggcucggauccaugccagaacucucccugaaugccuguggguaugacggggaaccaccuguuugcucacagaugucucacuuaaccuagacuucagcacuucaguauaagguugaaggcuucaggucacagaaugccagcgcuuggggguuguuugagagaguaucaaguagaggccacccaaugguaccguccugcuggaucccuuggugucaggaauggacauguacaaagcacaccaggaacaauguauacugaaaguucucagaguccuuuugucagcacagcaucaggucaccagaaacuucuuagggaagggacacagcuuuacuugucccugccauaccuuggggaagcuguuaggagugaggccuguggcucaagccagcaucuagagucauuggaaacaggagaggaaggaaggauggauaguuaccuuagcaacucagacaucccuucccaugaaaagagaaaauauuguggaguuugaaaucauccaucuaugcaauaaggcaaccauuuagcuucuaccuggagcuucuuguucccuucaaagcugaauguggguggcacuacccaggugcccuaaugucucuccucguuauuucuaguccuucuccuuccagcccuucugauucucagacacagcucaaauacuucccucgcucauaugucuguguauaugagcauuugcauguuuguggccccaaguguguguguguucauuggagggagaggguguugcugugcacauguguguauuugugccuguggaggcccgggguugauggaggaccaucuucauucgccuuuccccuuagucagugaggcagggucucucaguugaauccagagcuaggugcuacuacagcuggcugcuccagccagcuuucucucggggaucucgccucuaccucugaggcuggaauuacugccaggucaccacacacacacacacacacacacacacacacacacacacacacacacacacgugcuuuuauuugcacggcagacacuuuaaccacguugccgucuucccggcccacgcuucuuuuuuauuacuauuuuaauuguacgcauuuguggguagagccugggaugaccagucaagauagcaucuuucucucaaccuguuuuugaaacucggcuucaaacuguagcucaggcuugccaggaucucacggugauccuaucucagcuacuccagaaugcaggugcccuaacgccucucaccacaccuggcaacacauuuccaagucacccguccuauagauuuuucugcccucuuccagccugugccagccucugacccuccuggaguuagugagcugugucccuugcuuuuucaggauggcgaggugauugggauuaacaccuugaaggugacggcgggcaucuccuucgcaauuccauccgauaagauaaaaaaguucuugacagagucccacgaucgacaggccaaagguaacuagagcagggcauuccggagaccuuggcagguuuacaccagaggcauagcugcccuuaaggaauugggagaagggaagaugacaguugugaagaucaggccuuucaagcugagaauaaauguuuccaggguggcggugguggcggcgguggugguuguggugguggugguugaacaaagggauucucauuccggacacccauagaacacacacagggucaugccacagguuuugaguauuuuuuaaagugagagacauuccucacuguagaucuggaacccaggccaggacugaacuacaguuuuugggugccuuccccccuuccccccucccuccccguggcucaugcuauaagguggagcuuuagagcucuggcuccugucuccccacacuccggaggacugugcugacuuacuuuuuuuuuucccccucuuucuuggucccuuuguugucacaccagggaaagcugucaccaagaagaaguauauugggauccgaaugaugucgcucacaucuagguggguaaacaggacacauaacuuuguaaagacaaaugaccuguauguauguacacuugggcuucacaaggcuuugugggcauucuugaagagaaacuauuucuuuccuucagucaucacacuggggaaggggagguguguggccuugggccucuuuguguuggcaggucugauuccaccccucccaagacuccgcccuccucccugaaggcaggccugagcaucagaaggcucacuagcaggcacacuuuugugccugccucucuccacuuauucuguugaaacucacauuccaggaaugccucacugcccgccccagugcccgccccagccuggagcaccggacuccccugcacacuggugugaggguguggcugcaagaaagcagggguggguccugccuuaggguacugaugacugauggacuuguuuuccugagugcagaaguugcugcuugggauugccaggcucaugacauacggaagagguucgggguggaugggggugggggugaggguaccuucaugaaguacaggaaacagaauugacuagcaagucugaauaucugagucauucgagaggaggauguguugauagcgcuguuuuauucaauugucaaaauauuaagacauuccacacagguuaugaacaauggugcuuuucuuaguguugccaaggaugggauggcaugcugagauggaagucacaccucuugucuuuggaagcuaggcuauggagucaccuuccugggucguucccuuaagcucuuguacaucucagcuuacugggugcucagcaccguccccuucaggaugagguuagcaguguaggugugcccacuguauagccauguacagcucagcugugguggugacaaccaaccacagcagcaguccugugcuguugcuuaaaguaguuccuuacuauuauuuggaguccuguugaugcugguaggcaggccauuuuaaagcagagucaggggcuagggagcugguucagugggaaaagugcuuacugugcuaguaugaggaucuaaguucaaauccccaggacccguguaaagccaggcaaagaaguaggcgucuauauuccuagugcuuucucuguggagacgggagguaaacaggagauucccugucacaggccagcuagccuaguguaugcagcagcaaacgagacccugucucaaacaaggugcaaggcagggacuggaggugguccucagaccuccauauaaauguugugcugugccaaagccucuagaugugucauggucaaguaggaucagaagacuucaagcugagugcuggccugagaagauugugggaagcuaauauuaacacaagcacguuuucucccaagcagcaaagccaaagagcugaaggaccgucaccgagacuucccggaugugcucucuggggcauauaucauugaagucauuccugacaccccggcagaagcgugaguguggaguucucccucuuuuuccugauaacugcgugguuugugggucagggggcaguguccucuuugugcuggcucagaugaccaugugggcccucacuuccuaucagccagggcuccugacugccuugggcucagggcuuguccacagaaauaugcuucuucccuugggucgucucaggggucauccauauaggaggagcacucacuaaugggcucgcugggaauccuuaggaagccuggcuguagagagagcuugauagcgcagauugucccuucacagagccuucuguagcuguauuugugacuagugaagucggagaugccaacaccuauagggaaacugaccccaaugacaucaaaacaguagaagcagcugaguuggaacuucggcuuguuuccuggacccccugacaucuagagagaaauaaugugcuaaagaccugcacgugacgcccuacggucagacccggccugaugccucuuugugagcugagaaaaaaaucaguucuugcauuauuuuuaugguuggggaaaaacauccaaaugacacuauuuugugauacuguaaauucucugaagugcaaauacgcacacauguuuuauuagaccacagcuguguccccugacaagaugacaucuugucuggagcaauuuuuaugcugcugcagcagaauugaauagcuaagacacggagaccaaauacucugcgaagcuuaagcuguuucccaucuggcccuuuguggaaaaagucuguagacuuguauuagaacaagucggaccuugguagcauagugauccugucacguacgaacuaagguuccagccacagcacagaggagucaucucugaauagaggcauccaacauuccuggaggaaucgcuuucuaaauuacaguuccauucaugaggaaauuggcuguggucauaggaucugguguuuccuuguccccucugaggacaguugaucauaguucacacagauuucauaggcauuucuacaagggacauuauugauuuggucuuaaaaaauaaucucgacaggaaaugccaucuucucugcuugaagucauuuccguccgaggucuuaccaccauuuccuauagcccccauuuguucuggaccuuuggguucuaagcugugccuuucuccaugacugcgaggaauggaaaggguuaacaguguguuucccuuugcguuucagcggagggcucaaggaaaaugacgucaucaucagcaucaacggacagucuguggucacugccaaugacgucagcgaugucaucaaaaaggagaacacccugaacaugguuguccgcaggggcaaugaagacauugugauuaccgugauuccugaagaaaucgaccccuaggcagaggcaggagccagacuucauguuucccucaaagacuccaggggauggcgcaugagaacugagcuggugacgcaggacacccgggaccuuuguccaacauuuugcuuguucagggaacaccccugccgacagaauccuucuugauaguuugcgggcaaaacaaauguaauguugcaggugcacaggcagaaguccugccuucuguaugcuauguaugcagcgugcuuuuccuuacaagcuugggcuguuccugcuuacacagucaacauuugucccuucccuuagccuaaguugucugacuaaugcaguugacggaugcguaggcaagaggaagguccucgcagccauggucuugggcguguuuacacuuuuccuccgagucggcacucagaggaauuugaugccccgagaccacaggugggugacccuggcuucugagauggccaaaaaugccucuuaggaauccuggaacccggaguacagugacuuugaguuucagcuauuaaaauacuucuucauacguagau

SEQ ID NO: 4145 - RNA, 685 nt, Mus musculus
acggucacugggugacucugugccucaaggaggaaaaucaacuaaacaugggcaaaggagauccuaagaagccgagaggcaaaauguccucauaugcauucuuugugcaaaccugccaggaggagcacaagaagaagcaaccggaugcuucugucaacuucucagaguucuccaagaagugcucagagagauagaagaccgugucugcuaaagaaaaggggagauuugaagauauggcaaaggcugauaaggcucguuauaaaggagaaaugaaaaccuacauucccccccccaaaggggagaccaaaaagaaguucaaggaccccaaugcacccaagaggccuccuucggccuucuucuuguucuguucugaguaccuccccaaaaucaaaggcgagcacccggcuuauccauuggugacguugcaaagaaacuaggagagauguggaacaacacugcagugaaugacaagcagcccugugagaagaaggcugccaagcugaaggagaaguacaggaaggauauugcugccuacagaacuaaaggaaaaccugaugcagugaaaauggggguggucaaggcugaaaagagcaagaaaaagaaggaagaggaagaugaggaggaggaugaagaggaugaggaagaggaagaggaggaagaagagaagaugaugauaaugaauaag

SEQ ID NO: 4146 - RNA, 53061 nt, Mus musculus
cgggaccaaucacaggacggugagcagcgagguccaguuccugacguugugcggccgccgcgggguuuauuuagcucuaggguccugaccgccgccauucggaguccucugcgcccgaggcuguccccagaccgcuccgccccuguccccgagccucggcccccgccuccgcgcagccucuccgccccucgggccgcugggagccgcgcgcgggcccgcggagaacauguccugacugaggcgggagggcggaggcggcagcagcggggugggcggcggcgccgagggaggcggagaggggccgggcucggcucgucgccgcuggccgugcgggagucgccgccgccgccgcggccgccgggcgccgcgcgucagacggggaggaggaggauccgcggccgccagguaaccgggccuggguugggggcgccgcgccgcaggccccucgcgggucgaccgcggccugacggggcgucgcggggagcaggcugccgagccuccgggcggcagcguugcgggauagcgcaucgcaggcccgggguuguccgcggccgcgcguccaucuugggcuucccagcgcggggacaacccggaggaugagggagaguggccgcccggcuuguuuaccgaccucaguuggccgccuucgucagcggcuggcgcugcccuucugcccgccucauuccggcaacugggaucccucccgaguccgagugugugggucuuauucccaccucuuaguaggccauaaacacccggauuugucgcucuaaguuggugcugguccccaaacuuguguuuuggucccuuguccacuuucucuccccucauacguuggccuccgguugccuaaagcaaaucagggugaaaguugaugucugguggccaugggcagcuggaacuccgcucccgguaacgaucgcucugugcaccuaccuuguggguuuucuuguuuuguuuugguuuucugcucuaauuuggcuggucauugcacagacaaaagagcuguaauacuugcuguuagcgccggggagaggcaguuuacguuaagcaagaaguuugaacccgcccauuaucuuggagacgcugguuuugaaaccaccuugcuuagaauuuuguaucucaaccccucgauuuccccuuucgguuacccacuaagucaauuuuuauaaguucuuuccacugcuugcaauguuuggucucuguauaguugaccugugaugguguuaauaaacgugauguacaaauacuuggaaguguuauauaaugaguggcuccuguaccccgcagucucuuucagucgacucccuaccaacuuuugcuacaugcaugguaccucuguugaucaaaaaugggugacuuggcuuauauagagaaaacaggggagacccgaggaucuuugugacagaggccauuagaaaguccacugaacuaugcuugggaaaaguaaagcuggauccuguuaaauauuauuuuaauuaaaugagguauuucgaaaguauauuuggaagccacucucuugauuuggaggcucuuaaaauagucucauuaaauuuuuguaacuuuuucauuggggggggguugugagagguuaaaagguagggcaguaaugagacguuuuacuuuuuuggggggaggauguuauuugaacgccaugggagguuuuuucugguugcuguuuuaacaaccuuuuguuagugccguugagccuuggggcauccauuuauuuacucuugagguuguaugaagaacuuacaacucaugguaauauauuucaaacuaauggccuugauccauaacuauguacuaauacggauuguggcauaucacuuuuaaggucugaggauuaaaccaggcaagguggugaauggugaaugcuuuuaacccuagcacucagguagcagaggcaggugggucucuugaguucuaggccauacuggucuacauagugaguuccaugacaggguuacacugagaaaaccuucccccccccaaccauaaacaaacaaacaauuaaaguaagucugaguaugaacauuaauucagauguacauuguuugagguaaauugauuuauguguaauugauucagugagagccauuacauguaguuuuauuuauauugcuuuuauaaaaucaguuaaaacuuaaauguaguugcaaaaguaggaugcuaacuuuuuauauaacuugguuugguuuuauuugagcauugcuuauggcuuuccccucuucccuagaaauaccuucuuguuugaacauuuuuuucuuccaguuuguggugguuuauuuggaauuuucauguccucauuauaccuuggguauauuuucuguauuuaaauacacuagcaccucugaggcgcagugguggugcauaccauuauucucagcacucagaaggaucucugaguucaaggccauugugguuuacagagugaguuccaggacagccagggcuacacagagaaaacuugauuaaaacaaaacaaaacaaaaugaaaauaaaaacaaacaaaaaccccccacagaaccaaaaaacaaaguacccaacacauucacuucuuaccacaauaaauaaaccuauaaaaaugaaaaaaaaauucaaacuccuuuugguguuuaaauuucucaguaguuuggucucucucucucucucucucucucucucucucucuucuuuaaucuucuuucuucuuuccuaagugaagcucaguccagcuaaauuuuuguuucugugaagucccuccucucggccuuuauuuauuuuacccuuucuuacuguacaucaaguuaagugcuaucuccuaagaaccccuuugagaacuuacccuggaggaaccuguuugcuccucuguaugagacuuuccacccuuuguuguuauuguuguuguuagucuaugguaguuuagauuucuuucuaugacuucuguuuuccaacuauauuuuuaaggcuccgagauuugguguugaaauuuuuuuaaggcucugagaaaugaguuuguaucuauggagacaguauaguuggcucugaaaauauaguuugacaaaguauuucuggcuacagagguauuucaggauauacaauuuguauguuuucuacuauuggaguuucugagauuuuugaugauuuaugagagaaaauauuugaaacuauggucauaccauaaaaauacuuggucaguuuguuuacauuuguuaguacuguuuuuuacuaauacaaaauauugacauuuuuccauugguugugcuguauuauucaaaugaaaaucucugguuuuuuuucacugagucuaagauaguuacuugacuuuggauuugguacuagugacaugaaagguagcuauuuuguauuuguaaaugucauugcaaaugacauuuaucaucguaggaaggaggaauaaucuguagccuauuuggauuucuaaccucagaugcugauggauuguacaauugaucaaaaggcagaugaggcaggggaguaugauuuuguugcuaccuguuggaagaaaacauaaaacuggccuacaguauucuuauauaccaaagauaauacauguaguuauguaguggggauguggauacuuaggcauuuggaaaauagguguguguguuucuguuguaaguaugaguaaguuucuuggcaguaaauucuccugauaaugucucugccuucugugaaaacucacccuuuuauaguuugucaaaauauuuuucccuucaaaauauuuuguguguauggguguuuugucugcauguuugacuguuuaccacaugcauguaguacccuuggaagccauaagagagugucauaugcucugggacuggaggugaagaagcuugucagacacuguguggguucugauccucuggaagaacagccacuguuuuuaaaugcugagccagcuuuucagcccaaaauugucuaauuuuuauaaaauuauaaaauuuuauaguuaaauuuauaguuuuuuaaaacuaguacuuuuuaaccuuuguuuuaugggaauggacauucagccuauaugugugucuguacaccaucugcauguuggaucuccugagaucugaguuacagacaguugugagaugccauucgggugcugggaauugaaccuaggucuucuggaagagcaaccagaacuuaaccccugagccaucuagcccccaaaaguuguuuauauaagaacuuuuuuuuuaauauucauaaaucuuuccaguauaacuggagauaaaacuaaccuuuaacaaacuuccugaaaugcuggguguuuuuacuaggcuacuugaauuuguaaaaaacacuuucauagaccaacgccaguaauaagaagaaaccuagaucaguuuauccuauuaauaauuaaguuggaucccuuacuucauauuauuuauaaauuuuaacucaaacugacuaaagauaaauuuaagagcuaaacuacaaaauacuagaugaauuaagguuuucagccuaauuuuuugaauauggauguucauucaagcaguggguucugccacugcuguauguugaaauuugcugaacuuuaaaucuaauuauucucaacuauaaguugauuauuuuaggacagcauuuuuuagacguauggcaaaaucccuguuguguagaugaaggaaagaguccuuacaaauauuaugcuacaaaaacacauuugcaauugaaauucagaagacaguauaauugcugugauuuuuuuuuuuuuaaauaaaccaauucuuugcuuucuuguuuaggacauauaaugaaucuucuuuuauuucucuuuguauuuaaugaagcuaaagcuuaucucuuuaucugucucugucauauuuauucuuauggugcuagguaucaaauuuaaggccuugugcuuguuagguaagcauucuagcucugaauuaagucauacccccccccccccgauuucuuuuugaagcuugcuuucuguagcccauacuagcuuugaauuugugauuccucuugccuuagccucuugaugcugggauuauagcugugugucccuacacuaguguaagguuugcuuuuaaauagggaagcuacugcaggucuagaacuacuuuuuauuuuucugggaauguucuccuuugauaacuggaauauugaguuguuauugacuuauuaaugaguagcugccauaugauugaagacaaaugaauuuuucauuguugaauauuagaaacaaaccauagugcacuuagcuaagaauuaugggagauaauugucuugcuuacugauccuaguauuuucacuauuaagugugaugcuaguauaggcuuuuuucagaauguucuuuagcaaguuaaguucucugugcaggcucuuuguuuuucuucugauaaaaagucuuucuguauaguuuagggugacuuuaaacauggucuuuuugcuuuagccucuuaaugcugggguuauugguauguacuaaaaugacuucugucacugaauuuuuagugcuauucuauauagcuuguuaggaauuugcaguuuuucuucuuuagcccauugauuugauagguuccauuaauuuugggauauugaaccaacuuguugauuuaauuauuuaucucacuuggauauauauaauuccaucuguccauccauccauccugccuaaucagcuuuucaagucaggguuucuugguguagcccugguucuccugugauucacucuguagaccaggcuggcuugaguuuacagagaucugccugccgcugccuccuuguugcugggauuaaggcuuguaccaccaggcccaguuuuuuccuuuuucuuuuuucuuuuuuacuuuuugacaggcucucacucuggcucauugcaggcccagaacuugguauguagaccaggcuggccuugaucucacagagaucuuucugcuucuguuuccucacuugugugggauuaaaguuuuguacacuaugucuagcucaauguauuuuguagauuugugcuucuauauaaauuuuuuucuccucuuccuccucuccucuuguuguuguugugccucugugucuacaucuuauaauuggcagucaggucagaggcuugauagcauucuauuucuauuaccauuuauauuacuugguacuuuuaauuccugguaguguacuuuguagauguauggcagcauuagagacagagaucaggucuguuauguaguaacagauuaaauauuaguucuguuuuaaaauuugagcuuaacucaggauacuauaguggaaauggaaauuuuaauuuucaucaucuuuggaaauaagauauuugcaaaauaaauugguuuguuuucaaaagugaguuuuacacagaagaacagggagaggcuuugcuaaguaguguaguacuaugcuggagagcacauuauuugacugccuuuuauuuuuacaagcgagacauuuuugucuaacagauacauagagucugcuuacuaaucauauggccaucauugcaugcuuaccuuuaaagcauggucaucuuuaggcucugaaauucguauacauaccauuuagauagacucacucuuucacuuggcugaauaacaaugaaaggcuuuuaaauuguuauuaacauagcauuuuuuuuuguuuuguuuuguuuugguuugguuuuugguuuuuuagauuggcggcgucucacuauauagcucuggcuauccuggaacuuacuauguagaccagacuggucucaacuaacagaguucugccugccuuuguuucuugaguguugaaucuuuuuuuuacccccucucuaaaaucuggacugguguauacuggucuaaagucaggcuaucuguaggcccucauaaccccccauuauaggugcugaauuuaguguauuuuguuuguuuguuuguuuuguuuuuuugagacaggguuucucuguauagcccuggcuguccuggaacucacuuuguagaccaggcuagccucgaacucagaaaucugccugccucugccucccaagugcugggauuaaaggcaugugucaccacugcccggguaguguauuauuuuuuuuuauuagauauuuucuuuauuuacauuucaaauguuauccccuuuccugguuuccccuccgaaaauccccuacccacaacccacccacucccauuccugguccuggcauuccccuauacuggugcauagaaccuucacaguaccuaggaccucuccucccauugaugacugacuaggccaucuuaugcuacaugugcagcuagagccacgaguuccaccauuguauguguuuucuuugauuggugguuuuaauuccaaggagcucuggggguacugguuaauuuguauugauguucuuccuaugggggcuucauaccccuucagcuccuuggguacuuucucuagcuccuucauuggggaccuugugcucuguccaauagaugacugugagcauccacuucuguauuugccaagcacuggcagagccccucaggagacagcuauaucaggcuccugucagcaagcucuuguugggaucugccauagugucuggguuuggcgguuguuuaugggauggauccccaaguggggcagucuuuggauggucguucccucagucucuacucagaacuuugucucuguaacuccuuccauggguauuuuguccccccuucuaagaggcccccaggcucccccucccccauuauaggugcugaauuuaguguauuuuuuaaaaaauaucuagguuuugcuuacuuguucaacuuuuuuccccucucuccccauguucaacuuuuuagacaucauuuuuguaguucucaaucuaaaaaacaagauaugacgaaguauaucaccaaguuuuuuguuuucguuuuuauuucucaaaauguuuagguauugccuauugguagucuaagaaggauugcucagcaagaaacacacacaggcaaauuaauaguucaaguuuuggauagugggaauaggccacugaaugugugugcuuggauacagaaggccuggguucagauucuggcuguaccacguagugacuuuguuuuaaggguagucacaguguuuugucucccguuuuuaaaauugaauauaaaaauaguucugaggaauaaauugguuaauauauugauuuguacaaugguuauguuuacuuguugaacagggcugccuuuggcagaauugugacauagacaaaguuggccuagugcucacccacuuagaacaaacagugcuuucagucugcugcucuucugcacucuucugcaugaugcucuuuguugucucugcaaugaaagaaaaaauaucuucauucuguuuuuauugucacacuauaggaaccaugaggaaaaugaucuagucuaguuuucauuauuaaguaaggaauuuuaaauaacuuauuuugagaugggggucucacuguguaacccuguuuggcaugaaguuugcuuuguacaccagguuggccuugaccucacagaggucugccaguuucuuccugagugcuggguuuaaagauacgugucaccauaccuggucuaaauuaugaguuuuaacacaauuuuaguucaaauaacuuuuauauuuccaaugaguaaccgaauuugaauugauaugagggauugguauuuugaaacagaugguaaauuggaguuggcauugccuugggguauuuuagcuguuugcuucugcuaccuuuuacagccuugcuucauauuauacuuuauguaaaauuuccaggcacuaacuccuaucccugucaaacaggaagccccuuagcuucugauacuucaagcuacuguuagugagcuagauauacuuuccaauggccuucuuaaggguacuuuguaauuugggaaucuguuuguagucucuuuaagagaauggaauaaugaaaaaaguuuugagcauguuaagccuaucauacuuauuaggaaaauugccuuauucuuuuaugaaucucaggauggaagccaggauuucaggcaugcuagauugaacuccccagcccucuuuuauauuuaaaugcugaauugagaauauacucucaagauuaauugucccauuuccaugcacaucuaagaagacugucauuuuuuaacuaguuauauccgucuacucuuucuaaguuguaagaugauuaguuuuguuugagauuguaauuugaggugcaugucucuaguuaugguaaaauugaguuuacuauaugguugaaggacguauaugugguaugucuugccuccuuuuucauacuauguagcaacugaaaugcuuagagaaaauuaauuuuguauuuaaacaaaguugguaaguaaauagaauuccugaaaugacuagaagaagauagaugaaaagaaaugucacuuacuauuguuacaugcuaaaauuguuaauaacuaucuucuagguauuuuucauucucaccaguagagugauaguuucuguuuaauuaagagugggaaaccugucagaauucuuuuauuauguuccuuccauaauuaauguauucuuaccagauuaaaauagcaaaucuuaauggggcuggagagaacacugagugguuaagauaaucugcuuuugcagaggacaggaguuguguucccaguauccacaucagcuuacucagagggugauguaauucuaguuucggggugguggugggguggcaggguucaauacuucuguccccaaaggcaccagcacucaacauguacacacacacaauuaaaauauuugaaagaaaagacagcucuauuuggaaugaagauagguauucuagcuguaauauggguaauugccucaguuaaauaauagcauagugcugguguggccggugucauucugauagcuguuacuuaacuugaguuuauuuuauuuucacacacucuugggaggauuuagcagguuuguucaguucaguguuugauaacaggugacucugcaauaguuaacaugaguucuauagaggauguauguuguauuuucugaagauauuuaauugacuggaacuauagcucagaguacuugccaguacaugcaaagcuguggguuuuauuccuuaguaccacuaccaaaaguuaaugauuguaaaaaauuuguacuuaugcccuuuauguacugcuaauccaaauaaucagcucauagguugucacagcaguucagguugcgcagauuuugaauacagaagucugguguagaauacuuucagguagcaaggaauggaacaaacacuuacugaacaguuuguuauucuuaggaguuuagugccuuuaaaccguugauaauuaaugauuagaaguacucaggacaucuggcaaaucaugugcagugagcaaggcuugggauacuaccuucacauuuuauuagaaaacaacagaaauuagugaauauuagcugcacaacaaaauuucagaugcucaaugaaaguguuuauuuuccaauuccaaaaaaauaaaagaaacaugaauuucugaugaauucaguuuuggauauguuaaguuugagauguauacuaaauaguuaaauagauauucuguaggcaggauucauuaaucugaacuuggguagaauuugggaaucaucagcauauagguaguauuuaaaccccacagacugguacaaguauuugcugccaaagcugaugaccugaauuugauuccuguaguacacauaguagaaagagagaacuaacuccugaaagcucuccucugaccuacagguguauuguugaaugcugugugcacguaugcaugcaaauaaauaaauaaaugaaugaaugaaugaaugaaugaauguugaaugcugugugcacauaugcaugcaaacaaacaaacccacagaguuauugaaauuccuaagagagugagcugguaguuugagaaguguugaccaaagaacucuuggugccuaacaucagaaauaaaagccaacacagauuaagggaggauagcuagugagaaauacaggaagccaaaggcaguuuuugaagucuaauaagaacaauguguuuaguuguggcuuauaggaucaaaaggcucuagacuaugcuguuggacagauuuuauggugguuguauuuuucccauaaguuauuuauauuccaaaugucaaaguagcaggaaagaaguguuuuauaauuuuauuggacacauuauauuauuuauguuauaaauuacauuguauuuaugcaaugcacguucguuuauuuuugucauacuggcuaugcagcccaggcuggccugaaaguugauaaucuucugcuuguacuuucccaguacugggauuucaggcaugugucuacaugaucaauauuuauauguuuguuuauuuguuuuuauaaguuaaaauuuauuacuuuauguaucuuuauuuauuacuuuauguguauggaaguuuugccugcauauauguuugucuguucacaacuguguggguggugccuguggagaccagaagagaauguugaauuuccuggaacuggcauuauagaugguugacuaugugaguguugggaguggacccuggguccuuuggaagagcagcccugcucuugauugcugagccaucuccagcccauuguuuaaaauuuauggggggaggguggaaugggaggaugacauaguaaagaucaugauuuucagugaaacacuuuagauguuugcugauacuuacauaacugccaugguaagauuauaguauagauuauuucaggaaaaucgaguauaguuuauaaucuggcuaacuagauaggaauauauucaaaugugucaaacacgaacccuagccuaaaaucucaaguagaaagaagguauuucauuugcuuuguuuagaucaacuugauuugaacauugaaaucucuuggcuggaaauucaaccucaguuauucuugagggcuuccaguucuuagguuuuuuguuuguuuguuuuuaagauuuuuggcauuauucauuuuagguucucuagauaaaguguugucuuucauuguaugccaugggguuccuucugguuucucuagcucugcugucuggcuuggcacuauuuauuuauuuauuuuaaaauagugcuggguacuagaaauuaaauacagggccuuggaacaugaugggcauguguaacauugcucagcuaugucaccagccacuguuuuuuugagacacagugugacuguagcucagguuggccuugugcuuguugucauucugucuuuugauuccaacugcuaugauuacagacaugcacuaucuuguuuuaaaaaacaaaacaacaaauuuaauacugucuuguaagcacauuucaucaaggucuugauaccuugauacuucugcagcuauacccauggaauugaucucacucuauaauuucuucugagauugcucagaagcgucacuguugcuuuuuucccaggucacugaaugugaugugaucuguauuuuguuggucuuauaaaauauagugugcuggucuguaggucuugucucuaaaaucccugagaugggguuucagaaaccuuuguugaccuguuugaaaauuggugggagugaaugauggaagagaaacuuuugaauugauguuccagaaauuaauccuaagaagagaugcaguaagugcaugcaguaaaacuuugguugcuugaaaaguccuuggagugaccagagagcauccugugaacgugaugagagguaacugaguuuuaaggaugagcauaucuaaggcaauggcuucauauuugcauuuuugggagugaugacauaucuagaaguugaggguauguguaguguguuuagaaguggaugagugggcuuguguguuacaggagagagcugagagcuuauauuguuagagaaagcuucagacaagaggauugcugugguaaccaacagcuggauguauuuagaaaacagagauaccuggagaggcuaugauaguucugaccugagcugaggaaggauugaugccaguggggcggaagcaaauaacugaucagauagaaaccacuggaagaauucaaggugauugugagauucucagcuagguauagugacaugaacagugucauuuguggaaauugaagaagguaggauaggaguuucuugugagaggaagauaaaaggucuaaugggcgauuugguaaguuaucugaggccuagaaugggauuggauuucuaguuagggauuuuuccaugucaacaggauacugcuguagcacuccuguuuuuccucaugauuauuguaaggaagacagugauauaggaagaugagaaaagagaaauugaguggggauuuuggcuuaagagucaagcagugcuuucaguuuuuuuuuuuuuaaauuauauaauucagaaucacuuugugauauuuuaagauaaucugaaauuuguguguggaauacccucuuuuuaauuuuguguaguccuuuaagaugcccugugagcauuuguaaaucuccauaccuuuauauuaauaauuauauagagauaguuaauuuuauguuaagaaaguuaaaagagcugggcagugguggcacacaccuuuauucccagcccuaggagacagaggcaggcagagcucucugaguuugaagccagcuuggccuauagagggaguuccagggcuacacacagaaaccccaucuugaaaaaccaaaacaaacaaaaaaguaaguuaaaacaaacaacacuuuaauacugcccucuuuaauucuucuuuugaauaguuucuuauuugaaaguacuggcaacugagguuguuucuuagaguugguacuugaugaggauuauucacaugugagcuuuucuuuauuugcuuauuuuguuuuugcuuucuuuauagugaugcaggugaucaaaccuggagcuuuugggcauccuaggcuagcacuucaccacugagcuacacugucaucucauuguauaaggccuuuaguaaaggguugggauugguaguaugauaccuguuguuuugaggcaagaauuaaauguggccuuguuucuuaaauuugguuuuguuucuuaaauguuuaugaacacuucauaaauaaagcuuacauaauuaaacagaacauauuugaaaaauuauuuuauuaucuuauguucaaguguuuugcuugaaugaguauauauauguguguguguguauguauauguguguguaauauauauauacacauacacacacacacauacacaaucagcugggaacugaaaugaagucuucugcaagagcaccaagugcuuuuaaacagugaacaaucuccccaggccaaaugaagauuaaagaaaaaguggacauaauugugucucuuaagauaaauguuacuugcugggcagugguggcacaagccuuuaaucccagcacuggggaggcagaggcaggcggauuucugaguuuaaggccagccuggucuacagacugaguuccaggauagccagggcuacacagagaaacccugucuaaaaaaccaaaaaaaaaaaaaaaaaaaaaaaaaaagaaaaaaaaauacaguuuuauguauaaauaaauccgggagauaaaaaaauauuuuaaaaaccuguguuaugcagauuuuauugcaucaauuaauugaaauaugaauccuuggauagaauuugaaauccuuaauugcauagaguauuagaauuauuaaguuaaacaacuuaucuauaacauguuaacuuaacaugauauguauucacaguuccuuuucaaaaugaagcauuaugucuuaagagcuggggucuggauagauggcucagugguuuagggcauguauuuugugguagagcacuugauuugguuuccagcuuacagccaucuguaauuccucuucuggccucuguaggcacaugcacuuaugugcauauacacccacacagacacacaaacaugcacaguaaaaaagaaaacaacuguuaaaaaauccucucagaacuaguugccuugaaaauaauuuuauauaccucaugagagguugugacaaaucaggaagaaaaaaggcaguguuaauucuuaggaauguaaaauuauacauuguccuuacuuugauuggcacagguaaaaauggcucucucagaugagcaucucuaauggaauauagcuuucaguuacuaaaacucaguauccugucaaguuccaacuucccagaguauguauuucuauugaaaauagucuaguguacuucucucgucuuccuugaauuucaguuuggaauugaaguuauaccuauacuuucagaaugggcaggaaaauucuucauuuaugauagucaugaugauaauuacauagugcugaaauuuaacccagggccuugcauauggguaacaugcuuuccauugaccgcugccuccaaggcagucuugauauuauuguuauuuugaauuuuauuacauuaaauuuuucauuuucuguccuuguaugaguuguauaccuuggcaagcaugggaaggccauaggacaacuuguaggagucacuucucuccaucuagaguguggauccuaggaauuaacucgggucgucagacuuggcagcagguaccuuuaacuacuaagccaucuugcuccaauaggguuuugucaguggcaguucuuuguuuuugucagccuugaaaauuuaaguaugacaguguacagguuccacgaaguuaucuaaagucagauuacauuacuguuaguugagcaucaguucaagcauauacaaacauguaucaaagcaagcaugaauuucauuuuuaaugaaauaauggaauugcuuuaguauauguugaugacauuuuuuuguuaauaguaucuuuguuuaugcucaugauaauuucaaauaccaugaauaagaaauuuauuuaaaauuuauuuacauuuuauuucugaaaaacuaaagggccagucuaaugaauaugaauauugccauuaaauuucuguuguccacuuuauguaugcuuguaugauuauaguucccugccauuaaacauacuuucagaucacuauuagauguguacagucaguguacaaaguaaaauuuaaacauuuaaguaagggguuggaagaaugccucagugguaaagcauuuguuuuguaagcacagaacuugaguuugauuccuguacucagguuaaaaggcaguaguauguuguguucuuggagcuccagugcuggggaggcugagcaugaggaucccuggggcucacugacuaagccguuuagccuaauuggugagcuccagccggguaagagagccugucaaaggagguggaugguguuccugaggaucacaccugagguugucaucugacugccacguguacacuugcacccgagcacacauucaacccccccccccacuuuuuuuuaaauguccaaacaagauuacuuaaauuaccugguuuuaaaggaaguggggaaaacccuaacaugcaguuacaacagaaaaauauuuuaaauuaaauuguaaguaauuauuuuauuugauuuuuuuuuuuuuuuuuuuuacuuauuuggaucaucucaccguuuccuuuacaguaguaguacagaucggaauugacucagcacugcucagacucauaauauugcugguuguauugguacaugccuacaaucacaggcauuuaggaagcugaaacagaagaacuacaaguuugaggcuagucugggcuacauguggagucccuagcuccaaaaaauaaggaaacaugcauacacauguacaugugcaugugcacacacauaacacauuaugcaggaaauuuucucauguuuaauuuggcugaucagcccaguaaauuagcuguuuuuauugcguuguuaaaguaaaagucuaaauaguauguuauuaaaauaauuauaauuaaaauagaauggauuaaaauuaaagcuuucuaaaauacuuuugaauauagaaggcuauaagugaaauucaguuuuggucuccuuuacaggaauagcuauucacagucagacagaaccacuuacacguuuugcaguaucuuccgaggaagucagagucugagccagcaugaagauugaaucuugucuuuggucugauuuaccuuuauuguaaccaugugcaagguggagguuauagcauggaaacuaaaaucuuaguaagugugaauuuuuuuuuuuuuaaauuuuagcuauccaacaguauccuuucuauggugaaguuguccucuuagcaaacgucacuguguaugugggguguagauuuaauagacaggaacagaauaaauacacuuauaaagugauuuggcuuuccagguuuaggaaggagaaauaccuaucacucugccuaggaaccuuuucucuuuuccuuguuaaaauaggucauagggaaguacuaaguuuagaacagauugaaaaauugagagguuguuuaguguucuaauuuaagucauuaaaauaucauuaaguuugccauauaaacugcuucacuuaugaauuaguugucauuaaauaguaaagucuucauuauuguguaguguuaguaaauccacgguuagaguccugggaauguugacugacuuauuuguuucucaauacguagcccaagcuagcuucaaucucaagauccuccugcuucagccuccugggugcuaggauuacaggcauguuccagcccucccacuucuaggacuucuuagauagcaaguauauuuuuaauauaaaguaaacauuuuaguguauguuaauuuuucagauaucaaauaugaacauuuagaaauagauuggcaugcuuaugcuaauaguuuucuuagagaaaucuguccauuugaauuucuugagaguauaaguaacguagaacuuuuaauguuccaaauauaauuauauuuugagaauacagaauaucagaaucauuucuaguuuauaaaguuauuuuguuaauugugauuagagcucaucagcauauuuucugucugugcuaauucaaagcagugaauaacuagcacuuucaagcuauuuuccucccuuagcaaggauaauuaggaaagacuuugagcuucugaaaucacggauuagacauacuacaaauagcacagucuacauuguuugcaauuugugagugguuauuuaagguucuauuugguuuguguuuuuucucuugccugcaagucuuuuuaacuuuuccuaaacuaauggugacagcugagcugaaauuaaguaauuucuauuagugacucaccuauuuuuaucuucuuucccuguagaaagacucugcauucaucuccuuuuaucacuucagcaguccaaaguaaacuuuuauuaaacccugaagucuaagagcucuuuuuggaaauuuaucuuuacuauuuuuggaaaucuccaaacaaaaguagaauaauccaauaagaaauuuacaugugucuuuuaagaaauauauauuuucuaaguugaaggguauuuuuuauuucgggggcauauuuucagagauggaauuauguagcuauuauuuuaauaacaauguccuaauuauuuauagcuuccugccugacauaacucacuucaagaaguacacaaugucagaacaugggauuaagugggccugugaauauuguacguaugaaaacuggccgucugcaaucaaguguacuaugugucgugcccagagacccaguggaacaauuauuacagaagauccauuuaaaagugguucaagugauguugguagagauugggauccuuccaguacugaagguggaaguaguccuuugauauguccagacucuagugcaagaccaaggguuaagucuucauacagcauggaaaaugcaaauaaauggucaugccacauguguacauauuugaacuggccaagagcaaucagauguacccagugcuuaucccagcguaggaccaggagucccacagaaucuccucaauccucaggaucugguucaagaccaguugcuuuuucuguugauccuugugaagaauacaaugauagaaauaaauugaauacaaggacccagcauuggacuuguucuguuugcacauaugaaaacugggcuaaggcuaaaaaauguguuguuugugaccaucccagaccuaauaacauugaagcaauagaguuggcagagacugaagaggcuucuucaauaauuaaugagcaagacagagcucgauggaggggaggcugcaguagugguaauagccaaagaagaucaccuccaacuacaaaacgggacucggaagugaagauggauuuucagaggaucgaauuggcuggugcuguugguaccaaggaggaacuugaaguggacuuuaaaaaacuaaagcagauuaaaaauaggaugaaaaagacugauuggcuauuccucaaugccuguguggguaaguuucuggguuuuuguuuauuuguguguuuuggguuuuuuguucauacguuugggcuuuuuuggccuuauuuugaauaagaugggaaaaggcauugaaauggcuugaaaauaagaggaagaucaguauuacuucgcauuugacuuauuuggugugauaguucauguaugcaugcauaaaguucuguaucugugaccuugucugccuuguaccaaaguguccacauuuacuugugaacaugcuuuuuaaguuaaagagacuguuaacacaucugugagaaaguauauacuuggaguuugaaauuguuucucuuauuuauuguaacaagaugugacagagcaacaccagcugcuguuucugaauguuuguaaacagugugagcaucuugugaugauagaggcuuuagucagaaguuaaaaauaucauaaaaaugugugacuccaagaaguugaacgaacauaauauuuauugaccuugaaaaugcugauguuaacuuaauaugaaugucaugucguaaauauuuauacacuugguagaacugauuucacagacagcuaauucgaauccauaguucagauuaugacuuauggguauuguguuuuuaguucuuucauaaacauaauguugggccuggcuguuuguguagaaauguuaaaggacagagacauguaagaggaaguuuuucuccaucuacuagcuuaaugaguuaauaauuugugcuauaaaucauaaaagcuguuaauucuguuuuguuuuauuugagacaggggcuuucaccuugguuguccuggaacucauuauauagacuagacuggccuugaacucacagaauccucccaucugaagguguucauuugauuuuaagucuccccucccauuaguagauuagguguuugauuuauuuauuuauuuauuuauuuauuuauuuauuuauuuauuucugagacaggguuucucuguguagcccuggcuguccugaaacucacucuguagaccaggcuggccucgaacugagaaaucccugccuuuaccucccaagagcugggauuaaaggcgugcgcccccagugcucagcagguguuuggauuuuauuuaaacuauuucuaugggcugcuuacuuugguguucacuuuuguuuagaaauacuugagugguuuauaagguuaaacuugauguggaaccauagcuaccuuccacuccccauugauuuacccuuuuggauguagccccaugaguauggaagauauagauauaguagugcucaagaaaccuggaguuucucuaggcuagagacauggcucagcaccagagcacuuuuugcucuuccaggggaccugaguuuggcucucagcaccuauaucagauggguuacaaccauccauaacuccaacuuuaggggaucuucugacuuucaugggcaccgguacccagauguaccuagccacauguacauacacaccuacauauaauuuaaaauaauaaaaauaaaucuuaaaaauaaaagaaagcugaaauuuuagacauuuuuaaaaaaaauucauguguuugauuguuuugccugcauauaugucuguucaucacauguacagucccuugcacaggccagaggggcaaugaacucccuggaauuggaguuaaggagggauugggaacugcauugugagugcugggaauugaacugugauccucuggagagcagccggugcucuuaacccaucuuuucagcucuuaaauuugagguugguuuuuguuauugcuguuguuuuuguuuuuaauuuauaaugucaaaaaguauguccuagcaguuugaagcuuagucuuagcuucuagaguucagucaucagagcacuuggcagcuguucugauuuucucccccuuugagccauggacccuauucuguugacuuuguugucuuauuucaccccugggggggggcguuuuuuacuacuauuuuccuacuggggucagauuuauauauuuaguauuacuugaugcauuuauaauauauauagucgucuuugccuagccuuaaaagguuuuugccaccuaaaagaaacuuuuaccuccuucccuccaccuccaucccauuauccuucccuccaccuccaucccauuaaucuguuuuuuauuaaaaauaucacaaaaaauguggcuccaagaaguugaguuagcauaauauuggccuucagaacaugucauuuguauuagugaauuauaugaccuuuugugguaacugugagucuuaauuacuuguaugucuuuguaacacuuaaaaucacauuugcagugguaguguacuauauguaaaucacauuugcagugguugugugcuaucuguauuuuaaucauaugguuaaaauacaaauaguauacauaaguuuacagaagaaauaaacuaacuucuuuaccuuuuuggaaggggauagaauucuuuuaggaaucaaggguuuuugguaucuuaagucagacaauccuaggauaagaaaugcuuuaaauuuuuuuccccucugaaaguaccagguagaccagucagcauauuugucuuuauggcugcuaguauuucaugucuuuauuacuauucuuccuucuuuauacuaacuuuuauuuuauuuugcauauucuuaauuuuuuugaauucccauuccgauuucugcaucuuaacagcugugaguucauuuuuaaaggcaugaccagucuugaucauuuaccgguuccuuuguucauaggguguuauuuugguccuuguuuauggcucuugauaagguggauucuaucuuugcuauuagcugaauaauguuauuaaucauaacaacaaaaguggaccuuugucuauuggguagucuuauccugauguguaaauaucauuccacuguguuaacuuuaaaaaaauguguguuuacauuacauuaauuaaaaagacaaaagcaccugagcaguaaggcugauuaaaaaguugccaugcacuccaccccuuugccuggguuacacuucccagauuuuauuagaugugggggacauuaugacuuauugauagugugcaucaaaaaucaucuacaugcugggcauggugacacaaccuucaauucaggccaaggcaggugaauuuuugugaugagcuucgggccagcuagaacuacacagugagaccuugucuccaaaaauauguguguguguguguguguguguguguguguuaagcagggauauugaacauaaaauaguauccugaauguaaauugugaaauauucucgcuccaaauuggaaaauauucucaugauuaggccagcuuggaagcugacugaggaagguugacuuguugagaaagcaucaacaguguugagcaaacaagugucugugguuauuggauauaaaugucacauaagucuuguuauggugugagauggcagugcccaaaugugcugucaagucaaaguguuaccugggugugggaacuagaaugauaaaaacaaaguucucuugucuuuccuguuagauagcauguagcuagaacaccuuauagagcagagcaccuaauuaauacacauuaauguuuguucuggagcugcauugagacaguuacuggugaaacuguauucuaauuugugauuaauguugaaagacacaaugcuucauauaaaucuauauuuauaacacauguaguacuugaacccuaaacuuacauucuuuauguacuaaagucucaucuagagugccuuaauauuucaaacucaccucagagccagugauagauuggaaucuuccugaguuuguguccuuacucuuuuuuuggagggguggggugggggagacagggucugauugugaaguucauugucguaucugguuuuguguggauuuuauuucuucauuucuuuuuaaaguaaagauuuauuuuuuauuuuauuuuggcuuuuuugagacagagucucacuguauaguucuggcuauccucagacucacagagaucuaccugccucagcagaucuaccugcugcgauuacaggaguguaccacuacuucugguuuauuuuuauuuaucuuuaauuauguaucuaggugugguaauuacauaugagugcaagugcucccagaggacagaaguauacguuguccuggagcuggaguuagagaucguuaugagcuucccagccuggguccuggaaacuggacuccggucuucugcaagaguguguguuguguguauguguacacaaauaagugguugaggaggcuacagguugaugauaaguauuuuucuugaucucuuuuccaccuuaauuuuuaagaugaggucuucaucagcuagcuagacugacugacuguugcgcuccagggacuuuccugucuacuucaguaguucuggcaguauggguuuuuuauaggugcugggcaucucaacucagggccuuuaugguugaguggcaagugcagcugacugaguccuuucucaccugucuuuuaaauugucuuuuucuuauuguuuuauuauuuuuuugagcugaggucuuucuauguauccuugguugugcuauuuagaccaagcuugccuccaacucacaggcaucugccugccacuaugucaguuuucuccuuuucacuauuauuuugagacuagcucucaaauuaguccagguugguuuugaacagaccacguagcuuuccuaaucuuccugcuucuaccuucuggcugguaacaaucugcucaugugcucuggaguaaguaaaguuuuucaaagauucgauaaggucaucuuugcauucugacacccucauccucacccccaauuguuuaccaugggauucaucugcuguuauacuuggcuaauagcauucuggcaaacauuucucucucucucuuucuuuuuucuucuuucucauuucuuuaguccuggggauugaaucuagggcuuuguguaugcugagcucguccacugagcuauagccccaaucuucuuuuuacuuuugcuucugagacagguccucaaaaaguuguucaggcuagccuugaaaucacugugcagcccggggaggcuuucacuuaugcuauuccugccuucagagugucuguaccaccuucucugguagcuaccuuuauucuguuuuuuauaggucaaccucacagaccuuuccucucucugaauugaauaguuuguuaaauuggcuucuuugggucuuuucucuacuuuguguguaugugcgugugcgugcaugcgugcaugugcugggagucaaaaccagucauaugcuagcuaaguguuuuaucacugagcuaauaccauagcgagcaucagguuuuucucagauuaugccuucucagggagacccuccuaacauuccacccuagcccugucccacugcuacugcucuucuuuuuuaaucguauuugccacuuucugaugcauuuuucaucuuguuuacuauuuguauuuccaggaauucuguuuuguucauagcuguauccucauacuuagaaagguccauccucaauauugugucaugugugaaaguggguuaccuuucuaaaguauaguaagguauuaaaaugugcuuuuuugucagcuacaaaaauauuuuuauauuugugcuaauauuucaguucuuauaacuuaauucucugaaaaaucaguaucugaggcaguuuccaucuugaugccaguugucuuuuuggucccuugcuagaauccuguguacugagcccaagcuagcuugcccaauuguaacuguagaaacauaccuugaugauauaagauuugucagaauauguuuguccauuugguuuuacaagcacccuguccauuaaaaaaauauuguguagguuuucuacaugaaaacaaauguaacagggcugaggagauggcucagugaguuguuucuuaagcaugaggaccugaguucagauuccaaauacccauggaaaaaaaccaaaagcccugguccuauaaugccuuccugcaaucucagagcucgaaaguaaagauaagaggauucuaggugcuuucucagccagccagcuggucuagcugaaaggucccagaaaauaagauagugauagaagaagacagcugaugcuaaucucuggccuccacacaugcacauaaaugucagcccaucuucacacgugugcauauacuugcauguaacacacauauaaauaauaauaaacacaacuauuaaugguagagggauagauguauguggugcacagggaagccagaaauguacauuggaucccuggaacuggaaugauaggugguuguuagcugccagguaugguggcucguauuuguaauuccaacucuugaaaaguagagauaggaagaucagaaguuuuaaguuuccagcuauguagugaguugggaugcacaaggcccugucucaaaaaaaauuuuuuuuuucaucuuuuaagaccuaaauauaugggccaaggagauggcuuaguggguaaaacucucauugcguaaaccugaauuugaucccuggaacccacguaaagguggaaggagagaacagauuccacagaguaguucucugaguuccacaugugcacucgggcacguauguucccucuuucucugucacaccuacacagcaacacaguaguuaauaaagguuuaaaaaaagaagaacuaaauaauauaauacacaccugaauuacuguguuaguuacuuaucucuugcugugauaauacaccuugaccaaagcaacuuacagaagaaaguaaguuuauaguuucaguagaagagucuaugaaugucaugacagggugcaugucagcagauaggcaggcauguacuggaguuugaucccugagacucacaugguagaaggagagaaccagcuauuacccucugaucucaauacauaugcauaucugcuucaccccuccccuggacauggaauaaaagagggaaaaaaguuaagguagagaacgaugaaagaguugaccugaguuuuacaggcagauacacaaaacuuaagagucaagaaugcacagaaagaauucaucacaguuggacugaaaaauaaaacaugguagaggugaccuauagaaaagggugaacuauuugaggucuauucaccuggauaaggaaauuuagcucuugcauaucagggcagcagcagccuuuuuaaaccucugaagggaaugccuccaucuaauugaugguuuaggaagaccauucuggccacaauguagaagcgaaugggaccaacacccgggaggagcagacuagagguagaacuggcaaaaguuggaagacuuuauauugucugagaggaggaagaggaagaggagauuguuguuguuguuaaagaaaauagucaaguuuuuuugguuuggacaccuggguuggauaguuauauagagagaagauaggaaaggacaggauaauuuuagacaugaugugaggacaucucauguuuguauuaugcauaagggcuugaaacugcugugcagaauaaaugaucaguuuuguaugggccaccauuaguuaagcuguggaacuuuuuccugcaguagcaaaugauggagacuuugcuguuugauguuuuugacugagaagcagauagcuuugugcucgucuucaugaacucaguacuuauauaacaugcuuucucacuugaugauucacugauuggaugaccaccagcucaugguccucacaucauaugccaccaaggauagcucugaauguggcccaaaacaaauagcaaacugaaaauauucagagaugugugauuuucuuuccuaaccucccccaacuugauuacaugcuuguuuuauuuuugcacacagggaguuggguagguuagagaccuugguugucuuggaauucaaucuguagacuaggcugaccuugaacucagagagaucugccuucugcuuucugagugcuaugguuaaagguauguguuaucaugcacggcugauuacaugguucaugaacugugugaacuuuguagaugacaguguuguauccuagugucuuaguuuggguuuuauugacgugaaaaggcaccauaacacacaguguuguauccuagugucuuaguuuggguuuuauugacgugaaaaggcaccauaauccagguaacucuuauaaacaauaacauuuaauugggacuggcuuucagguuaagggauucaguccauuaucaucaagguuggaaggugaggaucucucuuccacucuggguggagcuugagcauaggacaucaaagccuacccccacagaaacacacuuccuccaacaaggccacaccuacuccaacaaaguuacaccuacuaauuuugccacuucucaugggccaagcauauucaaaccaccacacuuaguguuagaagguuagacacagcuaccaggccuuucuaaaauagaauaauuuuaaacaaagucaaucaagacacuguggcaguauaggguguguguguauaauuuuuuuuuuaaaagaugggguuucucuauguagcauuggcuauucuacccuggaauucacuuuguagaccaggcugcccuugaacucagaucugccugucucuguuucuugagugugugugugcgccggggauuaaauuuuuguugcuguuuggaaguuagagaaccuuuggguuugauugcacuggugaauguggguuuggcauauaccauuuauguaaauucugaaaguacauuuuaaaauucuccauuaaaaauaaaaaaaccaaaacccuuccuuucaauuauauaguugagugauauuuuugguuauaucaaaacuggaggccauguucauuucucuaauuugcuaguauuuguaaauacuucugauggccucuacuaaagaugguuuuuaugauuuguuccuuuaaauccuuucaguaugcauuuuguaguacuuuuaucugcccaucaagauucccccccuuuuuuuuuuugaaaguaccugucauauuuaucuaugacuuuggaauuuauauuuucauaauaguuggguuaguagucugaucagagauggaagaaagaaagagcucagagguauaaacuauauuuguuuuagugcugucauuguuaauagguaauuuuaaaggauuaggaacuuuuugacuuccuuauuucauugaaccuuucauuuuccuaaagagaauguuuuaaugaacaguaagauugaaaagaaguuagccuugauuaugugauuuauugauuuucagagagauggucuaguuugcugcuuuugcagaggaccuggguuuaguucccaauacucacguugcagcucgcugauuauaacucuaguuccagggauucaacaccuucugguauccucuggugccaggcauguacauaguacacauacauucaggaaugcagucaaaacacacauacauauaaaauauaaaugaauaauuauuuucaauuucugauuucucauuuauugauuuuuuugaggucauuguucuaauacacuguucuaguaauagaaauggcaggucugagcuuguugacauugguuauaaugugaaaaaugcaacuaggagguaguuugucuugucugcuccaauuauuucuguaauuuugucugcuuguguguauuugaaggcacaguuaaaaauacuaagggcauuuaaaauacaauucagcuuuucaccuuggagagaugacuuaaugaguaagagugcuugcugugugaguaugaggaccuuagcacccuuaguauccaaacacccauguaaaaagccaagaguagccaucaacauguaacuccuuuucuuuauaacgccagggaugugggcucucuggcuuaccagccuaucuccagcuucagugagagacuuugucguaaaagaauaagauggaaaaugauagagcaggacacucagugacauuuucucugacuucuguagcacacacacacacacacucucucucacacacaaaugcaauacuuguuugagcauuaaaagaguuucuugcaaacauuugaguccagguuaugauuaaacuauaccuaaggauauuuuaaaaaauaguuacugggugggauaguuucuuauuaguaucaaagucaauuaaauaagacuuaggaagagaaaacugccuaaucaauacaaccagccacgucugcaucuuucuacugaccauccugcaggacauucugaacacuaccacuuaaaacuaacuuuucucuuuaaggguuccugaaauugugccugcugucucgagguccacccucaccccacagcauaaaccaugcugugauguuacacagcuaccauagaacuccaggguaguguugagcuggcccauguggguucagguaaguccuggcuuuuuuuuuaccauuuggcauuuuuuucaaaguuaguuaccauuaugauuuuaugucauaaaggaaaauaaggcaaaacuuugaaaacugugccauauaugggggaaaaaauaaguccauuaucuaaacauuuaaugagccagcuccagaugcucaccaauggaguuccauaguagcugugaaguccucagugagucugacccauggcuucaaaguauguuaggcuccacucuggcccaguuuauuagacaaugugaugugagcuauuccuguuguggcagccuuuuaaagauuuuauuuggcagcuaguacuugcuauauacuuucauuuacuuaaagucugaauaauuuaaaaaguacauuagcauccuccucauuucugauugccaguaauuagcuaauuuuguuuuuuuuuaauauuuuuuauuagguauuuuccucauuuauauuuccaaugcuaucccaaaagugucccauacccucccccucacuccccuacccacccacucccacuuuuuggcccuggcguuccccuguacuggggcauauaaaguuugcaaguccaaagggccucucuuuccauugauggccgacuaggccaucuuuugauacauaugcagcuagagucaagagccccgggguacugguuaguucauaauguuuuucuaccuauaggguugcagaucccuucggcuccuuggguacuuucucuagcuccuccuuugggggcccugugauccauccaauagcugacugugagcauccacuuaauguguuugcuaggccccggcauagucucacuagagacagcucuaucuggguccuuucagcaaaaucuugcucguguaugcaauggugucagcguuuggaagcugauuaugggauggaucccuggauauggcagucuuuagaugguccauccuuucaucacagcuccaaacuuugucucuguaacuccuuccauggguguuuuguucccaauucuaagaaggggcacaguguccacacuuuggucuucauucuucuugaguuucauguguuuagcaaauuguaucuuauaucuuggguauccuaaguuucugggcuaauauccacuuaacagcaaguacauauugugugaguuccuuugugauuggguuuaccucacucagaaugaugcccuccagguucauccauuugccuaggaauuucauaaauucauucuuuuuaauagcugaguaguacuccauuguguaaauguaccacauuuucuguauccauuccucuguugaggggcaucuggguucuuuccaguuucuggcuauuauaaauaaggcuguaauuagcuaauuuugaguguguaaugauaucgugguuuuugguugguuuggaguuaaucucagaguccuuccaguucucuuuuuauuugccuuuauaauaacacaaagaagguaggacaggaaacacacaauauaaguuuguuaaauuaaagaauacuaagguauuucaguuacuuuuagggacauuaugaguggucagaagcuuaaagaaaagguauagauaauaccuaucucuucucuuagaaugguuuaacuucccuacucccagccugccccacccagccucuguucuaugaagugaggguucaucacuuaacguuuauuuguggcccuuuccugccuucagugcuucggcuuuuucuuacuuuuaucccugauguuagaaguugcuaaaaauguaaagagcucagggacaucuuugugguuguguugcccucccaccuccuaagcagaaaaaugugguggcuaaaguuuaauuuaaugacacaagccagguagguacuuuuaaacaucaaaccuucagugaaagcucaagugaagaaacucuaaacuugaucaauaguucuuucuaagcaauauguaguaaaaguuaacaaaacuuagacaguuucgugaugcucucaugaacuuugaucuguaauaaauuuauuaauccuuguagaugaaaauuuaccaguuaaacuauaagcacguauaaauaaagaacacaauggaauuacauauuccaaaguguuaugaaaaagagguauauugggcuggagagauggcucaguaguuaagaggaguuaagacugcucuuccgaagguccugaguucaaauuccaacaaccacaugguggcucacaaccaucuguaacaaggucugauguccucuucuggaaugucugaagauagcuacaauguacuuacauauaauaaauaaaucuuaaaaagaaaaagagguauauuguaccuguuugugugcugggagguuggagucuuuuuccucugucuccuuuguuuccggucuguguuuuggggaacaacagcauagucccgcuugaguuuuaacaaagacuugagugggaggggagaauucacuauuuuugauauucagaucaaaugaaaauucugacuggcucuguguaugugacucagcgcucugaggugugagacauaaaacauagaguucaguuuauaguuuuguaaaggauauguugaagacaggcaggcaguaaugucaguuguaguuccagguguaguuugcuuagguuggugugccuuuggucugaucucaccccaugugcuagugcuaauuucagaagucccucagaaacgugaguaaggaaacaaaugaagaacuuguaagacaucagcuauauagugacuuaacugaagaggaaagacagagauuuagagggucuucucuucuuccaaaccaaagaaagaagucacuugguauuuagcuuuagauuaccucauaauguacuuugggggaaaaaguauuugagcacacaacaguuuuauacaugucuaaauauguguuacacauaugcauaaaucuuccucuuugucuauucagguauaccgauaagcucuugggcuacuuuuagaacuuggugcauuuuaugugugauauguauuuuauaaauagauaauauuuuuagguuuuaagccaaaaucuguaaaagguacagagauguaguguuuuuuacuuccuauuuuggggaucagacccauugccuuuugauuguuagauuugugugcuauuacugaauuauacuuccucccgaguuccugcucugauaggacugaacgggggaaacacuugucuuuguaaagacuguagagaagggugcaguggccuaugccuguaguccugucaguugggugacugaggugaaauugccucaaguuugaggucauccuuuaguauacagugaguucuagacuugggcuacauugagaggcccuaucaaucaaaauaaaauaaauuacagaaauaaaaggagauggugaguauacccaguuugaauacuacaaauuacauuaaaucauuuuuaggcauuuuguuuacuugaacauaauuagaaauaguaaacucuuuacccgauagacaauugugauuuaagcauuacuacuuauaagugcucuuaagguuugugcuucaggaagauguuauguugucucaugcuaacucuacuacaguuugguccuagggacuucuagggcacuguucuucacaaggauguuuugaaaucuuuauguuuaaaguggauuaggguuggcauuuauaguugaacuguguggcaagcaauguauugacccaaaaugcaaacuaaaauuuuuguaagaaaacauucuuugugugugugugugugugugugugugugugugugugugugugugugugugacaggguuucucuguguagcccuggcuguucuggaacuaguuauguggacuaggcuaggucuaaaugugugugccaccacugccuggugacauucuucuuuaguaacaugagaguuacaguugguuguucaugcauggcaaaaggcuagccauggggcaagcuucacucccagcuuaaauguagucggcuuuuauuuauaguuugaguugaaaaguuuuguuguuauuacuuaggcgcucauuaagcucuuaggcucacuggauccuccugucugagagaccuaagaacuaguacuaugcaguccacaacaucaugcaugcgcucuuaugaacccuauccugaaaaguuuguauguacauguugggguuuggggccagaguuagauuuguggaaaagauccaugacuuuucagaguuugaaaaauuguaaagcugacuucauucaugucucacagaugugauuuaaaaggauuuuugggaagauuggugucauguacuuacugucuuuugugcuucucauauugccuagagcacacaccacagauauccugugagugugaaaauuaaaugaucaauuuuaagauugguuucuuuaauaaagaggggacuguuguguuauaccagguauaaagaguacuuuuaucucgauuccuaauuuaacauggcaauuaaaaugccuuucaaacgcacacuaagaauauuuuuagcuaauuuuagcauuuacuuggaagaauguuuuuuucugauacaacuuaggaaacacagaaaaaguugguaauuuguuuuacuguacuuauuaaaagcuaguguguauuaucucccccucaaggcuguuuauuauccaugcugcucaguaaguacuuucuuuacuuaacauuaauuugugugaugguuaauaacauaguuaaaugggaauagaagguuuauggcuuugaaaaugguauuuauuuuauauuccuauucuaauuguuuuauuuuagcauauuuaaaauuguauaagguuucuuuuuaacaacuaucacugcccugccuguguaguguccccccccacccccccaguagaccauguuguauggagaucugucugcuucuguuucccaagcgcugggauuaaagguauacacuauccacuuucuuuagagacauuguuucucuagcauaggcuagccugaaaaucauuguuguaguccagacuuuucauaagcauccugcccucuugcuuuuaucuccuaagcagagggcugcaaugacaguugugaaucaguacacauagacucuucaugaacaauuuguaacauauaugaggaagucuuaggagauucugaaaucaaaaugcugucaauuuuuacuuaaaaugaaaauuauuuuagaccuacacggcacaguagaaagcucuguguuuguucugcuuuaaaaaugcagguaaagggggcuggagagaugacucagcaguuaagagcacugaccgcuguuccagugguccugaguuuaauucucagcaaagacagggugacucacaacaaucuguaaugggaccugaugcccucuucuggucugucugaagacagcuacaguguucuccucuacauaauauaaauaaauaauucuuuuuauuuaaaaaaaaaaaaaaagcaagcagcagguaaagggcagaaacaggcaaauaccaauugaaagcucauguacgucucuuuggguuuugcgaucagggucaguacagaacaauaaagguucauuucuucugugaagucuaguuucucaaacuagguuguccucauuaauuuuaauccacuuacuguuagagcuugccauagaauggagccuagccaugaugugagagguaaguaccaaacuaggcaguucuagucuggaaauuuugaaauuguagagaaauacuaauuuuccuuauuuucuuuaggugauguaaaugauaucccaggauccaggaaggacaaagaaauguuugaaagaauuuaauguggucacuucaucuguauauaccuuuugaaacaaaauaaguucuuuucuauguuggugcuuguuuuagguguuguggaaggugacuuagcagccauagaagcauacaagucaucgggaggagacauugcacgccagcuuacugcagaugaaguacgcuugcugaaccguccuucugcuuuugauguuggcuacacucugguacaucuggccauacgcuuucagaggcaggacauguuagcgauauugcuuacagagguaaguauggugauuugguuauugaauuuagggguaaauaaauguuuuaccacugaacugucaccagcuuuaauguucuuauaugaagaaauagguucuuuaguuuuuuucauuauuauuguuuuugugguuacacuguggguugaguauagggccuuguauauucuaguguuuuaucacugagcuauguccccagcccuaauuuuuauuuuuaauguaacaguguuuucucaaacuauucuuaaauguuuuaaacauuuuuacuugguuuuaaaaaccauuuuacauuuaagagauuuuaauaguuuuguaugaaucuuuugcuugcuuguauguauauguguggacaauaugagugcagugauuucaaaggccggaagauguuguuagaucccuuuggaacuagaguuauaguugguugcaagauguuauguaggugccacaaacuaaacucauauccucugcaagagcagccaguguucuuaacuacagagccaccucucaugcuagcuccuuucauaguauuuuaaaggagacuccuucccugguauguuuuuuuugucguuguuugauuuuugcuucuuaaaagauagggucucauguaacucaagugagcuuuguagguagccaagaauagccuuaaacuucugauccuucucuguuccaucucccaagugcuuagauuauagacugucuuaccaauguacccucuucccguuuugugaugagauauuacugugcugcuuaggcuggccuugaucuuccagggucaagugauccaccaugcauacaacaucuugcuuugaaaugcauauacauacaguuuccugaguugaugaaguugcucauuacaccauugucccuagcaauauagccuuuugaagcgggacuuuucuccacaauauuugagucauuagauuuuauuaaaacacauggagacuuaucuuuuauuuguucauucaacuaagaaauauuuauucaguacuucugcuaugugccaagcuuuguggcugaggaggauauaauuguaaguaugccaacucuuccuuuauugaguuucuagaaaaguggagacaugaaagguaauucuuauugaguacuuaggaaagaacuugggagguguuuucccuuaaugcuuagagcaaauccuauuucagcaaguuucucucucuucuugcuccugcuccuccuccugccuuuccuccuuccccuucacagaaucucauauaucucauaugucaaaacacagacuaguuuuccacuuguuaugaaacugaggauaacuuugaacuucuaacccuuuccuuuaccuucugagcacuggaauuauaggugugucacugccacaccuguuuuaugucauguuagggaugaaccuugugcauacaggguaccugaaccccauuucauuagauuucuugaggaggaauagaaguuagcaugugagguaagcuuggggagaaauugaguuaauuagacuaugacgguaaaagggauccuauuccugaguauaugacuuuauuuuucagauaggagacuuuaguuuucauaaugagauggguuccguuuuugucacuguacauuuucuggguauacuuuauagaaauauauaaguugauauucaaaugugccaguguccaggauacuguauggagauuuaaaaauaugcaagguagaugaaaacucaauuuuuuuggcuagccauuacauuuaauuuucaagaucccaguaacaucaggggaaaagguuggguagacugagggaagggauucagaaagaguggaugcugugaugaaaacaguaggcaggcugcugaguauuagauauguguuaugaaaagggaucauugugaguagagggaucagauuuuugaaacgugggcuagaauacaguaucuuugugguguccuaaaugugacuguauugguguuguaauauccacuagaauuguugcauugcagaggaugucauuguaauugguauaguugacaaugguggcaugugaccagauaaaagaagauggcugugagccaggguuaaauuuuuuuaggguauuaauagauuucuuugggcuuuugaacacagggcucaaaggggacauucuaguuacugggcuccuaaaagcagucuggagacuaauggugagauggugcuaaaguaucuaugaauucauaauuuaugucacaaauuaccucaaaauuuaguagcuuuacaacagacauuuuguuacuuaaacauuuugcaggaguugggaaucuuagcugaaugguucaggucaagaugccaugagagggccuggaagaugacucugugggaaaagguuugcccuuagaguguacagaucagaauuuaaauccucagcacugacaaaaauguuggacagggcuggagagauggcucagcgguuaagagcacugacugcucuuccagagguccugaguucaaaucccagcaaccacaugguggcucacaaccauccaugcccucuuuugggaugucugaagacagcuacaguguacuuacauauaauaaauaauaaaaucuuaaaaaaaacguugaacaggcaugggggccuccuguaaucccagcacccaggaggcagagucagaagaucccagaagcaagcuggcuagcuaggcuaacugaaaugauaagcuccaggcucagugagagaccugucuaguaaaagagaauggagagucauggcaucaaaaucuagcuucuaaaagcauuugaauaauguguacggguacucauacacaugugcauacacaugcacaugcaugcacuuaaccauaaugguauugugaagcuguuggccaggccaguugucagaaaacuugauuagcucuagaggaucugcuuaaaggcucauccacaaagggcuauuggcuauaggcuuaaaucccugcuauguggguucauucacaacacuguucauggcagcuggagucaccuaaagcagaugacugaagagaugaugcagaaaugugguuccugaguuuuuuuguuuuuguuuuuguuuuuguuuuguuuguuuguuuuuuaaaaaaacagggucuuacuauguaauccuggcuggccuugaacucaugguaauuuaccucugccacccugccugguauuaaaggcaaugcccagcuuuaugaaucaauuuaagaaacucauuauuuucauuuuuguaauauuuucuggggcugauagaccaacuuggggugagggaagagaaguguugguugaggucaagaacaaaauuaguauuaaauuuuuucaguggaaaguauaggugcugccaacgauuguuuuuaaaggggccauuaaggaggguacaaagguagggugcaaaucugaccuaaguguuuauagaaaaagcacagaaccagcuucuucuuggaugaugauuauuaaaagaaaaugccuuaugguuuaagccauugguuaaggaaagugaaggauucuuauguaguaaacucugugaaucuuuuccaauuuauggacuccaaguuaagcacaacuggccuaaggaggaugguugaggucagaaggcugaaaaagauaagaaacagauuucaggauuuuaaggaugguagugaagggaauauucaugcuuuucuugaaauagauucaagguccauuguauguuguuuaaaaaaauaauuuguuagcaguguuaucugacaaauaguccauucugaaaauacccaauaauuguuucuuaauuuuuaguuacuugaacuuugaguuucuagguucauggagcuagaauguaaugaaaaauuuuauaguacuggcacucaauaaaaugaaaacaaagaguucuguagcugugcuaauucugcugcauucuuaccaacucuggcuccuuuaacaucagaaaugugcagaugauacuguuaaccaaaaugcacuuucaguaaauuacuacaagacaugcugcuccaggucccauuuauaauaugaagguauuuuuguuguuguuguuguuguaguaguuguuguuguuguuguuuguuuuuugguaaggagaaaaccaacuuguucucaccagauugcuaacagcagagagcagaacugacuggcucacucggcaugcacuuuauuacuuacuaauagaugcucuuccuauacuuagaguuccuacagagguugguugguugguugguuugagacuaguaaggcuuaauuucugaucuucuaaccucagacuuucuagugacaugauuacaagugugugccaucauucccuguccauacaguaacuacaauuggagugcuagauggagucuguaccauuuguugacauuccacauuuaaugacuguuuucuugaacaguuguccugaugauguaaauguccauuggcaagggaauaauacccaguauauuuaagauuaaaaaugaauuuggggaaaauuuugcuuuuaagugcuguuguguuuuguuucuauuuaugaucuauaagauacagagggaaguuucuuucuguauuuaagguaucucagcaagcagcaaaguguauuccagccaugguguguccugaacugacagagcaaauccggagagaaauagcugcuucucuucaccagagaaagggggauuuugcuugcuauuuucugacugaccuuguaacauuuacauuaccagcagguaaccccgacauuuauuaugaaagcacucucuguuuucuuaagguuacauuuuuaugugggguaaaaauacaguacaaaacuuacaaaaagaaagcaaguaaguugggaguuuuaggguuuuuuauuuuauguguauggauguuuugccuacauguauauuugugccccauaugugugccugguacccauggaggccagaagagggugucagaucccugggaggcgauagugaacuggguccucuggaaaagcagccagugcuuuuaacugcugagccguuuuguuagcuccauagguuaggaucuuacaaucuguucuguuuauucuugaaaugacucauacaagaacuacuuguaaacaaauacuuugaugguuagaagacaguaaaugccccccccaccccaccccauucccccuuuuuugagauaggaucucauuguguaguucuggcugggccuugaacucaaagagaucucccucuuaaguccuggaauuagaggcaugugccaccauaccuggcauauuaaagacaaacauacauauacuaauuuucccccuuuuauuuuugaauauucuuuuuuuacucucuuauuuuuaauuuucccuuuauuuuuaagucugucuguuuacauacucauuggcuacuauuaagaauuaggauuaggauauagguuuuuaauggguuagguuauuugaauuaaaaauacugguaaugcauguguaugaauguuuugucugcauguguacauguguaccugugugugccuggcguccucagaggucagaagagggcaucaaauucccuggaacuggaguuaaggaugguuauaauccaucauguaggugcugugaauugaaccuggggucuucugcaagaacaaccaguucucuuaaccauugagccaucucuccagcucccccaaaggguuuuuaaggguaaugcuuuuuauuacacuagagugcucuauuaaguaaccugggcagaacauggaauguuugaggaauguuaccaaagcacugugucaaagugacuugguucauuaacuuuuaugagaaaauccuuaauuuugaaaauagcagguuugugcagaagcugcccauaugaagagaagagaacaaauuaaaauguuuacguaauuguuuuucuacaacuuuuuaauauuaacuuuaaauaagaauuuuaguaaugaaacccagaaaggaaacuacauacacauaaucauguuucauauaauguuauagauaucugagacaacuucaguaaauagggguuuuuauuaagguuagcauuccacuuauuaaguuauuaagcacaagaucugcuuuuaagucugacuuuucuaugcagauauugaagauuugccuccaacaguucaagaaaaauuauuugaugaggugcuugauagagauguucaaaaagguaagggugugaugagugccguaacgugccuuuacccagcuagcugcuucauuguguguaaugucgggagugcuccauuggagaguuguccugccguguuguaaauuaaacauguagagucauagugguuucauaugcaagguucuggauuugacccccagcccuaaaacuaacaauggaaaucggaaaagacauucauggucugugauaaacagacacagauauuaaauuuuaaaaucuuuguuuucuacaacuuacucuagaaugaauauauuucuguguuaaacauuuuuggaaaacaaaauuggaagggauuuggaauuugaauuauuuauuacagaaccacaauguauuucacuuauuuagaaaguuuacacuaagcugggcgugguggugcaugccuuuaaucccagcacccuagaggcagaagcagguggauuucugaguucgaggccagccuggucuacaaagugaguuccaggacagccagggcuacacagagaaacccugucucaaaaaacaacaacaacaaaaacaacaacaaaagaaaguuuacauuaauaaauuacauauaaauauucuuauagguaauauuuuuagcccauuaaauauuuuguaauuguguagacaugaaaaugaauguauuauuuaaauuucuuauagagcuagaggaagaaucucccauuauaaacuggucuuuggaguuggcuacacgucuggacaguagacuauaugcacuuuggaaccggacugccggagauuguuuacuugacucaguacuacaagcuacauggggcauuuaugacaaagacucggugcuucggaaagcccugcaugacagccugcaugacuguucacauuggugagccgacagccuuccuuguuucaguguagaacugcacuugccaguagugggcuacuuuucucacauauaaauuuuuuuaauguguacaggcauuuugucugcaucugugucugugcaccuuguauaugucugguaccaaggaagccagaauauuugaucccuuggagcugaaguuacaggcauuuugagcuguagagugcuaggaauccacucagguccucuggaagagcagcaagugcucuaaacuauugagccaucucagccaggugugguagugcucaccuuuaauccuagcacuugacagguagaagcaggcaaaucucuugaguuucaggccagccuggucuacagagugaguucuaggacagccagggcuacacagagaaacccugucucaaaaaacagcaacaacaaaaacccaaccaaacaaaaacuauugagccaucuuccuagcccuuacauaaaaaaguuuuaaagauuuauuuuauuucucuccccucuccccucucucuccucuuccucccccccaccaugugugugugucugugucugucugucugucugucugucugucagucacaucagucacgugcacucacuugugugucaguucuuccuauacuauggggaugugauugguuugguuucugugauggcucgcuuccucugucuucccuucccccccccccccccgcaacccuagaucuuaugaguuuaaugugauugcccuguauaguggauauagucucuggugcugaugaaauuuagcuggaauuuuaucgugguaaaucuugucaucuuacaaaucuuugaaaaguaguuuggaucaggacauacugguauacuucuguaacaccagccauguaacuugggaugguaguggcaagaaggcuaccuuuuggcuauguguaaagauccugucucagauuuuugccccauacaaaaccagacauauuaucuaaggcagacuaccuaagguaguuuuccuuugguaguaauugucuuaucuugcaaggccgaaaauaaauugagaauauuaguaguugauucacucuuuucccuaaaugagaaaguuuuauuuauuuuuuaauucuuaagagacauuuguggcuaauaauaguagcuuugggauuuauuuugucuauuacuuaaaacuggcaguagggaaucuucucauauuuauauuugaacuguccugagucauuugagauucuguuagucuaguacagggugggaagagguagacagagcacauaaauagcucagugggggcauuucauuuauuagaguuagaaaacaggagaugcuuguaucauuguggcauugcagcagaacuuucaggugucuugauucuaauguauaauucaaggugaagaccuagagcuguuaucucuguuaugagauaccuuuucuugguauuuuagaguucguaucaaaagcugaauugaaagcaaggaucauagagcuauccuucugguaucuugggaauagggucaggcuaaagaaaaugggaagagauggaguguuauuguucuugauuugggacucagugacuaguucauuaagcuccacacgugacugcuauguagcagaacgacaguggugggcaaacuuggguccugaucuaggcuaggaggaggagccaacauaucacacuuguauaguuccuuuaaaacugcucuuugcugaguugcuaauaugcauaguccaaaguaaccaggguagauucucuucugcccuguaaaaccccuagugaagccgagaaagcaauguucuauuuugugaaccugugucacucuaguuagacuguuuauaugucuuuauguguuuguagcugugcaguucuguuggauacuuguaaucugagcuggcugaugcucucgagacugaauauacaguacuguccuugcuuuguuguuggguuugauuugguuugguuugguuuugucuuaauuucccuuccuguuacugcaauaaaauauccugguguugugugacagacuuccuggggagaugcagcaccagucuacucaccuuagaaaagggagcucacaacagauugugaaccagcuugaugaaccaaugaguuuuauuggugggcggggggcuuacuuacaggaauaagcccacccagcaugguggcagcuuacagaaacuggaaaccuggagcacacuacacagcucaccagguucuuuucagguggcucaguuggucugagcuucuuauagccugcuucuuccaggcaacuaggcgugucucacuccucucuuagcaaucuuuacuguuuauauuuucuuggggagaugagggucuaaugagucuaguuaguuucagggacuuucugaagcuuuuuugaguuaagucuuugucuuaugugcuuccuuguaguauucaccucuccuuagaacauccuguuuuuucaccucccuguaaacaucucguuuuaaauuucccuccaagaugaaaaauuacucaucacaaaggaaacuguuuuacaauacccugaagcaauuuaaagauuauugggcucacauucuagauuacaguccaucgcugugagaacgucaggguggcaggagcuugaagcagucauccauagccaugagcagagagcagugagucagugcaugcaugcugggucucagcucuuccacuccauacaguccuguuguccugcccaggaacagcugcuaaauacagugggcaggcaggucuucccaacccaauuagcauaaucaguauaacuccauacaggccagccuagccuugaagauccuucauugaaugagauuugcuuccucagcaacucuagauuguguuaaauuggcaauuaaaacugacacuauuucauugaaauaucuauccauuuucucagaggaacaaguugggauaaucuguuaauaaaggggaaaaaucauuaacggucuuuuagaauaauuacuguuuauuugguagucauuuuaaguuagauuuuucaguauagacugcuacaaauucugucucaaguaaagagacauaaacaccugugccuucucuggaugcauacaguuaauacuggguugccacaaauacuauacucaaaauacuaaaaagaagacuaaaguguugauaauucuaaggcugaauuuguaauguuuucuaaaacaguagcuuuauugaaguacuauuugcucuaaaaaguguugaaagcauacuguucacugccuauuuuacguacauauguaacacccaccacugcagcagaguuauagagagagcauuuauucaccccaaaagagaacuugugucucuuuuucacuucuuucugcuucuuaggccccagcugcagggaguuauucguccgcuuccuguaccuguacauuuuucuuggacauuucauguaaauggaaucauaaaauauguggucuaugauggcagcauauucuguaguauaaacaaauaucguuauuaccuguaaaccaauggaaggacauucgauuuauuuuuguuuuggcucuuacagauaauucuacugugacacauacaaaucuccguggggcaaaauauuuuuauuucauuaaauaauagauuuguguagguaccuaagaaugaaauuguuggaucauauaguaaaucuacauauuuagcauuuuaacaaauggccaaacuauauuuuacaguaccuggacccuuuuaaauuucugucaacaauguauuugaaguucacauuuuucacaucuucaccaauacuuauucucugauuauggcuguucuugugaacaucacacgaaguuguaucuuuacuguuaccucauggauaacgauacugaauauuuuuuucauaugcuuauuguucauuuauacaucuucuuuguugaaauaccucucuaauuuaccuagcuuuuucuaguuacuugguuuuugguucucagaucagggcuucagugaagcaaacaucuacuacugagcuaggccccagcauuaugaucaaucuucaagaguacuuuuucuauuauggauauacuuucuguuucagguaucucuuuagauacauaaucuguaaauguuuucuucuaucuguggcuuauauuuucugggacaaagucauuauuaguuuuaauauguaauuauuauuuuguguguauguauggguguuuugucugcaaguaugucuguauacuacaugcaugaaguauuccuggaggccagaaaagagcaucguauucccugggacuggaauuagagaugcuuaugggaugccaugagggugcugaggcuaggaccuggaucuucugcaagaacacccaauucucuuaaccacugagcccacuccagcucuaaagucauggucauaaugacugucacuugucaguauuuuuaaaaucaaacaugcuauugugucauagcuaacaacaucuucucuaguugaaggcgugugcuggcuaguguuuugucaacuugauaaaaguugccaaagaaucauuugggaagaaggacucucaauugagagaaugccccuaccagauuggccuuugggcaagccugugggaauuuucauguuuaaugauugaugugggugagcccaacucacuggagguguugccaccccugggcguggugcuuagaugauauaagaaagcaggcugcaagccaguaggccucaauucuccuuggccuucuuucugccuugaguucccaucuugaauuccccuuagugaugaggugugauugagaguuaaaagaugaaguagacccuuuccuucccaaguugccuuugguugugguguuuuaucauagccauagaaacccaaaaccugaucuaagacaaggccauaaaguccucuguuuuugucuuuggaguuuuguaauuuuaaauuuugacauuaaguauuuuauccauuuauuaugaacuaacuuaauucuguagaaaucuuaauuguacaguuuacugaaaagauuguucuccauucugggcaguuuuguugaaaauuaacugacuauaagagguuucuuagcugggcagugguggcgcacgccuuuaaucccaguacuugggaggcagaggcaggcggauuucugaguuccagccuggucuacagagugaguuucaggacauccaaggcuauacagagaaacccugucuagaaaaaaaaagaaaaagaaaacaaaacaaaaaagaaguuuguuuucuggagucuuauuuuuuucccaucagaaguguaaauccuuugacuuaguacuucuguuugaagaauuuuuauucugaguccuuuagacuuuuuuuuuuuuuuuuuugaauaaacuuuaggauccgcuuaacaauuuuuacaaaaugcuagcugggauuuugguuguauucacagagagaaguuguagauuaauggcaaggauauugucagauaugauaguuuugagucuuagaauccaugggcagggacuugauuuuucaaaaauuaaucuaaacuugccuguuaccacuugguuauacauuagguuuagguugauugucugucuuugugugcccacuaucugcagggguugagaauuuggucuuaguaccuguguaugauuauuugagcaugugugguguagagaacucuuagcuuccuggaguuuugauuguagucacugcuuaauuucuggcuaauuuagagcugucucauuaauaaauaacuuuaaguacaagaaauuucuggaccagugagauuguuccacaaguaaaagaacuuuuuaccaagcccaacaaccugacuuuaaucuucagaacccaugguggaaggagagaaccuaccccuccaaguuguucauacgcucacacacaucaaauacaauacaaccacacacacagagaaaugucuaacuauaaaucuucaguuugaaaaaauguuugauauuuuucuuaagcuuuuuaaacuguauauuuauugcccuucaaauguagugcugugaccacuaaccuauugugaaaaagaaaugcuuuuuuuuuucaaaaacauguuauuauauuagaaacccucuugaauauuuugaauguaaaauacuuaaacuuguuuuuagauuuuuuuuuuuuuaauuuuugggggcugucuuauaguuucagaagagcaucauggcugagaguauggcagcaugcagggagacuuguugcuggaggaguugagaguucuucaucuugaucuacagguagcagaaggagacucugugucacacugggcauagcuugagcauaugagaccucagagccugcccacacugugauacccuuccucuagccaggccacaccuccuaauaaugccagucuguaugggccaagcauucacacacaggagucaauggggccacaccuuuguaaaccaccacaagugucaugguuuagaaacucagaacuuuauaagcuuauuaauuuuuauaaauaaaaauauguauaagcuuaguuuauaagcuuuauuaaauuacuuuaagauaacuuuuuucugccauagcuuucuugucuuuuauuucuugucccuggauuuaaaugauuaggaagauguggucuuucaaauuuaaacaacuguccuuacuucacacagcuuugcugguuuuuguucuguuguuuuuguuugguuuuguuguuguuguagaagacugcaugacaguuuuggcaaaauucuggucuuaaacuuuuaaaaauguuaagauuuguuucuggaccuugagauuuaugugucagucacuguaucaauaccagauuagcuuugcuauuugcauuuuuagguucaguuccaugagaucauucauucacucacggaugagucuaauacuaucacauugguaauuccuucaagugauccuccuaguccaugacauucuaguuagaauugcagcuggucaccuuggcugguauggaacuuggaggucuccugucucagcccccauagacuaggaucacagguguacacugccauacccagucuuuguuucuaauuguauaccuaauauaaacuuauuuugaguuguuugccuaaauuaugugaagacaucuuacagguuauuaaauauaaagaaggaauugauuuucuaguuaaaguaacuuuuauuuuagauuaucauauaaucaugagaucuuauugacauaaagaacucucagggggugauacuugcuuuggccuuuugaugugagggaggccuuaaauagccgaaaccagccuagaccuuucuacauucuugauucuucuaaugucuaccucccaaauguugguugggauuacaagcaugucuaggacccaugugaucuugauauucuuaagaauaugaugggauguuucagaggcauugucuuuacacagugauacaucauugaagaaauauggcaucuuugugucuuacaccucaaaugacauuuugaccaucuucuuuguuuuugcaucauagucucacugaauagccuaggcugacuguaaauucuguagugcuaagauuauaggugugggcuaccaugguuggcucuuuagugguuugaguuuauuaaguuaauauagauacuauuaaauaacaauaaaacuguuuucuucacucuuuuagaguuaauuaguuagguagugaauuuuguuaacagaauguaggcauuaauuuccugagagaaauugccaaaauucuacuuaucgugauuuuguuugccuuuugcuugccagguuuuacacacgcuggaaagacugggaaucgugguauucccagagcuuugguuuacauuuuucacugagggaagaacaauggcaagaagacugggcauucauacucucucuagcuagucagguaagacgguaucaagcuuuuucgguuuugucuuuguuugaaagagaagagggguaauccacacacucuugaguucuucaggcugaucagaccaugcuuaaagcuggcagucaacuuagcuuuuaacaaacaguagucaauguuaucauucuaucaguguagaacucugcugcauaaauaauugaggcuaacagccaucaaaaacuaguucucauucuuuuuaauaucagacagugacauuaugccaucuuaccuccacuagcuucagcuguugaguucaagcucacacuguagggaauuaaaggauggaacugaacugucagucuugguguuagaaauugacauucuuuagauuguuccuucaugacugcauucauguguuaagaggaaaaaaagcaagcauagucuagcuuacuuugaacagaugaccauuugucuaaacagguucuuugaacccugacacaggaaguuccuuuuguuuggacaauuuguggugaaacugugaaacaguguccccuguggccaugugauuagaguagcugugguuggagggugaacucgaacugguuaauguugccuuuuaacuuuguacacaguaaagcugucuucagaacuuguuaguaaaaugucacuuuauaaaguguuucuugcuaucucaaccuguuuccugagauuggagaguaaaugcuaagauuggauagcaaggaauaccucaaaaucauugucucuaucuguucuguucaugaguuuggauaugaacagaguacuuagacagagacuuagauuucuauuauaauuccauuggacuuugcuauuugucgaguuaauuucuuuaauuagacaagacuuucuucuuguaaguggauugaaagaguacacugaagauacuaauuuuuacacagcaguuacugagauugauaauaaaugcuuuuaagaaaaauugucuuuucuuuuuguauguguguacagccuggagcaaguuuggaacagacacacauuuuuguacuugcacauauucuuagacgaccaauuauaguuuauggaguaaaauauuauaagaguuuccggggagaaacuuuaggauauacucgguuucaagguaagccauuaucaagaacagccuaguugucuuguuuacuaugauuauauagcuguggccucaaaggaaaaaaauaugggagaagggucagagcagcuccugcacuucaggagguggaaacagugggugcgggguggguggguggccaggcacuugcuccuugugcucuuucuuuuuuccaggaguuuaucugccuuuguugugggaacagaguuuuuguuggaaaaguccaaucgcacugggcuauacaaggggccacuucucugcuuugguugccauggagaacgauggcuauggcaaccgaggugcuggugcuaaucugaacacugaugaugaugucaccaucacauuuuugccucugguugacagugaaaggaagcuccuccaugugcacuuccugucugcucaggagguaaguagcuugcuguccuguuagugaggcaguggccuucuaucaggagccauccucaugugccucccagaagugauggcaccuguagugcacuucuauacuugggaaugauaguaagcacuagagaauuugacuuguggcuuaaauauagagguguuagucuugacagauuucuaagauuuuuuuuuuuuaauuugaguuuuuuuauuccuugcuguguagaggauggccuugaauuucagccccucuaucugggguuaaaggccugccuguguuaccacuccaggguagagugaguugagagggcguggggcaaggagcugaggguacauauaaggcagugacagcaguguagaccagccagagagguagugaggauguauaaaagauacccaggaagcccauguucuagaaaaugauuggcuauuuauuauguauucuaguaauucccaaacacgagcacagugucaaggaagaguagcccaugacguguacaauucagcccagauguaguuuacccagcggacuuaccuugucacgucugaagcugagaccuuucucuugguauuuuucugaagggcaugucaaauaauuuaaccuucuaggguguuuucuuagacccuuuugugaagaaggcuguuucauuuaaucucaaugcaaaaaccuucuggguuuugaugauaaaacugagaaaagguugaaauugggguagaaacaguuguuugcuuuugcuuuuucauuaucacaggagcugccaguuauuccuaccaagugccugacauacugugugacuugccuuuuccuuguguuccuuuaaaagcuagguaaugaggagcagcaagagaaacugcucagagaguggcuggacugcugugugacugaagggggaguucuaguggccaugcagaaaagcucucggcggagaaaccaccccuuggucacacaaaugguagaaaaauggcuugaccgcuacagacagauccggccuuguacaucccugucugauggagaggaagaugaggaugaugaggaugaaugacaacaaaccuaaggaaagaaaaagaccaaggcaucaggucugagguggccucaaaguuagugugguauccuaaacagaauaugcagcauggagcgagccauacccugccggaucugcucccaaguuaucuuucuguuccacacucacaggagagaauugacugcaucugcaugaggagauggagaacuuugguugaacuacaguuuguaaaaaagaaaaaaaaaaaaaaaaaagaaaagaaaaaaaaaga

SEQ ID NO: 4147 - RNA, 140639 nt, Mus musculus
uguguuccuuuaaaagcuagguaaugaggagcagcaagagaaacugcucagagaguggcuggacugcugugugacugaagggggaguucuaguggccaugcagaaaagcucucggcggagaaaccaccccuuggucacacaaaugguagaaaaauggcuugaccgcuacagacagauccggccuuguacaucccugucugauggagaggaagaugaggaugaugaggaugaaugacaacaaaccuaaggaaagaaaaagaccaaggcaucaggucugagguggccucaaaguuagugugguauccuaaacagaauaugcagcauggagcgagccauacccugccggaucugcucccaaguuaucuuucuguuccacacucacaggagagaauugacugcaucugcaugaggagauggagaacuuugguugaacuacaguuuguaaaaaagaaaaaaaaaaaaaaaaaagaaaagaaaaaaaaagaaaaaagaaaaaaaauaaccuaauuuuauugacagaacuuuuuuuuccuuucaaauuguaaaucugucuaugaauguaacgcaugugguuguuugagaaguuguguacuaggaaaagugcaccagcaucuucauguuacugagaccauuuucccagcaugggcacucauaaacagcacauagcagacagaccagugagaugcucucucucucauuagcaccugacauccugcucccaccacaccagacccauuucccauuguuuuagagauuuggaaacuuuguacaaauuauccacggcaagauaaaaauaaacaagccuuuauuuuauuaauaauuuaguuccuguugugcccaauaaaaguaaaaaaaaaaaaaaaaaaaaaaaaucaaacccuuaggaacaaacuacaagaaaaacuagcaaguuuuuggagugaacuuaacauaaacauugucucuuguuuuuugaagaggguuuuaguuucuguuguuuucaauuuuuccgauuugccccuuucauuauuuagguauuuguuuggaagagugcccuguaaaggggguucuuacucgacucugggcggugcauuugugcacuucuacccuggauggauggauggauggaaagggagcaggcucacucaucccuggguggguuaugugacaguuacuuggacucaaccuguucuguucccaggcggccaugcagacagucuucagcuacuuccugucuuugucaccucugcucuaagcagacccuguauuaggggcaggccuuugguuaggcugauugggaauacaguucaguacagaauaaagauuuuuaaaaugcaguaagguggucaaugcauuguaugaucaguuucuguguagucugagaauuuuugcauguugguuaguuguagcauuauuuaaaguuaaaaccauacuuuuuagaaaaaaaauuuauggagaguguuaauugaccacuucagguauauguuaguacuggguaaacauuucugaccuccucaggcacacaacauguaguguccugauaagcacuuagacugauguggcaagcaguugcaaaguagcaaauacacacauuuccucuucuccuccccuuuaaugaaaaggcugugaaaccuuuaaaucuuguuuuucugaugagaugguauugaaguguauacaacuuuuaaguuugcuggaauacuaaaaagaaaaaacuuaugagcuguuaugucuuuaguucucucucuugugaacacuuaauaaaaagguguucucaggaugaaagaucauuuaugcugcaugcuaaaaccagaaaguaauuuucacaguaggugacuccauauaaaugaauugugguaacaauacugguaaauguuacuguuccaguaguuaguguuuuucuacaaauugacuauuucguuuucauuuugaucagugaaugauaaccaagucaauagaaggcugucauucuaaguacuuagcauccauagcaucuagaauagcugaucuccauguguagaguugauuuuucaggaggcagagauccaguuaagcaaaaccuuccucccaaauaagccacagagagcugagaggguaacacuggucucuaggugcaucuguguuguacccaaaccuugugguacagagucaggcucaggauugagccuuguucugcauauugucaauucuugaguguccuuuccugaguucccucuguauuuauauuauuuauuuauuuauuuaugaccagugacccugaccacacauaauuugauagguacccauucuucccugugggaaagaauuaaagaaggcuccauuucuuggacucuuaagauaggaauggggcuuucauuaguuucucuagcagacugcuggcugugaaauggccaaccccuuugggaaaucagcgcuauguuaagcucuugaacuaaaccaacagccauaauuauugucccaagaaaguguaaugccguccuuuguaaaagaugauacauggcuggguggcagguauagggauuuucagauggacuggacaguaauacuuuuauaacuacguggacuuuaugguucuuuuucuagggugaaaccaguacuuuguuuuuauccugauguugucguucuuuggagucaguuuauaaucauuucuaaaggacuguuugagcaaccacaaucuaauuaaacaaaaccuaggcacaccauggauucagaucugacuuucuguuucucacuguuagguuuacuacacuagccauaacaaauguuaaguacugcuguguagaugguuggggccucuuuuuccacagucacugacaagaucuguaauacggaagguacuccacgugagcucauuuuauagcgcaguuaagguagagcacccuccuaaaaagaaggcagccagacaggcuuacauuguaagacacuucauucucucaggaacaggaaccuuggaauugugagcauugagugcuacuucagaagguaaguacaaguggaaguuuucagucacuuuauaaauauuagguuacccucccucccccaaacaaagaguucacaucuacauuugggcauauuaaaaucaaaacucuaaaaauuaaccaguuuuguuucuggaauugacuucacuccaaagcacugccucaucuuuaggauagccuaccuaauuuggacuucugugagauaagacacugucaccacaagaguucgaaacugacugacagugucaagggcuagcuuuuacauaggcgagauguaaauguacaucucaagggcuagcuuuuacagaggugagauguacuuaaaugucaggacuuaaaagaaauuuuaauuacuuuauugaaaacugcacugaaugcuaaaauguccaccuuuacaauaaacaaauacaguaacgauaacucacacuaaaacaaaacauuucugauagccauuauuuuucuguuugggacaguuuaaaguuuuuuuuuucuuuugugucacaaaaacaggaauguaccuauacaaaggcucaaaauaggccaucuuuaaaaacaaaaaggcaaugauucacaaaagacuaugaauagaacauguaacuagcugauacaaaucuaauaggauuuguuaaaaucagucacaucuaauagcacaucugaaguguucuuguauaaaauaucacgugaagaaaagaauuuaucaaugucuaaaaaaguggguuuguucauagacaaucugacaaguuaccauaaaaaguguuuccugagacauaaggaaaugcaacauuauucuucuugaacccuucucguccaagacuuuccacucaauaaaauagcugaggaucugaaacugagaaaauagauuugaguacaaacagcuugugaaacuuaauacuuuuuucuuuuguucuuuuccuuuuuuuuuuuuguuuuuuuguuuuuuuuuuuuuuuuguaucagaggguuuuacugaaccgacucugcugcucagaugugaaaccuucuguauaggagcuuuuacuucuucaauccugugcguggagaugucuacacaggcaaacaauguccuccccaucuuggcuuaauuuuaaucuuccuaucagcagaggcaccagccccuggagaccaaagggacuagucuugauggggauuuccucucaacuuuuuauugauauucggagcucuugaugcaacauucuagagcaagcucugcaggaccugcugugcccaggggauugauaaaggaaaagcucuauuuauucuuugugauuugaugcacagaugaaaaacuuaacacacaauaacagaaguuggucguuaauaaucacguccuagucuucccacaccucuggaagcagauaccaucuucaguuuucuagcuuuuguagcuuuaacacugcaguaucagugauguccaggaucaguuuaaaagaccaucaaauucauccguuuucuacugucucuuggucccaaguuuaucggauuagcuucaggcauucucugcuauugcucguuggggugcucucgauuguccccguguuuugugggcugguugggggaaggagcuugggaggggugugccacuguggggagguugugagucacggggaugcccccagggaugaucccuuccaucgcuggaggaagcccuccuggagccacaccuacaaugccggguggauaccuaaggaacacagaaaaaaggucuuaaguucaggccaguacacaaagguuuguuauccuuaacccaaaguaccaguuaagaucaagguuuccuuuggaaaauagccagucagguaaagugacuuugugaugacccuguuuauuucacaaaguacuuaaaguggcuacuaagcucguuuccuuccuaaauuuucauguucaaaucuuaaucucuaauauacugagaagauggaaguuugggguaaauggggacaguggggcauauuuaugucuuggccugaauuuucccuuccagaaaugaggaauggccucguaagucacuccugagauggcugaaaccucuaggauagcuaguuaguccuauguucccaggagaggauggcugugccuuucucuguauguggagacauucauuaggcacuaugcaugagcugccuacagagcauaugguucuuacaaugugagucaacguauuuaguuaccaaacccuuuguaacugaggguuauaucucacuguggaagccaggaccucucagcaccauucauuuuaagagucuccugccaggcggugguggcucaugacuuuaaucccagcacuuggguggcagaggaagucuuauaagcccuggcaccuugaagcccuaugaauuguucuagagggccaaagagauuucugaguugaaggaagagaggggcuuuuagggugggcacuaacaugaaugaacaagauuauaaugugcacaauuaugccugagggcaggagauaagauuggcuggccugguggcucaccagaacucaaggucaugaagguuuccaugaguuugaggcuaacuuggacuagaguaggacuaugacaugaaagaaagaaagaaugucaacaaaaauggagccuggguagaauaaaagggccaugugauccagaagcgucagagccuucacagaguaaacccagucucaucguucuaacuuguucaagcaccagaacuugaacagucgucauggcagcauuaaaguacaucaguaaaacaugguuugguccacguggugcugaguauucagagagccaaaggauaccuuuaaaaaaggcagcuucucguuucccuagaagccagcaaugauggagaagucgaucaugaugacccccacaagugacacuacugcuuccuagacagaagagucaaaccagaaaaugcugaucugauuuaagagguugcagagucugcaguggccucccaugaaggugguucuaccugggauuauuaccuuaaacucaagaggacuacaauggagcccuucuugucugcaucuccuauucauucugcauggaauuugcugggcugaucauacacauauaaacgacaugcaagguuugaagccaguuugagcauauacugucucaaccaaaaaaaaaaaaaaaaaaaaaaaaucagaccaaccugaacagcuccucacccuaacaccuuggaaaaagugauuuaccuuggggauuuuaggcauugaaaauagaauacagaagacguuaaaauggcugauuuucuuuuaagggccaagguuauaucaacuaccuaggucugggcuuuuauugccuccuugccugacaugauguugucaggcccagauaacuucaguucuucucaccuguauguggcaccauugagcucggggugaauugcuugcuggucaaugacugaccaaggagcugaagucacgaagaauucuuuguugacacaguuucguaagcuuucugggaugcgaccuagaauaagaggguuauacagucauacucauuuuuugaagcaugugcacaccaugacacaugccugguagucagaggacaccuccucuaugugggaucuugugauugaacuuaggguggaaagcagguuccauuagcagcuugaggcgaauguuuauuuuuaagguuacagaacuuuucuauuauacaguggcuucagcuuaugcuugucuucagcuacccucucucuguaauucaaauauaggauuccucaaaaucuaguucagaguucaaauaaaaccacccaaauacaaaaagccacauguuggguguuggggacucaccugugauugcucggcggaucucaguggcugcugcuucccucaucucuagugaugcuuguucacuguaccaggcuguguguggugugcagaugagauuuggagcauccuucaaugggcccugggcgaagcugggugaauggaaaguauucaguaaaaaaauggguuaaguuuaauacaauuacuaccgauaagggaggccuugaggccaugugagacaguagcuguguguguuaacagagagcagggaagcccugugucagauuucacuaguguuggguacuaugaccacaacuacagaaacaggugugccagagaggaaaaaaagccagucaagagaucccuuccagccagaaggaauacuccaggaucuacagaccaaaaagauaccacuuuuuugccuuugcccucucuaauguccuuuggggaucuuuucacuguacugcagaguccuuaggaaaaaaaaaaaacaguggcucuacuaagcaucauuugcagaguuuccugcccaggaacugguguuagaaaguucuucaaauuccaagugacagaucagauguggaaucagugccccaccccuguacccaguaggaagcuagaagcacacauaccugaagggcucagacucgugcacauccagggcagcuccucguauccugcccuccuugagggccugagcuaaggcuuucucauccaccaggccaccucgggcugcauucacaaggaaugcaccuugccucaucugcagaaggaaagagaagcuggcuauaucuuuaucucauuagaguagcagggagaaucucuggaacagaagcuuccgagacaaagcugggcaagcuuggagcucugcggcucugcuguuuccccaccauaggcagcagcaguucaggggaagagguuggaagucuugaccguaaaaguaggccagaaguauucucuuucuugacagggccauaagguacaaaauguuggagcugugcuugucugcccgaaggggugaauggaagccagcuggguccuaagcucuauuacugauuugucccagggacacuucccuguagucugcugugcccguggcaggugcuauuugacucugcagugaagcuaagaagagcucauuugccuucacauuaccugcuugauagugaagucauugaugaggugaugguugugcucguucagguugcagugcaaggagacgcagucgcucugauauagcaaguccugcaggguguagacccuuugcacgcccagagaucguucuaucccauccuguaaguaggggucauaaaauaugacgcugaauccaaaggccuuggcucgaacagcaacugccugcccugugcgaccugugcagagauagaauguccaagugagaaagaaaggccugcagaucuuguaugcuguccccuuuaucccaugacuggccagagauuaucaucuuugcuggcaagugcuaccgaguuaccauaccaaagcagaaugugucuccucagacugucaagacgccacaggcuuuuuaaaaaaaagacuuuaaauuaugcuuuauauuuguacguguaagugcagguacccagaggccgggagggcaucugugcuggcuagucuuauaccaacuugacauaagcuagaguuaucugaagggaggaaaucucaauugagaaacugccuccccagagcuagcauuacagagagauguaaagugcccaguauggaugcugggaacagcacauaccuuaguugacuagccaacuccagccccagaggauucuuuuaaauuauuauuuaucaugggcacuuucaaaccaauacccauuuagaauguaaugaaugucacauguccuuuccucagguccagacaucaccaauauguuucccugucuuguucuuucauuuuuguuuauauggcagcuuuaaguggcacuguccuuccuucuuguucucaguaugugaacaucaauguuucugcccuaagcucuguuggauuuguuucucucagagagguaugagggucaaagcaccauuggcccuaaagcuuaauagauucugaugugcaguucuaaccuguagucuaggauacuccaaaucauaauggaugucacauagugggccacaaaaacccucugaacuccacaggggccauucuaggcucaaauccacaguugcuccuugacagcacuaccaguuuuuuggguugaaaaugaugguuugacuggauuucaacuaggcagacucuaagguacaucuuaucuaaaacccuauucaacagaggcauaguacugcaugccuuuaacucuagcgcuccggaagcagaggcagguaaaucucugugaguucgaggccagccuggucuacagagugaguuucaagacggucagagcuagcuacacagugagagacccuaucucaaaagucaacaaaaacaaacaaacgccccccccccacaacaguaacaacaaaacuacccaacaacaagccccacccucaaacaacaacaagacuauucaaagacgugagcagggcaguguugaugguuuaguggguaaagucccggcugccaggucugacaacccacacugcagaaggggaaccaacucugcuuguucucugacccccgagcaaacccuggcagguguacacccacauauacuggcuuugaaaaugauaggaagaugcguauuucccaacagccagcagcugacaguuaaucugguugguagucccgcccgccccccaacaaaggacuaauaaggucacucugacagagagggacagcugcagugacaacgucaucucucuuggaagacacagcugaccaggagcuggacuagccacacugcaguguguggcaauggagcaagcaggauuggacaguggaagguggcagaaguguggcagagucagggacucagugauaucccugaaacaugggauugaggaccccaccaugugguccaugcccaagaggauaacgauuccuucuuguaacugugugcuacacgguggccugaggccuuuguagguccaguaccucaggagguggcaggagcccagaucaccaagacagaucuaaacacccuguauugacagugccauucucaguggagaugucucaucgccucccacacagguuuucacugcccucuaagcugacccagagagcuucugucuaaagcacugucaaaaaucacagacccuguagaugaaaaccuaagggcacaggccauauuaagacagaacccuuuuauuuggcaguacauaaauaguuaaaugugggcccuggauaaagguggcaugaugagaaguauucuaguuuuuaauaaagcacauuuuuaaaaaaaugccauaaugguaccuaaagcccugugugccaaauuaaaaacaaaaucaaauccggauaggcaaauaccuagacaauuuuuauaaauaugguacgaagccugagagaccucugcucaggucuguugcagguucacuugaggcucuccuguuguuaucagcagagcuaagaggaugcucuugguccacaccaggggcucuaaugaggagccagcuaauagccuucuuccuaucuguccucuacagcucagggggucagaucugugcagagagccagggagacugcagcagccaugaguguagaggagcuaagcaagggagcuuaggaaaagcugaaagaccccacccaccugaaggcucuagaauacggagagcuucccaccaguuggcuggcugcucagagcugcccacagguucuacagccucaccagagaccauacaucccaagccacaagaagggcuuccaaaacuugaugagcacuuuagagucacaggaagcacacuaggauaccagcagagggugcugcgguguucacccaugguaccugcauuucugaaggcgugugaaaccucacagaaccuuacucagcaccugaucacuugaacucggaccccgacugcuccagaggccagggagucaugcgcuggagaaagaugaguagcccugcagccaacugucccucuuuucacgcugccucucagaagccgagacccucaccuggcucugagcuaaauaaaggugaugcaaacuggaaauguuuucugaaagccagaauugaacuaucccauguuacacuugggucucaaaagagguagcaaccauauauccccugcugccaccucuaguuacagagccagaaauggaggcagugaagccaaauaauucccugcuuguuacacaguaggugaguggcagcagccagcuaggggaccuauuucagcccacacuugccugcuucccugguccccccuacugcacuugcugauauugccagggccucugcucaacuaucuccauggcaacaaccagguccagaaagaccaugccuugucccauccucacaagagauuuccaagaccguggccuggcauuacccucaggcuugaaucuuuaaguggcuucauguuacugcugcagggugccaucugcauucaguagccuucaggacccaugggcccagguugcuauacaaacacacagcuaacccauuauccucugccccagggagguuuaccaagcacgccccuuuuccagugacagcagaggguacacucgugcugcaucccugaucggccacauagaaacauucuuguagaacaggcucggaucauaucucugagcaaguugacccuuuaccuccccacacaguagaccucucaaggggcacauaccaaagccaaugaggcccaguguuuccccucggauccgagcagcuccugaggcgaccucacggaucuguuccacacucuguacucgagugccuucucggagggccugguagagccauguguuccgccgauacagauugagaauguggcagacugucgaaucugcugucuccuccacugcagcagaugggauguugcacacagcgaucccugaaagggcaauggccaggcacagaggugagcgacgacccuggaucccuaagcacccuacuuagaaauggaggaccacuccaguguauucagcagacuuguuucugaagcucagcagaucucgacacuccacccaaagguucuucagccucagcuuuaccugggcaggauucagaguggagggccagaagcccagaccuuuuccagagcuauauuggucaaggagacaguuugaaccuuaugcacucuuaaugaaaagaccacaccaccacucacuaaucacuguuugcaaacauagcucaggccaagcauggcaauacaccaacucugaaggccagaggcaggaggaucuugauuuuaaagcuauccacauuccuaaagcuuguggcugauagaagacaggaggccacugggggaacuaacugccuaaugggccugaggacaccugagguggauugcucauuccucagaaguaacccaaguccccaggagaugucuggacacucccuucuugggcagagggcauuuugaggaaauggguagcucuccuggccacucuuuagggcaaggucuagauguccuguggacagccuaguaaacagaagaaagcagaggcccugacugcucacacguaaccuuucuaagcaguggcacaggcaacguggcuauccuguugcucaggacaaauggcuuccucuugaccuacagaugguaucugggcaccuacuuucaggguggccuuggguucugauaguguuaagacugagggcuagaacugaaaucauaagacaggaaagcgaugaacaguucccuaacgcucuuuagcagcaguggcaugucucauccuguuaccauggcugcccuggcuccagggcucgaugagugacucccucagaagaacagacagcucagagugaggcaaggcacccugagcaggucacccuggcugccuggcugcagaggacaucucuggaccacaggcauuugcuaagggaccuugauaauggguacuauugcucuuaugaggugaggggcgguaaaccugcguuagcagaggggucucaugcaugagcacagaccucaggcauugugaggcagugcuguuagacuggaagggcagaagcacacccaaaaaaccuugggcacuaacgccaaucuucaguccucuaaggaaaagcccaguggaagguaagucagacugugcuguguuguccagcuguggcucagugcugcccucagcugacuaaugacaaccagugcugcaggugcccaugugauaaaggcaaugguugagaguggaacacacagaaggagagcaaggaaggaugucugcucaacccaacccacaaggcgcucaauguagcuucuugacuccaguccccauguggaaagguggggccuacgccuagaagcaaauguaguuauaaacgggcauuaauaacugaacaagaagaaucaucuugacagaaauuguuaguucauccuugaggugggucuucuguaagcacggcaacgaguuccguggaccuguuccccccucaggguuaucuucaaggaccuauuccuaauguccacagagaaaagccaugguuacaugagguuacguaggacccaccauuaaauggcuccaaauagcuagacagcuuuuugagaacugaccaaggguguuccucuguguuaugcaggcucucugcagugcuagggucaggugugaauuucugagccugucuugcccuuaagugcugccgcugggugcacagaugaugggccgcagguacaaugacagaaggcuccacacaggagcuggcgagcuccuugcuagguccacugcagaaugcacugcuucuggaaccccuuucagaaacuggguaucccugccauuccuugccuuaugacugcaaaggcucugcuggcucagagauaaagacacucucauuagaggggaguucacuuggcuucucuagcuacccucccaaguagaugucuucugggcaguuccuccugccacaguggaccagcccagagauggcacuaacauucacauucccugccuaucuguaacuggacucuuuccaacuggagaagaaaagagaagcugaucacgggcaggaccuacccgugugagaagaggggugaugggcuagagagcccugucucccaccacuguuccaacucagcucccuuccugacaagacaccuguuuuuaaacacaagcauacuugcuugugccacagaaaugacaccuucuuuuucuauuuugggagucagggucucacuacauaguuaaggcuagcuuugaacuugcuacgcagaccaggcuggccuuaaacucagauccgccugccucugccucccccacgcugggauuaaaggugugcgccaccacauggggagcuguuguggccucacaucacaccaaaggggaacucggagaagauauaacuggaaaugaacguaggugguugggcugaugagagaagacaccauucccugggacuuggguagaaagccugggaccgaguaugaccgcuccuccuuucccugagaugucucgcaucguccccugugaggcugucccaagaauguacugugggcacaggcuggugccacccaggcagguacaguuuucuuugcccugaucuuaaccuuacgguucagguacauaaaauggcuccccuaagugcaaagagacugaaaaccaaaacaaggggcccccucucucaaagcugugggcucagacugugagccaccaguauggcaggcaugucccugugacagaacggucaggucuagcuucaggccugguggagagaggacugugugaggcauuacagacaccuggcuuuccugugcuaggagacaggagcccuugggggugaggcaggagcagguggcaggccuaggcgugugcuagggacggccaggcugcuguccuucaaggcuuggguuuccagcgauucugaggcaucucuuacgaagccucaugaaugggggguggcacacuucaggcacagaccaaaugcugggacucugagaccacuccaaaugugucccuaagcccaggcucagugucuugagagucugcugacaguuagaccaagccucauggaguccccagugccuuccuguuuggcuuucugccugucauuuugucucugggaagcacucuggacaugggugcuuguugugguguguugacugggccucuuggggaggacaccucacgagucuacagcuuaucucgucaagaccuuccagucccuaggccuucugggagcgcuaaggcaaggaggcgaagccacaguugcauggggaugggggaauaaauaagacuccuuuaggaaucagccuccaggacaacagcccugacuccugccuucuacucauucuccuguucacugagcauggcucccgggcaucuggccuaacucccugacucaccgagcucgccagcagccuugauguccacguugucguagccacuaccgauucgcacgaucacucucagggccuugaacuucuccaggucuucccuggugagggugauggugugguacaucauggcacccacagccucauucaacaccugucagggacacgagucacaggucagagcccccgggguaccauggagauuuuguuggcagaauuaauuauaggauggagccauggcuggaugguguccugaugagcaagugccuaagguggcagaaugggcuaaggagaucaggaaugcugucacacacaugcgcucuuguggaugacuguuguuuacugacauccgcuggcccggagggacccagguaaaggugaggugcaacccaccuucucauggauuuccugaguggacugugcaucacagaaggccacaguggccagguccuucaggaugggcaucuccacagugcagucucugccauccagcagugccaccagggggcgggggugcagggggccguucaugaucugggggcggauaccugugaggagagaggaaaaguggggugagaacaucgcgcgaaggggcucgaggggacacccugaacaucuuaguggccaaugccaagguaagcagagcacacccgccugcuggagccagcugugacguccgaggcaggacgggacacagccuuaccagcuaacaagggcagugcucauagaucacagguuuaaugacuguggguuaagugcagggcucuggcaugaagucacgucuaagacuagggacacacacacacacacacacacacacacacacacacaaaugauagauaggaggacauuuguguagcucaccugaauugucccauaacguaauacucugggcuggggugauggcucagcaggcaaaggcacuugccaccaagccugaugaccgcaguuugaccuccacaguguacaagggaaacugacuuucuaaguuaucuuaugauuuucaugugugaaugaacacacacacauaaauauaacccaggucccauuuaaaaaaaaaaagaggcaacauggagcugaguguagucuugauacuuccaagucaaacccaaggccuccaagacggaggccacacaacagggucauucacccucauagggcacaggccugcugucaugccuccucacgugaccugggucuucaaauaaacuaacaaacaaaaaacaggccagcauaaagucaaauggaggaagcuugcaggugucuuuguucugaaagaacuuuccagagaacuccuagggccagcaggcagcccaagccuaucaaucacccugugaagugagauagccagggccauucuggaaaugggacagggguggcccucguuaguacgcccuaugauacucaagugcauauucucugguccucuaggacgcagcucggcccaggccccuuccccuucaauugucuagacagcagacuggggacacccacagcacagcaccugaucgacaugacaucacuguaccuuuggggucaccugccugugggggagggggugggggagggaggguuuccugacuguuguacuucccagccucuccuugccuggaguccucacagccuccugcuuuggacccagauuuggggacacuucccuaggccagcuguuuccuugucaaggaaggagauaaguaugauggacuaaacaggacagccuucaguuauccagauaaagucucauagcagccuaacagccacaccauguacagggagaucuguggccagggcuguugccucuccccuuuugcagaggcuccaaguugggcugucuccuuccuccaagucuguuuauccucucagaggcugcccaacauauggaagaacguggcugucccuaggugaaguguccccucagauccuauauggagcacagguuguucuaggagccauguggccuuuaugugaccauugagacacucaaagcaggagccuuuugcaaaagcaaacucaccuucaggccuccgccucuuugcuaaggggcauugucuugacuaaugauugaugugggggacccagcucacugugggcaguaucaccacuuggacugguaguccuggaugaaggcuuaaccgaccaugggagcaagccuguaagcagcgcucuucugcuucaguuccugcccugcuuucguucagcaauggauugugaccuggcagucacaagcuggaauaaacccucuccuccacaagugguguuugguccacagcaauagaaacacgaagacgacccuccuaacuggacaugcauggauccucuuguaccucacaggcuagccacacacuccucugguacucuuaccaccaaccacaucaucccuguaccaucucaggacagacuaggggccuagagcagagagaauguuuagaacaagcugggguuggaagggaaucaugaaccaucacugacugaacggcagucagguccugauguugaggcauuccuucuaugcacccgccaccuaccugagaaucucugacccauaaguacaguaaggugcccaaguggucucaagugcuaacauccuuuuacccuauaugcccucacugguccaugguucuuauaacggacagcuuagcccuaugaaaaaacaaaagcccuaaaaugccccaccuauccuuaguaggucaaggugaggugcuggagauggcuacugugcccaggucacagaggggcaagugagguggcagugaucucacacagcucuaccuggauucauccuggagucaaucagccauggagcaccauccgcucagcagaugagcacucaggcuguggcacaugagccugagugacaucagcccugccugcucucuacugagggccaaacuccaagacguggguagaggggcuggcagcaccaggacacacaaguaagaacccccuacacucacagucuguaaaaagcuuggcuuuaaaggggcuaacagguugguucauugcacaaagucagaaguuuaggcauagauuuagguguaauuuaccccaccucgccaagggggacagcaccggggacaagagccaucauccagugcaucuggaguggcugagagccaccaacuaagauguccaucugcaauaucagagcauguaucuguuacccggguaacagacuccagguugccuagugaucguuucccuuccugacuuggucuccuuuuucuuuggugaaucccauucuuuguucuuucccuaggcugagguggguccgugguacaucuuguuaaggcuagagguaugaaucccagcggccaaucugcuaauagcagggcaaacuaaaggggguggggugggguguguguguguagagaccuaucggcugggaaagggugcuaaacagggguggcaggguaggugacaggagccaccuggcaccaggugugaggagaacugggaacacgucaucugcauaucagggaacacaaaaucaaaggcagaggcccaaacacagacagcuaccagcagauuucccaucucuuucaacaauucugacaaacugaaccauuuuuaauauauuagguacaucccacuguaaacuacauuagcaugauacgcacguggcccucagagguggggauuagguugaccacuggcuuggagccauggcucauuucuucaauaccuaggggaauuugggggaaggaagccaaaggcacggugcuuaaugaggauuccuuccaaaauggaguuuaggcucccagguacaagacacugcucaaggccgucccacaugucuaaauucuaagacuggcaaagacccggcaaugcugccgcccuucugcccuucucagccuuccccacuggggagacaccugaccagacaagguguucaaugacuauccaaaaugguaaugugucccucuacauuccccaaagacuugcucuguccagcaacaauuaggcuuguuacaggaacuuggucagugcccugcugccaacggccuacccagcauuauaugugaggcagagagcucagcuagucccccuggugucaauuacuagcuggcuccaggauugccucuauacaauacgggggccuuguucaucugcaugguaccauggugcugcaguuugcagccaggcugcugccggucccugggugcucagaguugaagcuaucucaguaauguuaacucagagaaaaccaaagccaacacuaagccaagauguucacauuugugcuggccaccucagugaagccagguucaagguuccaaggccuuguagaucccaagugacuuccggagagaugcuggcugcuuucuggcuaccuagucucccugucauauagacaggagggaaaaaaaaaaaggcacuguacuccuguaugacgcugcauauccagaaacacaugcucucacccaacacacagacagagcuacaagcagaugugccaucaacuccuuuaaacuaaugggauauuauggcuaaccugcaguuacaguaacacaacacacagacgacccuuggugcuuaaggaaggccauuuccuggcuugggaucccauggcugucaugcuuccggaaguauuagcaggaagggaauguggugauccuggcccacaagccugcccuguauucugaggagcacuuaccauuuucuugaauaauacauguguaaaguugaagaaggaaaaggacccaugucuaaaauguggucugaaucaguuucuguugcuugcagauuaagaaccuaauguccggggauggagggguggggcucagcagcuaagagcacauguucuggcuuccuucccugcccccacagauggugguugacaaccaucuggaacuucgguucuaggagcuguggcauccucuuguggccuccacugguacugccugcaccuacccacaugcaggcaaaaacacccagacauagaaaagaaauaagaaccuagcugccuuugcaagucaagaacuggaaugcuuuccucccguuuggcauaguccuugugaaguuggccauaucgagacuuugguucuugguccuuaguauagccgggagguguucuuggagggaguaagaauuucugaguuaucuccaguggcuguuauaaaaugugagccugugcacccugcuucccauucauuacagcugcugucacccuccccucccucccccucucucucccuccuccccccuuucucauauauauauauaugguauuauuucacaauacagacccaacauugggacucaggucaggucaggggcuagguacugacauguagcucaaccuuaaagcacccaacacaugacuauguuguugugccaacacauucaagcauauuguagaacggcuuccauccugccuauacacaacagcaaaaguguucugggagcaguaaaaacaacuguggcauuugcaggaggcagggacagacaggaugucuugcuaagagucaccacuuuaugucacaccauuucaaagauuagaaaacaccacugucaucagaagccccagcaucccauaagagggacagccacaagaaugcccuaugcaaguuacuuugccuaacgcaccuuguauuuugaugguugaaggccugcugaaaucucccugcugaaugcuagugaccuugaccucucuuguaaugaggaaaggagccugaaguucaauguuuaucgaccacagaaacaaaaugaggcuggaaugaagcgggggccaccuggggauaccccaggagaaggaagcaaugaccaccagcccaagcauaagcuaccaaauaggugcacagcagggcaguguggcccacuuaggaguccauaauccccucaaaccugagggcuaagcugugacagauucugaguguacuauaaaaugccuaccaugaagaaccacuggcugagaggucaccauuauuucuagaauggccuacuaggaagcaaaaucuaacaaguagacccaggaagggcacgggcaagguggucuggucuauggugggccgcaggaacaggcaaagauggugcgacuagcuuacagcuacugcaaaaacccugaggaacuuguaaccaggccuuuccgaucacccaccaggugcccagccgccugcagcuccaaauaccugagccauggucgugggcccugcaggcuuccugugcgacugccacgaauccagccugcauguuuggggaugaugccuuccagagcgaaaguagagucuuacaauggugggaaacacuguguuucaguucaguaacacgaaacggaacuuagacuacccugucgccccagaaagaccagcaucuguuuacuuaacucacacacagaacuugccacgcacagaacucgagucagauaucucugcagcuuguccgggaugcucacccagaggaaaaugacagauacuuucccuuuccaugacugccuugucuaggugauucugauacugagguucuaucaccugccacucgccagaaucuaaugggugcuccggaaugaaaugucuccuagugaguuccuugucacaagaagccagucagcacgcaccugcaaugguccccaaggaacaguaccagaaacugaccacaaauggcauguccaagugccgagccaagggcgcaagcucagcugcugcuuuuguuaagauggguugcauguccuauuuaccugguggccugccucaccugggugguccuugggcauugggcuuguggguccagugaucucuaggcgugagaauauauuaguuccucuaugagugaggccccgagagauaaauuuccacuucccagaguagcacccaggucccuggagaccccucaucugccuuuuggaagaaacaugagccuacuucacaaucagcagacaucuccaggggaggaacacccaucuccuccugcagccuugcucagagaucccauuacaggcccucacauaugaaccuguguugccuuagccucuuccacaugcggccaggacacccuggcucagcugcagaugaaaucucaggagacuuggccagagaggaaucuuaagggagcuaggguuggggguggggaggugggggaugggguugcugguaacaagcugccagaacccggcaagcuuccuguucaaggccugggauucugcagcaugccugggcaugaacgccugggcacgaggacgucaagccugguccuguggacucacuuugucuucucugcugcugugaccacgugaggucgagcuguggauauccaggcuguauuucuucaggggugauugcuacccauagccuuuaaaaaccaaggccuggcugucaaggucauggguuggguggaugggaccugcuggaaagauccuagagaguaugucccucuaugcuguggucaugaugggaaggaaaaggcacuggggcugcaguuccuaggcgcccccugggaucucucacuggagucauggcucccauccccaugugaauuacauucagugcuaugguaauuagacuggcuacagaguagacuucccagcuaugaaccuagggaccagccuaaagguagagaguaguaagccuggcucuagccaaacaaccagccacuuuuccauaacugguuuucaauauacauuaaaaauaaacaaacaaccaaaaaaacaaacaaacaaaaaaaaaaaccuuuccauuuuugagacagggucucauuuugcagcccaggcaagcuggaacuugcuaugaaacaguaacucuguacugucuacauggucuuaagcuaagaagucaagccagccuuauaaucuugauguggaugcagguuauaggagcauccccagauacugaaggggacugaaaagauggcucaagcgguuaagagcacuggcugcucuuccagagguccuggguucaauucucaucagccacauggcagcucacaacugucuguauguaacuccuguuccaggggauccaacacccuuacacagaucuauacaugcagucaaaucaccagauauacauaaauaaaaaugaauaaauuguuuuuuuuaaaaaagagaggugcaagcugaauucuuucaaggucauagagaggggcaacuugauuuuagauucucgaucaggcucaguggugugaaggggacuaccugguccaaggcaccauuccuagccacugcaacagugaccuaaagaucaggcucagccagggauucauccaagaaaacgcacuaagcuaagaaagacggccaaaaccaccucccucuguugcuaccacagagcagacccuacccaucaauuaaaagcauaagcuggagacuccucagucaagaaccacacaggcuggggaccucaccaggaaggcucccucccuccacggcggucuuaggcuuugaggccuaagagaaaaaaaagucaugauaauaacuguuaccccaauguccuucuguaaacuuccuuugauuuuacaagggcuuguuggcugguccccagcguccgcagaaccauaguugaagaguaacgggugauuuauugcuuuugucuuacuccccagcucgacugggagauaccuggucacucuucaccauggcccugugacucaacauauacugauggacauaccagagaagacacgcccugauagaaaacacaggcuccugcgaagccccgucuuucuuugcaggaacagccuugaggugccucuggcugagcuuugcaagcgcuaucccauggccagauaagguucgaugaaacccugagauggcaggggacucuugggccucugcccagggaugacucaggaggaaaacccucccaacggagccucaggcagagaaacaagcugcggggaccacacugcccggcucuggggccucccacggaugcucaccagcagccuaggugggacaccccuugcacacaguaaggggucggagaggaugaagacgaaggacagagcccaaggugaacgccugucaaucagggcucccagcauaaaucugugggaaagucccuguggcacuugggguguuuacugcucgucuguuuccuccauucaauuaggccagagaagagagcuccaggucccucagaugcagucgcugagcuccggggagaaagagcagccuggaacauguguacccagacaucucucuccccuuuccugucaugagacucauuuaccagauuugaugaauggagcugugcaccaggccagcaaaguaggaaaccauucuugcaagcuagugaccaaauggcagacaaccacccccucugcagacacugguagaauugcacgguaacacaggagaacacugaggacugcaugcagggaccaccaaacaucuuucccugguacagccugugcccuguguggccccagagcaaggccuggcugauucagaggcacguccuuccuggccuuagaagaaacuucaaggugcaaaaucccaagcccccgaagucaccuaagcagcuagauccugauggcuuugcucuggucuccagccagcccugcaacccuggaugcucauaaggugccuccuugagcuguggggcaccccugacaggacaaguaguucuuaaaugcuaaaacugugcccauggcaacggagaggaugccaaagauaaacacaauugagacuggaacagacaagaaaccugcagagcccauuggguaguaguggucccugaagagaggccuaucuuccuuaucucacacugauacugugacgccaaggucaucugacacagguuucccuauguagcccaggcuagaucagaauuuauaaugacacuucugccucccaaguauagggucauaggucugugcuuucacgcuuggccucuccuuaugaagacugagagcaucuacuauguucaagggccuggaguccccacacccagcacaggggcuucaguacaagcuggggggguacaggggaagcuuuggccagccaaagggaugugcgaagaugugacaguuucuuuuagcaccuucagggccuuuuaugcaaaagccaagaggcaguugcaacugaaauggccacggccugggaaccccacgcacucagaucacaaaggcacagugagagccacagcugacucaugccagagggcugggguugucugugggcacugaguccauugaaaugaaggagccucaugggugacccugagaauggaacacauguucucuugcccuuccaaagggggccagugagccaggcagacccagcucaguuuucucuccacaucaccaaggccaauaagcacagacguugcugccauucugaagcuaaggcccagcccuggaccagcagaagagggaggaggcccuguacacucaacuuucuuaauucugcaucagguuuuaaggcccgcaaagacagcgacucuugaggacccuuuuguaggcucaccagccaugaggcccgaaggaggacuuugccaagugcagcagccggccagcucccucccuccuccccguagcagucaccuuuucuucuaaguauucugggcucaaauccccacauauaggaaaccacuagaaagcaccaagucauauguaucaaaggcaaguugagaguaaaauccucacacagagaaaggugcuaggaccugaggccagcugaacacagcuccucuugaccauuccagccuauagaugaacugcagagggggaagccacucugccagggcccaaaacuacaaggaaggaugauaaguuugaaugagaauaaaaaaggucaauaaaauaacagacagcggcucuaacacgagggucaagaccacaacuguagagagguuacaagaaaguaaacuucaaccuggagccagcacuucuuuagcuaggcagucaggaaaagacaccagggucauucgggaaagcuuccccgcaguaaaagguuguggguccagcccucgguggaauguugaguuuuucuagugcuccccucaucgaaugcugggaagcccccagaagaaucugccuuucuuguggacaggcucaucaggaauggucucuuguguucuggccugguuccccggcucugagguuuuuuucucuagccauuuaaucauuuccuuguuacaggugcugguagguuggccccgguccucuugggaccaaagaacagcucacguuccauuuacucaaaggagaaugcucuucacuguaaggauaaaaucccccaacguggaagggaagagcucauucccguggucagagcagcucaaggccaagugucguccugauucaggcaccagacagggacaggcaagcacuugacagaggucuagagucucacacacauacaguacacaggucacagggacaggcaagcacucgacagaggucuacagagucucacacacauacaguacacagguccuucuacaguuuucuccaccuagaguggugcccaaagggaugagguggccauguucagcauccuuccaaaccuguccacagcauacagagaacucgucagacacaugaagagaucacugggguccggugggagcagccgccauccugauucugaugguacuggagaaugccacauguauauauaaauagccauagaaaauuuuuuccccccaacugaccuuaagaguccuuaguaacagccagggcaaggagagaaauagaaauguagaauggagccuucgggugcuucgucggugcugcuacauuagggaaaauugcuggguuacagggugugugagacagcauuucuuacaaaagagagagagagagagacugacccuugggccuagcucuugacaggcugugccuugcuggauucagggaagaugggacaauguuuguaugaugcucuccuuuggcauuuggcagagagaggcucagacucuuggccacgggugacaacauagggcaccauugccagaaggcuugguggcuuguguuagcuggccaugucagugugggauggagagcugacccaccaaguacuaucacucacaaagcucuggccaauaauccugugcaucugcgugccucaccucgcugcucugaacugcuugguugcugggcugggcaagacuggcaaacagaaggugacuguguacacacacacaccaaacaaagcaaacauuaaugucucuacauuguguccuaagacccuuaaaaaauuccccaaacaauccugcugcaaacaguugacaucaccucaccauacgggcaggagaacacgaaaaaaaaaauauucccaguuaucccaagacccuccacacugggugaaaaccaacagauuuggugaaaucaaaacgaagaaucagucaagcugacugacccuguugcuaaugagaaacacacagggcuccacuuuaagaucccagguugccuccuggcuugaagguaggcaggcugcccggcaaugcaucuccgaucucugaugcuucuccuuggucuaacccuguuuuccucuggggcucagcaccucucugccuggagccaugccuagagauacuccaugaaggcucuugcugcuuucagcaaaccccgaucuggcuguagacuccaugaaaccugucaugcaaaugccauucauggagcugaacugcagccaggaagccaaggcccugcccccagucccgacaggguagagucauaaauggcacacagaauguaggauagggaacaaggaugacaacugcugcucugggguagaucauuugacagagaaauuuauuugcuggcagacuuccgacugcaggcuugcucggcacuggcucgcugccaugcaaaugaaauaaaaaucaauauccuugggucuguaaaacagugugucaacaaucacacuccaaacaacuuauauaauauccuucacccuauacccaaauagcagugaguguuuucuacucgggugcuauacaaaauaaacagaaagaaggggggggggugcaauucuccaggaccuccuccuucagcaaaaccuuuccaggacuucaaugaggagauaaucuuucugugauuaugaccaaacccuuccguugcuuagcaacacauaauuaaggaauauguuuucagauccgcuuugcaagcccagccauuaucagaugaaauuacuggagcaacaaaugucaucgccaugcaaauuaguugguugcaaagaaagaauguuugacugagaaagaaggcauggccccugaaaaaaaaaauucugacaccccccccccagggguuucaaaggcaaaguauauaaucacaauuuaaaaaaauaagaauagggaagggaaacaaagccagaaucacuaggcaagagaaaaacaagaaaaaacaaaaacaaaaacaaacaaacaaaaaucacaacccaaacuguuagccagucucuuucagaaaaacagguucucgagggcugagucguuuagucaugacagcaacucuaugcuguccuucauaaagcaaacaaacaaacaaacauacaacaaaacaaaaauaauccaucucagagagguuauuuuugaggauauuguaaaaaaauauagucuuucucacuccacuaucccuguccuaaacacuacauauuuuaaauuaauuuuuaaacuuuuuugagugcucagugguuaagaccacuugcuacucuugcagaggaccuagguucagcucccagagccucgcugggacagcuaacugcagcuccaguaccaggggauuugaugcccccucuucuggcuucugcaagcccuggcacguguacgcauacaggaacucguacauacacagacagcaacauagaaaaaaauuaauagaaaugauuugacuucugagcuaugcaagggaggcaaaggagagaagaagaaaacugaugaaggcuuuucagucaggauucuagaguuaaacacuaacuguuugagacauccaccacgaaguuuaaccaguguccaaugaaaagcacguagugacucacgcuuggcuucugccuugaagaaaaccaccuagcauccacccccucucuacucggaaauaguaucuucccccacgaacaagcagaguucccaacaguacuuucuaaaaugagaggcuaagucuguuuuucaaauaguucuaagggauuucaacauuugcuuuguuuagcccacaacuguggaaacagacacugucuuaucagcgguagauaaucucugccuuugauacugugugcuggccuugcagaggggugcuguccacagcaccaggcgcucuucccagcauauuauccacgagcaacuuacaggggcauucugucagauguuccugacuuuuccaaagccauccaaccgaacuagagaaccaccccucucguauauaaaauggaacagucacucagaauggcuucugauccucuccggaacacagcuauguaucgguaccagaaggagcuaucugcaaacaaacuggggcuuaaccuaauacauaaaucugcggaacucaagaguagcccgugggaggagggaauuggcaacacuccacugaugcuuuggugugguguggugugguggggaguauguugggguguguauguguguaugugggggguagggcuugcaggggggggguguugaggagggguggggggaugcugguguguguguggggggggggguggcaggaugaggguugugugugacaagacagacacuaucugugcuuuaaacaugaccaguaggaauauggacauacuauucccgucucaaaccucuaugcuuucccugcccccgaucucccagccauaaaguuacuugguucuggaguuagcaugguugacacgaugaugggagccccaguccgccgggccaccuucugguacggugaaugagguguguggagacuuuggcugacugguggcaggguagacggcuccacgggggcugcuccagguuuccgcaggagcugggggcugccgugcgggcugggcagcggagaggcggucaugcugcguucccucuuaagcaguuccaugggcaccguguacgagguggaguaggcaguucugggauuugagugaaggggagcagaggggccuggguuagcagucaaggcuaccccagcuugugaaggauaugaggaggccagccgugcuguuagggcacaggggguaggagagcuauauccagaguuggaggguaagugggggguuugggaccccaccacugggguggaauaaguagcugcugucuccaagaggugcugggaaggugcacuggaggggcggcgaccuagaucuccagcucggggagagggugucugcaaagguccagcagggugaaacugcagggcugugguacccagugaggccaugucauugggcagcagcucacuucgguggcugaagcuacuggaccuauugcgggguagagggcccguccgguccugucuccgaaacugcaucucuguccugcagcugcuggcuaggcggcuuaggacucgggccuggcccagguugggugcaacagacuugaugucagcauccuccaggguggccaagacagcuggggagucaaagccuugcuguaacagggcugcuaggguggccucugccacacccucugcccucagcagggccaaaaacucaggguacaugguccucuugcccccagguccuuggaauguagacaagucagcuucguaauucucauaagccagcuuugaauggaugcuuucucggguaggcccauagccucuauucagggaacccggggccacccccgugcuguucucaguagggacagcugagcugggguccacaaccaggcauguuggggccaccugucuggcagggguugagucaacaggucuuucgcagauaucguuguagaccugacuggaguugggggaauagguagguaccucuaucccuaaucugguaucaggcuguucccuuccauaccucccaggagauggagcccugccguguguccgcuggccaugcgggacaguuuuacccccagauuccggguacagguggccaguguccugcagagcagguaacuggccuuguaccugcucccauggcauucugcugccaagcauuccguagcugggcaccggccggcugguuccugggucccgauagaagggaggcuccuuggguacccuggugccccuggaugggucgccauaguagucuuguggcagcacggagccacggccagacaucacugccugccugcugucguagaaggugaagucaggcacggagcccuuucuugaugccagugaguuauaaaaagcuucccgggacagguaggacucaguauccugggcacgaugguuuagcagcucgcaccaggucccuucuccagggccauacgucagagaacuucuccucccuggagguccagcauucucccaagggcccucauaccagccagcagcaucccagcucugagaacggccaauauugaugugccugcugggaaccggcauuggcagagcaaaugacuacagcaaaggcagggaggaagccuuucuuuauaaaucuucaauuacauacauccaaaccagaccuggccacacgcgagcccuuccgagacggcaggaacaaacaacuggggguuucuguuucaaggcacgaccuaaauuauuaauccucugaaaccuuaguaggcaaaaagcagacucacgguaacuuugccucacuccccaaugguagcccgcaaggucuguccugugugcuucuaagcccaggcaggaggcugugcuccagccugcugggcccccuuuccaguggcugugcucacauggcccccucagcucuugcagcgugaggauuaggagcuaaauaaaaccccuaaagcuuuuguuccaugugacaucucggacugaugaagcuggcugcuugcuuuagccaggccuuacaggcagcuggaaugaucccacauggcuuugccccggagucugaucccuccccccaccccauccuugccugggucucucucaucccucuugggggagccucugaccaguguccucuucacuaagugcaagagaagcaaacuggaacuacuuagcuguccauccaguccuaaucccucugcgagagacauuacauuaaucuagcagcacacagcuacaacagaucaaauggagagcccccgggaccgauuccagaaugggagguauucugggaggcagggacucuguccaacccuggaaccugacuuccaggauucugguuauagaucaaauagguuauauagcccaaacccaaauucucucuaccuuuaaaugguaagauucuuucauaccacagagaaaaagacaaaguauggguuaggaccuggaauucucacuguaagacaacaacagggauugggcugaguaguggguuggccaccagggaagaaaaacaggaacucuugugucucccaucucagucugugcggcacguacaaagcucccucuugacaccauuguguuaacagauuucacaaaauaaacugaggggguaaucaagaaguauauuuaaaugaguucauguagcuaacuguacacagccacaagaccaaaaaguucucgcaacuagacaaaugcuagccauuuaaaaggaaaacaagaaaugaaaaacaaauaugagaaauauggaaacuuacuuugagguggaaauuuagauaacaguaccauuucuauuaaguagguuuauggucuuuccauccuuucaccaugcccaugcccaguccccaauauccaacacaaauuccaggagaagagcugugucacacuccucccuaaaggguccugauccagccaaaccagccuucaagaagccacagaugucaccuucccaguguggcugugaccaaggcuggaccacugugcaauuaacccgaacacaauuaacccgcaaagacuagggaccaccacgcuggcaccacagcccccauuccugacccaaugucauacgagauggaaauuuccugguacucagaaugaaaacccgggaacgacaaagcaucauuguaaagccucggacggccacucaucaacuacagccauaccuucuugggccagugucaggaaccuacccacaacacacugugacugaugacaggcagagagggccagguaaagaaggccaagggggccaggcaugguggcgcaugccuuuaaucccagcacuugggaggcagaggcaggcggauuucugaguucgaggccagacuggucuacaaagugaguuccaggacagccagggcuauacagagaaaccguguguguguguguguguguguguguguguguguguuuggggggggggggguaugccaggacacacccaagccaggauuuacaauucucugccucuaagcagguucauuggggggggggggggggggcagaaagcacgggaaacaguacagagccugggacaccauacacgccagcucacugaaguagauaguaguagucugucaggguccagggaaggugagcuggggaagcuguuugcaggguucucuacuuggcacuauucagaagaacaucccagcaagcagacaggugggggaggggggggugugugccagugugcacacacauacacugacacagaaagggugcuaaugucugggcccagggguuuuuugaagcagagcacuaaaccucauggagaugaaugugucucuacugcauaacuggcuagcgaacacagcugaccaagcaagauggauaucccagguuaucacccacccuucacaagcaagggauucaaaguaagacaaggcacucacccaguugccaggccaacuggggggggggggggcaucaauuauauaccuggccacaugugaguaucacagguacugaugacaucauaccaaauacugaggaaugaagagucgggaucccgucuggggucauaggucauagcaaagcugggcaaagaacucccaaagcuggggucacugugcccuccugggaugaggaaagggaaccauauuuaacaaaguaauucuggaaguuucuggggaucaucggaccugaaaguaccagcaaugcccacugaggagaagacuuugaugaugaggugguaugcuccagucauagcuggaucuguggccuucaaaggcuggcaacuauucaguccuucuuggguauuccccucucucaagacaagauacagcauuaacgccaaugcaggguguuuguaguguggacagacauguaggcaaaacaccagaccucuccagacauaacuagaucugggaaaugcucuaucaauccccuguggcucugggugccuuacccguuugcugucagggguuuuguuaacggccagguccacaaaucuaaauaauguagaauuacuaauaugagacuaggucaagaagaacuaagaagccagcaaugacguaggcagccccugagacuaugcaaaggugugaucaugcagccagggagguggcagcagaugacaggcccugcucguugccccucugaaguagaaucaggggguccagauuccauucccagcaaccugcugcagcugguucugucuggaagccaaucaaauuaacgaagccucagcucaccaaaauauuucgacagauguuuucuccuguuagaccgaaaacgccugugcuuggacuuaauccuucccaaauaacccuggaaguuguuuaaaaaaccaaaccaaaccaaaccaaacaaacaacuaaaccaaaccaacucaucacagcauuugagaaaggacugauuuccugagaaaucucaugcugucugaaaagggcaggauggguccaguuucugaaggcuaacgaguuucagggauauagccuuauccaaaaaacaaaaacaaaaaaauccucucuggggcuggagagaggacuccagcacccacauggcagcucagaacuguaacuccaagaucugacacccucacccagacauacaccagugcauaugaaauaaacccaacaaagaguggacugugaaaaagaacugaguggcugacacggaguggcaaguggugucugcuggcagccuguucccgaacucugcaauagaaggcgcaacucgagcuuagggaagagaacuggcagaugagggucaagacaccccaugggcaggccucgaaaaauacccccuccccaaagcacuucacaaccagucaaccagcuacaaaacuacuuuaagccagaagggugacugagaggaaucaccuaaaagacaaaaucagacagcaccaucagugccaaagccauccaaaugugaaggucacuuggcccuucuucagggcccccugcagcuuccugcucaccuggugggaugacgccuguggguagcucucagucucuugggaguugcuugggcuuggugggcagcuggccccaaccugggaugcuauggagguacccgagacacggaagcccuaagccaggcccccagugucggugcucuuccaacaccuaggccaugcacgagacuaaugaagcccugagaauaaagaaccugcugggggaaguggggccucuugucccucauggacaccaggacaaagugauggccguggccucccauagccagcggugcugcucaggucaguggguuacacauugccuuccagcugagacagaggcaaaaauaggcccuagcugugccuaccuccuacuuuuaaacguggacaggcugugcuugccuuuucccuuuuucaaaaucccaguuuucuuugaagguaagugaucuagaguuuguguugaaaugcagcguuccugccuuuaacaacagcaacaacaaaaaauggccuuuucucuuguguacccaauguucuuuacuaaagaaagguguuacuucuauaaagcacugggaaaagagccacaggaaauguggguggggcuuaaagcacuuuuauucaaauggcaggagcacaggaauuaagagcugugacccaaggucggcucagcugucaagaauaaagcuuucaccacaaacaggguguucucgccacuucuuggcuagagcguuaaggcuggggagcauauuuacccugcuccaaagagacucuguguguguguguguguguguguguguguguguguguguguguucauucgacagccagggcaugggcugcaaagcucuuccaugggaccaggaaggaugaguguccacccucuuuguggaaucugugcuucucacagugccagugggaagggagggagggaggaacacuauguuuuacaugugccucucugaggaguaagacacgugggaagagggauaguggauggggagagccaccacccacaagcacgggccaccuucaaagauucuuuccaggaagccacagaaucacaguggcacacgggaugcucucgacagacagaaggagaaugaacacagcaaaagcuuagcaagagauccgaccacugcucgggucacaucaaacaaccgucugggcagcgugacauaagccaaacugcacugguccugcugcacacucuaacaccuguagcuucugaaagggaagaagggcaaugcucagugggccaaguccaucuccugauucagcaguccaugggucuauggcugccugcagaccuacuauauagcuaagaugacuguccuggcuccucccuaggagaucaucgcuguccuaaauaugacuaagaggaaggaaaugcaccaauaagaaaccaggcugggaagaugaccgggugacccuagccaguacugacuggcagggugacugagcucaaguaguaauggaaucagggcaccagugcccagagucuacuggaaguggugggugacagcagcaaccaaaagagcaaacuggaaaagagcagggcaucccgugcuggggucuccaaugguaccacacaucacugagccccaguggagaagcgaaguggcccacaucagagauggaacgagcccaggaacaacacuugcaccagaccagugauaaagggagagugaauucagccuggaacuugagucuucucgccaagguaaggccuguccaggacuggacgacacugugaaccuacuccccaggugccgggaggcuggacucccacaggcggagucagugcuccuauucucaaauaagacaauacaggauuuuuaucacuugcagauuauggcuccagcuucccugucugagcauuucuuuacaaugcugagcaugaucugggacacuuguuuguauuguagaguuuugagccacgucuaguugacuauuguauauuuauuuacacagccaaaguaauugcagcuaaucacuuaauuacuggaaaugugcauaauugccugaucucaacauauaauuaaaauguacagcaacauuaugaaucccauuuuuaagauguagguuugggagccuccgaaagacggcuuguugaaaaugaucaggagggccuguggacuguaggauucaagcccacuccuaugcaaacccaaacaaauccacaaaggcauaauacauucaauaaaagagggacaggcgaaaccaaacagcaucuugaauguggaaauucaaauaagaaaaccaaacaugacacaaacugcuccuucuguacaggugcuguguugggcaggccacagacaggccacuggagaagccccauuagccaacccaugccaccaugcccuccgcgggcuuugagcugauuucuuccacaacucggaaacaaacaucuaggggauguuagaccaauacaggcaccugcuggggugcucagccaccgugguaggcagauccaacucagagugggaagacacuacccgugaaagcacccuggcuugccucugcagcacuuucugugagcuucuuggugaccaagaggacacagagaagccacacauuucuuuuauucugugccuaugagaguacucaggagaagucugugaucacaacuuuuauguaaaagcaguucacaacacuuccguguauuuccuguauuucuuuugcuuauccuaacucagcugauaccaugcuugaaacucguuuccaccacauuucuaaagaaacgcucaaacacaaugaacuaaaauaccuacuuuauuuuuuuucucacacuucaacagcuauaggaaaggauuguguuuagggagugacucuauccuagcccauuguaagauguucauaggcaaagccauagaggaguacuacauacaguucuacagacccaaaccuuggcuuagcucugcaaggcuggagugacagcaagccugcucucugacccauaaauauuugggaaaagcccaacuacccuggcaugauccaauacaguauucaaauccucugguaagugcaauccacaaaugcacugcgucaauuaugucagcaaaccagagagaagaaaggcauacaucagagagaaagcagguucaaucuagggaugaacagcccguguuaucaaaggcuguucuguaauuauuccauacaacguacucaaggauugucugagagcaggcaucaagaaagccagcggagaacaaauuacagauaucaaaaagggucaauuacaaaagcacauuaaaaucuggcuuuuaaguaagccucaaagauuuuauuauuccagaugauuuggauggagucccaaagacuuuggcugccucuucaacauggagcagagauguacucuggcuauguauaugugagugacgguucacauuccacgucaagguagagagaaagauggggcuucauucaggucguggucccuggcauuaacucagaggggaacacgcaagcauccccuaaagagacuaggaagaggcugagugggcuucaguggaaaguucuggagacgaauccucacaggggcgaagcuaaaauuucaucuggucagcuccuauggcacugagagaagcucacccaacucugccaagggaucccagaaacagggauggaugggcaccggguagcagguguucgacgagagaggcuuaagggaugguuagcacuaucaagaccagcagaaggcagcucuccaaaacucagggugaaaggcuugcuacagaauguaggagacaugugcauuuaaucaauuaaaaacaaaaccaaagcuggauauggugguagcacucaccaauuaacccaguacuaaagaaacugagacgagaggauuggucaaggacagccuaguauacacagcaaaaccucauugcaaaaaauagcacugacugcucuuccgaagguccugaguucaaaucccagcaaccaccuguaaaagugaucugacaccuucuucuggugcaucugaagacagcuacaguguacuuauuuauaauaguaaauaaauuguugagccagagcaagcagggaauaagcgagcgguguugaccggagaaagcgggguugagcggagcaagcagagaugaagucuuaaaauucaauucccaacaaccauaagaaggcucacaaccaucuguauaguuacaguguacucuuauacauaaacauguagccgggcggugguggcacacgccuuuaaucccagcacuugggaggcagaggcagguggauuucugaguucaaggccagccuggucuacagagugaguuccaggacagccaggacuacacagagaaauccugucucgaaaaacuaaaaaaaauaaaaauaaauaaauauauaauaaaccuuuuuuaaaaauagcaaagugcugggcaguaguggcacacggcuuuaaucccagcacuggggaggcaaaggcaggcagauuucugagccaggucuacagagugaguuccaggacagccaggacuauacagagaaacccuaucucagaaaaacaaaagaaaaaaagaaaaaagcaaaccaacuauuccaccuaccaaacauccuccaggacggaauauugcagcaaagggcagaacaggcuaucuuaucuggaagucuaaguucaacaggcacggugagaaugcacagcuaugugguagguguacaacgccuucagucuaaacagcaaaaucuacagagagcagagcucucagaacggcuaaagaagagcugucuugggaaccagucacaaaucaucaacuaaucaauaaaacaggugcuaccuauccagaccaaucacuccuuccggucacauccgcaucagcugugacuuucuuagacaaacaggaccacaggugaggagcuacaccuggcauacuucaaagcaugacugcuccuaauucugcaacaccacucccauuuagauaaagauggcacugaacuuuccauucuaaguuauggccgaagauaaccagucacagauauaggaugggugagaguuagugagccauguuugggacagagaacaugaucaauaaauagcuggcucaagucuugaguuguggaaguugacucacuagaggcuuucuggagagaggauuuggcaucuaaccccagugaagguuucucugcuaaaaauaaaagucaauuucugcaaucaggugaggccagauuguggacuauucggugagccacuaggucccaaaucuuccaucacauugaucuuuccaaagucuaaaaaaaugccagguuauugucugagacucagacaaccaaacagaauacaaaacccccgacggcuacacaaacggacaugauaaacccaagauagcugcaaacagacccaugcaggagacacgcacauguaaucugcaucagaugaaccugggggggggggggagaaggauugugcuauugugguuauguaggaaacuguccuaaaaggacacacaugccauagcgugguaacaggaaaccacugccaucuacaagcuuguuucagaguuucagauacuucuggaaacaauucacacacacacacacacacacacacacacacacacacacacacacacacacacuuuaccucauuuaaaaaaaaauaaacaaauguuaucuguuaguaaacacaguuggaagacuacugguauucaugacgccagcccuucagucuuucuauagggcuuaaaccaucuugucagagaccaauagcaaaaucuagugauuuuaauguuuacuuuuaaaaaccgguuaaaugccaagcuccauaaacuaaacuauagcagaacccaagggacauggggguggagcucaugcauacuuugcacagagugcucaagggcugucucaaacagaauggcuuugauguccccaucccauguggcuugagcuacaucuauuuaaaggacaagcaauuccauauggguggcugcaggggaaguuguggggggggguguggccugccugagagcugguguggcagcuuugccugugugcccucugcuacaggcuggaauacaccuaacauaccaagagccaagcuagccuugaaaacacuccuagacaaggcuaguccugcagcacugacugcaggcuggcacagcccguauaaaccccgaguugcagguuuggcgggccuugcuccucacuaauuaggaaaggacagcgcuuaaucaauguuucagaguuuuauccccggguuuccauuagauuuuaauuauguuuauuuuuuccuuucaugaauaaaacacuuccagacauuuucaaaaauacugaagacuugaaaacaucaagagggcuagaguggguuccucggaaauaucuuggaauucauuguuguaaauaucuuaauagaaaacagauaaagucgagaaacuucaggaagcuaaaaaagcugguccugauauauggugucuuucauaugcaaaauaacccuagguauacaggggugggggaaagguaccucacagccuacagcccucccucauguuccacccagcccccacacaaaccaaggaccagccaagaaaguggggugccacaaagccaguaccugaaaagguuagggguggggagacucuggggguccuagugucagagugugacacagccaggcccagcuaccucaaaugagcagcucugagaggaucugcgugaggggcuacgugucuuucaagaaacccccgccaaccgugcuggcucuuaccuucacaaauccuguccaaucgcugccgcuugacuuugugcuuauccacaagggccauucuuuaucgaacuuugcaacucucugauucaaaaggcaaagcaguccgcuaagaacuuaggggaauucgcaggagucugcgugcauugcgccacuaugaacccugaaacaaggagaaaagaagccuuaacucuggagaccuccaggacacaggcugacaggucauucacgacuuccugucgcucucuaaguaagaggggacagaccugcucuucuggcguguggugcuugcucuccucccaaaacauggguggaggcugcucccuccaugcgagccuuagcaaucuccuguuuucuacccugcaucaguuagaaagcaagcaggcaucgagagggacguuugccacgcauugcugaaaacagcaaacggcaguguaugggccucucaacuauaggcaccaauugcagaccaacuucaauuauuucaacuccaaggccagggaccaagagacagcuagcuggaucugccauuuauuucucugaacuacaaaaguucugcacaaccaggagacagucucacagacagcucuggaacacugggcuguauguagguccuaagugcacagugguaugcuaccaagcacacucuggcuaccuccacagaggcucucuggaggccugcacugcgcagucuuuacaguugcuuucuuuccaugaaggacucgcaggggccacacaccaaaaaaaaaaaaaaaaaaaaacaaccaaacaaacaaacaaaaaaaccccacaacacagagcagcacagcacaacgcaacacaagcucccugcuacacuguguaagaaugggccugcccaugccaucuucuagaaccuuccucaaaugggggcuuuuaaucccacauuccucagcugguugagcaguggcuguuaagccuuuucuaagccuucucgcugacucagaggaggaagagccuguuccacguaugcuaggauccaaagaacccugucucuuuaagcaccagcucacaaauuaccaggccgggcuccacugacucucuccuucaaaacugcagccugucaaucacugugagaagaguggggacccauucucuggucuccuguucuucacugcaaaacuucacaaugaguauuguuuuaaaucuaacagcaauccauguguacacacacacacacacacacacacacacguacguacgugugcacgcacacaugcacauggggcuauucucagcuagcaggugaauugugcagagaaagaugaggauggaagauuaaggcuuaagagaaaccuggugguguaugggcaucaauuaugcugaaugcugggaguuccuuuaucagacacaggucuaaacuacuaaaagguaggcaaguucaauuuggcuagaaaagcauccuaaagauuuauagcaauaauuaugugaauuugaggaaagggagaaauagaaaaaguacaguuucuaacccuauaaauaaugaucaaaacagccaaaaggacaccaaacucuaacacaggcaacugccuaaaacaagccagucaccacacguacagaaguauagaacucugcugucaucguuccugggcucuuucaugaagguagccagccaugugugaacaaaccccugacucagggaaaauggagaugggauagaagaaccaagaccuacaaaugucaaccauaaaugcacaucagaaagccuaggcuagcucuuuuacuuucuugaggcuggggcuccaauguccacacuacagugaggcaccuccuagacucugguaugaaaacccaagccucauuaucuaccccauccaaaggacaagcuaauauuggugaagggcuacagagauaaaaaccgccagaguuaugaucagcagcaggacuggcuuugcagucuccuccucuagugaggcguaaucauucuuuuugcuuuccuuugaauuuuaauucguauaauuaggcggcuucuugaaaaauugguaaguaggcucuugaucaugcaaucagagagauagccaacagcuuacacaaaugucuucaucuuagacugucacugauucccacgccuggcuuuucugugguucuucuguggaguccggggcagaccccgaggggaggugcccacccaucauaucagcagcgaauacagacuucauuuggaacagccaguaugaguuuugacacauaacuaccacccucucccaccauauuucugcuucaaaagggggggaggggaugggugggauaaaagauguuuuucuccuuuucccucccaagaaguaugcuauuuaugaagacuaacacagccacugcacaaaugucagggacaaacacgccuuguaguggaucuacgcacgauggcccucacugcaccagccauacuggcucugggcuccuagacuaucaaucacaucuuugugauuagguuugccaugaaaaccaacuuugcccuuuaagucaguccuuccucccaagucauaagcuuccagccaaaggaauuugucagcuauugauaucauuagucaaaauguucaaccaaaguacuaacuaaaguauacaucagggcgggcaaaagagaggcagugcuaugguuccucuaucuuugcuggaaucagaacuggaaucguucuggaauccagggguuccguccuggagacuggggcucugugcuuaugaagcaggaaaggcauuccuuguaugccaccacauccaugacagacagaggagagagaaugugcacgagccucuaggaagugcucucuccaaugcagguaaaguucaaagucaagaggaaaguggggucguccucucacggaggaggauaaagaggaaacggcacgaagcucaacuucacaggagaaagccagaggaaugccaggccuaaucccaacccagagauauaagcgcucugaaaaucagaauggacagaagugaaauguaauuuacaguagucuucccacgcggaggugcuguuuccacagcuucaguacucuggguauauucaggucugaacagcauuacauuuaauuuaaagcccaccauuucaaguuguacgugguucagagcaucacaauaaaauccuguggaacccuggcugcuucccagcuggggcuagaaacacccugcggucucacguauccacacuguauaugccaccugaccguuagcaacacaguagcucaguuuggauuauccaguggauccuuacaguguuaaaaucaauguuacaguaacuauuuugcuuaaugcucaaagaccaagaaucacaacacuggcaauuugguuaugcuaagcgaagccaaaagcuccuccugugagugggaaggugagcgcggugcucaucacaggugcacauacgggaggaaacccauauuucauacaaugagaucuggaauucucuacuuaucaggcaccuacugcaagucuugagacacgucagccagggaggaggaaguaauaauguaagccauagaucuuuagauaagaaagcucagcaagaagcuaccggguguggcgcacuguuucacagcagugucaacgagauuugagaaaagaacaaaaaugaagagcaacccauuuuaaaaucagucaucuugacauuaaacauccaugauuaaaagcaaaagaaaccauuuguccaaguuuggguagauaagcauuuucuacuguugcuaccaacagccaccucuuggccaaaccaaaccagcacaaaguuauaucaugaaaacuccaguccucaccaauugucucucuguuucuccauucuaguucagacucugcaaaggcuagguggaggggaacugcagagcaggggugcaucuucaacggcgugucucaaaacaggaugcuucuagaacucauccaaagcuugcuuucaagggacucugcuuaucuucaugcuaaugaagaaagaucucguuuuuugcaacaguuuaaaaggauucauuaucaguguaguuaaguggacacaccccauuguuaaucgcaaacuagguucagauuuaaaacccacgugguggggagaucuaaugcaaacacaaagggaucccuauacccaggggugugugcucauacugggccccuccuuuacaaggccuucuuguauacauaacccaggugaggcacagggaggaccuuggaccugucuaggaaaagcgaggacccugcucuuaaugaggccuaacuaacaccugcccuggguggacccaggagaaagaaaaaaaaaaaaaaaaaagccaacaacaagccacggguacuuacaaggaagccauuccaugggcuucgggaggcaagcauagccaagggguucuuauccugagaagagagcucugaggagcuuucagagagccagggaacuaugggcagacuguaggcaugacugugggggaguaacagccagacacugagaccgcuaaucaaaauuacugaguuugcaaagaaauuacauauccauuucuaaaaugauuccuauaggcagaagguuuguauguucccugaaaccuuccauguuugaagcaguccuucgacguguaccauucucuugagccuucugagcucccaucaccuggaaugauugacagcugucagagaggacuguugucacucccugagcacauaauagauucuguaaaugucccuuucuuuuuccaguguggguuagggagugggaagagaagaccucccuuuaccagagucccccauucagguccuagaaguuuccuaaaagaaccccauccugagauaugcacaacguuucacucacagacaggccaguccaccauccaguaacaagaggaagcggcuucuccacgcagcccagcccagugcugggcgggcgacccagccagucagucccugcucgguacucucaguugguuagagccccaucuucuauccccaaaagcacaaguacuugggaugcacacaccgauagcucgugcuucagccauggccuuuccaaucggcauagcuucagaauacugaagagugacaacuuacacagguagccauguccuucuaaugccugcccccagcccaaccacugauuccacacuagaaaaauaaaauggcauacugugugaccaacacugacucaacuagacuaauccagauuguaaaaaugaaauacacugucaauaauuuuggccggcucagagugugccacugucggggguuucacagaaucuagaggguuuauguuggugguagagagcuggccuuuauuaacuucuauauggccuuggguuugaaaugcaacauuagagaggggguggggggaguuacacgguuuguaaauccgaagaaaggguugcacugugccacggaaauccaccaggcuaaaggugaaccagucaagguaguauccccaccccccaccccccgccccccugcccgaugaggauuagcuuuaaaaccaugauuuuccuggaauaagcaagugguguggucuuacuuugagcugggacucuuagcccauacaaauacauuccuagugucaaaugcgagccucaagacuucuguauauuuuucgcgugcuaaaagugauaaacaaggcaugagaacuuaagcagaaagauccuuucauguuccuaauuggcuguuuuauuugggucauguugagaauccagcgugggucgucacauucuacagagacucucuagaauuuucacacauuuuaaaagcccuuguccuccaaauaugccuugaaaauaaauauuuuaguuaauaauagaggcagaacagagagggauaaaagcaaacaagcaaauguccauucagauuaugaggcauagaaugauggcgugcgcucaggcugcucagggugagcagucgcuaacucuuccccaccuaggcgugugaugugugcucuguggccaaagagccugucuguguaguggaaugcgaucugucaucucaucugcuaugggacagaaaagcuugucccgguugcaagagaaauuuucauuuaaccaaguagagaaugccaccaacaggagaaagcauacacaauauuggaaguucucacagaaugucugcagaggggucacaauacagcuguugggugggggcgaugacccaguacccuagugaucacugugggcagaguccauggccugugacaaaaauguacauauacagugcauuuccugggguucagugauguguccaagcacagguaggauggcggccagcagccuggaccugagaguuagaccacagugagacccaccaggccguggauccuugacaacauggaaacuacaggauagacauaagaggcacacuagauaauaugucauuauauuuuaauaaagugaacacagacuggagagauggcucagcgguuaagagcacuaacugcucuuccagagguccugaauucaauuuccagaaaccacaugguggcucacaaccaucuguaaugggaucggauacucuccucuggugugucugaaguguacucauauaaauaaaauaaaucuuuaaaaauaaaagugaacgcaagucuaaugaaauagcaaaauaaaauacuucuuguuaagcuugaacuauuugcccauagaaaaauuacuaguucuaauauaacuucgauuuaguuaaagugaacacguaugaagccauaaucugugucuaguaaaagcaauuuuagagguuaguuacaaauuacaacaauaaaacauuuuuaaagcgucuuaagaucuugauuuguuuuuguuuuaaacacgccugccucuugacuucaguuugaccccacagaagucccugacucuggacugucccaauuuggcaacacucugucccauaaaagacuucaguggguuaccucuugacacggugagguccaaaacacaugucucaguaccugcaucuuauagccuuuaucugcuuaucaaaaaagcaauggaaaacaagaccagucccacccuaccccguggucaaccugucaugcugggagcaagauuagcccacgggaaacauuuuacccagcgaugaggcucuugauccagcagagggcacugcucacccugccuagacauccccagacugcaaagcugggauaucuuugccugggucucaaaugugaacuccauaagaacccagagaaaauacgucaaauacccuugauggaaaggccugagcacugugugucuuaggaagcaagagaggcagaaggcaccuggccucccuucuagccauggaugcugaauggugggaugugacucccuccccauugucucacaccuccccugagagccaaggucuccccccucccgcacgcgcacacacacacacacacacacacacacagggcaggccaaggaaaggugguccaagagccagugaguuuccugacccacagugugagguuuugucccgcaaaggggcacaaacugcccuaagggguaauuuuccuuuaugcuugcaauucucauucagagauaugugaauccuggugauggacgaugggaacaacuuggcagugagaggauuuaagacagaauaaauaggaggguacacaguucuccacaagccugauagaguuuccaucagacuaaaaccugggggggggggggggcgcgcacacaauugagcaauuguuccuugacccuaaggucccuuuguuguaagacuucagaguacaugcccuuccccccagagcagacacuaagcaggcagaggagggaaaguaagaaggauuucccauuuaaauauaauuauauaucuucuucauuaacuuuggggaggagcauauucaaccagaccugugggaggcaaagaacagcuuucaggaguugggcucucaccauuuggguccuggguuuaagcuccagaugucaagcuugguggcaaguaccuuccguuuaguacuaaacuaccucccuggccuggauuuccugguuuuagauagggagggcuuagaagcagcagagccucccucugccuaaccacagcuggccagucaggagccauggaaugaugcaggaaagaggugugcuuuaacuagucauguuccaggagcgacaccaugcuccaccuaaccccagacacuccaugggacgacauucucugaccauugcuucaaacaccguugcuguggcaacaggauaccacuuagagcacacagcuauuucuugauuaugauauggcauacuuaguuuuuuaguaagaaugcgccaaaaugugggaggugccaaaugggauucgaggagcccccgaucgcaucuccauacagccugccaucuccuuugccacaacuuacaucacaaaguaccugguggccaaagacaggcuaacaaggagggauuuugaauuugccucaauguccugcuagaaugacagcuaugucuucagaaaggccucagcacucggugaaccuauugaaggauuuucucugcucuucccuuauucuaaagggacagucucucucugccuuagucccugcugcucacccuaucugccugguggcuaugucaccccaaugaaagaugccugccuucuccagucaccaacccaaguuucaccaagagcagggcccauagccuuguguggcucccagagcccacuggcugccugaaaucccaaggccaaagaaaaaucaagucucugucacaggggacgggaaggagcaaagaaaggggcagcauucgacugggcuucaggaccaacaucccaggugugugagagggugggaagagcgugcuuccucucucaccucugacaccuggcucugggguuggccuggggacccggauacagugggaaagucucaaauuuuaggaggaagaacaaucaaauggaagcagacacacagcuuugcuucugggaaguagggcguuggccagaggcggagugcaugccaguagaggaccugcuuccucugggaggaccuggcuuaggcuccaggaguaaggaccuacucauauauccagacccuuacagguucagccagacccagaagucgcacauggaaagggggacggggagaaagaaaagcugcaucuuagcuuaaugaccaaaucuuucuccaggggaucuaaugcccuuuccggcauccacagguaccaggcauguaugugcauacauauaucauacaugcauggcugugugcacacaaacacauaugaaauaauaauaaugauaaauuuuuuuuaaaaagagagagauuuagaccuuguggcuggacuaccauuuaagaguucuguaggauggagaguuugcacagcaaagcccugcuucucaaauuauuuacaaacaaaacuuuuauuaggaaggauacugaggcuccuggcccuuuggggacccucacuggugggcauccgcauccuuuugcuauauuugcuuguaacaagcuggcuucuagcauggccuuguucuugcugucaacucuggggauguccuauggagaagucugagcaaucaagcaucagaggggaccagggucaauauccagacagcacuaccuuaggucucugugucagaacacccuagccacaggcacccacuuaagccggguagauucugaccccaggaaaugaagaugaccaggcuuggugguuuaaaucucuacauucugagguaauuugucacacagcaauagauaaaauaacagaacgcucuaugcaacccaucaaauuuacuauggucacugauagagugccguucaacagaagacacaaagccacgaauccauucgugacgcgugacgucaagcuccacgcuggagcuccaggccggagaacacuaacagaccuacccaaagcuguaaaucccagcagccugugcuaagguuaggucugugauauauccacucggagcuccugggguaaacuaugcugcucacaucagcaauaccaaacagccccaagaguggaaugucuguugcuauuuucacuuaccccagacacuuaaaauaaauuccacagcuacacuccacacauacacgguuaacuaaggcacccuggggucuccacacuuacucauaugcacccauaagucuggaggacauuagaaacaucuaucagagccugggccccacauuaagaaggcaucucccaggccacccucugcaugauaauuugcuggcccucuggcugaacaauaccuauuagcaaauaugagaggcuccucccagagucagaagauucaggucaaccccucaaggcagucccuaagucugcagucccagauauagcugguucuugugacaagaaaccaccaagugugagcuuagagaugcugaaauccccaccugaaacccaggaagaacacagaagcugcaaggccagauguggccacaugugcaaaagaaaagcuaugugacugcaugcaccagaggaaugugugccuagaguaaugcaaucaggggccucaaggccuguguggccuucaugacaucaugggggcacagcaucccugaagccuacuccccucuuagaagucaccaaacucaacagcuggcuaccuucaaauagccagacuuaauaagaccagcucacccaccuuuugugcuuucuucugacccuaccucuaccaggaacagcuuugcugcaaaagcuuauuggagcaaaagccuggaagcaauggagggagugugauccagcccaggggaccaggcugaaagcacaacacccuguggcuuaggaccacucaaaggccaugaucccuagaacccacgggacugguuugagaaggcacugacagaaagacaaggaaaggccagggggacacagaccuaaugugagcagagcucucucugaggacaagauuggggggggggggaccucccagcaguuguuggaauguuuuacacaggcaagcauucuuuuuaaagcucagugugcagagacacuuccgagugggucugggugcucagucacacgugugcaacagcagccgcccaucagacuccucgugaugaaccuuacaccuaagaccaccaacacaaccaccaucugggucuucauaucaguucucuagcuaagccucccagauuucagauguuugcaaacauaggcaucuaaauccuaccccagaauucuaagaguaggcuacugauuuaaguaagggccgggaacaggaugggaggggcagcacuugcuaucugcucaagguucguucucuauuuuacagaaauuuuacagcucauuuuacaggaaggcuaagaaccagcucuaucuucuaaaguucugacaguagccucgugcuauuaacucuggugugcucaggaccucuaaggucacucucagauccugaggauacaggaggaucccagauccugggccacacccuuacacauagaguccugggagcccauauuaucaucuguguuugucacucugcagucuaccccucugugggaaacacuaguaccccucuauucagcuuuggggcauggaacgcuauggggacacgggucagaccccaaacuccacacaagaugcagcagggcagaagccaggcugugaacucagaaggcgggacaauaaaauaagagguuacccgggaaggguuaaauggguuuuaagaacaaaauggaugaaaauggcuucaauacaacuugaugaggucagcgaguauggaggccuaaugacagcuguaagaaaaaacaucuggcggugucaaaaggucggcaggaagugaguggggcuuauauggcucugauuggcuggacugauacuccuggaaagagacacacauggcuuaacuuagcccuagagggccaacaaaaccccuuuuaauuguccucugaccagcuccgccucugggguccccugucugggauccugacaggcaaauagucuuuguucacccacagagggucaaugggucuaaagcccucugaagcaguagucuuugggguguggcaaguggcaggugugcccucccuccugggccccagaaucucuuagcuucauuuuguccuggaacaagcuugggucacuccacuagcacaugcuucaauaaauccauccccgugaaaacccaaacaagagcuuccuuuggaauaacaggaagugcugguacacagcauggccuaaaauaggguucauuuuaucuggagacaaagcuguggccucagagcuagcuuaccucucagagcucuugcaagaacccaggcuguccccccagggcucagggggccuggacuuuguuaugaucaacccuggcacaucuuguuuccuguucauaagucccaaaaacggccacaugggaaaccaaaccagcccugccgcagggaucaggucuggugcguuccauaagcugugaggcuugcuugcauccuucauguucggcaagacccacgggccuuuggaaucagugacuguucucucugaauucuuaguuuuuacauaagccggagcagagaaguuaacaggucucuguggacaugaccgacaugcagaggggcaaagcugggugcauggaaaggccaggcuggaagacaggaaugguuuccauuuuuccaaagggcccucaauguaagggauacgagcacuaagaaacccgcaaugaacacuugagacccuuccacuggcagccugaacaccucccagaacacgacuggagccuugcaaggugcucccuugcaguacuuugugcacacuccugccugcagcccaacugccuaauccucucaauggucuucugcauuuauauguuucuuuuaauuuguaaaggagggugaggaagaacagggucucaauccacugcuaagcacgaccuugaauuccuaaucuuccugagcaccgggauuacaggcacauacuccauucaugcaaaacugagauagaacucgggacuuaguagauagaugcaaggcaagcgaguacucuaccaacugggcuacagugucagcccuguuaucuuuuugaaagcuaaaagaccucacaaagaauccucucaguaaugugaggccaggagacacauauaagaaucaacugcaucaccaaacucacugcucaaaguucagauggauucuguuucuuuacuaguaagaaaggaaaagaucugggcuggaagcccggugugguggcgcacgccuuuaaucccagcacucggaagguagaggcagguggauuucugaguucgaggccagccuggucuacaaagugaguuccaggacagccagagcuauacagagaaacccugucuccaaaaaaaaaaaagauuugggcuggagagauggcucaguguuuaagagcaguggguguucuuucaaaggacuugggcuuguucccagcacucacaugguaguucacuaacaccuguaauucuaguuucaagaguuccugcccucugagggcacuauaugacacugacauucauucuuucauucauagauacaugcagacauacauacaccacaugcagacaaaacacucauaugcaugaaauaaaaauaaaauguaaaaagaaagauuuuauacacagguucacaaugucaccugucuugagcacugggucauuaaauaaaauaaugagguggugggugaauggauagauaaaagacaugcaggcagguagacaagacacacaagacagugugugcaacacagagccagauguuggcaaaugcugguuucuucugcuggcuuauacaggaagacaacuacagaaagcuucauaaaagauaacauauaauuucauaucaggcaaguggaaaauugucuauagaaagagagagagagagaacgaacgagaacgaacaagcuguaggagucuaagccagagcauucaggggaaauuuugaauuuugcuuggauccaagaaaugccagcaccuauucugauucacacagauccugcuggacccaucagaaggaaggagccaaaccaggcaacaucacaccuuucccuacucaauaguccaaaaucaggguuuugccuucaaccuugaccuugggagcaaccaucucugggaguugaagauaugggguaguggcucacaggauguugccagucuuugucucugcuugcugugggggcaaaaaaaaaaaaaaaaaaaaaaaaaaaaaaaaaaaccagugugcauuuggaagauuauauagggcuugauuuugcugaucuuuugagcgagacacugagacagaaaacaggcucaucuuugggacuucacaguucacuagugaguucagcaaaccacaauacaaggccuguuucccuggggaucaucucucccagggaaagauccaagaugucaggccucaucuuuagaacuugugggggugggugaagugguucucugaaggaacacuauggaggcuggacguauguggcugugcauuggauccacacacacuccacauggcacuuauuuuaaggcaccaccagcuauuuuuacccuccccagaaacacuggaaagggaauccacacaggaaaacaaaggcugcaagccucuugagcuacuccacuucacacuuccacugaaucaccaugguacacacacugucugcuccuuugucucagggacaaaucucacaaacaagucacaggggaucgaaucuaagaaaagucagagucaaaaaaagcuuuuaggugacaacaccacuucuccccagcagccaugauacuccaccagcagugcugggugcccagugugugacuaacaggaugcuacaggaccgagugccuaugcuuaugcuuuagaaggcccagagacgccaucucgacugucuacaguuacaugcaggauacucguaaggggaagaugcuagaguaccagguggucagaccgcgaccaggaggagacagcaaacaugacgcuaccggaccaagugccuguguguccaucucaacucugccuacagauacacaggauagccuuaugggagagaugcuagaguaccacguggacagaccuugaccaggaggagacaggaagcuggaaggaggggucuuagaggaguacauuaguuuuaugucauauaaaccaaaacugacccacuuucccacaggagacauauaaagcuugguccaggacuaaucuacccaaggaaaggaaagggaagaagggcauguagugugacaucuguguaugauuuaugcuguucuggaaucuucuagcuggcccaggagguaugccugagggcaccucacagccagcccuauuagacccugggccuugcaaugcuggccucuuacuggauuccagcagaggcaaacagcccugguauguaucauuuuauuuguacuaaaaacauccuuccuggagccaauccaacacgcugagcacacuguucucaacuaaggccuuaccaguaucugggaauguguuagggcucagcagcucacuauagcgaacauuuuauccucugcugguuuuuuuuuguuguuguuguuuaaaaaaagaaaaagaaaaaggaaaaggaaaagaaaaaaaagcuugcugaugucccaaggguggaacugcccccucugguggagcagcuagcucaggggcacucugaggcagagguucucaccucuaucucauucaauagccacuccgccccucccccaacagcccaugggcaacagguguggugauaagaacauuccagagcccaaagagcccugugcaucucaaaaguacucacuuccucuccagaaguuuaagaaauuagguguuguuacccuacucaaaauuguaggacguggucagauuuaucgucuagagguggugggggcgaggacccugaaccucagagguccaguugugucuagaguuaacaggacccauacucucacagauuucaguucacuuauuuggaaugugaagaugaagggccucacacaauugcagaggcaaaagcgaguaagccugcagcagggcucagaggcaagcuaguacacaggggucagcuaaagcagggguucuccauccugaguccuagacgccuaggagggguggguccucucagaggaggccaucuuugucuuuuacugacacacaaugcaaaaauagcgcuguuaggagacuguggggaagauuugcuuuaaaaaaaauauauagcggggcaggaguuugugacacaggccaggaaccuuagcuuccauaaauaaugcuuucacaaagaaacaaaccugcccaucuaugggcugaggagcuggaucugugggugaggcgcuagccuuguaagcaggaggaccacgcuuugauucccagaagagccaggugugguugguggcauguccuugaaaucucaggaaaauguguggauuccugggucaaccagccaaccagccuagccugcucgguaaguuccaggccaaugagaaagaccuuaucucaaaggggaaggggugugccuagggguggggcuucagaacuaaaccugaaaggguguccucuuggcucaacaaguacucaggaaugaacaugaaugaacaaaccaaacacacacacacacacacacacacacacacacacacacacacacacacacccucucucccucccaaauaaaaccugugaaauggggaaagugccauuauuuuugcgaaacuguuaggaagacucugggaacagacacaacucuucauacagucgaguuucuagugaagcccaccagagcacuuaguucuggugccuacgaauggcgagccucgggaaagggcacacuguugggccucugggaggcuggcugaguucagauuacuuucuuuggaccaggccccugcaaagucacucccagccaggacacucagacccuuuggaaggguccuggagagcagugcucagucuugaccagcugcccugacacaccuuagcugccacggccccacuacccugcagagcauccauuagccccagcaagaaagacccacaagcuaccucagccacacggucagccucuacagaaagcuugcuggaaggcuaaaguuauucugggcacucuuugaagaaaucuggauuggguuuaucugcaagcuacaucuguaaacacgccauaaggcccaucccaucccaaagaggaguggguauuuguccacugccucugccuuuaccaggggaagaaaacaauggagcaugcuaggccaccuaugaggaggccaccuuaacauagcaauccauaugacauuccuuccacagaauuuccuaguucuucucaauaagcacaaagacaaauuccucauccuuuggcuuccguugaguagaaaaaaauuaauugccacauaaaacugcugauuccuaccaagugaaauaauacgauuuaucaacucacagggcgagcaaacucaauagggguuuagcuacaucaccugaaauaaaugugguguuuucuguggaugacaguuuuaggaggaauguaaaguuuugugaauucauucagaugggacaaacuucuaauguaaacauagacaggagguggugagagcuucugggcgugcaagccucuuagagcauucucugacaaagaaacccuagggugggggacucauucccaacagccacuucccaggcugcagcaucgcccugcccagggaugcuaaggugacccaauucucagccccuaacuguauagcucaugguuuccucuguguaaaauccaguuucuucaaaugcacagagagugaaccucagucaacagcuugucuuguuuucugcgaaggguuaugaauuuguaaauaaaccacacaguucaggacauuuaagcauggagcaccugaggaaagaggaccaaaugacaagaaggggcagguggcgucaugcgcuccaaggacagagugucaucuuuauuggaccauuucugacuaccuaaucucugccccauuguuaaggugucagugggccauuucugcagggcacucuucucacgugaacaaggccaaacacgaggacccauuccauucucucuuuccaguuauggugaaagacuaggaguuagacuccugguaggcaacagauagggagaagguccacuauguccaagguaauaaaggugaugaaucuccaaggccagcuucuuccucaacuuccugacuucagaccaaagcuuggcaacuuuagucucccaccagcugauggacugauucagcaaguccgaggcuggauccgugggugucauacguaguuucggaccacccuguuuaucuucagacugggcaacccuaaauguggcgaagaaaacugcuaggcgucacaaagggucuuuuugucugugucagcugcaugaguguuuccuugucccccaguaaacgucuuucuucaacuguugguucugucuacaguguuugagauugcucugcugcuaaccacgaacccaaaucagacuguaucauuuggaacagaacaguccucaauuucccaacuuagcaaugcaagccucuguccuccagaagaaaguaaaggguuccaacugaagguaggccagcucagcuguuaaguccgacagugagaggauagcaugacgggugccaugcgugccuuagacccugaccaugagcucagacccgugugaggacugugcucuuuaaaaaauuuaagaagaauaaaaaaauaaaaaaaguauuaauuugaaaaguaggaagcaggcauccacgcaagacacagucuacaaguugaggucagaggaaaacccgggaguuucuccauccuucauacggguucuggggacugagcucaagaucuucacacucgguggcaagcaccuuuaccuagucacccucuuguuaauuaaaaauuuuacuacguuuauuuacggggugaaugugcauaugcccacauggagggcacaggcuaccuugccaaaggacuuccuaccacgugccaugugggcucuaggaagccaacucccaucaccuuuauccacagagcugucucaccaguccccggggauccugugagccugguaaguaagugggaacagcucaccuuggguuuccccguggucacagcuacuaacuaacuaacgcauguugaucuuucccaucucuagcuacuccaauuugucccuuugucaaccucggcucccucugaaggugggagguagggauccugccgagggccguaggaagcaggaugaagaaugagcccuuucugguuuagcugcucaccucaaagacaguuuuguucuuuucuucuuucuuggugaaguuuuaugucuuaacauuucaguuucgcaagguucuccaccccacugguuuuacuacuuaaugagcagagacuauucuggaaugacuaucuuaagugcagcugcagcuaaccuaccacugcucugcagagaacaagacaugcccaggagaacugcagucuggugaugaaacgccugcuucuaggaaacacacucugcucuccccacggcccgacagcugcuucagagaagcuagaauccaagggaagcugugagguccacccuugcagcaagggccuguuuaauuacacuuagaacucagugugcugucuaugauuuauuaugugaugucuaugauuugugcguauuccuggauaugugauaguauuaaauguugcaaagacuccagggaaaagucaacauugggaugcccccaccuggcugcucagucccuuccucucaaaggaggagaacuuuuggcuaaaugggguagguucccaggggauuuguucccauggauuuugcauagggaaguaaaugggagcuccagacaaagugaagaguagagacugagccaucugucucuuaugcuauacauaaaggaccaaacuacuggagaagaaaggcauccaucaucccaaggcuuuagauagaaagcugccaguccucacuucagcuuccaugaguaugguggaagcaaaggccacagcggccacuccucuacugagccacaucuacauucacacucccaacuucacagaaagaggagccacauccaucgggcaucgggaccaacagaaguucaggauuugauauuccaaaaggcaugaagugauaccaucaugcauacggagccgugagggauggacagcacagaccaagacuggcaagauggcugggcagugcuggcgacaucuaggcagcagcaucuuugcagugaaaagauugaggaggaagacaacagcugaacaucugacagaugauacugugcucuggucacgugaugcugggugcaucaccugaaccaucacauuugggaauccugagcuguaacaagaacuacuucaucgagauuucuaacuguggcucaagaaagggacuagcacagcacuuggcaucucuuaauaaaugccuugaggugaacaggagaagccguggcaggcuggcuuccuccucccuaucuguucccacaagucuucccuggugacuguggaaaggacugaucaauggcaaugccacuaaguucccaaagcucaggcugacuucaaugcgaggcaaggagagcuccuuucaaugacaucaccaccucccuaagaauaccuugcuacacgggcaacgugaaaccaaguucugggguuuauucucacaggaaaacugccuccuacaaaacgcacucuauugcccaggcuaaucgugagauaucagacaaacuauaggacaacccagauugcccaaagccgagacuucagugaauaaaugcucuccgaagcagcacaucacugggaaaggcuacuugcugggaaccugggugggggagaaauuacucacugucccaucuucagcuauuuuguaauucccaaaccauucaaaucuugccaucuagagcucaggcugccaaggucucauuagcaagcuuaguugaaggaaggcucugauuuucccauuugcuggauccaacaggaggaaacaccagaggggcacauguuucaccaagccugacucuagacacccauggcuguccccagggucaaccccuaaguacuugcuaccugucagaaaggaguccaaagugcacauccuaugacaucaucuccccaggcagggcuucaucugacuacuuuaaagagggcccaucauuccagaggcccaucaugugguagcaagcagugucaaauuggguauccaccaccccauacaacuggaugguccucaccucagcuggcauauacaauaagcagaagccacaggaagaggaagaugcaacacugcaagugaauuuuguugccaggcaauaagcccuggugaccccaacuccagaggauucugggaaggguuaugguggauccagaguucugcuccaaugaccuuccugaacuguggaggccgugucucuucugaccaggcgaacuguuucuaguuaucacucuaaaaagucucacauccagauaguuacaaagcuacuaacuuaaaacuaaggaaaacaucaauuuacacacacagacucaucccuuuucucucaaaauaacaaccagaaagcagaugggcaggguggugugauuccagcuccuugggagguucuagcaagagaacagcaauuucaaggccuuaggucaacugccaguacuagauuaguggucaauaaaaaugagacuguccuucccacaagacaggcugugggcuacaaugaaacaagaaacauagcgagcagcacacaggcacccaggagccuuaccugggacuggcccugugaguucucaaacccugccuaccacucaacccucagcaucugaagucuuagguuuuguggacuccugcaugugaccuuauacaauucaguuacacuucuaaucuucugucuccuggaucuaagcugggagauaacgcuuacaggggugcaccagaguucacggaagggcguggggcagagcagccucccacccccagcaggcacccucccagaacacaucccuggacagcccucuggcggcuggucacucacagcuaacuuccccuucccuaggcuugccaggguaacacccaaccccucucagaacagucuggaguggccaauagcuccuucuguugauauuaacuaucacaguaaucuucagguuuaaaauucuuaacaaucaagagucaggagagggcugacccacacaaagcaucuaugacaaccaaaagacaacgggcucaaaguuuccgguuacuuccaaggccggcagggagggcauugcuaaccaggagacuuuaccacugcccaacucauaaagggucacacuggauggucuacugagucaccuccucccucccccaaaacaggaagcugaacagaaaccagggguaugaaauuauuucuuuguccucaugggcccccaacagaggaauuuaacaaaacugacagaaaagaccacccucuccaaauauaauguagccuuuaguuauuaacaaugugugaagguugauucauuaacuguaacaaacaugaccauaacugaagaggcuaguaagaaaguuuggguaggagauacacaggcauacacgauuuucucaauuuuucugucaaauugcucuuuguuagaauuuuaaaauaauuuuuagacucaauuuuguuuuuaaaguuauccguuuccaccuacugucucccuguggugaucucuucccucagcuccuuuauguagaagcuauuccccuccacacucaaauguucagugucccaggaagagucuguaaguccuguggucuguaagucguaggggaaguccuggugagaggaaauagcugagcugacagacaguuugggcauggcacuagagaagggggugggguggggaggagaaugcuggacaaaucaagaaauaugaacaccacacacucugugugaacugccugcugucugaggaaggggcaguuggcuaacaaaagucagcuacuuguguggcuggcuccagccuaagccaacagggcaucaauccagcauccaagacuccaaucgcugaacagaagaugggagcaagacuagaaaaaccucaguaaaaaucugagacucaauggaaaauggagcaaguagccccaagauccagccaaaguacccaagaauggacaaguaggccagguuuccagaggaaaucacaaaagugaggcucacuaggggugcugaggggaacgauggcaaaugaagccucuagccaacagggcaauccuagaaccagaguccagcaaccuuucuucuaagaacgaacagauuagcaaacuaacucaacuuugcaaaguacagagaugcagaccaccguaucaaaacacaucuccaaacuccuuggcaccgauggucacugaaagcuagcaagccacaaacagaaggcaagccggagaggaaaucuggcaacuugcauaugcaggaguccccaugcuacacacagaugugacagacacagcagggccagggcaauagaucagagguuaggaugggguuucuuccaaguuguaaggauacaacuccauaugccaaacccagccccaaaccagaaccagccaaugcaaaaagacaaggaaguaccaggugcuaauuucugguugcuuccaaugguauggcccacugaauaccaagagguaugcccuauccccaaccaccugcaagguucuguucaggcacacgaaccagcccaaggcaacagggaacaagcccagggcaauuggcucugcacugcugcaaaagcuaaaccagagaaaagguuguucuccgagacugauacaccugccccugcguugcauguguaccaccuuacuuacaaggucccaaaucauuaacaagaauauugauuacaguucuggaaaucauuacugaagucauuacuuuaacugaugguuacaacagauagucagacagacagauauagcagaaugacaaugcugagauucuaccuucagagaacacaucgcuagggaagggagugcagccauggugcaucccaaacuaggcucacccuggucaagugaaaucaugguucaagauuuuuuuuucccuccuugcaaaauugcagaggcuacugcugcugguacaaauuugcaaauucaucuacaacuggugaugucuuguuuuagaaaaaaguucaaauauaccugauuuaaucuauggggauccacauugcuuacccaugaguaaucuugcacaaaauggacauauaaagaaucagaaaccaacugguaugggacaaacacuuuuuuuuuuuuacaacuuuacacacacacacacacacacacacacacacacacgggggggggggggggggggggggggggaagcaugcaugaggaugaccugaggcauugaaccuagcuuguuugagauggucuccuuugcugcugcauccaucaagcuaguuaguuagcugcccuaugaucuuccugggguucuugcaucuccgccucucaucucauggcagggucacugagauuacagacacagcauuuuacauggguucuggggauucaaacucagguccucacgcuuaugcggcuuuauuaacugagccaccucucccgccuagcaaacacuuuuuaugaagcaaaucuaacaaccuugauucguguagggauuuacgacauaaagugaaagcuugacagaucacgucaaaagauucuucgagaauauugguuuguugggacuuggcauauaaaauggccuguguucagacuugcugccaggagccaagggucaugaagacuugagugguccaagggcuggaugcugugugguccucucucacugaaccucagugagaggggguucugcucuuaauucuacaggccagauguggacuccuugggccccauccccgaacuaggcaguggcuaugagauguugucaacuuuauaagcaccgugaguaccagaggcucucccagcuuaagcgccgaugaugugaugugugggauaagucuuugagguagguucuaugcauugcgaugaguuuguuagcauuccugaccuagaugccagcagcagucccaacucuggucaugcuggcaccauaacccagacguggugguguagaccugaacucccagaacuugggagguagaaaaagguggaucagaaguucaaggucaguguacaucuauggauccucugcauacaaccuguaaaagacaccuugcuugcaauguuaguaaggccauaaagaccuggcugggagcuaucuuucacagcaaacacugcucuuucaacacgaaaauaacugugauucagggaacauugugaaaccaaagcacuaaauuuuuuucuuauccuucaguaauugcuugcugucccuuuaagaaccuugcacacuacuuccugcugccuuagccuuuccaccagguauuucauagcgcccugaggcuguucuuccuuaacaguugcugauucaacaagauagugaggucuaaguaggggagaagucacagcgcacagccaaaccaaaccggacuggccucugucugggaaugacagguugccuugaagcugggucuguacgcccuuuccuugacaccuggagguucucccccaaacccucacuugcuuucugacacguuuuugcagagacaugacaggccugucuacaugugagcucugucugcagaaucacgaauucgucugauuuugaccaccacgugcagaguccaggacauugaaaaugagaaccuggacccaccacucuuuucucacuggucaugagaaaagaauccagaaaguuacacccccagacuucuacauggaaccaggaaaauggcaaggaaccucaggugccgaaaugaaccauuaaaagugcucacaccuaacaguagauuugguucagaacaaaacagacaggcuauagagagaggacucagcagguuaagagcauauacaguccuuacaggaaccaaguuugguuuccagcaucuaaaaaugggcaauuuauaacuaacuaccuguuaucccagcuccagcaggaucuaauauaucuaauaccuccgcaggcaccuguguuccugugcauauacucacacaagcauauuuaaaaguaaaauaaaucuuuaagggaaaacaacaacaaaaaugacuuuaaggcagagagaacacaaaagggggacuauuuuaacacaagcauccuacguaagccuaacagaauaugccagggauuccuacguuucuaauacaguaagacugggauguccugccaaacacaaacgcagagaaaaucucccuggaccaagaauucggaggauggaugauucuagaacagauaaggccaaggagcggcgaccucaggguucagauuccaguucagggaaaggcaagaaaagaaagagagggcaagcucugcccccuuuuuaucugcuuuccgucccuuuuuuuauuuuucugaugugaaauggcugagcacgaggccuucaucacgcuggguccuuugacccuagaccucugaccuagccaucagaacuauaggccagucaauuucucuucacuguaaguuaucagccuccaccauucuauaauaucauaagccagacgauggcacagacugaagucugguggauacugcucaggacacugccaacacagcaucaggacccaaucgcaucaggaauacacaacugaaaauaccuucaaacaauacaaauccacagaaucaccaaaaaccaccacaggggugcuaagaagugggaaggcuauauagguggcaagaaaauucucucgaguggacacuugugucucaaugccaccuccacagaggacaauaaauagaaacacuaaugggaauauggcugcagaagcagauaaaaugaccaaugggcauucuauauccacuaaaagaaaauccaagaugccugaccaaacagcccacagacaaccuuccccuagcuguuccacauucaagaucccuaaaaacaaggaaaccuuguaaaaaaggacauaacaagccaacccugacacuuugcaucucccccaaaccaggguuccagucccaguuucccuaacaaggaucccuuuggucagcucaguauaacccccaccccacccccacccccacccucuacagcuugaccuaaaagauuggccaaugcugcuuuucagucuuagaaagcagaguuucucccaggaaucuucuucaucugguuccucuguggguaccacacucugcccugccccuccccgcucugugcucgcccaccucagcaccugggaucagagaggcagagccuguucccagugcacagcucgcugagugauggugugguacaauggacauaucugacaccagcgcuggccagggcaguguggcuuugggguggccaugggaaaggggcuugagagaauuacguccauacaagcaagaggcagcgcgguucccagggacguccgugugccuccagauucuucucugaagagucugaacuugcaaaacgcuguuuccucuccaggccuccuucuuggccuuccuccuccaacuggucugugcugccaagaaucaucuguccagcgacuuccuucuagucuacuaauuacagcaacaagaaauaacaccauggugaugucaugcaaacuuucacuuccuguaguggaugaaucgguugggccagccaccaugcccagaugcaccaugccuccauuuuggaagggaaccaagacaaaggcucccauaugccauaagagcucuucuguuuacaggggcauucugaagguuuccuagguuagauagaaaaggaggcuuaugggagacaggaaguggcacauuugguaaggugcuugcuguacaaacacgaggaccugaguuugaaccuucaaaucuucagccuucacauaaaacacugggcaugugugcgagcgaguguuuguguccguaugaaccacagcucggggucacugggguaugcuggcugacagccuagcuccauguucaguaagagacccugccugaaggggauaaaguggagagugauaaaggaagacacaaaauaccaucuucugguuucucgauacacaugauaguauggucuuuccauaaacccaaauacaacauuguuggcacguguucuccauaugggugugcacuuacauacacaaguacacuuuuaucacauaacacacauauguacucaugcacagguacacagauucgugcggcaccacuaccaacagaaaggaaaaaaagaccgaucauguauauaaagaaaagcuaccguuucacaacaugucaugagaugcggggcagaaaacaccacccgcucccggcauguacuagccaaggagagccggacggaguuccuucauaggaacauggaggcgagaagcguggauugacaaggacacaaaggcagguguuucuucucguccagguuccuagaguaagaggaggagcuaaagacagggaaggaaggaccgagugccaggcuccaagcugccuggacucaaacaauggcuuuccucacugcccccaacccgcuucgcuugaccuggcagccaacaccagccagaguuuaaucuucugaagggaucaaagaauaaagcugugcccaacaacacauucuggaaagcucugugcuugggauuuucaacaaaaaggccuuucucuguggaggacaaacaggaacuugcccagaagaacagaucggguuagcugauaaaauuuaccuugaaaaggcugggaggaggaucuggcugggcuccguagacacacccaaaauagccucuuagauccauccucaguuuaccucucuaaguaguuagucugacgagggcuaccgcuuggagucugucuucucuaucagcaaucuuggccaaugaggauuaagaaugcagccugaccuuggagacaaacacugguaggggaagggaggcccaccucuaaaaccauccuuugaacuugugacaaauuuucuagauauaagcagacucuuaucuugggggcgucaaucacaggcguggauacugagaaugacauuugaggacguaucugggagaugcuuccuguggggccaaaggcuucacuaugccugagaagagugaguggcuuucuguauuguccaggaccuagguauugguaccauuucccuucuucuaauuuugauuuaaucuuuacuuuauguuuaugggaaucuuggaauguuugucugugcaccauauacaggccuggugccagaagaggccagaagauggcgcuggaugcccugaacuggaguuacugagccaggugcuuggaaaccaaacccgggccgcccuccauguuagcgcucucagcaauuaaagcugauauuaccaauuaucacacacauucuuuccaagugaacuccucugaccaguuaguuagucuacgggucaaugccaucccaauucuaagagcuauuggcccucuagccaccccaagauucaccuaacuucuacagcuuucuaaacccaaaacauaccuccaaucucuguaaauuuggucauagcugacuucaggacuaugucacuuugagauauuguaaggccauagacaggccaggcuauaagaaaggcaaagacaagcagugcccacauugggugcuacaaagauggccgcacucaugagaaucuuuaaauaccuacagguguucuggcucuccccuucauuuuaaucugagccucaucaaaggcaaaguuccuuuccaccuguuuuccaaucacugaucauggccgucgugaaucuuacagaccaauuuaaaauugagggucgggggagauggcacaugcuagguaccugcccucucaacuggugagugccucaaguuuccccuggagccaguaggaugaugucaccuugcucugugggcaggguccugguccuuugcucaccuggccugcagugagcgggaagcaccauucugcacaccuuuuaauucaaaggcugguggggcacagccagacagagggacauacuugaaacccugucacauagucuguaaucuucuuggaugaccuuccaggcuuaaagagguaguucccucaguacucaggacccuaauuccaucagguuauauuauauuuacacagacugagacuuauaaauaguggcuagcuuugccugagaugacaaagaagagaaacgucauuuuugaaacagcucacugaauauaaaaaaaucaaaucaauguuuggauguuguauuagucagaguucucuagagucauagagcuuauggguagucucuauauaguaagggaauugguugaugacauacagucuguaguccaacgccccaacaauggucagcagcagcugugaauggaaguccaaggaucuagcaguugcucaguccaaagaggcaagcagacaaaggggagagagaaaucuuccuucuucacauccuuaaguaggucuccagcagaagguguggcccagauggccuugaacucagagaucucccagucuuaaucuucugggauucauagccacuaugucucaagaucuccaugccaagauccaggucagaaacuuguaucucccagccuccagauuaggauucacuggugagccuuccaauucuggauuauaguucauuccagauauagucaugcugacaaccaggaaugccacuacagauguaaacaccauagugcgugaagaaccagcagucuauucauuucccugaaaugucccaauauggacucccucacugguccauucucagaggaucguguguucccauugacagaagauccaaauaauugucgggguuacuaauuugcauauaaucagcuccaaaaucaggacaaaggucuacccucagcagugauuuuauuaaccaggcauucucucaaaugaaacagagcccaacagaaaccacagcucuucuucaaugaaaaccacuuccacucuacaccagcaaagaagcacuuacaccuuuuccuguugauuuccaacguuuuaggcagaauuuuaaaacccuagcuggcauucucuguccauuacuggccaccaugcuaaaugguucugaaccugucuguaccucagcacuugcugcgauccugucaaauaaaaucuuccccugaguuaacacugcugaauauuuaugcaucuaauaucauggcuuucugcaaagugcacaaaucauuuuaacagaguguaaauucaacuaccaugaaggcauuuuacacucugcuuaacuucacuaaggggcagguaaaucaagcuuccauaagucuacuuaaggaaacagaagucagaacuuguaaagagaaauauacaagucucuggauuagagagcaaacacaugcccauaugcagcaccaagagucuacucucuuaccaagcacagagcaacccagaaggguccggguagugggguguccgcacuguagaaugauggggacugauuauaccccaacauucccuagggcugauaagugggcuaucuugagugucccccuaggaaacacuaucccuucuggcucucuccuaaagugaacucaacggccuaaagccaaaagguccccagaugcacucaaagaacauaaaaauggaaaaagaagggagaagaagaaaugcaugcccaaagcagcugaagucauaaauuauuuacagaaugagggaacuuuagccauggcccaucuggaagggccuggugugggucucaagcugggccccaaaggucaacaggaggggcuccugucugagaggccaagaaccucugaauucacugggaaccaugacuugcuuuguccacagcaggugaucccacgugggugacacccaccaggaaagaugggucauucacucagcacugucugcuccguccguccguccguccgucccauuuccagaugcagcguaacccaacacaaagacagagaaggguacugcacaccuucuucaguucuggucaaagaguuaaggcaugacaaagagacacaagauaauagagccuacccaaagaaugcauuggucacaugggaauuaaucugaaggccaagauauaaugacaacacccagauguagcacacuagaugaagaagucaggaauccccaaguuaaaggcaugucuccagggaaagaaacgugagcaaugucugcccacuuaacaaucacugugacuacagaucugucacauggcauuguggcauagccccggagcuuuacagagagaaaauggugaggugacaucuuuaccaugugguugaacuuaaccucuucaguaaucaaaccaaguggaccacacagcuaacaagaugggaccagggggacggggccugcuaugcuuuaccaggcucugacuguccugggcaucgaaugggacagcaaaugacucagccccucuggucacucgggcagaccaacaguagcacauccaggagaacuucuugcuuguguaacgacuuaugacuuuacaauauaaucaauccuuaauaaaauacacuugccucagguaccauuuucagauaauuaugacuauccccugugacuaugguaacugcucaggucacaucugcauauggucuccaugaucacugcacccgggucaccugauuguggacaagugcuuuagcauuuagaucagaugccagaggaccaggaaaggucugugugaggcccaacaagcaagaauaaaguacccacuucugagccagacuaggggcgagagcuaaaucugucaggaggcccaagggagccccuggccaccucugcaucgcagcuguugauacucagcacccauagaacuaaaugaugcagcucuaauauuuuaucucuaagauucugagcauaacugacaccaaauccaccuauaaagcagucugggcagcacacauucccaacacacuugcacuaagcugaaacccugugcuggagggaaggaaguccugaagacaucugccgcccacccuacagcuccaccaccaagaacacaucaaugacuguuggucagcacuggggaggguugggcugugcacacaaacaugucccacaagaacaucaguugcccagacucaguuuccucaccuggaagaggaaauggugccauguuacuauagcuaugugauccaaacaaugaccgauggggauaaaaggugaggccgcuuuuguuccucacagcccaaaagcacgcgccagcccacagcuccgaagcuaccuccagcaccauuggagcgaugcagccagaaagacuggcccagucaucuuucuauuuugagcccauagcagccacagaaaagugacugacugacugaguuaagugucugauucagcaggaggugaucgagagggcaggcgcccucacuuacuucagaggggccaccuucuaaguacagccucuaaacccaguaacacccacccaacacagugcuccugccugggaagggaagacacugagagcugguauucuagaacugaacucccccaggccccacaacuucagucucaaaggcccucagcggccuccauuacagcagaguucuagccaggaugucagaagcaccucugauaagcucuccacccauccuuuguucccuggccugguguaugguucaauagggcaggucagacccacccaggaugcuguagucaccuccgggcccugccuacacuuccuuccuucacuuuggccuucgugaucguugguacucuuucccaccaagguguccugugguaccacaccaacugucccccucuuugcuaacccaaucugucccuaggguguugaccuugccaccuguuacagcugguacucaacaccuaacgcugagcugucucccucacaucagcaaaucuucaucaaagucuacuuguccuuggacauuccccaggcuccaugaaaacaaagcccacuucuuagcaacggcacaccaggcuccucgaccagggacauccgacccaggaacagcaguccaaccuggagccccuccaacagcccgggucuuggcuggagacaacagaaagcaccuucagcccucaagucgccaccuaucaccuaugccuuuauucacacuaauccaucaacaggaacaaggaggcagauuggaagcagcugccuaguccgaagaucaaggguuuuauaagagaugccaacauuuuuacuaacggcauaauuacaucagagaaaacuuccucgucuaagauuccugcacugcccugacagcaauuuaagcagcugagaaaagaugguguagacagugauuccagcaggauccugucuccucgucgcgcacagggcugacucucuuuaaugacagugaacaagagcuucgcagacauauggugaggggagcuacccugggugcaacagcaguuacauaaaguguuuaguggaggauuuagcuguuguaaagauccuauuagccggagacaauuuccaucucugacuccagggagaacuggaagcuuugcuucugaaaucagggcaaagagccuccaacagcagugcugaggggggugcucuacuccgaggggaggcucaggaaaggcccuccaggaugcaguaugguaccuuccccucccuuccaagcugccaccucggaugggguguucuuauucucuuccucauucauucauucauucucuuccccaccucucacccaucccuccccucucuaaaguaucuacugugugguccaggcugcuuuugaaccaaggccuugccucagccuccagagugcuaguauuugagauggccccgauucaguaugcaccucaaaucauagcuuucucugcucuucucuaucccuucauuuacaucauuuccagguaaaguagacgccucccccgcaaaagaaaacagcaagucuggaaacaccaugccagccucgauggaccucgauggcaacauaaagauuugcuauguuggcugcaacucauucccccaggcuccuccaccugcucucugcucauuggcucucugccugcucuugcuagaggcuccuuccucagagcuucccaacacagucuccuuuagcgcuaaucuagugcucccuucagaggcccaugcccaacaggccuaucacaggcuccuggcccaagguauaugucuugguguacacgcuuggguacccucaaguuccuauggagaaaguggcagccccaggugacaguauuaacagaggugggccagcagggaguuggcuggacaauggaagcccucaggauggaucugagcucucccaggaucugagcucccucggcuccaucugagcaaagcaagaaaagugccaccuguggggccuucagcagacauugaaucugcaugucucuuuauuauuucuuauuuacuuagaaauacugaggauugaacccagaaugucaugugugcuaggcaaaugcuaaaccacugagcuaauucccagccuguuucccgccacccuccacuuuuuuauauaacacaaggucucacucaguuaaauggcucaggcuagucuugaacucacucuaauucagacaagcuucaaccuuauagucuuucugccucagccucuugaggaggugagauuauagaucuauacaaccuugccuggcuucuggucgucucgaucuuggccauccaggcauccaaaagcauucagauuucuguugcuuacaagcugccugguuaugacuguuccuuguaagaggacaguaagacugaagcaaccuaucaucaguuugaaucaaagucagcaagaaaacaagcgaccuggaggagugcuuucccucuaaaacggaaucucggcauaagcuugcccaaggcagcugcagaacaugaagagcugugccuugcaugcaugugugugcacaucagcacaggugcgcgagucagacacacaccuacacacccacacaccaaugucugaaugaauaaauauguagcaagaacacaaccucaucuuucagcccugaucucaacccuaaagagaugagagcuggucaccaccauaccccaggccgguccucaacagacuggaucuaugcagaaggaauaaacagagacgggauguccuacuggaaccaccuaucucaggcuguuucagucauuccuuucauuggcccacuacuccacucauaagccucacaauuucuaucuuaacacauuucuccuccaaucuuucugcugggcuaagaaguuaagagccgccacccaggagcacaccuaauucacuuaaguauucaagacuuccauguuucuucuacugucagaagugcaccgaccccuuuaggggaggccuggugcccugucacacaauucaucagcacguaagaucugucccagaaguggacuggugugggucucagugucuuuaccucugaacuagccauuuuuccugguccccaacuaaacuguacucuuggggacaaguguucuuuccucuguaccagaccuuacaggaacucuguaaggaccaagguagcacggauacccagcucuggaaucuaagcauggcacuacucugagugcaaagcaguguuccucuuugacucuaaaggcuuugacuuguggagccaugaggaaaaagguaacaaacccagaagccaaaggagaaaaacaaaacaccacugagacaaagaugaaaagaccuaggaugugucaaggaugcagcacacagaagacagcagcuaguuaguaggagugaaaaguugauaggaugaauaagaagucagccggccacaggcaugggcgggacaacuaccaugguaaugaagaaccaacaggaaggguguaaauuauaaaccacaaccuaggucucuuuuaccacccaaagagcagccuucuggaaccuccuuggcaaauugagagguccucugagccugacaucacagaucacuguaaguaacaagaaguauuacaagcaauccagugggaauguugaagucacuccaaugaccaggaucugccuguuguuuccaagcuauaggagaugagucaacacgucugaaugucucuccuggaaagaccuuagugcuucuagucccuagaugucaacagcccugaccaaggccucacaaugcugccaugcaucaaaaacagaaacacggggauggggagacucuucaguggguaaaguucuugccacguaagugggaggauuggcgaucagacccuagcacacccaugggcuaaccuguaacuaacuccaagcuugaaaggggaagacaggggauucacaaagcaagcuggcuaguuauagccaagugaaaggcucuacacuucuguauauuguauauaagguggagagcaacugaggaagacacccaguuaagcaccagccuccauaugcaaaugcucuccucuccacaggagagugauaaccauauucagaaucccggccucacagcacuguacuguguaagcuagcuaccuccaaaugcuugauggaaggggacagcagaggcccuucugaguccucuaaccuccucccagagcccagucaucagaagcuaaugguaaaaugcuagacuaaaccucuccacucuccuaccccaaacuugucuucugcucuagccagggccaucacauaguucugugggcuuauauaaagacagaccagccuuacuccagcuucccucucaaccaagcagcaaugugaaucacagcucccauagggaagcuauuuacgccucaaaacaagcugaaaccuacaaggauuauuucagcaccagguaauaugauguaaaauacuuuuuuacuuuaacagaucugaucugccucugacagauuuuucccaucagaauuaaaugugcaugugcacacacacacucacacacacacacacacacacacacacacacacacaaacaagcgcgcacuugcgcgcaugcuuguccacaaaaggaugcaaaaggaaaacaaacacuaacaggaaacugcuucuagacaucaggcgacucagaagaauaugaaguugaaagaaaaauucuaaaucagaguaacaaagcccaaauuuucccugaaagaugaccaacuacagugacagcuacaccuuacaagaacaaucugacugaccucgaaagaacgugaaccccacacaagucagagccacaggcagacacagccccaguaccugaucaacccaggaaugagcaacuagggaacaaaugaguuauuccacacaggccaacuccccuaguaaaacccccaacacacaguaggcucuucauaaugcucaaccaaagaaagcacuccuggaaucuagcugcuucggggaagcucacagugaggggaacggagaucaggcucguccgcugcuggcucaagcucaacuagccaauucuggagacuggggccccagggaccaaauaguuucaggacugagcaccccaaaucuaucacaaaucaaagaagacuugcuacagaccaguuaccaugcugguguuaggaaagaggacagaaguggggccaaggggcuguucuuuugaauagaacaucuggggaaaacaccagggagagaggacuuggcugacaccuacucuacaaagaaaucuugaucaggaccugaauucuccucugaauguucucaccagaacauucuaugcugcugggugacuucuggggggagagguauuuaaagacauagaaacgggaggaaaagcaaugacaaugaccacaauuagcaaugcacuucuuaagagauccccagacaucgauauguggaguuuauaaauguucaaucauuuauuccuuguaagaccccuuuucuuucauuuuaggggcugaguguggagugagccuuguucgcaccagguaagugcuuugccauacguuauaccugcggcccuaacuccucacacucuauccauccuccugccuccacuuaccaaagcacuggaaccaaaggccuggggcaaaucaccugguuuauguggugcuggacucgaacccaggacuccacgcaugcuagguaagcacucuacgcugagcgucagcuucagcccugcuugcuuaguucuacaagccuaugaggcagaaggaagaaaacugcggcagagaagaggagcgcggucauccucccaagguagccgagccgacacauaggugggcuugagcccaggcagcugccagugaggggaugagguuugaccgagacaugaaaacaagugauuccucuuacacauaccaaaaccacugccaggaaauccagaguccucccaugcgcuaacaagccgcagagagaaacaagaacaccaucuacugucacaaaugggcauacaggaagagccagucucugggaggaggaaaaugaacacagccugucuucuguaugcugggagccgaucaggucucagccuucagugggugcuaaggucacuguauauguucaagaagcuuccgaccuugaaaagccagggagagggaggcgcugcuggggucugaggugggaggggcacaggauuuguuuugccucugcuucuucacauuagauggcuucccucuucacauauaagcaguagguagccaauauuuuccuccaccaaaaguaacuggcauucaugacauguuuaugaagaagggagagaaggaauguaaaaugucaaaaccacccaaauucuaccguaugaagauaagcacacuagucaccaggcaagagcaucucucugaguucaaggccagccugguuccaggccagcauggaacauaguaagaaucugucuaauacggcgcacgccuuuaaucccagcacuugggaggcagaggcaguuggauuucugaguucgaggccagccugguuuacagggugcugggaagggacccugggucuaagagguguucuuaaauguuaugccaucuuuccaacccuaacuucuugguuuauuuaaaagaacaacgagcuagguauaguggacaacaccuucaaucccagcacugaggaggcagaggcaggugcaucucugaagguuccaggccaaccugaucuauagaguucuaggacagccagaaaguuacacaaagaaacugucucaaaaccccaaaagaaccaacaauuaauuaguagguaggagauacugguuucuacaucugcuugaaguucuaagugauuaacuucccagugacagcacauuaccuucuuccagcuugccuagcaaguacuagacugacccaguccgcuggucagucaacagggucugcaagagaguggggacugaggggcaagagacucaaagaauagaaacaaaacaggcuaucaaggaucaagucucaugucucgagucuuguuuauugaaaggcaaguauggguauauaugcacucgcuggggagugcagcuggagacacuuaaccacagguccaggauguauaggagaaaagcaagauguuaucagaguguggugggcaucuugcaagaacaucaugcuaggaaaacaagucucucaucaggguggaaaaguaccaccuguaaguaaauagccugagauggcugcagagaugagagccgcuuucugcuaggaguccgcucccaacacuagccuagacccagagagggaggauccuugugcacagcagcggucucaucucacuagacuuagcucuuugacgugcuagucaaauacccauacacauaaguacaagucaggcccagcacaggccuaaagcaggacagagguggcucaccacuguguagccagcaucuauguccagauaaggccugagacaggguaggggaagcugcuguuucuucugcaaagugccaagcaggaauaugggcuuauuuauguccaggagccagaguacuugcaaaacacucauuuuuauccgcuaaugacacagguauucacagcacauggggccagugacccccaaaaggcuaggguggcagugucguuaugcccuguuccucaggggcagcaugugcuccccaacuuuagcaggccucacagaccagcccucaucccaaacccagcacacauacucagaccuugaauggugcccagcacuuggaagcugagggaaccaaacaccagguagccccugucaaguuucuccagccucagucuggguccuucaccuucaacuguuaaauacucacuggccugaaaguaucuuggcuauguacuuccaccugugguuuccggccuaucgggaaagcagcagacagcauuaguaaggaagagaauuaccgcugaagaccacuaaagccuaaauguucuuucuaaucccgccugcugcccgggagaccauuuuaccaccucuaaguacaugggacagccacugacugugacaaauccuauuuugagcagacuuuccacauuaaaaagcacaaagguuaaagaugguuucgagauauauugccaucccaggcacauuuuaaaaacucaagagucaaauaccaaagcaggagagauuguuuaccacauuuagguuuaugcauggucuucccagucacucaggcugcccugcccugcccccacaacucccccuucucccccccacacacagcugggugggaauucacugaccuaauaucauuggacagauaauuccuugccuuggggaaagacuggcaaagcccauggcaucugccguuuccaaucuaugcuugggaacacuaacuaggagcuugugccaagaagggaggaggagggguaaguagcacaaaugccugcgacaguggcuguaugugaaaacuuaaaaaaaaaaagaaaaaagaaaaaaaauuccgcccccagccuuguggggagucacugcuuugcaguaggaaagcccggcauuugauucgucuaaaucaucuccaagccugcguuagagaaaauaauugaauuaaagaguugccauaacucauucaacugagauaaaacccagccagugggaagcaagagggccacgcaaaggcauaucugcaaagauucaccaucuucucgagauaguaaaggggguggggggagcaauauaauaugguucaaaggacagaugggacuuuccuaauuguccccagauuccuaacagcaggggugguaacuaagcgguuucaauuaaaaguuaaagaaacaggggaagcaggcaguuaaguuaugccugcugccgauaaggcucuccccagucugagggaugcggcauccugacuucagacagccaagugucaauggcacaugagcggcgaagccaucccaacaugucaccaugacaaggugauaaauaaaucugucugucaaaggcacugccaugagcagucaugugaguaagaagccaggcaccaggcaggagggcggcaaugucagaggcaaggccucuguguaagugugccuuccucccucauagggcccugccucugccaaugccucugccucugccucugccucugccucugccucugccauggaggcucaaagaagggagugugggggcucugggacagucagagaggauacagcacugcuccacccuguggaaggccgaaagcugacugcugggccacaaaggggcuccacuguggaguggacugcaagaagcuuaagcagaauaggaaaaugggcccacaauacauuccuuaaaccacgguugcuugagcgagagcuuguccuacucagggaaccuaaggcagugucuauaaaugacugucugccugcuuggagacucccaugcuugaacaguguccacaacaggcucauaaugacauccuaucugccccaaaaugucagucagugaggccaaagucgagaaagguuaccuuaaaagaaucaugaaauuucuaaggaaccagaaacuagaagcuagauggugcugauuacagccaaguuaauuuuccaccgaugugggauaccagagacuugcuaccuugaaggcaccugaugaaagggggcacauggcaggaacauugggucauccucugcuacaucaugaauuugggaccagccugggauacaugagacccugucucaaaagaaaaaaaaaaaugaaggaggaagaagagggagaaccaacagcuucaggcacacaugcugugacugaagccuacacaggcacaaacacgcacauacacaauuauuaaagaaaauaugucuucccgaugagaccaaaccauguuugguccacgagcccaauauagaccaaucacuagcagacaagcuagauauuuaaauucauggcuaacaacagccaaucaagucuaaaaguaaguucucugugcucagaagagagguggcggguggccugcggucacugacagguugaguuacagagacgggcuccucuugacagauucuugcauaagacagucaaucucacauguguagagacugagaaaagggcagacgaagguaggaaauaccaacaucaccgcagcaagaaggcaagaagcacguccuggauacuuguuuagugaaauuaacuagcgguuuaaugcacgcaugcaugaggaugggggggggguugucugauauucaagagugccccgauuucuucagagaaauuaacauuucaauccuguuuuuaucuagaagucauuaaacugugcaacaugaauuauuggaaguguagcggcgaauuaacucuauucaucagcgaaguccaaacacuuuagagcgcaucgguaaugaaaaaauagcuccgcauccuaucucuucucauuaaaggaaaccaguuuugccucucucaguauauaaagcugucuucuccuccuguaauuuauaucaccguaagccgguucacauucuaaacuauuacacgucuccaauuaauuuuugcagcuuuugccugaaaauuuaaugagauaguagugugugaaccugcugacucccugauuaugugugugcuccugguuuucauguucauguaauaaaauaaucugaucuggacagaaggagaaagcaucuccccuggccagagugcuggagguaauguguaaagcaggggccccacacuugacuuauuuacauccaauuauaaaauuuacuggccucaaaauaaacuggcccuacuuaucagccuaggagaacagccuaaggccugguggaguuaucaccugagaccauuucuggcuuauaagugaacaguaaggacgaguaacuguuuguccaagagucaaguucucuguggugcacgaaagcaaaaugcauggcgccuucucacauccagccccagaggcugcaagaggcaaaagugggcuaaacaccagaaacaagaacuacucuguccagccucagggagucugcagcuacacacaccacuggcaaacagcauccagugcacacguggcuauguacaagugugucaggguguacacauauccaugcauguucugugauauugagcauguacauguguauacacguagguugcgccaucucugccugcauaagcaagcaugcccacccauacguuuggguaugccugagccugugcaucggugggcacaggagcaugcagccaugugaguuugugucuaaguguuugcgcaugagugcaucucaaugugccuucgggagucagacagaaaauaacaggucaaacacuggagcuccaaucucggucaaggcucucuuguuacugccuuuugccaaaagaucuagaugcaaagaaagagccccccaaaagccgacaauaauagcuugcagucacuguucauaaaggaccuaccauguugucucuuuauuuuuaaguuaagucugugugauguacaugugugggcaugcaacuuugugugugcaugcagcagaggccagaguaggauacuggauaucuuccuauauuguucccuaguguguguguguguguguagauagauuagauauagauauacagagagacagacagacaggcaggcagacucucccauugaaccagcucaccauuuuggcuaggucagcuggccuucagacucuagagaaccuuccaucucugcccuccacugcuaccccaguuucucacaagagugcugagaguucuaacucagguccuccugcuugcacucucuucucucuuuuaaacagagcccaaacuccacacacaaagggaagugcacugccagaaauccuacuguuaugaaccagaguguugcuguugaguguucuggggaaaaguugcugggccuuggggaaccaggaggccauuuccuccuguguugcucaugugugugaugucagugcccccucacuggucacacugcucagccugugugacugugguuguggccucugcugugccugcuuguugccaggaccuaggggaaaaagaggacagaauucuggaaagaugcccagaauaauccugggguuaaagauagauggcaaauagacagacagacagacagacagacggcaugccaaucuaagcugcccucuuauggugguccauccgaggcucuggcaguagcggguaaauccaaagcuucuccuagcuuggugucaccccuacccggcuggauguguaaagaaaaguucuacaccagacaguaagagccacaagccaaaaagccacgagcagagagccagcugggaaauguggggaaccuuagaggcaaaguagaaaaggccauccaggaacuuguggcccucagccuccaaucccggauuauauucaaaguccaucagugagaaguagaagaucgaggagugguucaaaucccaccucuacuccugccauccaccaugaagucagcaugucuguucacucacgggaacgcaugggcuaugaucccaggcuuacagacugcagcacauacacaggccuugugugcaucuagcucagaaaacucacagcuaacguuuaagagccagugguugaaccacucuagcccuucaaaaaaaaaaauuguuuuuguuuuuuuuuguuuuuaauucucccucacacuuggcuuuccuggcuaagaaagguauuaaaaacccaacaucucaccuuccuuggaaaguacauaccaaggacaagcugacugagcagcuaugcaccagccacugucuccacccugcccuguacccacagaggaagaaaaugcuccuuugccuccaaggaaggccaagccuagaugccuagagggccuaucaauggguuuguacuaaacaagaaagagccccugagcugccaaagcuccuggcucagcaguaccguaaggaaggagcauuucccaaauagcaggagcaucccuaggacggcauggguccauagucacucugucugagccucagcugcagccgggcugaccuggguaguuguccaggcucuucuuuggaaccaacauaacccauccuaucuggccagaggccucuucaaaacacaaauucacauggugacaggcccaggucaagcaaguuugacaggaccgagcccugggaagccagggcaggccuccccacgaucaugugaacaaaucaaaucucugccugcugaugaacagaggcuaucaacuguguguuacugacacacacagaugucuguuucuaaaauccccaaauagaccaauuagcauauuauaaagaauuuacuuccauuuucccuugacagaucauaaaagccaaaacacaaugcucaguuugaaacugacaaguguauauagcaggagagucgggauuagcagcagacagccgcaaaagaaaacgguauuuauaaugauuagacaccuaauuaauucuaagaguagaaugucaaaagcuauacaugcaugucuuugguuaccgaggcucaacaucaaacaagucacuuguacugugugaagggagccuuaacacguucccuaacauuugccuggaggcugcugcacuggcuuuucagguaagcuacuggggaugugcauaaaaaaggaagggaagggauggggagguacccuaguaaguaagaagcuagugagguguucugguugccuugcaaagccagaggaccagaauuugagucccccaaaccacguggaaacagaagggcaugguggcaugugucuguaauccuagcacuggggaggcagagacaagauccacgcacgggccugcugaccagccagccaagccuacaugggaaguuccagagugagacucucucaaaaacagaagaggguggauaguggcgaggaucguccuuuggcacacacacaagcauguguccgugccugcacaaacauguaugagcauacacacaccgagagacaguguguguguguguguguguguguguguguguguguguguguaggguaaagggccaguaacacauaaaauccagcguaucagauuuuaaaauuaaacuaagcuuaaauagacagacuauguaaauauuaacagaguucuaggauguguguccauccccuacuguggcaauuaacucaguguaaaagaagaaauucucaggcuccugucaugugagaaaauccaaagccuuuuguguuucuucaacuugacugugggugggggagggggaaggacagcggauaaugcuaagacagacaaagguauaauaacauuauuauucucugaaacuuuagcucucuccuuuacuugccuguuucgacaugacccuuuggcagagguggggggaggagagcgcaagaguaagaugugaacccaaaauuaaguuaauagaugcagacuugucccgaugcauucuuccagaauucucuuccuagauugcaaaucaaaaucugcauuuaaauagaauuuuuuuaauguagaaaagaggaagcccuagggcacaagguauuucauucaauaccuauggguacaacaucgcauucaaaaugagaugcggcauuuucaaaguuacugaauagauuacacacuccagauugucuaguuauuacuguuuuuacuaaauucuucucuuaauaaguacguuucuuuuacggccagggcuguuaauaaaaguaacucaguauuacaucauucuaucaauuuaaucuugagaaaagauugcacgaucccagaucucaaaagcugugggcucugauaauucuagccauuauucagcgugaaauucaaacagucugaauucauuaacguucguuguuacaaaucugcauuuuuagacuuugccauaaaacgcaggaguccaaacccagugaccugaaucuaacagccuuucaugucuaguggugggugcucaccagcauuucccccaauucucucagauaaagccccaucauguccucauccucucccaggcuggggagagauggaggcugcaagagaccucacucaggcccugcuaacuaugaguugaagguauuccccucccguaggucaaauguuggacgcuugauccuaaauucagaugaggucauguauuuggagauguagccuuugagaaauaaacaaaaaaaucagggaaagcuacgagggugguacccugcggcaguuugacuagcucugugcccuaaccaccuugugagaggcucucucucacccuauggcacacaaggcagcccucuaaugacuguguuuccagaguccuuggcucugagcagauugaaaauaauuguuuuucuucauaagucaacagucuuuaguauacagauagaaguuucaggcaaauuguggggucucaagccaucaagagggacacgaaggaugcacacuguuagcagguguucacucuacugcaugcacccaucauaggagcaggcggcugacgcaucgcaucaugguaccagcauauccuccacaaaagugggcaagaauuagacuugaacccggagacaucccaaaccugccauggcugggugaagaccacuaggcugcugcaaaggaaggacgcaucccauccccuaauucucacaaagaaaacaaucauucuauauucuuuguugccuaccaaguuuucauuauuauugaccacaggugcuggcacccugggcagcuuugucuccagauggagcagccccuccuaugcugaacucauggcccugcagguccuguggcugcuacaggugaugacagugaggagaggauuucccuaacuguaccaggugcuaagaccucuucaguucacuuccaugaaaucccaacugcauaagauuaacuacuacuguuaacuccauuugauagugugggaacugcaucucaggaaauuaggcucagaaaugccuacuuuucccaaggcaauugucaucgaaagaagucaauguccagcugucuagaguuucuuggccacgguaucaggacucugccccucuacccucaccaagaccuuggaauuuuuaccuucccuugcaaacacaagacagagcagccaaagucccuggggcugcuggagaaagacugcucgggugcaauuccacaaagcacccgagcuguuuccuggccaagucugaugcugcgucaaucugcucuguuuaaacagaaggcuugcuggcuugaaucagucccauaagcccaggggagaccaaggcacaaaucaauauggauauuccuuccuaggggaagcugcagcccggcacugcggcuuagaggucauccucggcuguaauuagggagaggcaguggguagcaauucaaucauggaaagccccaguaccguguacucauccaagugaagguuucaaaaaaaaaaaugugggacugggcugucaguuacacacaggaaacacaagcuuccaggccucugauggugacaacacaggcagcugccgccccugaaggagucucauaaccauccggguaucacucuccagggcuuagggaugcagagagccacuuaaagggcugugcugucuucauggucacuacuuggaucuaguccaagcagaacccuaacaccccucaucuaugagguagcacagcauccccaggacaggagagcauaggcagguuuuccacacagggcucagacuuccugacucaaucuacaaguaggaaggcaggucaugccucuacuuucuggcgguggaaaguacaguuuaaacgcaauucccuuuuggauagucucaguuaguuuugcucaccuucuagaagaaucagaagggacaucacgagacuaucagaagagaugugaccauagugaccacuggagacaauaggccaucucccugcauucagagaacuuuggugauacaagcaugugggaaggguaggggugccucagcagugaccauccaaguaauguuuccaagaaggccaagcuaugggcugccaacacugcuggacacaaauggccacagucuccacgagaugagacuccauuccucuccaaugagucccgucuaaguuuacuaccaagucccuggguuauggaaauggauugugucuuaacaguuaacacugugacuagugcuugagaaaagaacaaaucugggcuggugagauggcucaguggguaagagcacccgacugcucuuccaaagguccagaguucaaaucccagcaaccacaugguggcucacaaccaucuguaacaagaucugacucccucuucuggugugucugaagacagcuacaguguacuuacauauaauaaauaaauaaaucuuuaaaaaaaaaaaaaaaaaaaaaagaaaagaacaaaucuaacuuggacgcugggauccuucuccagggaaacccacuuguccccauggccugaucaaucaucaacaugcuucugauucguucccugagaacugcaggggcccuggcccagggcgacgcagguucccucugaauucaauagugugugugugugugugugugugugugugugugugugugugagcuaugaaagacuccccaagagcugugcagguucaaggcaaacagggaacaccagcgaagucuuuuucaaacccauccauacacagcacaauggcauuuggagaaagcuggucuuucucagaacacauccgaugagaagcucacagacaaggaagccagaaccaagcccagacagcaggauggaaaggacccuuugaggcugccaccgcugacaguaaaugcaucuauggaaaaugggaauuagaaaccacuaucaggugcucugacuggcucuccagcugcaguuuuugaucaacuguuuguuuuuuguuuuuagagacagggugucacuguaaagcccuggcuuucuuggaacucccucuuuagcccagauccaccuaccuggggugcugggauuaagggugugugccaccgaccaccugguguuuuuuuuuuccuuuaaauccuugcccaucuugcccauuagcaauuuuguaugcaauguauguauguauacacauguguguguguguguagguguaugacugauuaauuuuaacagcucugcgacuuaacccuacauguuguugcuauuucaauaguccacagcagagaaaccugauuugucugcuccucaugcuaaaagaaaacagccauguuaaauauguguaaugucacuauuaaggccacuucucagagaaaguccagagacaugucccacuuccuuucaugaauggucacucacacaagacauucucauggacuaccgcaccccgaaagggcaaauuacacagcauuuucuuuuuaaagccugcuauuuauccuuagcugguauaagucuaggggaauuaucuuaauugcuauguggaaagaaugaauugcaaaaugcauuuaguuagcaggaagacuuuauuuguaagcagcuuggggccaggugggagucuugaaguuugccaaaaauaaacgagucaaucaauaaagaaaguaagugugcuagacugggguuaagcagaugccaaaggggaggauggagccacggcccaacagcauccuccugucagacccagacaaauuauuaggcuaagcccaggucgaagaggacgugggauuccugguagcucuuggagcacugcuuuggaaaaugcacuugacucucugcucuuuaagcaaagagaaaacagggaccugaaccaguuuuuuuuaaaaaaacaaacaaacaaacaaaaaacaacaaaacucuaccaucucuugggcuaccugaagcuagagccacuguaaagaucucauuagcauuuauaguuauacuccaaguucaaguuuaagcccuacuguucucuaagccgggcauguccaagcacaucauggaggagguccugccuugaaaaucaacucagagugauuuaaccugaggccguauuaaaaaauaaaacccacagaggcuggagagauggcuuuguaguuaagagcacauuuggcccaacaccuauguuagguggcucaggaacgccuguaacuccaucuccaggaacucccacuuucucuucuggcuuucguaggcacuacauacauauacaaacccacacuugacacauacacacacacauacacaaaauuaaaaagaaaaacuguuaaaggagauguuacuuguugucgcauuuguuuauuuauuuguuuguuuguuuauuguuuugucuuguuuucaagacagaguuuuucuauauagcccuggcuguccuggaacucacucuguagaccaggcuguccucgaacucagaaauccaccugucucugccucccgagugcugggauuaaaggcgugugccaccacugccuggcgucuugugcauuuauaaacagucacaaggccaguagcaaugguaacacuuagaugauaaacaguucacagaaaaaacccccguucugcuccaaaaaucccaugugagauaccccauuugaaauugagcucaauuuuuuaacaagaaagcucauuccccugccuccuuacucaucuauagccccaaacuugacaacaaacaaaauaccauuucuucccaauaaaucugauccucucgaaauacccuucuccuuucuacucucugggaugcaaucuccagccucaggcaaagggcagugaggggucacugauacuugcaucuaauauccccaccagaaugcaucugugguuccuacacccacaggggagaccucagagagaccauaagccuucuugccuggcuugcucaagucuccaugcagcuggcuacagagggagagaggacguugaguccacccaaagccauccgugaggaagcagccugaggcuagccuccauucccugagaaccaugugcugcuggucucucauaagcuuaggcaugaccuagugccauuauacacuugagaaaaccuuucggaagaucaaagucccuagaauguccucccugauuacaaaaucucccuaacacuggcaaagcugaucaagccacuuugaacggaaccggguuugggaugauaccaccauaucucaacccaagaucugcagaaagcuccacgugcaaacgaguggaacaaagaauugagcucuucacuggucccaaggucuacagauuaggaggcauauacgcccaauucuacccugaagucuccacauacagaucggcacaccagagggucucaguucuggccauuagaaucuugagcaaagagauggcuaucucacuaucuaccaguguccaaauuguguauguccauaaagaagacaggugacugugggcucaugggcuaugcuaaauaaagccugccacggagucaucuuugagagggcccugcagcaggaaucacaugcuagcagagaaccuuggaaaacagaauucugccccacgugugacaaagugaaaauuuauuuccucuuugaccuugaauaaacccaacuggauggagcaggaggccaagagaacugguuaacacuugagacaaccaaacccaccaggaggugcagggagcccuggagcgcuagagagccugcagcuuaggcccaugcaggaagugacacuuggacucucucaggaggaagaagugugguuuucccuaacacuucccauuuauucuugggaguggcuaugaugggcuugguuuccaagggggaaaucaaguaaaacaggaagcagggcuccagcugcagucccauucacaaccagggaguucacuccuuugguccagcacacccauuuucacacccaacuccuugcuccuuacagacauuucccuucuggcuuuugguuucccacugugacagccugaccuaacaaccuacagcaggaucacacgcccuucaguagccacugagucauuuacuggagcuagcaacuaccacugaggacccugaaaaccgucacauugacaccuuagccccguuugggcauuuguuucuaauaaggcaagacuugucuguucuuuucuguuuuuuucaugaaagaaagauuaacuuccggccagaaacagauuggaagcccauugacuagaguggugaccuuacuugaugccauuggacggcugauacccagcucaggucagccuggccugguucauaagucccuuuuccacuacaccgagagaccagcaauggcacuguuaacucuaaaggccccacgcagggguccaaaucuauacugugaucaugaucugucaaaauacaggguaugggguuggagaaggggcuuagugauuacgagcacuuugagcuauugcagaggcucaugguuugguuuccagcccacauauaacaagucacaaccaucuguaacucuaguuccaguggaccagauguccucuucaggccucugaggugaccaggcaaacacccguaaauauaaaauauuaaagauaaauaaaagcagugugcauaagcagccggcuccagguccucagccaccaggauacugauacugcuuuauguaaaaacagcuaugggcucuaaugugacuuccauccuuuuuacagauauuuacaaaauggauccuuucccaaaccccaagaguguaucauccauuaaaauagaccaagugucccucugaggaacugcucuccagccaaggagcaaccuggcccagguaagggugaguguccauuugugguggguacuuccaguuccuagaaggaacuugaacaccacaguccaccaugauaagacaucaugccaggaacccggagguggcaacugaagcagaggcuuacuggcuugcucaucaugguuuggucggccugcuuucuuauuaugcccaacacagagaugcuaccauagugagcugagcccuuccucaccaaucacuaauucaauaaaaugucccucaggauugcccuuuccaaacaagucuagcuuguagaagcaggcauaacaguagccagagcugagccuauugggcuuuccucauaggucccccaaagaagguucgugggugcucuuaaguccauuauccuuccugcugcuaagacugguaauugucuaaagaccaccaagcacuccuguguuaaccaaugugagugccuguucauuuuauuaaagaaugucugggaaagguagaccaaaucuuuaagagggcaugcagggcagagguggggcacugcagccaaccuacccucuuccuuccuccaugcacgccaaagggauaguauuugcugacaggcacaaagcuggagcaacaucugugagccuaggacggggcuagcugcacugaucuugccccaugaagaagaaagggaugaaagcaacccucuuucaaucuguaacacuguaaccucccucuagcauucuguucgcacuugagacuuaucuuaguccccugugggucaccaguuguugcucccagaagaugagaaagcuggguuagaggccacaaugccagcugugacugucuugaccauagcuugaaccucuaaacuacugagcuacacucaagauugauggccuuuuuuugaauggcgcuguuaguuccgggggaaauaccuuuuuauuuuuaaagcaaggguuggagggggagggggugucaaucauaucaaugaaguugacuuuugagcaagaccccccuuuuuugugcacgauggcuaaaagcacauugagaggaaacuaaaaaccaagccucaaugcuggugcaggacugaacuacgcccgaucaauauucucucugccacaucccuccuccacuacaccccaguccccaucgacucucaggggaaaaaaaaaaagucauuagaugcacaagacauccccaaggcuggaacuccaaaagcauaagccaugccaugccggccgccauugccagccggccacgacccuuuaacgccguccaucucccaucuuacaaaguaacuggauggcaagaaaccaucucccuaauucauuuuuauucucuuuaauuaauacguccaaaaguccuaccauccuagaguuuccuuguaagauaauuuccgcugacuuaucuccagagcagcagcagcagcagcagcagcagcagggaucucuugccacuggacuguauugcuucagaguuaauuacauguauuuugcuuuugauaaaugaaaauaccagaugcaauuaauugaaagacaaucaauaugcuccugccaugagacaucccgaggaagcauccagaggcugccagcgauccauagucaucugcuaauugaaaacaccuuccaaaggggauuuuagaaaacaacuuuuaccuggagauauuuuacaguaacucaccgauagaaaugcguccacaaacucuacagcucacgcgaugggcuguccgucuuuuucaggaggugcagcuuugucggcuugcaaccauuuacagugaugaagcccugcaaaugcaauggauggagucagcgaggaaacagcccugaucuguuuacauccagccauucuuuaauugcauuuucccaaugccuucaacucaaagcuaccaggguuauuaaaugguuucauuaaaaauacuauuugucuugcuguagccgcagagcugaucaaauuaaacaguagagcaccagaacaaauggacccuuuccauccacucugacacaaagccaagagugcagaaccagaaaggugguagugucaucggcaugaaaauaucacuuggcuuccuuuacagggccacauagcacgccaaggaaccaaacaaucaauaccuccaagcaaaaaguguuagcaaguguucuaagagauacagaauuauaaagugcauuucauaagcuccugguuuauaagugcuauuagcauaaaugcugacaacugcuaaucuacuggaacucugaugaacggcugccgcuguccauuaauagaaggcauuuuaacucacuacugaaauugauuacccaguuaagaauucaauccuaacguucaauaaaaucgcacuuuucuuggcaaaugcaauaugaagcuagguauugcauuaaacagcacucacauucauuuuacccagguagagcagggggaaauacaugguagcaucgcaggcaccugaccugcuugcugcucaagcaggcagagcagcagcaggggcaggguacugaagccaguccuguggaugagaggaaaaagccaacaucuggccuggaagaauggccaggugucuuucucuguggcuuuuccaugaagauggaauuccaccaguggggguugcuaugcaacuacagugcucacacacggaaaacacccuccugcuagaaaggggaaagccacacuuuacagacaugaacccuugccgacaaucuuaaccugucugcccucuccccgcaaacucaccaguuaaccuggucaguaucaccacaaauaaaaaaaaccaccacacucuaacaaaagccauaaagucacuaacgagccccucagccagccaugaugucccccaccauaacaaugcgggggucaggaagggacugucuaccucagggaugcuaggguaaaggcaugcagcaagaugcucaguccuauccacuccuagcaucugaagaugcucuaggucgcuaacaaagcauuccucauuuaaaacaaggaggccgggcuaacaggcaaagaagcaguucacugcccacuguaucaccacuaucuuacaaaccaagcacccaguaucccaaguaugguaggauaauguagucauucuagucucuugagugucaggaacagaaggacaugcacagcuuugaaaggucuagagccuccauccaaaggaccauccuccuccugcgguggcagcacuaguuaccuacaccucgcucuccuccuauacucguggguuaucuccucuaacaccuucccuccucuuuagucaguguucaagauucuuuagucucugagcacaggaggggaucaaguauuaaugaucaaaacagcucaucuccguguaguauggcuuguccugccuggugugccagagaaacucuucccauuuucaauuauucgcuugguagaauacaaaauguuuacgucucugucucucucauacacacacacuauauauguaaacgugugugugcgcgugcgugugugugaauuuccagguguaaugguaaacaaacacuuuuaaucccagccagcauuuaggauacugaggcagguagaucucugauacagcauaagacugucucaaaaagaaaaaagaaagaaagaaagaaacuccugaagcauaaagaaauaacauagccacuugacaaaacuggcccucucagaaguggaugaaguaugaucagucuaguguuucucaaucaagagccagaucggaggaaaagagaaacacucuuccccugccuggucuuaguagguguggcacaggcugucuaguugacagcccauacauacauagugaggagggaacacaauugcaccuccaagagggcuucacggagguggccauccauaccugguggaauuucaagcuggagauucgacagagccuguagccuucagccugagccuaggaugccagcuuauuuaguggauuaaaaacauuaaaaggcuuggaagacugucagaaccuuucaggcagguacccacuguuacuagaggguuggaagaagcacuuacaaaaagaguggagcuacagagcaccuaugaauucacacacuugucucagcagauacuugcugacagugcagccuugaguggugcccugaggauguaccaggggaaauugucuuggcagguuucucuaagaacuuccaggaguauacagccagacacagaaaugacuuagccgauuaagaucaccgccguuccuaaagcaggaaccacaggauccuaagcagccucaguacaggcuugccuggcaaccuuuccugccucagcaagggaggggcagccaggcccacuaacccucaccuuuccccucuuccacucggggucagagauagcgcacugagcugcagacaugaacggaacaguaggcgccauggggauucgcaccagcccaguaagcagaaagcgauggaugugcaggcacguggggacuaagaaucagacaggacauccagaaauaagugggguucaagggccagcagcugaaggggugcaaucucuuccacugagcucaacuuucugggccccggggcgauccagguccuggggcaucauggcuccugaaucaccacuuugaguaucaugugccuggucuaaguacaagccuacuccaggaaggccugaccuaucgggcaugaagcaauguguuuggguuguuccacggggaaaagcaauuuauacaaccauccacugcagggcagaauuaagcagccccuaucagacacacagagcaugcaccagcauggugccaucugggcaggucugggaugcugucacuuuugagcaggcagguucucaauucuauuaaccacugccuuuauaauaaauaagccacauuaacuaacuuggaaacaauuuccuucauggaggaugaaaaugauccuguaaacuaauucuucugguguccuucauagcaagguggguaucaccacacuugaggacaaccuauccuuaccugggaggcucaagagugccaauggcaaggaagaaagcauccuuugggcaggacuuuacauauccagguuuuguggaauucagcaaacugaggaacaggaaacauguccggcuggcuuuagguuguaagaaugugaaaagccucaaugucuaucuguagcuuggggaacucgugucuucaaauaggacaaccagugacaacuguaagcaagccuuggaagccccauacguuaggacaguaaaauagacagugucccagcgcggauacagacauagccauucaagugcccaagccuuggcugggucuccacagacuacuaggugacaggaagcacaguccugggagacuugaggggacauugggugacaagagcaucccuaccucacuggcuccuagaaggagggggaggggaaaggggauggcauagcagguggggagucuuggcagucacuggaaacaaggaaugccccuugauuaucgggaucugcuaagcaaagcugcuugaggccaaguuggaaugaaaaguuggacccaugaacaucaacaacccacacaccgaugucauuuugugaccucaacaugagucaccacacccaaaccugcccagcuagccaggaaagagaaggcagcugcugugaucagccugaccacgggcuccccaggauggggugugaggcagugucuauaggaacuugaaggacuacagacuaaccaucuucucuuaaaacagggacaugaggaaugccugucagcagaucaggagucccugaaauccaaccuagcucaaagaugucugaccgccaaaaucuucagccaaaacucacuagggcaccuuucaaccucugcccaaacaucaccuaacggagucucaccucgggcccagcaucccaaacaguacccaggucaaaaugaccacugaggaccacgcuacuguuugagagauucgggaacaggcagggaagaaguagauacaagaggaagcccagguugaacuagcaccagcuaggcaucccucuccccaugacagugagaugcucccugagagccuaagcaccaggcagcuaccaauacucagcugaacaaaggacaaggggcauugaguggaguccagagagguguggccagacauuugggacacagacugucacuauaacaagauagaaccuagacacuucagguuccaucuucagcguaaggcugaaggucagggggaggcaugaugggagcaugaagaaucuacagggcagaguucucacagagccacuggaggaagcauugaucaucuagcucuaggagccuucuuugaaacuuuggcuagcaagauggcucaguggguaacuccgaagguccugaguucaaaucccagcaaccacaugguggcucacaaccaccuguaaugagguccgacgcccucuucuggugcaucagaagacagcuacaguguacuuauauaauaauaauaaauaaaucucugggacggagcaaggagcaagaagggacugagugaacagggcugacuggagcaagcagagguccuaaaauuuaauucccaacaaccacaugaaggcucacaaccaucuguacagcuacaguguacucacauacaucaaauaaauaaaucuuuaaaaaaaagaaaaaucaacuuuggcauauuuucccuagucugagacaaguggucaauauuuacagaaaaguaaaaagucacuacgugagagguuugguaacauuaggaauauuguguuaccuauauauaccauauauuaugugagaggccauacauauaguuuggugugaugagagauacagauuucaagcauuccaaaauauguaaaaauauaagaauaucuauaggucaaaugggaaaugaaauauaaaacauaugcagauuuuuuauuuaaaaauauucucuagugaaugaauuuaaucuuaauauauacauauaugcaugagacaaaaaaaaaguguuaucucuucaugcuacaguugaaagugauucccuaaaauauauaauggaacaguuauuuguucgcuuucuucccacugcccuguauguggccauguucugcucggagcauguguuuccugacaucaagaaaacacugcaaguucccaggacaacggggacagagcugaagcuggggacagaagcagggugcucccuaggcuacuucugucugguuuuccagccacccagacccugacuuggggcgugaguccuuaaaauagcuacaguacaaguagguauaugaaaguggaguguccuucagaguucaagcuacuacaaaaugauaccuguccccuccagggaaucccaauucagaagucagaauuaaaguggccaauuaucucugagacagggagagagagacagccuuggaacguugcauccaugaggacaguaauuuguaaaugcuaaaugguaucccccuucauacaauguggcaaggcauauaugucuuaaaaccagcuugagccagguauggugauacacuccugcaauccaaacacuugggaggcguagagagagggcuacagagaucgaaaaaaagaccagccugagcuaaacaaacagcaaguucagggguagccuuaacaauucauauauagggucucaaaaaucaaacaagcaagagggguggugguggcgcaugccuuuaaucccagcacucgggaggcagaggcaggcggauuucugaguucgaggcuagccuggucuacaaaugaguaccaggacagccugggcuauagagagaaacccugucucaaaacaaaaacaaaacaaaaaaaccaaacagcacucaaauauuuuauguggaauuaagguucccagaacuugcaguuuuuacaguucucgcugaaaugugucacagccagagggcuguggagcuucuacuugaaaaagcaggcccacacagacccugcuggacaugugcaucaagugaacaccccuugcuagucucaggacauaacugcugcuaacaauguugacaucuauuaguccuuuggacaggaucuguuucuuacuaguuacucugcucuacacaauacaaggaagaaaacugacaaagcuaugggcuuuucuuaaccaaaucauggugacacaagccccacugggcaccugagaaaugggacauggugugcagggcccuugaagauguccagguuuccuuagacugauagcaugcacgcaaggcugcaugaaugccccacugaggaucaucuugaugccuacauccagccaauguuacuuacuguuacugauggggagagagaagagggaggaagucauuugacaucucacugcaucuauuacuucugcuacaucucuaugugcaucuagcaagauaagagguuggagaagugguucaguggguaaaaaaaaaaaaaaaaagcugccucccauauguaaggaccuaaguuuccauucccagaagccaaguaaauaaagucagagagguaacaugaaggguaaucccacuucucugaugguucaaaugagaggcagacacaggagaaaaggccggguccuguuggcaagaacaggcacuggucucgggucccugccuucuggcaccuagcccauaagaacacaccgcucccugaacucugaccuuccacuggagcccguaguucuaagaaauucugucuggcuuguuuucuuccagaugcuacaaucccaguuauccccaagccacaucugacagaaggcuucugaucuggggccuagggugagagagaaaaaaaaaaagagcccuggggcagcugggaaagugggcagcuugggaucagaacucccugauccagccugggugaaucgaaacuacagacagcaggcuggaaacaggcuacaacggucccagccaccauguguauacacacugggcuggcuggcuuccaaugcccagcucacucaaaaacaguucuggaacuggaguguuccaacagaucgccagggucggccgagcugccuggcccagagcagacccacgguuaugccccuguuccucaggaagcucugggacccagucgguggccugccucagccucugugccagccuuuuacaucaggcaaaaggucuuuuccuagcacugggucuguccucccacacccucccuuuuaaggaguggagugcuggcucugcggcuagcacucacaguaacucccugcugauucaaagacuccaaaagaagaaaauuacaggagcguccuugcuauuuccgccuucauugucuccgggcuugcacuuuucucaauucaccccagaguuuauccuuacuaucaccaggcaacaaucaugaaaaaauaccucuccccccaaaaugcucagugacguacagugugcgggugaaaaaaaagauuucaaugcuaauacugcucccccaccccuagauuuuuaugaaaccuuaaauggccguuuucuugaagaagugagccauuuucaaacaccagcaucacuuggcuccaaagcugcuucucguggggggggggggggggaagggaccacccaugaaucuuccacaugaauaaaaauuacauucuacauaaauuaaauauauaauuugauuaaacauguuuaugucuuugugaugacauuuaaaauagaaguaaucauuuucuuuuuuuuuaaacaagaaaaacucuuucaaauauaauucgaagcugucaaaccaaucuucugcuacagaucuuuuaaaugucacauaccuucaaaaggagauggcaguuuccuuuuaaauaugcaauuccaaacagugcgcucugaaucaagacuguauuaaaauacaccgcuggcauuuaucccgacuuaaguagcgcccuuucccccucucucugaguggaugggcuucuaugguagaugugcuuggaagccccgcagaggugucccuccccaggacagcucucucgguucggggaagagccaguaagugcgacagcaguugacugcacaccacagggcuggacaccaaacccacuccucauaccuuaugagggcaaagguguccucugcugaaucuggcucaugcccaauccagaugccucacugaacucuguguaacccacuuuuggcauagcguugauggcccauuguaagacaguguuaaucaaaugcaagaaaaacucccagcucauucucauaagucaaugaccuacauauucaauugcuuauucaccaucccgguagcaaacacugcuauauuuaaacccagcacagcuauaucuuuuuucucuaaaaugcuuagagacaaauaauccuuaugucccagccuucuuccucuugucggcaucaagcguuuggggaacucaaaagagcccacuguuccaucucucuaaccugggauaggaagagacauuuccauaaacagcaacagucccgcugcaacucuagcauagcaccuggcucacaguaagugcucaggggguaaaaacagaucagaugacuucaaguuaguuaaacacaggugacaagcaugucacauacaaagcgugcagcauauaucacagcaaggaccaacauccuaauuagcuugggccacaagagaggaaagggaaagauaagaguuuggcgauaaaaugaaagacuggugggaaccacgcaguucagccacucccaucccuuaguguuucauccaagcuuuaaggaagagcgugaauugagcaaccgaauguccaagaugacgugaacuauuggggcagaguaucugaaauaacacaaggaauccacccauucccccaccaagaggcagauagcugcagcacuaagguggagccaguaggacugggaaacuucaagacagccaaucauguagaggagugugaagggggcggagcacacuucucuguggugcucagguacagccaagggagaaugucacucaucaauccugaaugggaacuaagcacuuacaagcuccaagccaucaccacaggaucuggcugucaguaaguaguggcucaggggggagacugaggcaagacaagaggauugguauggacuacauaauaagacucaccuaaaacuacaaaaaguugugaaugaaggucaaagcaggagggagggcaaggaggcaggaaagagcaggagcaacuaccaccaaaauucuuacuacagcgauagccgauuccagucacugaggcuugaagaaauccagcgagagaguccaaggaccuguucucuuuagaauucuggcagauuuccuuuccaggguggcaaggcccucccggugcagaggacuagaacuugcuaacaccauucugaaaucuggcauuuggugcauccacaacugcacagagagcugaggaugagccgggaugcagggcagggcggggcagggcggggccaggcccaucaaccccauccucaagccucacccuucauacuucccuagaaaggaugcugcauucguuaccaccuccucucccagguaccagcauuccaauacugggccuugcucucagccccugggucagauguaucuaauauccacacauagcaaauaagcauaugcucuuaugcugguuugaccuuaccauggcaugcguggcgcacauucaauggaagcugcauuuggaaugcagaaaucugaccuuuuuccucaagccagcaaugcaugcuauaaccugcuguuaagacugggccgucgcaccaggccucaauucccucccagguagcaacagcucggacaccuagcucuuuggaacaaaauggaaacaucaacugaacuaguuauaguuuucaaauccuacuuggaaucaaaugacccuagacagggcuccucaccacaccccuuccuucaauacugugcuucuuuuuaaagaggucucagacaugagccaaaaauugcaaaaaaugcaaaccuagauaaguuccuggugacaaaggaccucacugccaccaucccgacauaagcccgguggcaaugcuagggggaguggcacagggaacaggugacauucauaucagaauauaucacagaauauauacaucagaauaccuccuuaguuuggagaccacaggccugagcacagccaccuagcauccagugguaaguccucaaggugguugguggaaggaggccacaaaucaguaagauggaauccauucaaggacauccugcaacucuacaaaaccgucccucagaaacuaacagccccauacagacccuccugcugccucaggcugcacuuuuugggagccuagcauuuugaugggaagaggcagcaggaaaaaaagagagagagagagagagcugaagaaccaaucauguugaguaagcagaaaggugagugcccucaccuagggacuccacaccucacuuccaacagaaaaagagugcaaaccaucuugauaagggcagaauccuggacuugauccccaaauccagccaagcagaaagccagaguucauuaaguggcuuacaaaacaccuguuuuuuuuuuuuuuuuucauuuguuuuuugagacaggguccugguaucauagcuuagccugugacuacauagugaucccaccuaccacggcauccaagcuacuauaauuacagacaugugccaccacauguuuuacaacuugaaaaggucuaucgauuaaagguaaaagagcuucaggcaaaaugaguauacacggugccaacauacaucauacuguguggugugguguguguguguguuacauauaacacacagaugaaguauuauauggaaaauucuagaauaaguaagacuuguugggggcggggggcggggggaucaacuauaccaaccaaccagccaaccaaacaaauaaacaaaauaccuauuggcugccugugguaaacauggaggugguaaaggacacgggccacaccacacaaggccagcaagaaacuuucuagauggaccuguuaaguucucuauuaucucgauaggguguacaugucagaauucaucaauggcacagugacagccaacauaggucauauggccgcucuuuuccagccaauccccauugcagcccagcaauacauccucuacaugacaugaugcugagauauucuaggugaagcugaggucugaaaggcagcccagugauguggccaagaccaaggaagagcagggagcagagggagagugcgcagugcuggcuggagaggcuccgauggcugaucugcgcucgcuguugacugacacucguagccaaagaucaaaccagaaucaagcugaucugcuaaggaaaucgcaguagcucauuagggaaaccuuccacuccaucaguucagggucugucuugggaaugaaccaccaaggaccgaacgaagccuuaggaccagcagcacuccaugaugaacagacagacccacggaccugugacuuuuaaagcuccugcucacauacugaagaccauacaaauucaggccaauaaagcucaagguuccuggccuggggagauggcacaaugaguauggcggccugccuagagucccagugcuggagagaugggaggcagagaugagauuccccaagacaacuggcuauccagcucaaucagcaagcucuuguagaaagcagcgacacacacucugcuucacccauguguacacacauacacacacuucacacacacacccauauauacauaauacauuaaaacaaacaaacaaacaaacaaacaacuuaugaucucaucccagagaaaggaucagaauacaaggguaacgacucccagguuuccccauggcuucgaggcucauuaaggccagcagcccacagggcauuugacucucucauuccaagccuugucaggguaguacagccuuuuuuuuuuuuuuuuggcucaacagcuugucaggucccuuuggaaggacacugcuaaacaacacaugauucuaacaaggcugccauuaaauaaagugggauuucucaaugcgaaguucccguuccagaguaggucacaggcagcuguacuuacaagccucucucaguacccaagaggcuuuuuaaaguauuaaguagagaaaaugcauguaacuucccaguuaaaauacagugcagacacucuaaaagguugaggcggcauccacuccauuuucauugccagauggcaggacacugcgauaaaagcacauacuucgauaaaagacucaacugcggugacccuugaugcaauacuagccaucgcucuugcaucagggaagauccugaaaccaccugguagaggauucucaguuuuggagggaugcauccugaaaucuuagggaagaaauuuagccuccuguccagaacggaaaaaaaaaaaaaaacaaccugauuucucuaacucacuugauuacaaacagauguguauuggaaucaggcucuuccacaggccgaagccaagccaacagacucuugggggaagcuagagggccugggaggcagagggagaugaccauccaugcaguguauguaguccagagauagcagggagcugggcaggagacugagacaggaggauuacaaacuuaguuguuguggcccuaucuucaaauagaagagcaaacuguguaguauaugagaagcuccagguucagucucuggcaccauaaaguaaaacuuagaccagaaugacuuuauaaaccacaagcgaggaaaaacagcugucaagauauggcguggauugauuuaauaaccacgauuacagagauguuaaaauguuaccaaccagugaaaucgaguacgcacugaaguaccuuacucuaaccaguaagguuagaaacacaggcaucuccacuucggauaaaaaaaaacccuggagcuccccaguauuagacuugucuaucacuccacuggcagaauggggaaggaguuucuggccagucucugaaccgguugccuggagcagguuaaguucuccacaauugccuucugccacacaaacuccaagcaaccaugccaagcuccgagucacauccagacucaccaagcacuucuguauagaagaauauucuaucaacucuuggagggggaaaaaaaaaagccacuaaaacaugacauucaagugagaauggauguucaaaaauaucaaaaauaagcuuccaaguuagaaaaccgcugaggguuauuuucacauucuaaugaauuuaguuucauaaacacaaaucaagcagacacucucaaaauucuaaugguaugguauaaaacaaaacagacaaacaaacaagaaacaaaaaacucuuauugccagaguauggaugccauugagaaaaauauguaaggaacgacucacugcaaagggucucccucguggucuguguucaugaacuuggcucugagcuggcuugccuugcugccuugcugccuugcugaagcagcaaggaguuugagauacaggacuaggggucaugcucucagucagcagagcauggggaaucuaucugaguucaaacccuggcacagacuuaaaaacaggugucuauccacgaucgugaugcugggggaaggggcacacaagggagggagauagggugaaucccaggguuguagcucaguuggugagcuccgaguucaauaagggacccucucucagagauuagauaucugauguguguuugcacacaaacaccggaguuugaggccuucuauccuuuuuuuuuucgagacaggguuucucuguguagcccuggcuguccuggcacucacuuuguagaccaggcuggccucgaacucagaaauccgccugccucugccucccgagugcugggauuaaaggcaugcgccaccacgcccgcucccacucaggcauuucaaucaggugucugguaagcacacagcaggugggggaggggggaccacacagagggcauccaccucauggggacuaucagcaucaaguguagacugcugggcagcaugaaaguguuuggaaagaaccuggagauguugaggcaaaaguagacccagacugcucaccuugcuguguggcuucaaucugugugucaagcccauccaucaaacagaaagcacccaaguucaaaucccagaguugaacaaacuaaucacaaguaugcaaaauuagcaggcuggaaacacaaaaccaggagcuagggaaacacguuggaaggccuguuccacucgcucugcagccuggugggauacagaaugggugguuaccuuaagcagaaccccuccaucugagaacaaaggcuuuuggucuggaaacuguaauuagaacucauccgaacgugacuguacaacugucuaucacuacaugagcacagacugaucuguuuagccuuuuaaagaacaaggcaccagggcuggugagauggcucaguggguaagagcacccgacugcucuuccgaagguccggaguucaaaucccagcaaccacaugguggcucacaaccaucuguaacaagaucugacucccucuucuggcgugucugcagacaacuacaguguacuuacauauaauaaauaaauaaaucuuuaaaaaaaaaaaaaaaaaaaaaacaaaaaaaaaaaacaaaaaagaacaaggcaccaagaagaaucucuccucuaagaagaauuccaaagcccaaccacuccccuaaaauacaaguacagcaucccuuauccaaccagggaaccuuggggacaaggaugccucaauuccugcagagcccacuguauggaaaucaauacccaaguaacuguccuggauggcaaacacucaccaccacguucaagacuagagcuuauuuggcaugaguaaaagucugguuccuaaaagaacauaaaggagaacugcauaucuagacuugcgagauggcucaacaauuaagagcaccaacugcucuuccagagauccugaguucaauucccagcaaccauaugguggcucacaaccaccuguaaugagaucugaugcccucuucuggugugucugaagaaagcaaugguguacucauacacauaaaauaaacaaauaaauauuuuuuaaaaaagacugucccaaggacuagauuaagugcuaugcugaaggaaccaucaauaaccaucauaaucccgaaccuuuccagcucauaggcucuaaaugccugugcaaagaguuuacaguagauucagauggaaacuugggcuagcuuaagcccaucuugacccuugacauacucagaggugauccaacccaacuggaggaccauucccugccuccaccccuccccugaccccaccaccaccacccaacccgcuaggaagacuggcagucaagguugacuagaucuuccaccuauaggacauucugaggaacagcuuucugacacaugaguaagcacaauguucccagcaugagagucugcagguuuucagugucaggaaccaaucaacucaccucacccuccaggcuuccaaaccccagagaacaacacaucaugggccuccuccagccuuuguaggccaaggaugaguuccugggaaaaguugccccuuuucuacaaaaauacacaugaccuuucccacccuuaucccuuuuggcuugugccucacccccuccucacagguuggaacacuggagguccccaaggugcccagcccgagucccaacuaaacuaguugcuguuuccuaggcaacagcugcuuucucucuccagauacccagggaucugcgggaagaucauuccugccccuacaucugcugcuucacaauggcaagagagaggcugguucacuuuaagauucauggaugcuggcuggaccaacagcaaucucacagcaaccuccuccuauaaaguaucucccugguugaaggucauacauugacauaagacgaccuucacccuguugauaggaagccagugccccuuuucagaggaaaguagaggaaauuucaugguacuacucaacuauacagccccaagggagauggagacacacugucauucagguauuuugugaaaggcugaggcucucacagcagcccuuagucccugcacugacucugccaagccugggaggcaggaaaguuagggcuuccagguguucuuuccagcucucaguggaaccgagagacgguguuaaagguguguugguggcccacuagaaucaccggaaacuuuaaccaaaacaggucugucccuaggccacugauaguuuugugagagugagcuacaaguuuuuaaguuucccagggaauucucagguccacacagggaugaggaugcaguguacggagcucagggcaaucugggcaggagaccaagugagaggggcuguggccuagccccuaaccuuccagcucaugaccuucaggcaugugugugugacaccuccccccaggacucccacauuucuacugcucacgauuugauugcccacugcccucugggagggugaugggauccuuuucagcagggcuccagcaggccacuacccuagagcccugccgggaagggccacacgugcuacccuuaaccccgagacccaacaagggaguaaagauccaucucucuacuguaugagagaaagacaaggaaggaaggccacaauccuguucuugugggcacucugcccuuaacgccucccacuuaggucugaccugcuccaaagcaaacucccgcagggaauucgcucacuuggcccugcugcaucucccacaugccagggccugaggaacuagaacccagaagucuguuacaagaugucauccagaacacuauuaaaccccugccgcacuccucacauagcugagcauccagggacacguaggagccaagacugaacaugucucuccugaaugguaaccggaagcucuccuaccaguguagcccacggccugggaagagccaggugacuucaaauggacucugggaaggcagaaagaaggggaagccauaacauuagcuaaccaucaucaccagaagagaacuguuuauuuauuauagucucauguuccugaguauucuuuuuaacuuuaaaaucuaaguuuucacuggguagugguggugccaugccuuuaacccaagcacucgggaggcagaggcagaggcagaggcagaggcagaggcagaggcaggcagaucugagacagccuggucugcagagcaagcuucaggacagucaagacuacacaaagaaccccgucucagcaaacgaacagaucuguuucucagcugaagcuuuacagccaucagaaccacagauucaccaagauacacaggaaacacuagcaauucugaaagcaguuuacacacacggaaagguuuacucaggaaaaaaaaaagacacagagacagacacacacacgaucagggucacaguaagaaaccuaugaaagaugaguuuucacaguguauguucuaaaccagccugaguugagucccuuagccuggcauggccccagugaguauagugggcugcuguucuaaggaccaacaccccauccccgccuugccauccugcccugccccaguuagcuccagccgguucucuucacggauggggagcugugcauuccagggucagacuuuaucuucuaaaugcacaaugugcucaggccaaaagcaaaacaaaaggccuuuccaggaugcuuuccaaauuccugaaacacacuggguaggaaaaaaaaaaaaauggagccccguuuccucuuauuuuuuaauuuuacacuggcuauguuuauaauaaaauagaauaacuuauuuauuugcuuaccuuacuuggaaagacaauaaauuggaaaggcuucauaaaucucacagggaauuccuuuaaacaaggaucgucagcaaaaauccguaaauaacccccuggcagccuugagccgucaccuccagcaagcauucuuguuccuccagccuuggugcauaaccacuugcaaacgaaucaaacuaagaacuacucuugcuuuuucugauaccguaagguuccgaaaacauccagaguacaggggaggucuggaagucaggcugugaggggucugaggagaaugaccuucgaaguucagaacccaugaagauggacagucucacacagaggcuucaaggacugugcuaaaaauaaguuuaaauaagaggcagaaagaagcuugguggauaaucaaacugcgcccucgaaagagcugcaguaaucaauuuacauaucacucaaaaggaaaauuaccauagcuaaaagggacaguucuccaagccaaagguuauaaagaaauucagcccaacuaaccacuauucaaaagugauuaaauauguauuuucagcggggagcaaacucaaaaccgcuacacaccuuugcccagagaccuugacuugggugugagauccacacagcuggauuuuaaguuccacugagguucccguauagcaccaaagagccagcaugaugucuacaugcuagcuaugagucacuagugccugcuggguaauuaguccagccagugggguacggauggcauuuauagacugagcaucaccagucugaaaauacuuuaaaauccacagcuuugagugcuggcauagcacaggcuaaacuuucuacaccguaccaauguccaagugcccacuaacaccugggucucaggcacaagcagaacauuaaucaguccuguguaaggcucgaggucucagcaugcauaugcaaaugaguccacugggguggggguggcuggagagcuggcucagagauacuuuuuacagcauggcuccuaagaccaugcugguucacaacaugccacuuccagggaaucugaccuccacgggcacugcaugccugugaugcacauacauacacgcaggcaaaauauuuguuuugcauguacgaaguaaauccuucuuuuuuuuuuuuuuuauuuauuuuuuuuuugagacagaggacuggacuggccucaagcucagagaucugccugccucugcuucccacguggaacuaaaggccaccuggcacggaagaagcaaaucucaaauuaaaaaaaaaaaaauucucauuauguauaggcaaauauuccccaaauuagaaaacuccaaaaucugaaaauccaagcacuuuggauaaaggguacucaacugugacuccgagggacgugccaaacacauuuccaccuccucccucauuuauaaaugaagcccguuuauaagaagcucauuuauaacugguguuauuuccuaaugugcacccuaacaaaaggccuuucuaaagaagugccuuucgguugacucugaagacacgcugggagcuuggguccagaucagcacagcuggcuggcugucuccccuuaagaagccagcugggguuuuccaguccacaaggaacagugcuacccaaagguggagacaggaguagaggcccuagagagaacugggaacagccugugcccaaccaacacaccaccaggcucuguagcugcugagugccgcagcuuagcugugcuccgggcuucaucuucuagagugcggcucuggcuggugaggucuguggguuaauuccuguuggggaugacagcuccuuaauaaguuugccaauguuccucaugccagccaaccacuucccuccuuaugcuuauuuuuuauaaagagcuuauuugagguauaauugaaaaaaaaaaaaaaaaaaagcaaggaugaauauaccggugaacccuucgccacagcuguggugauaaacauagcccucuccaaaagcuaguaagugcugcuucguguguucgauuaaaaucuaguaaucuauuugcccuauaggaaaucccaauggucaggcuguccagggauggaggagagaacugccacggggagccaccauggagcgggagauccuucccuuccacagaccugaugaagcagacuucucacacuuacuuccaacacuuccaacaguccuugacccauggcccuacgugccuuuuaacuuauaauccagauucagcucacacuuucaggccccagucugaauucuauaagcaggugccuggguccccauuaccuucccuguacaggacaccucaggugacuacgccaaagaagccaagguuuuauauauauaaaggccucagcucccauacaucuaagccagauaacagugugaucccagugaaagguggcagagguggccaaccagcccugggcugcucugaugaauguaccgaggggaagugaucauaagcgcagaaaaggcgguuccagcaauaaucaguaaguuaacaaaugcagugauuccccaaauuaaccaacuuaagaacucauagccaagccguggugacacaugccuuuaaucccagcacucgagagccagaagcaggcugaucucugaguuugaggcuaaccuggucuacaugaguuccaggacagccagagcuacauacacuauauuagcauguucacaggaaccagugaaggaggcaugggagggcuuaggacagcacaccagggggcucccuuggguauucaauucuccacuaccugcaaacggaucaauguggcugacccuuccccaccuagaaaguucuccaauucccagggcuuuucacaaaccacucucugaaccacaggaaggcagcuagcugguccagcuggccucuaccuucaauaaacaaaucaugacccaagagccacccaggauuccugggaauagaagcaggcccagcacugugaacagcacacgucccagcucucuccaaagccauuucccuuaaggagaaaggaugaagcagcagucaguguccugcucaucacucugggucuggagccauggcagacagaauagacaccuguuccugguccuuccaagagaggcuggaggggacccugcggagaggcuguagaaaggcagugaacagcuguuguguguccccagggagcucaagggccgaggcauggccuuagaugcaccaggcucucaagugugagcccagaacugcccacuugagaugggaggguacuuugaggugacagguggcuuaaagaggcacauaagacacagguuucauuaacuugcuugaugcuaucuaucuaguaugagcuuuggcucugucugucuuaggcaugccuggcauggcaccaguaggaggucacccaggcaugccccucuucucugccugccguucuugugagcacacauaaauucuuaguuauuacaaaggacccagaacucccagucucuuacaugaagaucuaacaacuucuacuaaacuccuaagcuuuccuacuaacaaaaaaaaaaaaaaaguggggggggggacgacagcuuggaucagcaagaugucucaauggauaagggugcuuguuugcuguaaagccugacuaucuuaaucuuaguucaaucccuaaaacccagauaguggaaaacaagaacugaucccuuaaaguugucuucugacaucuacauguguguacauaggcacacagggagcagaauauauuuccucagcauagaacugguuugcaacaaagugauauaucucauuuugcaaaaccugcaaaacugcccacugcaagcaaguucuacuguccauccauaaguguaucuacauggcaugguagggagccagcacccucggaacaugaguaccagcaaucacuuaguggggugaacugcaaagcucacuaauacagcaggggccuugcagucuggcccugaagccaucuaccccagggcucccuggaaggcacugaagcagggguuugggaaacacacuuaacauucauagggagggaaaaaucuuuuggcuaccucucguaauuucauggccaggguccaagucccccuccuuaccaguucuaaccucaucacagcucuuaccugucacagcuagggccaucacacucccuuaacaaccucaguccaaauccagugacgucuacucaagcaggaagagacaaccccaccggcuuggcuaggccaaguugcuugagaaacugccuaccgaccaaaacagaaccugcacuuguguguacaugagcgcccuccuuaaacgucuacuccaaaacccaacucugccccuuccauggacaucuaggaaaaaaaaaaaaaaagcacacauggggcagaccagcaacccuucucagaugccaucaaucucuuggcaggaagcaaugggacccugagaugagucaugggccucuuuaaaauaugcuccugcgcugggugugguggcgcacaccuuuaaucccagcacucgggaggcagaggcagguggauuucugaguucgaggccagccuggucuacaagugaguuccaggacagccagggcuauacagagaaacccugucucgaaaaaccaaaaaaaaaaaaaaaaaaaaaagauauguuucugccacaacuuaggcaugcucugaagcagaccacacacacacacacacacacacgcacgcacgcacgugcacacacacacacacacacacacacacacaccucugcucuuaaggucuucaucuaugauacaggacauggcucaaaaaguccagaagaacuccuggcacacagcaguccacauuacagucucuacccaacaaccaaggccuuggccaauguacacaagucggcugccaccugccaacuggaaaacccuagaguccuuugucacauaauccaaccacuguuccagaagcaaaacggccaaugugagaguuccacaaccuuccauggaugcugcaccugagggcaauaccaaucaccccuaggauucgaaaugcuucacaaggcugacuccauuuguaagcaaaagaccuuaaacacaugcaucaaaaaucuagcucaccaaacuccacaggaagaccagagucaacuaaccugaauccuuggggggcucucagagacugaaccuccaaccacagagacugguacauauguagcagaugcacagcuguccccaugugggucccccaacaacuggaguaggagcugucccuaaagcugcugccugucuguggaccccguuucccuaacuugacugccuugucuggccucagugagaaaggauaugccuaggccugaagagacuuaaugugccaggugaggguauacccaagggggccuccacucucucagagaaggguagggagggaacuaugugaggaggaaaccuggaggaggcaagggcggcaaucaggauguaaagugauuaaauuaaugaagaaaaaugcauaaaaaguaaaaauaaauaaaagccagguucaccuucucugcccacuccucaacggccgccugugaaucccagaguucccuccagucugcccuacaguccagcugcguacgcaucagcuccaccaccacguuagaucuacucuuagugugaacaccgguucauuuucccaggcacagcaauggcuuuuauaggaaauaacuucagcugggagggugugguauccuuuaaucccagcacaggaggccgaggcaaagagaauuguucugagugugagaucagccaccggagcuacucacagcaaguuccaggcuagcuggagcuauccaguaaaacccaggcuaucugugucacucacuauauagcugaagaccgauucuuuugacuccacucuucccggugcuuauguggagcugcgauggaagcaagcacucuaucaauugagcuaccucagcagcccaccaucaucuucaaaugaagugggaacucacagccaaaaacucccaaacacuacuucucuccagacucaucuuaccuaacgcuccuuacuucagagagagagagagacaacgagggccacccaagaacuuuaacaaaccugaaugaacccucacccacccacacccugcaugaaaccauaaagccagggaugugguaucuuggcccagcuuccccaggaaguaccuggaacacaucuggagaugaugcacuuauccacucacagcagaagucaaucacguggcccaacccacuaggagaaaaggacucugacccuaggaauggcccaccucuuguuccagcugccccugaagcuccaggcucuccuggaacuacagcacacaguaguauaucuaccugauuuuaaucaggucaggaaagcauuuucuaaagacuuaaccguauaugacaccccacacuggacaucucuuuucacuugacuuacuaaauuauaaagcuuuuccaaaaagcuaagagauaguuccuccagugacgucuguuuaauugggacguguacagaacauaauuagacugucuaacacuacaauauugcuuaugggaguaucucugcccaugcaucggcuuccuucuguacuuaaucucuauuaagaugucuguguggaagcagauaggugugcgccagacuucauaaacacagucaaucacaaacucaggaagucguuaggucccaaagacuccacuuugcacuuauuccagcaggcuagccccuucccuuuuccucgggugucuuuccaguguacccaggcuucaucagugagaguucaagucauggccacaauggcucucucacagucacagccuaaaaccaccccggaaagcagcuacccuaaccaagagugaagcuuuucugaccaaggucccaguuaccaaccuuggacucuagcaaacugaggucucuuguguugacccucagcucagacagcuauggacaucuuuuuaaauuaaguucauuuccccugguggauucaggagacuaccaccaaaggcuccaaacucuaugggauaagcucacacacguacacacacacacacacacacacacacacacacacacagaggcauggauauacacacagucuucaaauuugugcacuuccgggggcuggagagauggcucagcaguuaggggcacugacugcucucccagagguccugaguucaaaucccagcaaccacauacaugguggcucacaaccaucuguaaugagaucugauugcccucuucuggugugucugaggacagcuacaguauacuuauauauaaugaaugaauaaauuuuuaaaaaauugugcauuuccacccaccccuaagcucacauuaucugagaacacagccauucuuuauacagcuuggcaccaguggagaacccacaaaauggccucacucuuuccagaauugugaagcgauccacagggcuuugacaggguggaaaguuccuuucugcauuauauaggguuacuaguaaacuaaaauuaaauaagccaauaauaaagcauuuauacaaacagaaaacaagggaagggcuggggagauggcucacugguuaaggccacuuguugcucuuacagagggcucaugcccaaugccagcacucauacgguggcuuauaaccacccauaaccccaguucuaggggaucuaauaggcaugcuggugcgcauacaugcaugcagaaaagacauuuauccacauaaauuagaauaaauaaauccuuuuuaaaaagggaauaagaaggcuggcgagaaggcucagcggguaagagcacugacuauucuuucaaagguccugaguucaaaucccugcaaccacaugguggcaaacaaccacccauaaugagaucugaugcccuccucuggugcaucagaagacagcuagcuacaggguacguauguauaauaguaaauaaaucuuuggguuggagcaagcguggccgaccggagcgagcagagguccuaaaaauucaauucccaacaaccacaugaaggcucacaaccaucaguucagcuacaguguacucacauacauaaaauaaauaaaucuuuaaaaaagggggguggguggggauaagaaagugaggcaggcagcugggugguagcacaggcuguaaucccugcacgagaagcuaucuacucaagucaaacucaguuaaauauggaauuaaaggccaguuggaacuacaugacccuugaaggaaggaaggagggaaggaaggaaggaagggaggaaggaaggaaggaaggaaggaaggaaggaaggaaggaaggaaggaaggaaucaacugaugaccaaccuugaaaacagugauaauaaagagaagcuuucucaguugcucacgcaaagcccccagcaguuaaagcuaaagcaggagggaaaauuaaagucuacuuugggccaccugucuuaagaaaggagagagagggaaaugccacaaaaugcauucaaugucguuucuaaaacagaagguauuuguucccaaaucuguuugagugccuaguauuuuuuaaucaaacaaugcuaucugcauggguagauaaagguagauuugguuuguugguagaggcgcaaaugcccauaauccaugcauguuaaugcugguaucaacuaguauuaagccuaucaacuuccauguugcuucuaucuauaaucccagcacuaaggaggcaggaggauugccacaaguuccgguccagccugggcuagagaguaagacccugucucaaaacaaacaagcugagcuucacgcaucuaucaugugaacauggauauucaugaugcacuucaccaagccaagucuuaaaauguuucuuugcuuacaugcuaugacucucaucacaggcucaucugaauaaacacuucugugugcagauacaguucaagguucaucuccacaugagaccagccggagaguaauagacacagacacagacacagacacagacacacacacacacacacacacaauuuccucucaacuggugauguucuagagacuuuuaaagcaaagacagaaagacacaaauacaugugucaaauuucaaauguauucauucaaucuggggguuauucaagcuauauaaaaccuucuuucaaccauguuugcaugccaaauguucaauaacuagacucaaguguguggguguagcgcugagggagugguuuguguuuagagaaagacagacugugugugguuggcagguucugggaugacuacacggagaaccaccuggaggaguuugcuaaaaauacagauguugggguuuguccaacaugauggugugcagagcccaggagauggacuccuagaaggggugccccagggaucccccuucucuggcagccagccucucuggaaccacccagucauuagguccucccuggggacugcaggagucacucaugugaaaaccaccaaacccacagccaacuucuuaacuuaaaaugcacaggucaccuggagagcagggcagagcaagggcugguuaaaggguccugguacucacccaagggaccucucugugcuacuggaggccucuaacuccauccccaugccaaucugcagaggggcagggaacuagaguacugcccaggggaggcagacagacgagaauacaacuuacuaaguucuauuaauuguguuguaacuucagucagcguuccucccuccggggcaccagaaccacaguggcaauagaaacuacuggcaaacgccacgggcgucagcaacuucugggcuuauccacccucacagucuggauccuacgcacggccuauuauauauccuaugcccuugcacugcagacccccaguuuuccaagggcaucuucaagaaccaucuccaaaagaaauucugaauggcgugaacugagugcaaagaaauagcuggucuaugaaaugaccaacccuccucggaggcaacacacagugccuucuacauuggcgcaugcgcacagccuuacaacacacaccuagaaccugccagguaacagaggaguggcauugccuaaagggagcagcagcucacacuaaaacuggaaucagccugugaacuuggcauucaggaggcugaagcaggcaggucaagaguucaaggccagauugggcuaugcagcaagauugucuuacaaacaaaacacaaaaaaaaaaaagagggaaagagaugggugguaguggugcacacauuuaaucccuguacuagagaggcagaggcaggaggaucucaauaccagccuggucuacauagugagcuucaggacagccagagcuacacagagaaacuaucuccaaaaaaaaaaaaaaaaaaaaaggauuaaaauuggauucucacuaaucacuccauaaagacacacacauguaugucugggucauauugggugcuucaucaguaucugauaguaugcauggauucugguaguggauggauagauacccuggagaccauuuccagguuuugaagagccuggaucagaaaccugcuuagacacacaaagccaauugcuacuccgcugaaucaaagcucuucaccaaccaagaacacaauaccacauaccaggcaggugacccacacuagauccauaaggcaaucaaucaccugcacacagauccuccugccuccagaccaagagaaugagccaguccaccagccaggaaggggcaggcucuaaggagugugcugccugccggccugcccaugcuguggcucccugcucgaugcggugggaacugggcucccaggguacacaaucaaacccugagccuuuuccuuggcagcuuccaccugccaaaagcagcuggaccaggcacagcucccauguugguuguccacccugcaggacagccaguuuucuucccuuccacggaaagggaggaggucuccgguaacacaugaauauuuuacuaggcauuucuuggacuuagcuaauacacaguaacauucugcugucuaaaaacaacuucuugcaaguuuuuugguuuguuuuuaauuuaucacauuggccccauuaaccaaugagaagccaaccaaacucagugcccuucccuaaacagauugauaccuaucccagguauccuuuuauaauggccuccaacuaaguccaggaauucuuucggcuguagcagacccucccaccuucuugaugucugaugggaacccuucaauauccaucuacuuugaagugcagaaugggccuuucucugcacaaaagcagcagguuuauuuuauuuuacuauacagcguuuuuuauacuauauaguauuuuuuuuaauuuaacaauccaaucuaauacgucagccuguucuaagcacuuauaaaauauuaccucgugggaucuuauuacauaccgccauucuacagacucagaaaccuaagcccccgucaagagcuaaguaaaugagaaugaagggagggcuacagcguucuuuccaugccaucuuugccacacauucuagaagaaucuacccccugcguacacugauccuucuacuggccucuagaagggcgucucucucgucuaaaagaagugacaacaucuucuagaucagagcuucccacccauucuaaugcugugacccuuuaauaccgucccucaggcugggcuggggaaccauaaaacacaaaaucccucaaccauaaaauuauuuacuugcuacuucaaaaccuugcuacuguuaccaaucauaauguaaauauuucugcaagauguaggucuguccaaggaauuugagacccacucuacucuuccucgccucaauacaguacagggcacccagugcccccccccacccccccaaagcaaaguuuauauaucaccagcuugaaaaauuacuggaaugcagcuuuaagccugacccuacucuaggugacaggcagcagcugggaaaccuuuucccaggcuucccuuugggauagcaguuaugaauuuaccuccaagcucacaggccagacagacagacggacagagcccaggcaaacaacccuggaaucacucuaucucccugcaauccuuguacacaacaaacucagcuguaugaaguucccagucauaauauaaaggagacaaaauucagaagcaagcucaaaugaguccguaaguuaguuccaugggguacaccuggccauuuuaggaagaaaagaaauuacccacugguccagugaaaauacucagaggaacucucaacuugauccuuacuggcuccuggcuuuugcuuaagucacaguuuggucuuccauucgggugaggaaugaaaggaugcugcauggggagguagggggaggggucuccaucccagaggaucagggggagggggucuccauccccaaguuaaaagcacugugaacgaucggccaacagaacugcacaaaugcuggauggggaaaccagaugaucaggagaccagugugucccuccauggggugggcagaacucaggcaccccuaccuuguguugaaggaguuagcuuaaguaccagccucaguggcuuuucuucagagcaaaggaccccugaccccuagggguauauacuuucugcaugccagaaccaccgguaugguuuggagacuaccugaagccaugccuagcagggacugacugucuauaagaaaauuacaugcagucacaguggucagcaagcaaaggggcuuuauccucuccugucccaucaccuaggccuguagaguuaaagccaauacagaauuagcaccccccccaaacagaccucugcgugaugaaguaaagggcgaccuguuugaaaacucaggagggagggcucuuaaaauagacagaaauauaaucauuacccaagcuggagcagggccaggacgccagggcaaacaugaguaauuuguuaagagacaccucuggcacauuauccuaucaggguugaacccaccauggagccaagcccccugccuuucagccucagaccggucccccaacauaacuacagggauuuccccagcucacaggcccacaccuguucucgaaggggaaggaagagcugcagagcaggaaggcacucacucuuucaauggaagccuguuuuucaggaaaauccccagcauauggggaccuuagguccaaagcuccugcccugggugccuuuccgguugaguuauucaccacaggggcagggcugggcucuggaucuuagggcacgcccaacuucaugccauucccuucaguucggauggccacuuugaaaggaagacuaauccuuuuguucuggagaacucacucaaauuccuggcuaaggccaguguuacacaaaagcaaggcuguaaccuagaacuuccuugaaaggaaguuuuuacugguuuuacaggaguggagcagacggaccaucccaucguccugaggggagaucuugcccagcuuucuccaaauaucuauguguagaaauugaggaacagugggguauagggcgccugucucucccuccaagggaggggcacucaccagaaagguagugccugcuuugaggauagucugaaucuaccuacuggaaaagugaugccugucccuaagcacaaggaguugcuuauggacggguguguguguguguguguguguguguguguguguguaugccccgcaagccaugagucaguaauccagagaauucuuuccagacagccagaaacuuucaaagaccucccagguuugaauagucacuucaagauuacacugagaguaauuggagagaaagcucaacagucaagaccacugacugcucuuucaggaccuggaugcauacaggcucgcacacacccaugcacccacaauggcuguuaacuccaguuucauccagagggucagaugcccucuucugguguuugcauguacugugugcacaaaguuucgugcaggcaaaacauacacauaaaauaaaaguguguuuuuaaaauacagagaagccugaucucguaguacaguacaggucuuagcugcucaggaggagacugaggcugcccagugaauuuaagagcagccugguaucuucgggagaaaagggaugagauauagcugagugugcuugccuagcuuaugcaggagacccuagguacccuaagcuagaucuccaguacaaagugaagggaaccuaccagcagguggugaugcgcgcauacacaccucauuccaauacuuggggaaaggaagauugugaguuggaagccacccuacaaaacauagcaagacuguccccacacacacuguguguguguguguguguguguguguguguguguguguguguguguguuaagggauagcucugcuaauaagccugauagucggagcucagucuccagaacauacagguuagagauaauugacucuugaaaguuguccaccugcaaccuggacacacacacaugcgcacccacaaauauacacaaaugggauccaaauguuuuuaagugcaauaaauguuuaaaggccuagagagucuacucuaggaaagucuccccacuuuaggguggaucacgcuaucaaaaagaucacucaaaggacaaaaugaacagaagccggacuucucacagcuccggggcucuggggaaccuaugagcugagggcaggguaaaauggaguaauuauuugagacuucagucugaauucgggaaaaacacagaaucuaccccuucccucugcucccauggaggagauaggguggaaccaggaaguccuacucugaccauuuuccaaacgucaggucccagcuccauggagaggucaugagcaagucacuucaaaguccuuccuuccucagucugccaucauuccaccuagggagacuggugggccagagccagauacaagcgagggcucaauugaccaucccuacaucguuaaacucuuaucauuaaguaacaacgcugcaaggagauccgaagucgugaaugaagucuacaagacagaggaaguuuaacguucagaaauugguucaccauggagaacccucaauccaagucuagaucccgcugccccucccccuagugcccagcaccuccggcuaagauccccaggccccugagcggccaccauaacaaacacccgcagcaguuggcggaaaugguaggucucaguccuggcaguuaugugucaagcucuauggccguuuguagagcaaauaaaacagcacuuuagaacuuacugcacagcaaaccugccacagggaugauaccccuguaccccugugggccuuucgcccugaaagccuaauggaggcgcuagaaacaucuugaccccucccccccaggucagaaacauugggucaggaucacugugggcagaaaaguguucaggacagggucccgccaagcaccuggcucagcugagcugaaguugggggcccacuugaauguccuccccaccaaggaaucucaagucaccccgcccgcagcucccuccaggccauggaggccagcuggugagagggaagcggcaggaggaaggaagugggggcuggggcacagggucuauuaccaucaccuuccaacacuucccugcuguuuagauuagcaagugaaaaggcccggaccaggggaguuuuccccgggucggaugccucacccugggcacagagauagacgggcggggucgccaggugcacacaccccaggggcuagaagcccacuuggaguccugagauuccagauccucaaaagccaaaugaaaggccccccacgcuccuuccccucacuucccauccagaccacgcccccucccggggcggggccaggugugaccgagaccuuccucuuagacccagccucucuugcccgccuggaaggucgcucaggacaccggaaguugguguccgacuggguagaaggcagaggguccuggagggcccaacucugcucuaccggaacaaggauagggaaaaaaaaaaaaacacccagccccuccgugacuuggaaaaagcgacucuauuucuuccuugcaauaaacaggaauuauuguauuuacccagcucgcagagccucgugaagauuaauggcugugaacuguuuuuaagauaaaaaaacacucccagaucuuacuuguaacauucauauaugcauauggacaucugaugcacuuaaaaaaaaaaaucacucuauccaagugacauucaucaccagaucuuagagcaacaaaagaaagcgaugggugcucuccggacaauaucugaccauggcacgcaccugagccaccagcuccaaaaggcagagaggcuauccagccagcagugcagauuaggauaacaucuagagaagguagggaaacaugaaacuuaaaauauccgucguccacuccauuaggaaagaaaaugaaagggcaucuuccuaaugaagcccauuagacucggccuccaccuggguuucugguguuuggaaacuccuaaacacggggcuccaguggucauucaagcuaugccagugccuggagcuugcacgauccgguccuaucuggccaagcuguuccaacagcaaaccccucucucgaggaaccagcagcgcccuuccuggauuaugcaaggucacgugaccgccgagggcacuuuuggaguggaaaugggaguuggggguucaggauguuaaccucuuucuuucaaccaucccaagacuuggguuuuaaggcaggcagaucugaguguaagcacaccagcguuucaccgugugcgaggcguuaagagcuagcagugaagcacuuuauuuggacucgaguagaacacacuaaaauucuccaucagcgagaauagucacaacuaggguucauuuaaagggaaaguacagagauccucuccagcaagucauuuucaccugcugccccuugccccuccuacuccucucuuccgaucagguguaaacacaguuccagguuucauuaugcccguucgcacccauaaagcaauauuuugcuggccuccauauuaauuuuuuuuaacuuucauaauaggaccaagaaaaacaaaguaucccauuaggccaugagcuuggucucuuaguuccuuccagacaaacuuccuaggauuccaugacuucaauaauaaaguuuuuguuccuccugagauaacaagaggcaugaugggagcagagccacaaugaggccugagaaggaagccuggugcuauuuuccacaucaucugagcaggccucacuaugggcugcuccaguaauacccagagccacugcuuucuuaucuccuagcaaacaaucuuuaagccaagcaguguaaaucauaauuaggauguuguaauacaagaagaaagaagcacaugcugaccagaauccagaaaggaaaaaaaaaaaaaaaaucaacaccauaaaccagguaagggguucauugcaugucuguaaucucugcacuugugagguagaaacaaggaaggaauucaagucuagccuuuguuacauuagacuagaccaaaaaacaaacaaacaaacaaacauaggguaagguauuauuuccuuuucuaguuuacaaaagcucacccccacacagacaucuucaccaggguuuuccuggccaccugaggucuagacaaacccagucaccugcaauuuaggauuaacauccuccaaacaccacccagcuugggggaugagaaaggaaaguucuaguacuuaggacagaagucacaauuccuuuuaaaacuagcaugacugcuugccccauuagucagaacccaaccauuuuaucacaauuucuaugaaauuuaaguccacucuagcagccaacuguuaaaucuacguuaggccuacagcucaagccgggcacuucuaagcacccacaggggaccaagcuugguggauggaaacugccagggggccucaaaauuaugagugcacauugcuaaauaccagguagacgcagcccugggaauagacaauuacccacaugguuccaguuuggauggagauuuuuacgagguaccaggaaugccugucaccugagccaucaugggucccacguggaagugcgaggaaaggcucugagaaugaagacucaaagaagccuuuucagaaauaacagcaggagccacaaacaggcaggcccuauagcaaauagucaaguauaggauccggucccuaaaggcaaagccggagcacagggaggaauuaaacacaaagucagguccuuccugggauuucaguugccucagugucuggcacuguauagauaguguucuccuaagaucacauuugaaaggggggggggggugagggaguugucauucuuaaugcuuuucucggaaacugcuucuauuugcccuuguaaucuuuccucaaaaagaaugcagacugcuaagaaccaaagcauguauucuccuggaguccaguaagaccaccuucuaagaaaaacucaggaagggaagcuggccaaauuuccaugccugaccaaggcagaugaaugccaggcugguucccaucccuguuguguucuccugcagaaggggaaaacugccccuuggcucccuuugucaacauuccgcacaaacaauggccaggcucuuucaccacuuuagacucuauauucaucugugaaucccccucuuccacacaaugugcaaggcccuucuuuucauaggagaaguucugaaugcccaagagcagccauaauuuaggccuuccacauuaauaaugacaucuaaaagcaaacuccagauuaggcccaaacauucauuugugacuaucauuagagucacacugauagcuuuuggauacuuuucauuaaaucaugaucaaaagagccacuauaaaacugguucugaaguuuuuggcgauuauuaaauauaauuuucugaacucagagauagggcuuuaaaaaaauaaaaaaaaaaaaccuuucauaacuccaugacacauauuccauuaaagccagacuugaauaaaaauuaacuucaaaaggugggacuggggaaagcuucggauauucccagcucuccccggggacuguaacuuuaaguugcagccaaaguaaauuaggacaugcuuaccagcuguaauagguaaggugauccaccuaggcaauacgcccacccaaacauuccuguacccccuaacuuuucagcauacacaagccucgugagcauucauuccugaccuaucaguccauggaaagauuguuaguaagagaccccaagauuucaccaaaagguggcauuucuuugugaaggaucaagcuguacuauuuuuuuuuaagacuacaaaauuguguuccacccucuguaauggugcuguuauuaccugugcaugguaguaacugaguuguuccuacccagcacaauagguaaauuagucccuucccaaccaagcuaugcgaauccuuguguuuccguguggccugcugcuuucugcugauagaaaguuuauuagcagagggacccaagcugaacucacauacauuauaacgagucccucuauauugaagagucagugggaaaaagugagaacugagaccaccauuacaucaauguuguaaacucuuuacauuuucuuuccauuuagcagagcccugagugcagaagggauaacugcaccuucaaauaugacucuugaugccaggguguguuguuggcaaaagacaugccccugcuacaacacagcaguagcccucccugaaaggugacccuaaaagguauccuuuuugaaagaccuuuuccguuuuucauaaaucuguaagaaggccaggugugguggcacacagcuuuaugugggaggcugaagcuggaggauucugaguucuagaccagcauggucuacaaagagaguucugggucaccgugcauggugacuuccaggacagucaaggcuauguagagagaccugaucacaaaaaaaaaaaagaaagaaagaaagaaagaaagaaagaaagaaagaaagaaagaaagaaagaaagaaaggaaggaaggaaggaagggaaggaaggaagggaaggaaaagaaauucaaacaaaauaugccauccuaggcucacuuuccugcugguucaguauaucucugaccugacugcucucucagcacacccuaaacagcuuguuuucauaguuuguugucacuacuuguuuguuucucuaacccaauuuuucuuuacaacacuuucuagacuaacaggacaauuucuauuuggaguuuuuaaagucaagagugagguuauugauuauucccugaaaggguaauggauggaguaguuaauaauuauuccacuagcaaguuuuaccguuucaucuuguguacaagagcuagguuaacaaugccagggaaaucaaaacgacucagcagggacaggaacaggugugccugagucugaaagggccaaaauauuucaccaaguaugucacagguuuuuuacagaggcaguguuugggguuugguggaugauuuuucuuuucuuuuuuuuuuuaaguuucuuaacucugaaaugacacacuuaaauuuuacagacauuucuucacuuaaauugacgacuaaaucccacacauaaauugcaacucaagcucagcaaggaaaugcauuuugcgggacaaaggguugaguuuuuuugggggggggguuguuuuguuuuuuuuaaaucacagcuaagaaaagguaauucacccugccccucccccacaagaacacccauucaagagcccaguuucaaagcucccaaaugaaaccguaaauaacucacguggcagcgagcuccccucagcagggcacaccacaccgcccuccacucucccuuauuaaggugccauuaccacgggggagggaggcgggcauuauacuccuucagcuuaaguaucuccccagacaagaaaccaaaaacgcaccuugucagguucggaacucacugcaaaccugagaucuuuggauucccucuaauagcugcuuuccacagagacguacccguguccccuaccccuggggcacagaaaaaccaaucagugucauaaaucccccuagcuuucaacccgcucucccuugaacuggggcagaguggggggaggggcgacccaucaucaacacuuacacuaaaccccucaaugcacuacagaaauaugcuggcuuauuuccuuuguuuggucauguuauacuugaucaagugugaacgauuaaacugguuucauuaaaggcaaguacauucacggcuaacauucaacuucaauggcgacuuuaagcauauuuugcaagagggaggaccugcuucuagcuugaaaccuaccagcucauuaacuuuucuuuggggggcuauaaaaagggcacuggggguuuuuccaggagugugucagagccagacaaaaggauauucaauguuccaacuuuaagauacaguuguuauuuggaacacuaaaaaggaaaccuuguuuucacguuaaaguugcuggggcugaaaauguugaauuggcauuuaaaauauuacucuguaauugcuauuaagaaguacucuuugagaugaaguaauuauaaaaacaagauccuuuuaaagucccauuacuaaagauaugaaagauuuauuuaaaaaaaaaaaugcuucaaaccagaauuguccuaaguagaugggaacuaguucuuugagaaucuaucuagaggcaaacggcagccccaggagccgaacgcgagguaauuuuaaaacugucuuugaacucagcacgaggagagaaggccguaucuccuucaaaaagagaucccaccguugaugcaucccgucaaaguuagaaagcagaacuacuuuuguaaucccucuaccccaauacaauguucccucaaaaaaaucacccaucucagauaaaaauauacaugucccaaaaaacugcaaauaaaggccuuuggacuucaacuuuccaaugcauagaguucuauuaccacucgcaucuaaggacucucaaaaguucccuaguuuuuuuuuuguuguuuuuuuuuuuuuuaaagaaaauagggcaaauauccaggaaggucuauuugcccgagguugggagccuggcguggcgacguaggccauugccagcagccuccaagcacgcagagauuucauaagauauucccugcgguccccuacaaaaucccaaaccugaguccccuaaagccaaccgcugcuugggccgcaucuaagaaaaguagggggugggggcugggcaaggguaccacacacacgcgcgcacacgcacucuccgugucggcgacuauagucgccggcguuaagcaagccaccggagggagugugugcgcgcgaggguuugcccgcggugaccgcgccgagcucucgggcccgcggccuccuagccccugggcgcagcgugggcugcaggcgaccggccacgccgcggggccucccgcaaaagcaaggccugggcgcaccggcacucccgcgcugcccggccucagucgcccaaggcagagggaagggcgcgagccggagaagaaaggcucuucccgccggucgauccggcuccgcgaaacaccccaggcgcaaggaggcgacugcggcggccggaccguccccgcgccacgcuagauccccggugcccacggcgcucccagccagccccuuuuacgaaacuuucuuuuuugcuucgccccacccgaaaagugcggucccggcgaggacgccgaggacagcgggcggagggcgaggaggaaguggugcccgcgggagcgcggcugggcagaggaaaugcccgcgccgcccgcccccgcccuugcagcccgccccggccccccgccccgccgcgacuuuggcgggccgagccccgcgcgccacuggcggcggcggcggcagauguggccccggcugccccaaggagccaacaaugccgggccggcaaaacaaaagggauucgcuucgcgucuuucccggccucucacuuacacucugggagaaccgcgcgggaucccgggccgauaggggccgcgcccccaggggccccgagccacgcgcgccccgacuuguccccgccgaccccggugucuacuccccccugcccgcccgccucccaggcgcaaggccugccgcaccccgucaugcucggacuccugauccccagggaucuggccguauuguccccgcggcgcgcagcgcgcucguccgagaucgccagcggcccccgcgcgcgcacccaccgggcuccaggagcaagcccggggcgccuaggaaaccgucgccagacgccgccgccgcugcccuccggacgccgcugcgcgccggguuuuucuuuccuuuuuuuuuuuuuuuccccaauccugaugggaaggaaggugaccgccuacuucgcauucaucaacucucaucacaacaacaaaaauccuggagcaaagggcggccagcaagcgcaaucgguggcgaggggcggaggacgagaaccccccggcagagguccaccuccgggcguaguguguggacacagggcugggggcgcugaccaaagauguccucggaugccggcccgguguccuucgcccuccuccuucucccggaguggcgcagugaggcgcgggcacggcgccccagccagcggccgcaggugaggcgggggcggcgacagccccagcccuccccggguacccccgcccuuaccucguccugggucgccggcguccaaggagaagggcgcccacccgggaggcggcggcgguagcgguggcucccgccccucccaccccacccggcggcggcggcggugguggugguggcgcugguggugcggcccccccucucagcgcggcauggcucccagcucggucucuugcuccuccggccgcagcuggcuccucugggccgcucccgagccaccuuaaaaugacacacgcacacagagacacacacacaaaaacuuaaucucuccagcuccgcgccccacccccucccgcccuccccucccuuccuuugccuucccuucccucccuuccuucccuuccuccuccucccgucgccgccgagccucuuccuacuuccccacccaccccacccccuucccccgcccaccggcucccgauccagucccccccccccucguccuggccgcgcgccuucuugccagccccgcggccuggcgggggcugcguugggggucccuggcccgcgccucucucaccccccgagaggaugcuggcuguaacuuggauccggggagggaagguccuggaagccgagcgccucccggcuauuugcucuucuuuauuuguuuucuccucccgggaaggaggaggaaagcgcagagaaaaaggaaagggaaggacggaagcggcgcgggccgcugcuccggugcccuccggcugcgcaggagcgaggcgggaggcgaggugaggguccccucgcacacucguuuucuuuuucuuuuuuuuuuuuuuucuucaaaggcggggucucucuuugcaaaccaaugacacaaccccacaugguccggucucgccccuacagauacuucucacuacaaaucggcucucuccggggauuagcagcuacacgaaagugcauacuggcgcugcgggcagccgagggggccgggcaaggcagacacuccccggcccagccccgcgccucccuugagacucuggggacgcgcaggggucccgcagccgguggggugacuucacccuccuuccuucuccuccccuuccacguggggcacgccacguggggagacgcgagcucuagcgggccucggcacgguccccgggguagccccggcucgauaaggcccccaccacgcccgcucagccgaccugcacucuacucggccccgaggcuccaacuuccuccagggccccgcgcaggccacgggugccgucc

SEQ ID NO: 4148 - RNA, 2601 nt, Mus musculus
aaaaaaaacaauuuauucauuuuuauuuauguauaucuggugauuugacugcauguauagaucuguguaaggguguuggauccccuggaacaggaguuacauacagacaguugugagcugccauguggcugaugagaauugaacccaggaccucuggaagagcagccagugcucuuaaccgcuugagccaucuuuucaguccccuucaguaucuggggaugcuccuauaaccugcauccacaucaagauuauaaggcuggcuugacuucuuagcuuaagaccauguagacaguacagaguuacuguuucauagcaaguuccagcuugccugggcugcaaaaugagacccugucucaaaaauggaaagguuuuuuuuuuuguuuguuuguuuuuuugguuguuuguuuauuuuuaauguauauugaaaaccaguuauggaaaaguggcugguuguuuggcuagagccaggcuuacuacucucuaccuuuaggcuggucccuagguucauagcugggaagucuacucuguagccagucuaauuaccauagcacugaauguaauucacauggggaugggagccaugacuccagugagagaucccagggggcgccuaggaacugcagccccagugccuuuuccuucccaucaugaccacagcauagagggacauacucucuaggaucuuuccagcaggucccauccacccaacccaugaccuugacagccaggccuugguuuuuaaaggcuauggguagcaaucaccccugaagaaauacagccuggauauccacagcucgaccucacguggucacagcagcagagaagacaaagugaguccacaggaccaggcuugacguccucgugcccaggcguucaugcccaggcaugcugcagaaucccaggccuugaacaggaagcuugccggguucuggcagcuuguuaccagcaaccccaucccccaccuccccacccccaacccuagcucccuuaagauuccucucuggccaagucuccugagauuucaucugcagcugagccaggguguccuggccgcauguggaagaggcuaaggcaacacagguucauaugugagggccuguaaugggaucucugagcaaggcugcaggaggagauggguguuccuccccuggagaugucugcugauugugaaguaggcucauguuucuuccaaaaggcagaugaggggucuccagggaccugggugcuacucugggaaguggaaauuuaucucucggggccucacucauagaggaacuaauauauucucacgccuagagaucacuggacccacaagcccaaugcccaaggaccacccaggugaggcaggccaccagguaaauaggacaugcaacccaucuuaacaaaagcagcagcugagcuugcgcccuuggcucggcacuuggacaugccauuuguggucaguuucugguacuguuccuuggggaccauugcaggugcgugcugacuggcuucuugugacaaggaacucacuaggagacauuucauuccggagcacccauuagauucuggcgaguggcaggugauagaaccucaguaucagaaucaccuagacaaggcagucauggaaagggaaaguaucugucauuuuccucugggugagcaucccggacaagcugcagagauaucugacucgaguucugugcguggcaaguucugugugugaguuaaguaaacagaugcuggucuuucuggggcgacaggguagucuaaguuccguuucguguuacugaacugaaacacaguguuucccaccauuguaagacucuacuuucgcucuggaaggcaucauccccaaacaugcaggcuggauucguggcagucgcacaggaagccugcagggcccacgaccauggcucagguauuuggagcugcaggcggcugggcaccuggugggugaucggaaaggccugguuacaaguuccucaggguuuuugcaguagcuguaagcuagucgcaccaucuuugccuguuccugcggcccaccauagaccagaccaccuugcccgugcccuuccugggucuacuuguuagauuuugcuuccuaguaggccauucuagaaauaauggugaccucucagccagugguucuucaugguaggcauuuuauaguacacucagaaucugucacagcuuagcccucagguuugaggggauuauggacuccuaagugggccacacugcccugcugugcaccuauuugguagcuuaugcuugggcugguggucauugcuuccuucuccugggguauccccagguggcccccgcuucauuccagccucauuuuguuucuguggucgauaaacauugaacuucaggcuccuuuccucauuacaagagaggucaaggucacuagcauucagcagggagauuucagcaggccuucaaccaucaaaauacaaggugcguuaggcaaaguaacuugcauagggcauucuuguggcugucccucuuaugggaugcuggggcuucugaugacagugguguuuucuaaucuuugaaauggugugacauaaaguggugacucuuagcaagacauccugucugucccugccuccugca

SEQ ID NO: 4149 - RNA, 15137 nt, Mus musculus
ugggcuuucuccaccucucugcccaggcaacagcugagaagaucagauacagugggugggggagcucuacagacgucacaagcuugugaggccacagacagcuugugaggcaaccccaguacauucagcucauuggagagaauggccaaagggaggcguuucaacccgucuuugaauaaugacggaagauggguaaggaaggaugcauuccugaaagcuuccucaugaaauguggcuguuguugagggcacagaucugggcuggauucccuucugcugccucugguagcuugaccuuugaaaagacucugggccuuggucuuuucaccugucaagagggaagcucaauauucuuuugaggauucagugaacacacaugaaucugagggaggcaguccaagccuguaaucuaaguacuugaaaggcugaggcaggaggauugagaggucuagggcauccugggcugcuuaacaagguacagacucagaaaauaaaacuaaaaaagggagaggaaggacagagagaaagaaagaagacaugggguacagaaaggaguggaaaugugggaaugaagaaaaggaagaaaagagggaaagagggaaggcagaggaaaucaagaaggcagaaggaagaaagggugaaaaaaaugaggaauaagggguaaggaagaaaacugcucagugcagggugggcccuugaggaugcucaguggguagcaacugcuaccugcucucccuuguccauuucugcacuccugccuucuaauacuacagcccucauuauauggugagcuguuucuucuuccuagaucguaaguuccauggggcuuugucauuucuccucaguggugcuucaucaguaccuagacuagaauccagugcagaaggcauacucgguacuuguugaaguagucuuauauuuacuuauuuauuuuaaagauuuauuuauuuguuuuauguucagcuacaccagaagagggcaucagauucuauuacagauggcugugagccaccaugugguugaauucaggaccucuggaagagcagucagugcucuuaaccacugagccaucucugcagcccuguugaaguauucuuaaaaucucaacaaauccuguccaguucuugucaucagacuaggaaauggacagagcccaggagucguuuagcuguuauccuaacaguuguuaccuguuucgaucaucccccagacuucugggcucaaguuauuuuccuggcaagaccccuguuuguugauaucacagucagcccagucaggaauucuagcgucuucuagaaacauuugcaucuugacccagggacuucucaauugcucuuucauaugcauauuucaugcacugucaguuuuccauguccaguuccuaugacuuguucacaaaaagggaaucccccuguuguuuuccacugucaaaaugagaggcagaaucugagaaaagauuuguguucaaagcuuuaaggcaauaauguggggugagggugggguggagauguguggguguuuugcauguguuugugaguagugugugaacauguuuauguguguggauaggugcugugcauguguguuuguggggagacccaaggaugaagucaaauaucgccucaguaacucuuuaccuuauaaauggagguagagucuugagucuggagcaggcuggcuggggacagucuucuugcucuggggacuccaucucugccucuugaguguuagguuggcaggcgggcugacacuccagccuggcuuuuauguggguguugaggaucugguccucaagccaagaucuuuacuuaaucagucauaucucuagcccccaaacugaaauuuguguuuguuuguuuaaaagagaaagggaagagauguugggaaauuuggcuccuuagaauguacaacacugauugcagucucuuugguaucaaccuuagacuaaggcaaacaaguuuuaucuaaucuugacuuuuuaaaauauaaaaugaaauauaacaaaauuggagagucacugugagacuagcaggauaauucauucagaaggacaaagguaagcagacuagccagucagcacuuccuaaguauaguuaguauaugugcaccacauauucacgcgcacgugcgcacacacacacacacacacacacacacacacacaguacacuuuauuuuauuccauuaagaucaaaaguaauauguagagaauauacaauaaaacauaaaagucuaauaaaguaaaauaaaauuuaugaugaguauaaauauauguuagaauauacugagacugggaaacauuuuugaacuugaguucuuuuggggccaaagccaaaugggaaauagugucagucacauuuucauuuuuucccauuuuaauuaauuaauuuuuugagaaaguguuuuauauguaacucugguuggccuagaacucacuuuauaguccagacugccucaaauucagagauuugccugccucugccugucucagucacauucuuguaacggcucauagugaggaaacuguguuucuuagguuaaauaccuucauguuuaugucaucuaaacaucaguuagauggauguuugacuuacuaaaaagcugacuccagggcuggacagauagcguauuggcgugguauuugccuagcaugugcaaggcucuggguuugggcuuugguuaccagcauggugggaugcggggcagacucagauuuaugcuuucccuuaaauagcaacaacguucagaagcaggcagguuagggcugggacucugccucaggaaguuuucagaggccuggauucuuuccagcauucuguuuagacauuuuuauggaaggauuagucucuuccagguuguagagagucuacauacacuccaggcaggaaaacaagaagaucaaagaacaacaauacagaaauaucugccuucuuuaucaggaaaacaauacuucucccaggagccuugcaggcucauggguucacaucgccaaucuagcagcugcaagggagugugcuuugguuuuaugaacuacauugacauuucaggugaacucaaguucuguucuaauagaugaagugagaauccacagagcguggguagacauuucauguccugcuccagccacaggcccagcagggcagcuugguucucaggagugaguaggagagacacuguccauccacucucaaacuugagccaaacuugagccucuggccaagguccucucugcugucggcaccuaagagugucugaagaaucaugcugaucccgaaguuuccggaaggaacuucagaugaguuggguaaauuaaagaagcuguuggccgugagucagcugcggcccaucugcgaggacaguaauugucccauuagaagugacggucauuuugcaguugaccuugcugguuguaaucuggcuguugcugggcaggaaaggcuuuuuuccccuacuuacuuucguuuuccuauuuaauauuucagucacugaguaauggaaggcaguggaaaucucaccaccaacuaguuaaaaguuguauuucacgguuacacuaucuaacagaaggguuuauuucacagcuaucaugcuauagccauuaaauauauauauuuuaaaagaguaaaauuaaaaugcuagagccauauuuuuuuaaaacagugauuuaguccacagacuugcagaauacgaaugaacucaagucaguuaugagcugaugugagcugucuuuccugcuaucagagcagcugccccaccagcccggguucuagguguuuccaaggggguugcaacuuagcuggagggagggagaacagagagaauacuuggauccugauugcacuuuuuguauucaucuuuaaaagugacuguucagggaccagccaguaaagguagcuaccaugcaugcugacaacuccacuucaauccacggacuccugucaagguugaagaagacugccaacuuuacagaguugcucucugaccucuucauguguguacuucacaucaugcacacacaugcacacaguaauaacaaguaaacaauuacaauugcuuagggccuuaggcgauagcccagucagcacaguguuugccuugcaagaaugagggcccacguuuguuucccagaucccacauaaacaaauggguuugggggugccuauuuguagccaaacacuggggagauggagacaggcagauucuugaggcuuacuggccagccagccuauccuuacuuggcagacccugggugccagugagagacucugccucaaauaucaagauaacagccccugaggaauaaaaccugugguugacauucaaaaacgugaacaauaaugguuugauaaugcuuuaaauuuuaauacaaagcuacuuaaaaguauauguaagaugguugagaauguucuaguauauguuagugaggaaagcaagguauggaccauggacagugcagccuguguccugcacagcaguaucaauucccuucauguaaaauacaugagggcucagucaguguugugauccaagguggcagugcaggcaacaaggagggaggaggagggcaacaaaaaguuugugagaaauaaaaaggcauucaguguucagaaaugacauugaucauaccacguggccacauguccguuguaaaauuacaaagacauuuuuuuuauagauagguuuuuaaaaaaagauauauuuauuuauuuuauguagaugaguacacuguagcuguacugaugguucugagccuucaugugguuguuggggauugaacuuuuaggaccuuugcuugcucuggucaacuccacuugcucagucuuagcuugcucuggcccaaagguucauuuauuauuauuauacauaaguacacuguagcugacuucagaugcaccagaagaggguguuugaucucauuaugggugguugugagccaucucuuaccugcugagccaucucaccagcccuacaaauacauuuuaauucuuguauuaucuguaugauacaauaugugcaaacuaccuauauguagaguuguauauccacaucaggauguuauguuagucuucaagagcuaaaggugagggaugugguaaacauuuuugggagaacauuauccccucucccuguuuugugguacugagauugaaaccaugccaggcaaagcucuugaccaucgagguauagccccagcuuuuuccccccccccgaaccagacucuuacugaguuguccaggcaggccuugaaccugcaaucuuccuguguaauggguuauaggcgugaaccacuagaguuggcugucucccuacauuuuucucuauuuauuuuuuuuuuccacaggacauauauauuacaagucucaucaggaacaaacucacugggguccuauggacaguuccuuacauuuccacaggagggucugcacacauagagggugggggggguugccuggugauuuuguugucauugguuuuauccuccuucucagcccauggguagccacugagacguauuuggugguauuuuaucauacuguguucuuguaaguuacauauugguuugugugcacagguuauuuuuccacacccaugcugcuggguuauacaucugugagucucaaacucuaauacaggaaaggaggagggucacaggcgcgugggaagucgaagggaauuuagcaauguguaagcagauaggacauacaugguauauacuagguagggagcuacuggcaggcacccaggcaaacauugauacauacugaccacucagccaaguggcacaugaacuuacagacaaaaauauacaggcagcuuagaaaaggcaaagacucaggcuuuuggcauccagggccauuuacacagaacccacauaaaaaggacacucugccaggcagaguuuuaugacagaucacauaccugaucccucuugggguucccaggucaucauccauugucacucauuuugugcugacucauaguccucuggugucagucauaucuuagcugauucauaccagauaucaugccgugaucagcaccaugauuucuaaacauaaaacucacccuguuaugacccuguucucaacaacauuguguuucuuucuucugucuacuccaucaaguccuaugugucuuuuagcuucuucauggcuggagauaacaccuacaaaguacauaggauuuauaacacaaccucccaaccuaacuacuuagcacacucuggcacagaugccaaucaaaaagcaccggaauguacaguuguaucuuaacuugggagaauagagagauaauuacagaguuaaccaaugucuuuacacuucaaaagggaagagcuggguagggagauaguuuaguggguaaaacacuugccuugagaguuaaggacaugucuuugaucuccagaacccacagauaaagcugggaaugguggcauaccacugcgaucccagugguggagagauggaagcagagacaggaagauccccaacagcuuguuggucaguuagucuagcaugcuuggcaaccucuaagucugagaguagacgacccaguccuuagaacaugggcuggaugcuaggcuccauaagaccuugaagaagcccuuguggcuugaaauguuuguuuggaaggaauacuucaaagguacauuuuuuuuguuuguuuuguuuuuuguuuguguuauuuauuuauuuacuuuuuuucccauucccaaaggguucaagaagugcucaaaccauguuuuaacuauguugcagaggaagccuguauuuggcauccagcuucagcuguaucugguucuaaucaagacgcauguuguguuuccaguucacucacacuggucugacggagaagacaccagaauccaucacguguacuucccugaaggaaacccacugcccauacuugucugagcagguggagaggaggcugccaccaaucuacaaaauucgagagaaggugacaugaguauggggcccagauauagcaucucagggcucucugaggaggugccauguuggccagauagcuaacccauuugcccaucugccauacccagguucccagugauagauccauguccucugcagcuacaacugcccccugauccagacaaugagcugggauucuccucgucauuaauagccauggucugccucccuugccagcuccugagcugcugcuccagccgugguagugugagggaggaggcggaaugguuuuaguaucaauaucaaccacacucacugugggucuugacugaggcgcuaggcuucugggaacccagccucagggcuucuaggaucaggccagguuuccaggauuugcuuucugccauccuuauuagucagauaagaggcuggcccccaugcugucaaaagguccuugccagcauuugguucugugcauauaugcaguuuugcauucuugccuccaaagacauuuugaaagagauuuuuuuuuuucuucagagauuugguaacaggauuguuuggaagccccgcccaugcuugcacccacauccugugcuauuaacuccaugcuagugauagacuucauuagccucccugagaguucccuuugucccacgccucucccuuccccaucaccgugcuccgguucugaggacaucucgcaguucugacgugugcuuaucaucucuucauucuuccccagcaagcagcaaacaaaaacuucccuuucucugugcaugacaaccgccacaguuuccagaacucuggauacuauuuugacucugugaguacuucuuugcugacuagcaaggcuucagguauagcucagugguggagcacuugccuagcgugagagagguccagcaucccaucgcugcuggcacagcaagcaguaaacugguggaagggggaucauuauuuugauuucuaugcugcacagcuuauggagacacauguguuucucgagacugaagcaauguccaaacagccuggcaucuuccacgagacucagaaacagucacaaaacaaaagccaccucuugaaacucgcagaguuggguggaguuuuucaaacuggcaccaggcuucugccuucauacacacgggccaugguuacaaaagugucaccucucucgugagauuccuggaauuguuucucuaaggauggcgaguucccugacacuagagagcuuaaguuuuaacaguacuuguuaacaguuuaauguagcauuggauguagaaauauaacacaaggugcaacuacaauucucaaaugucuaguagugacgggaacauuuaaaaaccagguaaaauuaauaaaacagauggucuacuuaaaaaguuucaacuuuuauggugcugugaagguaacacucagcaaaacuucacacuuagaauuucgcccuuuucuugggcuauugccagguauaaaguauuuuguaucuucauuucuuucgaggaucagucgcugguguugggucacaccuuccagcuagccacacaagaugccaguagacagauuuaaugcucuauaguguaguguguugccaagcgaggucagguggaccagaaacauguuuuuccuuuaagaaaaauuuaauuuuauuuuuuaauuguuugagaacuuuucguacacguauguaguguguuuugaucaaaccuaccccaucuccuucucuucaguuccucccuaucccugcauuaccaccaucuucaugcacuuggcuuuaaacccucaaaggccacuccagauauacuuucagcuuagaauauuuucaguuuccuuugguuuguuugaucauaaguccauagggguuuguauauuuuauuuaacauauuuccuccggauuaucaacucaacauguaauacaugcaauagagcaauucacauacaauuauguuuuaacaaauucuuaagcuuuaaaacaauuuuuuuacauuuacucuguguguguguguuaguguguguguauaugugugugugugagugugugugugugaguguguguauguguguguguuaguguguguguguuaguguguguguguaugugugugugucaguguguguguaugugugugcguguuuguguguguguuaguauguguguguuaguguguguguuaguauauguguguuaguguguuaguguguguguaugugugugugcauguuuguguuaguguguguguuaguguguguguauguguguguuaguguguguguuaguguguguguauguguuuuaguguguguguguuagugugugugugugcacaugcgcacacacguguguaagggcauguguaggagugggugaaggucagaagacagcuugcagacaccgguucucucuuuccaucaugugggcucuggggauggagcuuagaucuucaggcucagcaacaagagccuuuaccuguugaggaaucucauugacuccauaaaaauuauuaaucaguuauuuuacauguuccuuuuuaaugaacucucuuaaacaucugauugaccuguuacuacucucaauuuaaacugcucacauuuacaugcucuguaacuaguggucuggggcuuccauacuggacauuacagguuaguguaccuuaggcagaagaagguaugucaggugagcuucaaggacacguaucaaacuugaaaauccacacgacaaaggugcuguuagcaacauccugucuuuauuaacccaugacugugcuccagugcuucacaugaucuuguuuaagucccauagcacuccugugggcuaauugcucuuauccuugauuuagaaaugagcccagagaaaccuuuuccuccacacaacuguguuccaaguaaaauugaauaacuuaaccuaaaaaccuccucuccuuuggcagaguauagaauagagucacaaaacauccacccccacccucuccaagaggauggauuaauuaaaaaaaacaucaugcuuauuuuucuuugcauaugaauauuuugccuugcauucaugucugugugccacaucaccacuugcaugccuggugcucauggaggucagaaggaguuggauacucuggaauuggaguuagagaugacugugagccaucacguugguucugggaaccaaaucuagguccuuugcaagagcaacaaguacucuuugacuucagagccagcugucuaacccugcuuaauguguuuucuagauugcuacaguaacacaagucuaucaaaagccaaacaagggacacugaggugacucagugggugcuugcugcugggccugaauuugaucugugggauccacaugguggaaaaagaagcuccuacaagaugcccucugaccuacauagcaugcaugcucucuuucucugucugucugucugucugucugucugucugucugucucucucucucucccucucucucucacacacacacacacaugcucaaacacucaaguaaauaaaaaaaggaacauuuuaaaaaagucaacccagauuuguauaaacuuacaaauaaaauuugcauccuuauuucugccuuuagcacuuuacccuggugcuuaacugcuuaucagggucuaguggguagacccagccaaguguguaucuuguuaaugacacaagcagaccuggacacaugcaucuuuagcaggcgaggagacccuccagccagccucugaagguuucucacauguccucugugugcuagaauagcuuacacagccuuaacauuuggauuuucaguuugauagaacuugcccaugggacccaagcuggugccaguggcacagggggauugcuugccuacugcacaggaggcccuggcuaaauaauuuuguccaugaaaccacuuagguuugguacauuuuuguuuuuuuuagaauaagcuuuuugaauauggacuugacuauuacucugucuauuaacuuccaagcgucugcuucuuauugcauggaguuuaacgauguguuugccuaaaauuuaucucauucauuucaaacuuaaugguauaauguccaaguacccuuacuugucuauucuuuaaaauugcuucaguugacuguggaauucaaauacuuguaauuuuuguuaauaagauuauuaaaucuacaaauauucuugaguuguuuuggcuaccagggagauauuauuauuuagaccuaauuaauaauucuaauauuguuccauuagcugaacagaguaaacucucugaagguguugcuuuauuuggggggaaagcugcagggggucguuuuuauauccagaguguaguagcuuguuaauacacuuuuuaaacauuuacauuugaagguaacacuuaggaaaauauuguaagucagaaugagcaaauaaaagaacaaguaacauuuuaggcaaacacaucauuaaaaucgguauuaaucagaccuaauuaaggucucauuaguaguugccuccaaauagucuuuauuuaauuuuuaauuucccuuuuaacugagagcuauuuggaagauuccuugaauuucugaugugacuagaguuuguuagguuacgaauuuguugcuaauaucugauuuugaugucccauuaauuuuauggagggcgcucugugauuuugacuuuucgagugauagagauuuuuuuacaugugauuaauuuuaaagugucucauuagugauaaaaagauuauauagucccucauuuaauugcaaaauuauugacugaggacugcuaauuauguuguaaaauauuucuuaacucuuugucuugguuugucaauuucugcuucugagaguuacucuuaaaugucaacacuuuuugguuuuugccuuaaaucguuuaguaucgugucuuguugcauaaagauucaugauugcuuuauuuuuaucuugauggcuuugccaguuuccaccgggagugucccucagccucuguguugcuuuuagccauguaacacguuguacuacgaagugucauuccuucaucuucaugaauuaaaaauacauuuuuuacuaauucucugagcguuucauaaacacauacaauguauuuugauuauauucaccccauucuuucuuccaacgccucccagauccaccuccuaccuccccaacccuucccaaguucaugucuuuuuuuguuuuuuguuguuuguuguuuuaaauaacccaccaaggcuuguauacucauaccugugggagcauccacuggaguuguuuuuuaucuaccacuuaccauacccaucaggaaaaccgacccuccgucucucagaagucaucagcucuuuauagcuccucagaaaggggcugggcuaccgagucccuccuauuccaugcuagaccguugccuggcuugaucuuguccgggucuuauacaggcagccacagcagcuguaagugcuuaagugugauaguccuguguuguucugaacucaguuuccucuggucuucccugaccucuggcucuuacacaacugucccugagucauggugggagggagaguaauacagauaucucauuugugucuucaugaacuuuagucauuuugcuuuggguuuaucuucuguuguaagcagggugcagcccaauuuaaaaagaaaaacaauaccgaagagucacuguuuuucugcauaggacuuugagccaugaacauuauuaugacaauuuugacuuuauacaugccauucacuuuauucuguauaucugcaauaucuauccuuccuuccucccucccucccucccuccuucccucccucccucccuccuuucuuuucuuuccuuucuuucuuucuuucuuucuuucuuucuuucuuucuuucuuucuuucuuucucucucucucucucucucucucucucucucucucucucucuuucuuucuuucuuucuuucuuuugucucuuuucucacauugcucuaucgguuguguauucuauuugcauauucugacuucuacugacuuuuuacuaauauuuaacuuucaauacaaauguuuaaaauauaugcuaacaaggcacuccuuucuggaaaauaacaacaaacaaacaaacaaaacaccccaaacaacuccugcagacuucucuggaacaacggggccccuuccugagugccauuccucuuuucuuuccuuccuggggcugauagagugguggcucuggcuggcuucuccccuucucuggaugagcccuaaagggacuucccugcagcucaguaacugguccuguuuucucugaucugguuaaaauccugcaacuucccuccagucucccuuuuccucucucccucccuccccuccugcacccuuccuuucccuguccaagccucccugcucccccuacccccacccccaccccagcucccuguuccuuccucuuagguuuccgugcucagcaccaauuuugacuucuguucccagccacuuuccgugcagcucuucccuauauuauucauauaauuuuuauuuccuuuuauuuugcuggagcaucuucaaguaacuucccccaaagaugcaaugugaccagggucuucucuuugucccuacagagccucccucccucccucuuuauuuccugcccuagccucacaggcuggucuguacagacuguacaucaggagccauuacacuguaccuggacauuuccccauacucuacuaauuuuacaauaugugaaugcagucauuccuggacaucugugcggauugguucugagaucccuguugaugucaaaaucagcagaugcuugucucuuacagacaaugacacagcauuugcacauuuccccucuaaucuacuuaccauauagugugauacuguguaaauaguuuuaauauuguuugggaauaaugcuaaugaaagucuauacauguuugguucagaugugauuagaguaguuuuggugcacgcgcgcgcgcacacacacacacacacacacacacacacacacacacuauuuuccaucuccaguuaguuggauuugaggugguugaaguagggaggcaaaugccagcuguggcacuuuguagacucucuuucacccugauucaaguaucccacucaagggcccuguugccaccuuguugaugggcccuuggagcagacaguccugauguaaucuggugucugucucuuuucagucuuuugugccaacauccacuuucuuucuuaguuuucagcccauugugaugaaucaagcgcucaguucugaauacaggaugauucucagguucagauguaaggugcugauagcaagcaagccuguggguagagaccagagguccugcuuugcuuccuuugggagacaacaggguuggaaaagaauucaaccugccaguucuucagaggcagccaugaguacugugacccugaaaauugaggacgcugaacagaugauauccagcugggcuuccucugauuuugcuuucauuguccuaaaaguccaguccccuugguggaaaggaagcugagaauagugacagggcacugccaggaugucauugacuuuugauauucaacaaguuggcuuuuuaaaugguuaucuuaucuaugcauuuaaauauaugccugucauuagcugguuucauugagauccucagaacugugugaccuuguguaucucucuccuaaucuuguuccucuuccucagggcuuggggcgcaagaaguucaccccagaucaaaagcaacacauuucuagaaauuucaaucucugggccugugacuacaucccauccaauuuugauggucuuucaaauaaccaaacauccuacguaccuaagaaagcuguggugaucucaacuuuccgacgauuuccaagauauuaugaugagaaauggagugacuacaaguuugcuuacaaccaaaacugugcaaaguuuuugggauaccagccaaauggagagcuugcuguugacccaaagguugucucuccccaggcuugugcaggaucccuaaaccuuccagaggcucuugaugagguuugugauguuaucccaucaggcggucauaaagacucugacccaacacuaccucaugauugcugaaauacuuuugugauuuuuauaagguugaaaaauucuuaggaagguacgugaagcuauugcauguguaaauuaacugcuaagauugucauguuaaccuuuggggguuuuaaaaaaaauuuuguacuucauauaugauuaaauuaucauuuugaaaucuug

SEQ ID NO: 4150 - RNA, 35346 nt, Mus musculus
agcucuuccuggcagccgccggaagugcgagccgcugaguguccgagucgcucgcucugagguucuccugcgacucugggcccgcguuccugucgccgccuccagggcucgcgcgucuggucgccuccccagggucggaaaugaugggggaccccaaggaagcaggagccgaggcuucuccuucaggggcggccgcccgaggagggcucagccuccugucccaggcggacuccgaggagccuucugcacaggugagaggcggcggcggcggagcgcgaccugcaggggcuugggggguuugcgggccugggagggggacguggggcuucuggaacuuucuuccacgccuccuuagcaccucuaguacggaaugaaucaccaggcgagccugucgucgggugugcaggcaggcguuugcuugcaaugcgcaacaccccuggcuucgcacucggcgccaguggacgggcuauagagugugugugugucacagcccgccgaaggcaggcagaggagagagggacggacccagggagggcacagagaauuugcaacgccuggaaggguucucgaaggagagucgaacagcggguccagacauugagcaugcccggguggguguagggucagcuacggagcuaauguagaaugggaugcgaugagcuuaccgaucaaucgcuguguguuugguaaaaauaaacacguccugcaaaugacguuugucauugacuuaugcuacuuaaaaauauuccauuagaaccguacagaagucuugcucguuuuacaugcgguugacaggacacaguugagcgcacuuaguuucugagucuacauuuuucugugacucaucguaccggguugagucuuggcugguguggaacugguuaugcagaccgggcagucaagcuggacguagaccuugcacuggcccuugugccucugccuccagagugcuugaagcuuguguuugcaacuacuaugcccagauuuuuaaaaagcagguugguuggccccuguccacuucuugauugauccuuuuuuuuuuuuuuuuuuuuuuuaguuucgugaaaaacagcuaaguaagcguaauuuaagcuuguuuauuaaguguuagagcugacacgcagcugaggcuccuugugaauccugauuugguggguucuuaauucauuuuuaugaaagugagauugucguuccuggcaguguucauuaaagcuucauuccauauguuauuuagggaucggccuuauuucuuggaggcaacgaagugaaaagcagagcugugguaaaauacucuucugccccuccucgaacagcguuugcacgucucgaagaaaaaacagacuugaaacucccaccugccaacugguuacgagagagugccaaacuagggccagcaggaaccaccauucuuggcaauaguaagaaaagcaagccguuuucaagguaaauuuuaaucgcuggcauuucuuucccucccucucaaccccggcucgaagcucugaaagcugcuucgcaguucaauuggagaugcauguucacuugcucagauauuuuuaguaaaagaauauaguugucauccaaaguccaugguacaguaagaagauuucagagguacaugcuuucuuccaggcugcagcaugucacgauaacguguacacguugacugcucaucagcuguuuuagccuguugugucugcuuucauaugugcaaauaggaugguaugcgaggggcaagacuuaagcugcugcucggcuugcccuuuggaguguuuauuaaauaugauggaguauuuggaaaagccugagguuuaaaaccccaaaugcuggguaaccuacacccuugacccacacuggaaauucuacuggugguuuuuaaaguugugaguauuugggagucuuaugcugugucuauauucuuguaggcuguuuuaaccguguuuucuuuuuccuccccugaaugauuggacuuaaaacauuuuuauauaacuuauauaaaacuuuauauaacacagaaagagccacaaaugcauuaauacccugagcuaguaguuuagagauuauccuagugccucaaaagguaauagcuuugcuuacaaguugauguagcauuuuugauacugugaaaagucugaaaaugaccacauauuucgacuauuuuaaaaauggcuuaauuguauuaaauguggugaguugguuucaguaguugugcuagauuuuuuucuuuuuuaauauuuauuuauguauuauauauaaguacacuguagcugucuucagauacaccagaagagggcaucagaucucauuacagaugguugugagcuaucaugugguugcugggaauugaacucaggaucuuuggaagagcagucagugcucuuagccauugagccaucucuccagcccuaagauagacacuauuaacuguuuguacaugagaaaugaaggcuaaccuacuugcccagagcagauagaaaaucauacaugcauaugcaguccugauuaaauguccugacucugccaccuacuaaggggaaaauggugacauccguugcuuugcaaccuuauagaugaacuuggugauuugaaugaguuaggugcuuaccaguuuuucauuuucucuuuaagcugaguugauuuuagguacaauuuuuuuucuuuuauugauguuauaucuuuauauguuauauccauacauguuaacauauuuuucucauuuuguuuuucuucauauguggaauuaaaucuugaacuguuuugcaucagagagguuaaggguuuaugcucacacugacugcuuuuugcaguucuuacugucucacuaaguugaagaugcauuuuaaagaugugcuucauuuucuguguaccuaagaagaaaugagaaguuggcagccagauggcaguggacuucuugauuuccaaaugugaggugugcauguccuagaagcaguagacaguuuuacucuguucagccuuccaucuguggccucuuccuuccuuccuuccguaguuucggcauggcguaugacuucauugacucggugggaaaugauguggaugucgucuccgacucagaagugaguguuuucacggugacuuuggggauaugcagugccgcaggggaggggaggaggauguuaaaacguguuaugcuuuacagucuugcuaucagcaauggaauaagacaaaguuauguaauuauucaauaccuauguuugcuuuaaaaaugcuuuuuaucuccucuaagaggaggauacaauuccaaaacagugggacuaauaaaaaauaugaauacuguugguuguauuuuaacaguaauaauugaauauguuuagaguuauucugugucuauuaccauuugagaauuuaaaaugguauacuaguagcuguuguccuccaucccuauaaaaaggaauuguacuguaauagaauauguaauaguguugggcugcacuuacauugacaguguaacucagaguuuaaagcucugcccucuauaugauuauuauuacgaaaagucuaguuuguguaaccuuaaauaaggcuuauuaaacuucagauugaaugaaguuaaacuccauaaauucugggugauacuaauggggccucucuaacucucuuaagaacauaaaaaagcuccugaagauucccuacagcaagucccacgugagcauggcugugcaccgcauaggaaggacccucuuacuagaugagcuggacauucaagaacucuuuaugaggucaucucagguaacuacuucaugcaaaaaucauuuagaaaagcacucucuuaauaugaaagugugguuuuguuuuaaggaaaugccagagucgggcuaagagcacuugcugggcaagcacaaggaccugagucagauucccagaccuugucuaaaaagcagagcauagucaugcaggccuggagccccauuacuguggggagcuggagauaggauggcuagggcuugcuagcuuggcaggaaccggaucaggaaugacaaaaaacaaccuugggguacagcgagauagauggugauagagcaggacaccugacaaccucaucugacauccaaaacagaccugcacgccugagcaucaaacacacgcauauguacauauucauacuuaaaacaguuuuuuuuuaaugccaaauuggaauuguagcugaguacuucagcaauaaagaaaugagcuguuugaucagagacuuaaaaauagagaaaagcuuuguuaaagacaaagcaucuggucaugguugguggaaugcaaccaaccucaggcugaggagacagaagcaagagugaaucucgaguucaaggccagucugcuguauguagaguucuaggacagcugggccuauauagagagucuuuaaaggggggugaggggggagagaaaagaacagagaagaaacuucguauaauuuuuaggugcaugauggacacaucugugaaccacauggcaugccuaauaacuagggaggccagaagagggugcuggaucauacagauauuugugagcuaccacuuggguacugggaaccaaacccagguccucuggaagaucagucagugcucuaaaccauugagccaucucuccaaacccauuuuuuuuuuaagcugaauguaaaaccaggauucugucuuuaaaaggaugaagucaguuuuuaaaagaaaggauugguaaaucugugagauuaaaggaacuaauuguuuuugaaaauucuuuuaaugucuauuauagacauacucuggaaacauggcuggccgaaacguaaacaacguuaaagagcuguuccuaugaguauaacuaauuauacgaguugauuucuagcuucucaggcugcugguccguagaugcuuucccccaggugauaaggacaguugugacuucucuaggccuacuugaugcuugccuuccugggcugcugacaaguacuugaugguucugccugucuguacuaccuuuuaaauauuccuacacagugcuauuuuugcuugaaccuaucuucaugcaugauagauaaguguucugucacugaacuguacccaugaacaccucuuuccccagacagggucuugcuaauugcccaggcuggccucuaacucacauuguaguucacccaggucuuaaacuuguaauucaccugcuucagucuccagguagcugcgaugacagaccugccuaccaguccuaacuucuccaaugcuuggauaacaaaaaauaaguuacaagaaauuaauuugauaauauaguuucuuuagaaagcaacacagugcagcuuguguguccuguacuuggucagaucuuagggugacagugaacaagucacagcccuugcuccuuaguucagugugguuguugagacacacauagguacuuugauuaaaguguaaagcggggccuuccucgggcagcugagaagguacuguaggaaaggauuuccucuccaggccuagcuagaagagaaacguaggagauucuuagaugugaauugggugcagaaaaaucaaaguguucuuucuauuguucuuccuauaagugcaugcucaugaaacaaucuguagaaacuaaagaauaucugcuuuuagcugagagcauugggugagugagaaucggugucuugcuugucacagagaggaaacauccagcagaagagcaggagggacgugaguguuguucugggugggugcagaagcuccauccugucacccugucacagcacaacuccuuagagccagggugagacucugcuucccucaugaugaccgaaaaguaaagagagagagaaggggccaggagugcaggauccuuucaaggccacaccuccagagaccuagcuuccuuccucuaagcucugccuucuagagguuccucgguaucuuagaaacaccauuggcugugggcugagcuuucaacacaguguccaguauucaucacacgugugcauauuuguucgguaaugucucguuauucagacuggugauuggacaugguugaaagaguucuaucaaagacugaucgaucagaaguggcagaggaagaagaaaagcaaggagcacugguaucagaaggcuauucuuuccaaguucuuguacuacagguauuugacuacuguuuaucuuugucuuaggaaaaaucagauucuguccuaaaauuuacaguuugaauaggguaaaauuugcaguugaaguuuugcuuuguuaacacuaacuauguuucuuauagacaagaugcaugcuugauuauagagucuguuuuauacagacagguaggcuguaguaugaugugucacguuuuccucucuauuuccgguugacuagcaucaauggugauggagcugcgcagccugucccgucuccugcagaacaagaagagucaucgaguucucagcagacacaugagucugaaggggccgccuggccugcucccuuugaaaugcccucuuccgugucugaggaucccagugcuuccagucagguuugucaguccuuggaucugauucugugaacucacucaggagagcagagcugaacuaagcaggugaugaagaagggugagggguauucacucagccucaucucaggguuagaaacaaaaaugcauuuagcuuuccacaguagaauauccagcaguuaacaugaaucaggguuagauuaaauaacacaaaauauuuuaaaguagucaacugauuuuuuuuuucucuuaaaauugaguacgacugaauguaaaguguauuuuuaacucuagauauguacuaaguaccugucaugcauugagugauaggugugccuauaauuuagguuguuuggccuaaauuggaugauguuccuccuggaaaauggauuuggccccacauuaucauauaaagauuuuuaaauauuuuuauuuuauauauauggguauuuugccugcaugcacagaucuaugugccaaaugcaugucugauaugauagaucuccugaaacuagaguuccaggcaguugugaguucccaugugggguucugggaauugaaccaggguccucuagaguagcaggaaaguguucuugacugcuuagccaucccucuaagucuaugugacgaaagaauagacuguugucuauuuuauuuauguuuauuuuaugaauauggguguuugccugccugcaucucugaguaguaccgugugcaugucuggugccuacugaggccacaaaagaguauucagucuccuggagcuagcguuaacugacacuugggagcugccguguccauccuggaaauuggagccagugcucuuagccaucccuucagccccuaguuacuuguuuuuaacuuacucugucuuccguaggaugaaauaacacuguagaugcuaauuuguggcauuucuguuuuuaggaagauacacuaaaaugagucaaaagaaauaaaaguagaccuuuuuacccaaaccaggcacuauuguggaugcugacaggagccuaagagagcugucuccugagaggcucugccagugccugacaaacgcagaaguagaugcucacaggcauccauuggacugagcacaggguccccaaugaaggagcuagagaaaggacccaaggagcugaagggguuugcagucccauaggaggaacaacagugugaaccaaccaguaccccccagagcucccagggacucaaccaccaaccaaagaguacacauggagggacccauagcuccaaccacagaggauggccuugugggacaucaaugagaggagaggcucuuggucuugugaaggcucggugucccaguguaggggaaugccaggaguggguggguuagcaaggagauggggggugggauagggggguuuucggaggggaaaugaggaaaggggauaacauuugaaauguaaauaaagaaaauaucuaauaaagcauuuuuccaaagggaaaaaaaguaaaccuucuaacuugguaaauuggguuuuugucucgcuguauauugucauggacugaacaugaauucagucagauuggcucagucuuuacacauaacagacuuguaaaaaauuagcacaucuaacuugcuuuuauuuuuuuuaaaaaaaaggcuaacuugauuuuaauuuuagagauuuuaaaguagagaaggcauuccauaaaaguacguauuuaaauuugagguguuugguuuuuccccaaagagaaaacaucaaaggaaggaggugcuuaauaugcaagucacuuagugguuacaggaagaaguagaggcguaucguuuuguauucgguacuugauguguuuuauugcauguggcugucuguaaccagaggauucuuagaacucacauuacaguggcuagaacaguggcugcguagguaagcucacacugcucuugaaggucugcauuccauaccaucacccacguugggcagcuugcaaaugcuuuaacuccagcuccaggggagccuuuguguuccucuaagucaguggacugagauaguucugugaaggcagcagcagguccaugugugcaucucaaggccaaaggaagagcaucaauguucuuggugacagcugccuagcggcugcagugcugugguguggcauacuguguucacccaaaauguggguauuuucuaauguaguccagauucugggaagaagaaaaggauagggcuacaaaaaaagacccugucucaaaagaaggaagaaguaguuucaauauuaaaaaaugggaggacauuggauuauacagagagggagguagauuuuucuaauuuaauaccauuuaaaauauuuggauuuuguguuguuugguuuuguuugguuuuuagaacacuggugggaaugauguucaauagacauuaaucuucaaaagcagguuuuuggcaggcagcagauuuucacacuaauuggaaaguucucuaggguuuaggauucugugacgcucacauaggacauucucaacuggagacuguggaaggugaagguuguuuuaaacuguggcugaggugccugguguuuuaguucaguagagaucugcugggcuuccagagagugguaaucaaacuuaccaaaaaccaaggaaugaaaagugauucuuugaaagaucuuuaaacccaucucauuuaagauauggauuugauuggcuugcagccacugugggaaaucagagcuaaagcaagccacaccccaugaguuaugaacaccgugcauuguacuggcuaauucauacagguagauugggauauguguucuugugcgugggugauaguucuguaagcauaggucaauuguaagacguguuggcagcacagucacuccuuaucuugcacuuuccacagggcagggagccucuugagcccucaugcauaguggggcauguggccucagcaccuaaagagcaaaaccuuacuacuuuguucaaugacggggagaacagucagguaugcuuuccaugugcccaucugcgacaacugaucccaguccacuucauccuuugagaacuagucucaguuggaacugauagggaauaauuccacuuggucuucaaaauugcuuuguaaacaucucugucuuacagcucucgggaauugaccuugucuccuuugcuucuucuuuucugguguuucuuuggauuauggggggaaauuguuaaucuguuguuguuauuauaaucuauccuguuuuaaauuaaagggucuuaaaaaugauuucguccggaauauccuguggacuuuugaagauauucauaugcuaguugggucuaacaugccuauauuugguggaggcagauauccagcaguuagcuuacgucucagguaaaccaccuuaugcccccuugugcuuuuuuuuuuuuuuuuauaaacaagcuuccuuuaaagugaaacgucucauuaacucuucucuggcuguugguuuguccuuuccccaccccacccccccuucuuccuccugccaacgagauggccacaguaaaaaagaaacagaugcugagagccuaguaaacagguguuuauucugauccugauugaaagaccagacuguggaccugguuucgucuuauguuugaggcuauaacuacuaaaacuagaagaguuaauguaauugcuugaggugguugaccaacuuccccuuaaguaauuguaaacauuuucuuaucacucgcuccaugcucauucaccaacgucaggucugacuugggcauauuauuauuauuauuauuauuauuauuacuuauguggucaguguuuccuuggcaugugugaggagcaugcagggagcucagucaggucaucauaccaccuucuauuuguacugagaacuuagcaaugccuguuagaaaugcaaaguuuuuggaaagauuuuagacauaacacaacuacugagcuauguaugggucuucagauuagaaagugucuauggcauucucugucuagagagaaaagaguagaauauuuaaauaggaaaauacagcuaagaugauucauuaugggacauuuuaauuaagccagauaacacuagaaauguacauuuucagggauaacaacaaaccgauuaacguguuaacuggaauagacuauugguuggacaaccugauaugcaauguuccagagcucgugaugugcuuccauguuaacgggaucguacaggugagacacggggugaaggguucuaagcuuccaaguguggaauggugcagaaggaacuucauaauuuuuaaggcuuuaaauaugaagaugugucuuuggcccgaaagauagguaugaauaaacugaaauuuuaguguuuuuaggguuaaguugguuagagcagaguuuuagauuuucaggaguauaauuauaaguaauguugugagaaggucauaaacacaguugaagccuguacuguuaacucaaaguaagugcacaguggacacauuccuuuguuuuguaaacagcugcuccaucuauacaaagcuuuaagaaaaugccacaguuugcaucuggcaagacugugcuuuccaguaccaaguccccucagggcuguaucucagagucaccuaagcauuguuaaacaacugcguuuggaugccagugaaccaagcuucuuuucaagaagcuuuguacacaauucuaauuuucaguguugcuugagaaccauuuaggccauaacccuaagagacagcuguagugauagguaaagagauaacugcccacagcaggcagagagggggaaguauuaaugauggggaugggggaagaggugggggagucccaggucuaggacagugauacaguucacugagaugggguauugcuacauuucagaaugaggaaaucauaaagagucucaugaguauucuuaagauacagugcuagggauguuggauguggugauuuguaugugcuugaucagggaguggcacuguuagguguggucuuguuggaguaggugggacacuaugaaugugggcuuuaauacccuaguccuagcugcccgaaagucagucuucugcuagcagccuucagaugaagauguagaacucugaacuacuccucuaccaugccugccuggaugcugcuaugcucccaccuugauuauggacuaaaccucugaaccuguaagccagccccaauucaauauuguccuuauaagaguugccuuggucauggugucugcacacagcaguaaacccuaacaaaaacacugggacuggagaacaaguuggcauuugaucuggauaggugcugauauguugccucaccaaagacucgauuauauaaagucacauauuggaguucccacacagaagugaaauugaaggggaugaaggggauaguacagaaugaaaugcuggagacggagauaaccacauugaggaucacaguauaaaaggaugagacacaccuuguuugauguuaggaauaucuagucuuaaauauacaucagaaaaugugguuagagcuauuuagggcaguuugcacagaacacaaacuggaaaaauacggagguaucuuaaagguaguaauaguuggcuggguuuuagcuuagaauagcagaguacuugcuuaaggugggaggcuuuuagcauuauucccagcaauacaaaacaaacaaacaaacaaaaaaacccuauaaaaucaauuguaggauccauacagcuuuucuucuuuuugccacuucuacccauugugcuacauuccugcaaaggaaaauucugcagguccaggaaaaacaucuggagugauguucuacccuuggcccacugacacaugugucuggagaaagaaaggggccagaaauuguguguguguguguguguguguguuucuuaaagcuugauagguaaagcccaccuucaguuaccuuccuaguugcagacaucagguggagaagaguggucuguccaugcucugguaggaacagugcuucuccuggggucacuccuagaaaaugacacuaaugaucccccuuaugggcaagggaaggcccucagcuccuuuugccauuugaaacaggaaaaaauugaaaaacaccagcuuaaacuauaugcuacaucuguuuguacuuaggacuuaccuauuugguuuuuaacaguaaguugcuguugccucaggguuuccuaaacugcauucauuugugcuuuacagaaauaugaaaugauaaagacagaagaaauccccaauuuggaaaacucuaauuuuucuaccaaaguuauaaaagacauugcacaaaauauuuuaucauuucuuaaaucuaauuguaccaaagaagggcauaccuauuggcucuuuaaagguaagcuaaugcuugaauggacaguagugauuuaggugagggcuguagcaugagguaaauugucucuguuuucagcaagcggcagugauauugugaaacucuacgaccucacgacucugugugaagaaacugaagacaaguaccagaacccauucacaaugccaguggcuauccucuuauacaagugaguccucgggaacucaggugucagugcaguguggacacacuugggaagcugagggugaagggccuguuccagcuagacccugucugaacacaaaaguuuuaagauaagaaaguagucccacuaucuaagcuaaagauuuuaaguacuuuuuaauguuuauguugugacagaguauaucuuagagugggacuggccuguggguuggaguguguugagcagagaaccacacaggcacuuuauacuaaauaaucucagccuugcuguguaagcucugucauggugggugauugagaugcagcaucgggugcugcuuugugccauuuguuccauuugacagauagaggacccgccuccauuguauccugcaagagaggcuaaguggguagugaaacuaccaugcucuucuuucaggguugcuuguaacaugaugaugaagaaaaaucaaaacaagaaacacuauggaacuauuagaacauugcuucucaacuguguuaaguuguuggacaaaagcagacauccucaaguaagauugccaugccugaugaguaagcuaguccuggacuauugauagagcauuguugcaguggagccuggucagauccuuucuccaugcuguaucccucuaacugcaugaagcugaguacuaaggauguguuugaucugaauugaggcaucugccgguguaaaauacacauugaauuuuaagaaugaaaguuacguugaaacauuuaguagauguauaauuaaauguaugaaauuguuuacuagauuuuauaucuuaaacaugacuacugaaagauuuaaaguucauguguggcuccuguuaacauuccuuuuggacaguucuguucagugacaaacacugaagugucaucuuaguagagugugaguuuuccuuugcuuuaucacaauuaaaaagucuuuuaaaggauuuauuacagagaugagauuuguuaguaagggaggcucaagauccauuagauuuucccucuagccauagguuauauaguaccuguuagcugccuaguaaagauuaacacucacaguuuauaaagagacucuggggaugagauggaaucugcuagcauuuuauuuauuuacacacgaaagcuugucugcaguggcggaggaggagggcucagaguccaccuaaugucuagaaggaagaaaacagucagucuggguuucagagcacacuguccuuugugugguaucguggugaaaacaacuuuagacuuccccuaagguuuucaguguggugaagcagcuucagucuuuacauguauuucuuucuuucuguuuuuuuguuuuuuaaauaagauuauugcuucagccaacuacaugcuuucagagcuuuuccagcuggaugagccuaaaaaggaggaaaguucagacuccccuuuaaaugagaauucggaugaaagcuacagugaagaggaggaggagauggcagacagugaugagaauggauccuacagcaccagcucugacccagcagaugacaacaaggcaguggcuaucauuaagucuguuggagaacugucaguaccggaaaaauacaagucgauucaucagaucagaguaagcagcucuguuugugucuaugcuguuuuccuugcagaauagaauaggacauucuuguaacugacuuaugaguucuagaacuugacuuuaggagcacacagugcaguaaaauuaccuggaguaacugacucacauuauauaaagccauggugaacaaaugugcuaaccgcaaguccaugguugacuuuuucugagggggauuuuucuuucuguugaccaauauauaguauuggucucuuuccccggcauugcuguuuaguauuggaacaguugguggauuacuguuuagugagcauagacucaguugagaaggggaugccccuuagguguccguguggagaaaccuggugaguuaccacugugucgccaguaccuguuucugugcucuuaugucugccucaguuggggccaggugaaccuuaacaacuucauccucuucccgucugucucucggcaugaguggacucuccuuguauacuaccucccuauguucagguacaggguuugaaggcauaccguucuuuuacccuaaaccgcugccugguuuuucugaccugcuuuucucccucccacacuucuuuauuuuuuuucauaaagaaaagcaauuagagccagucaagguccugaccuguugcuucugcuuagcacgugcuuuuccugauguaguuuucaugacugcccuuuuuuaaggcugugucuuggcuaaauggugucacuucuuccuucggggucccagaucacuuucaccacaccaugcuguuuuuauuucucucuugaaccugucuguaccugauagcccuguacuacauguuuucucucuuccccagagcauaagcuuacaucuaggacgaguaaugugcuuacaaagaagucauugucugaaucuuaguucacauuuagcuugagccccacgcuuuuccaguuaagucaguaauuacuacauuucaguguacuagggagacugcauuguaacugagccuuggacucacaagacaguugaaugguuuaaggaugguauggaguguuaagauucucugauuuuauaggaacccucuuuaccagugucugaggcacacagaagagugucgucaucuuccugggagcgaucuuagcuuugcuuggccuguguggggugacuuaggaguuugcagucuugguuccuaauucucauuuacucacuuuguccugagucaucugagugggucuuccugugaaugcuagugauuccagccucccuagaaucaacaaaaugaaaugcccuuucguuuagugccacuuagcagucagaggguguuaacagguuguuucuuaauuaagcaaauaaggugggagugguacuuuuuaaccuacuaaauugauugguguuacucucagugugcugcugucagcacuaauaaaaggugagcugaccuguuugcuuuggugugcauuucucuaaagcauuacuccucuugcacuuuugcuuuuaucaaauagaauuauuagaacuuuaaguguuuggcuacacagucuuuuguuaagcaagauuugaaacagugcugaaaacauuuguaucaguuaccucaccaacugcaauacaaagcacauuucuaaauuauugcuuugcaaaguuguaauaauuuugggaaaugggagcuggucuguugggagugguagcaugcugguaacuugucauuguuugucucugaagcccaguugugcauuucccguuugccaugacacagaagagcgcugucgacucguccuuagcuauguguuggagguaagucuagaugugcuccucauugaucaacagucugugcuuauuugcaaguagcaugugguuuguuggugucuaaauguuuugagugauguccugcugugauuuuauuuucuucaucuaaagcaaaaaccaaaucauuuucccaagucuuucagaucauauguaguucuaaauaucugagguagaaaugcugcugugugcuuaaguuuugguuaacuauuagugaguggguauagcaaauguuuuucuuuuuaagaagggaauaaagguauguguuuguguguuuuacuuuuuaaaggguuuaaaaucuguagauaguagcaucaaaaaagaaagcgaccuuccagcagcugaccccagcacuccuauccccuuaaaauaugaagaugaauccacaagggguggcccugaggggcuggagaagcagauggccuuguuccuggacaaaaguaaguugguugguaagcacuuaaugucuucaguagagcagcacacuccccuguagccagacaggcugugucaggcacuuacugggagggauugagcaaaagggaagccauggagaugaagagucagggauccuuuccuuggaagcuaauuuugagauuuuuccuggugagaaccuaaggaaccugcaccucugcuggcagccuggggaagccaccaggguuucagggaaucgccgcccuugugaagugugcggagucuuaagagcaagagaaccagaucacucccuagcccugaaggacauggccucuacucaauuaagcugcuuuuucuuucucacacuggagacauugacagcagcuucuuuagaggcucuuagaagauguaaaggguggucuggugagaugucucagugguuaauaacuggcugcucuuccagaaguccugaguucaauucucagcaacugcauggugacuggugaccaucuuugaaggaucuaaggcccucuucuaacagauauagcauguagacagaguacuccuacauuugaauaaguauauaaaaguuuuuaaaagaagaaguaaaggacugauaggauaaugugcuuagagaugcguacauuaugagcaccuaucagagauggcugcuauugugccauaguugaauaagcuagaaauaguuauugaaauuucuagagggucccucuaggucaccuuucagaaagacacuguggacuuggaaauacaaaucuuguuucuuaauaugaauuauaugucccuuuccauuuauacucugauagucaguuccaguuugaguuuuuguuguuuuguuuuuuugagauuuuacucaauuuuuuacuugauauguuuagauaggugguuguuuggcuuacaugucaguuuaccacaugcaugcagugcccacagaggccagaagaggacaucgaauccucugcaacuggaguuacagaugugcgccaccauuugggugcugggaagagaacccaggccuuuuggaagagcagucacugagccaucuucuccaucccucaguuguagcuuuuuuguuuuguuuuaaugguuugaaagucuguuuguuguuguuuugagguaauacacauguagaaaugauagggcagaugggcuagauuucuuucucuaguacuuaugugguacuccuugugugcaaggcucguucugcauucagagaacugcaccaggacuucacuguugccuagacugucucuucuuaucucucuucccuguugaaaaacccugcuccagugugggcuuggugacuccguuguaguccugucacuugggaggcugaggcaggauugcugcaaguucagugguagcuugggcuauagaaugaaacucgggaaaagggaagauggggcugagagguggcucagugguuaagagcacuugcugcccucccagaggacccggguucaauucccaucacccauauggcagcucagaacugucugcaacuucaguuccagggaacuugacaccuucacaaaauaauuaccagugcaaacuuaccagugcaaaacuuagugaaggaaggaaggaagaaaaggaucccagucucauucauguucauguucucugugcugcugucccaugucaacagacuuaauccucuucucuguguuaaacagcucucaguacacagcugugagcaagaccuucucacgguaccucacaugcagagaauguuuauggcaauagaagaagaggaugcaggcacaacccaggucauaguaacaaagugucuuagcaugugacuagagaagcuggucugaggucuggggacaggcucuguuucacagcguauauacugcuugguggugugaugcagaaauuauagacagcuggcaggugucacuuucauguugaaagugauagugacugacagcgggaaaaccgaagaccuuagaagaugccaugacacugcugcuuucuucuccugccauaaguuaccaaucucagccugccaguaguaccugagucagguuauuuuuuuauuuucuguugagauuuaaguucagucaacaugugauguuuuucuguguuauagugggcuccauucagaagggcaguuguucugggcagucuggaaugaccccugguucuuggcaacauaaaaugaaacuucagcugauucucaagucaucaaaggccuacuacauuuugucagaugcugccaugagucuucagaaguauggaagagcauugagauacauuaagcuagcucuacagagccaugguaagccuccacacugaguauguccugaaggcccuggagugagggaagcauugagucauaguaaaccuucacuccucuuccuuaaaaaauucaauuuuaaagcagcaccuuccggcauguuacauuucauuuuuagcagcguucuaacaucuuggugugaagaaugugaagcccugugccaccugcuguggacaguggcugucacagcacagagauuucacguuugccaugaguaucaguucuaacaucugugugggcucucccucucaccacuguucaaacagauacuuacugcugccucugcaccaacaugcuuucugaagugcugcuguuccucucucaauaccugacacuuugcggcgacauccaacucaugcuggcccagaaugcaaauaaccgagcagcacaccucgaggaguuuaauuaccaaacaaaagaagaccaggagauccuccacagucuccacagagaguccagcugccaggguaugcaggcauuuuccuuguucacagugggauaaucuguucagcucagggaguaugcugcaaaagugucaggaacaguagccuuuuguuuaaggguuccaugccauucuuuuucaaguucuaaaauugaccauggcugaguguagcuguauauaccuuaaucccaccaaagggagauaggcaggcagaucucugaauuugaggccagcuugguuuacauagugaguuccaagacauccaggaauacauagugagaccauuucucagaaacaaagaguaugcucuuacguguuuguaucacauaauuuucagauccuuuuaacuaaggucugauaacaguuguuuccuuuacucacgcuugaugggauuuuuguagguauacaucuaggcaacucugcaagccaggguuuuggggauaaagaaaaaaugguuggugaaaguggguuaaguaucuuaugaaugagucuacagggcuaagagaaaguuagcacguaccauauacuuuuaucauccguucuaaaaagauaaaaugauuuaaccacaggaacacacuccucagcucggagcagccaugugagcacauccaguaggauguaagcgucagucguggguaauuacaauuaacguagaacacuagaagagagagauguagcauuuccuaggauuuuuacucguucuucccuuucuuuuucuaaaauaaucauuuuaauagccgcagugggaaaauccauagagauuuuacuucucucuucauaguuauuucacuuaaaacacugugugauguccccugugcauuggugucacaguaggggugccacacuucccccaaggguuggaaguaauggcaucacccagcagccucuuugguaucuuugguggcuuaagcuuggcauguguucuguuucaugagcuggacccaucaguccagaaaaacaaagagcaaagcugccuaacuguacuaaagaccuuuagucugugcaaguagcuugggaagaucugagugauagaaauaguugguauuuauaggcagaaaaauacuauuuuaagcaaacaugaauauucuaggaagauaccauuuuauuaauagacauuuuacaguggcacgauuuuuguuguauugauggaaucuguguuuacacuguauugcacugucuuucugacuuaaaaugucaggcacuuacaggucuuaaggaaaggaguaagggcucauaacaucccauuguccuaacauuucuuucuuuucuuuuccuuuuuaaggauuugcaugggcaacagaucuaucuacagacuuagaaagucaacucucaguuaguuguaaauguuaugaggcugcuaaugaaaucuugcaauucagcgacuuaaaaagucagaauccagaacacuauguacagguguugaagagaaugggaaacauuagaaaugaaaucgguguauucuacaugaaucaggcugcugcacugcagggugagcgaguaggugagugucuccuguggccgccucugcauucccgguuguacuguuugugggugaagcaaaggacuggcaccugagggugugugauuacaaugugcuuugcugagaaucuuacaacuagaaaaaaacauuuccccuugggauccauucuuucccguaucuuccaugcuuuagacugcuaaguucagaaguagcuuggacaagucagaaguagcuuguauuggaugugcagcuaguaccucagaucucugggaaaugugcuaaaagguacauacaugcagugcaguggauggggaagcugucuguccuaguuguagguauuugaaggcucugggaaagaugguacaguugcaucggcagucccugaacaggaccucuggaugcaaucugaggaacggaaggcuccagagcaugaggguagcagugcacaccgcaaggaguugaggaagcagugaguagguucaggcugcacuggguuggccugugccuaucaguggacugcguguggaaagaucuaauuuaguaguugauuauaaaugugcugagagcugaaaagggauggugcuccucaaauugaaaagcauccccauaaggguaguagcugaagccauucaaggggcucuuaguggaaaaacuaggugcuaugagaagggaagggaccugggcuggaggugagggccacagauaaaccgaacuuaaucuaugccugcuaaauugugaaccgugcuugacccgggggcacaaaugaugcucuagaaaguucauuguuggugggagaaccugagugcuuaagugacaucuggaguuuugucagugggagagcaugugguauauaguaagaauccaggagaaguauauaaaacauaaacuauagccucuuaaaacucaauuggaaccuugauguguguuugaugcuuaauaauguaguccuuugcccaggugucuuuacuugguugguuuugaaugacugugauuaaauguaucggucugcugggacuacuaaauaccccagaugguauagucuaauauguuaggauuuauacuucccaguuaugaguacuggaaguccaaggucaaggcaacaucaggguuggauuuuucucagauuucuuuucuugccuuucagacagccaccuuccuacugugcauuuacaaggcccuuucucuguaucccuuuggugucuuuucccaagucauauuggaucagagucucauucuuaaugaccucauuuaauguuaaucaccucuucauaggccugauccuacguauuguccccguguaagcuagugcgagguagugcuuuaccucagggacuccugaagagugccuucccucaugugacaggcaucagagagagagcugcaguugacccacuggguucacacugaugucugcuuaugcaauuguuuucuuucuuucuuugugaagugagcaaaucugugucugcugcagagcaacaauuguggaaaaaaagcuuuucuuguuuugaaaaggggauucacaacuuugagucgauugaugaugcuacaaaugcugcccuucugcugugcaacacgggaagacucaugcgggucugugcgcaggcgcacugcggugcagaggaugaguucaaacgggaguucucuccagaggagggcuuguauuacagcaagguaaggugguugccuucacuucaguccucaucuauucacucucauccaucuaaacugcccuuugcuccacuaaguaaacuacagaugacuacagcauuguaauggcaaaggagcagacagcuuguaggaacaguaggaugucagugcugaggacgaccuguggaacuauuggguuccggaaagaugcuuaaguaaaugguguugauggaguucaggacacuaaagauuggcauagagagagaaacugggaaagucccagaagaugcagguggaaggcugugugccccagccagcaugggagauagacauguacaucagagagcaaauauggaagcaggucgcagucuaacagaaaugacagguaaggucagaggugaauacaucccuaagguaugaagaaagguuaagaauaugcaacagagcaaauaaccuuuuaaaguaaaugcucaguauguuuguuuuuauuuugaaauuacaguuuauaauuaugaaaaauugaacauggcacagaagacauggcucaggaauuggaaaugccugguguucuuccagaggaucagaguuuaggucccauguaggacagcucacagcugccagaagcugcuccagcuucugaggacccauuguucucucccugccucugcaugcaccccacacguacaguagacagacacacacuaaacaucacucuaaggaaugacccugggcugcuucuuguacucauguaccucuagcuguuaggagacugagacagacaggaggauuaaaagcuaccuugcagggagggguugacuuaccaaauugucacauugucuccaguguuggagagggcgagcaauacaagaaaugagccuucaggagauaagggcaccgaaccuagugaucugaguucagucuccuuagcucacacggucaaaggagaaaaccaacuccuacaaguuagcuugacuuuaauaaauaaaaacaaaaauuuuauaaaaagacaugagcacuuaaauuauuagcuguuuucaaacuuuaaauuuagccuucaauagaaaauauaccuagcauaguacauuuuaaaauaaaagugacuaaaaaacaacuuguguauucauaacaguuaauacugaaauguaauaaguauugcugggugauagagcuuaauguaacuguugugagaauaccauggccaguauuugaagaugagggugagagaauuaauuuuacacuacaauaauuuuuuuuuuguaguuuacuaguuacacaaaguaauuuuccuucagcguugggggagaaaaacccaacaaaguccauccuccugcaucauccaaagucagaaagcagcaccaaaaacagaccuugcaggggcauucuaucugcuucagguugucucuuuacuaaguacuuaacauugguugcccugccuuccuucuuuagguaauucucccagauucagucucauguaugcucuuugcacauguuuaacacuugcccucuucacaggccguugauuacuauuugaaggcucugaggucauugggaacgagagacaugcacccaauuguuugggauucugugaacugggaauuguccacuacauacuucaccauggcgacucugcagcaagauuaugcuccauuauccagaaaagcucaggagcaggugauaagacuuucuggauuuuacacugaagucaacacuacuuauuccuguuuuuaauguugcacaccagccaucuuuagcaagcaguauuuaaugugaaugcuuuuucuuucccuucuccauugaaaucuaugaacagauugagaaagaagugagcgaggcuaugaugaagucccugaagcacugcgauguugacucagcaacugcucggcagccccucugucaguaccgagcugcgaccauccaucacaggcuggcuuccauguaccacagcugucugaggaaccagguguggccauccagauuaaauuccaugcuucacuuauuuaaaaguauccgccgagccugccgaugcuuuggguauauuuuacauggcaccucuuccuguuagcugauguggcuacuuuagaagaacucagcaugucagugcuucucccuuuuuauccgugacauguacuuuucucugcuguaaaugauggcgucuuaguguggaaaucagauacuuuccugaguauacuacuuaacguuuguuauaaauguaguuaagcuuuguauaguaguaguccuguguacauuuuaaaaggcuucccggggcaggagugagagagucagcacuuauaaccaucuguaaucccagauccaggagggcccagugccucuggccacugcaggcuucugcacucaugugcacucaugugcacaugcuccucuugcacauuugcauaauuaagauuuauaguacagcccucucauccuugugaacugggaagugcacaugaaagcaucuggaaagugucaguggagcauggacacaguugaaagaaugugagggaagccccagugugccugcucuggaggccagagaauggaagagggcucuguagagaauggaagagggcucuguagagcccugggcuucccuacugauguguguguuauacauuguccaagauguucucucguguuuagggccucuguaucuuacaacugaaugaguuguauuuuuguuuuugauuuguuaaaaacuugauggacuuagacugcuuuuccucucucauggcucacugccuggcauugaacaccuugucuguagugcaucgagccccuugguucuuuguuugaauuuuauuccuuuugucccuugagauuuuugagacaaggacccgcuaugucauuucagacuggccuagaacucacuguguaguagcuggcuuacugagaacucaugguucuuagucuccucuucauuuuauuauucccauagcagguacuaagugauauuuuaaauuggugaacuucaaacuuauaacacuauaaaaaauaaaaaugaacgcauuagugaugcaggcaggauugaguaauaauacugaagccccagccuugggaccuuuuuuacuauuauauuauuuuuauuuguagguuggugaugagcaucuuaggaagcagcaccgagugcuggcagaucuccacuacagcaaagcugcgaagcucuuucagcuucucaaagacgcucccugugaacugcuuagagugcagcuagaaaggguggcauuugcagaauuucagaugagcaguaagucugacuucucagauacauguguguuggcuguuuucugcaucauguuagagggaggccacgcuguguguggcucuuggauauaagcaggaccauuuuccuguuaauuugcccauaguuaaagcuuucccuacauuuuuugaaaugcuuuuuaaaaccuagagaaaugaauagagacuuuaaguauggaaaguuuuggaugaagcagcagcagcguggaaaccaugguccucacucuuuaaauauggaacuggcaccuggggccuuugguugauuguggaauggaugcugcugugauuccugcuugagcucagcuaaaugagcaaauaggggagggucacaggaagugagaggacuucauugugugucugucaucuucucagcagagcaggagagaacauucugaccacuuaauauuucaaauuuaaacuuuauaauaaaguuuuggauuuuggggugugccugauauccgauguuggaauuaagaaagcucagccuguaaaaucuaugaccuacuucagaauggggagccaagaucuaaauuguuuugaucccagacagucugauuagagauguuaauguauacguuaaauaugugugacuugguuuguaugagauacagagcccgugagaauaagaaacuaccgguuuauugccuguacauagggacccugggagaauaggagaaccauuucuauagacucauuuagaaaugaauucauuaccauuucuaaaacuauucucugcgauuuuuuuuucuaucaguguguaugcaugccagauguauauaggcucuggauaaccuuuuacuuggcaucuugcaguuuucugucauguuugaauucuucaugauuaaaagauauuuuuguaaaagaauagagagacauuggagacacagucagauugguguaguucauugcauuuggaaaacaucuuacgggcaaaugagagauaguucaucagguaaagguacuugcuuccaaaucagaugaccuaaguuccaucccugggacccauagguuaccaucggaccuccaaacaugugucacgacacaaaugaaccuccccacacuuacaauaaauaauguuuuuggaaaaauaguggagauaauuaagagaaggggguagccagcuuuguggaguuuaucagcaauauuacuaaguguugucauuagugacacuacuucaucuuaguuuaccuuaauacauggggcuccuacuuaccuuucuuaugacucuguugucugcuucuuucccaaagacagcgcacauagucaguggcuuaccuuucagaugccacaucuacucugauaucuuauuuguccauugaguuuccagcuguuuugaaaguuucagauuauacuguacuggaaagaggugaccuuuaacaagugaauucccaugcccauuuucacuucugaugcuuccuccacacuuaaggacucugacacuaucugugagguuuaaggguuugcaaaaggacccaaaacuugcuguuccuacagcaaaaucagccaaggaagaucaggcgugccccagaaauaaaguucgcauuguguucucagugcagguauuacugaucucaccucaucccagcagugacuagcacccaggaaguucuaccgcaauguggagucacuguguuuauuuagaaucugggugcaugguagaacuuagccuccaaccucucuagaagauaaucugucacucugcagcucagggacuccauagaaauugcacuguuuuaaagaccuauagauggccuugagagccauagaggauggcuggaucuaucuauggagauuaauccuuuauucauagcacagcacugcacacacugaaugugagcagagaacaggaguugaggugucuugcaguggcugagagauguagacaaguguaauacucaccugaucuaccuuugaacaaaaauuuugauacuuuacaguaggacggccgauauugaggaccaaauugacucaaccagcuucacacagcuaaauaaugggaugaccuuugaaccacagacucuugucuauugggccccuguaaccuaauacuugagauacuagcuucuuaguccauagagauuuuguaugcuuaccauauagagccguacacugaggcaagugaacauuacugcaaccacuuuaaaaaguuagacguauuauuauaguauaaugcuuuggguaggcugaguggguuuuuuuccccaacuaguaaacaaguugucuuuuguuuguuaggauugucacaaacugccuuucuagugccuaaagucgguaacauuagcauuggauagcuucauaggcuuguaguuuagggaugaucauuugguuuuuuauuuuaggucagaauagcaauguuggaaaguuaaaaacauuaucuggggcacuugauaucauggugagaacggagcaugcguuccagcucauccggaaggagcuuguagaggaaugugaccagguaauuggagaaaacacuuuuauauguuuuaugcuaaaugguaaauguauguaacaggcauaggacacauacuuaugaguguauguauauuauguguguauauaucacuacauaaaaauauaauuaguaaugucuuuauguaauuaaaagucuuagucuauuugugugcuauaacaaaauacuggagguuggguaaguuguugcaaagaagcucauuggcccauaggcccauaauugugauccacauuagcagauccaaguagauggcaccauuguccugguaaagguucucuaacaguguugaacauggggaaauggaaagggaacaagccaugugcagaaugggacagggcaugaaguagccucuuuguaauaacuuaaacuugcaagaucuagcccaggguugaugcagagacauagcuaccaucaccaagagagguuguuuacucugcagccacguggcugaucaugccugggaauacaggugagugucaccaguuuccugaaaucauauagaaagagaaccaagaaaggaauacuuuauaaauacauuggugggaauaucaugcagacaaguuacaagaaagaagggaugucucugguuuagguaggucucagcugcuaucugagggcauccuuaaucuuuggguuggcagaagcuaggguucuauugguacauuccaaaaggauuuaccucauuaucacaaggauggauauuaggccagacacaggugggcagugaaugucuuugaagggcacuaaagauagcccaagaugauuugaccugcagcuuucuagcucuucacagucgaggaaguucuaaucagucagcuagccuuguagaaucuuuaacacacaugcaggucccacacucaccuacccaaccccugggaacuuuaguuuacacuuaccugauacacucuccagaggcagcauugaaaacacuggagcccagugguccaguuaccuucccaugucccaaguucaucaguucacggccacacaccacacaggagccucaaagcacagcagcuguguuugcaugauugcauuacugacuucagucuuuaaugagcauaguuacagagagaccuguuagaaguuucaaagccuuguaagguuguuuuucuauuugaaggugucuuugccuuugcuuuccaagagcagggagcgcucugcucucagucccagcugacugcccggaagcauuugcuccauaacucugcagcauaguccagcauuucugcugagugugccccaggcuucugccaccucuucuguccaugguggguccuggcuaggcaguaccuguuuccauguugcuucuguagcaaacagucaaugcugggaagucaugaaauuccacauaggauucauuucuuuuaugucaguauuucuuagguguggggccuuacuguaucuuuaucagggagcuuuugggucugcuuccuguuuaugauucuguaaacuggauuugaagaggcugcuuagccuucacuguauaugaaacaugggaggaggacagguuagguaaaguaacuuugugcuguuuuuagcccaagaaugaugaggcuacaccggcugcugauucuucaccuaaucuuaaucgagaagaagugaucaaacuccuuaguauauuugaaucucgucugucauuccuucuccuucaauccaucaaacugaugucgucaucuaaaaggaaaaugagguaaauuacuugguuauuuauugaaccuucuuugcuaacuccucaccuauaaaaagaacuugaguuccugcuauugauaaaaagaacagguuguauuguuuauguuguauguagaaaaugcaaaauuugaggcuggagaaauggcucagcgauuaagagcacugacugcucuucugaagguccugaguuccaaucccagcaacuacaugguggcucacaaccauccauaaugagauuuuuaaguacuauuccuuguuagguaagaaucaugaccaugugccuacugcauagucauggagagacaaguagccguggagugaagacccuaaguuguuuguaguagcacuugcaaacauguuuuuaaugugaauuggggacuaugauguggauauaaaggugcacaccuuuaaucccagcacuagggaggcagaggcagguggauuucugaguucgaggccagccuggucuacagagugaguuccaggacagccagggcuacacagagaaacccugucuccaaaaagaaaguuagggcgucugaagcuggguaguaggagggagauggguggucgggugcacagccaggugccucggcugaugugugugcuguuucaccagagcuguucuuuggcaucauuaacuugaaauugaguacaaaguucuacaucaggagcaugauauacaaacacaagugcagucuagcccauauuacagaaaaugaaaaacagauaaaagucaaagaaaaugcacccacguacaucauuguuucuaguuaaaucugucuuaccauuuuaucuugggguacagauaaaguaauuuucguuuugugacucgguguuaugagcuuugacaacguuuauuuagcauuccaaaaauuucuguccaccacaaccauguugcaacaaaguccaucacuccacaaauugcuucuuggugauguuaagcaaucugaucuuguacaauuuuggaguuuucucuuagugccucucucauuaauggucguuucaagcccaugaagaaaccccucacuaucaucucugcccagcuuagcuguuauuucuugccuguacggauauuuguucaggaguguugaaaacuggacauccguuaggacagcagaggcuggcuuggucugccugagagguuucaccugccagguauuccauugaguucauuuuuuauaucuugaacagagcugcaguugagaauuucuucuuaaacugcaaccuucuguauagcacaggauccaaguuccaacgaaguagaugcccucagcuaaaguuccuccucugauguuuuuuacuuuggucaguucuagcccaaaauauuaaguggaaaauuccaugauuuauuuguuuugugcauaccucagucuucaaacuuauccuucugaggagaacuuuuacuggaggaagucucaaguacgcagcaaggugguuugguauguucacugcaguuuagugcaccagaaagcagaguaaauaacacacaguggagaagagagauucuuagcuuuuacugccuaaaaacuuaacugcagguagguuuguaacauuuauugguguccacaagguggcaguguguguguguguguguguguguguguguguguguguguguguguguguauguauguauguauguaggauccugugagcuaauuuagugauuuuuuuuuccagauuagugguuugggugauugacugacaguuucagucuuuugauguuuuuuuuuuaauauuuauuauauguaaguacacuguagcugucuucagacacuccagaagaggucaucagaucuccuuacggaugguugugagccaccaugugguugcugggauuugaccucuagaccuucggaagagcagucgggugcucuuacccacugagccaucucaccagcccuugauguuuuaucacaauaguucuauguauggcuuauguaauuuuuauuuccaaccagguuauuaguguugaagaaaugauguuuuugauuucucuguguagcccuggcuauucuggaacucacuagguuagaccacgcuggccucaaacucagagaucuaccugccucugucuccuaagugcugagauuaaagauauauaccaccacaccuggauuauugaagaaauuuuuuuuaaagauuuauuuauuauuuauucuauguaaguacacuguagcugucuucagacacaccagaagagggagucagaucucauuacggaugguugugagccaccaugugguugcugggauuugaacuccggaccuacggaagagcagucggguacucuuaccugcugagccaucucaccagcccuugaagaaauuuuuaaucuaaaguuuucaugcaagccaaaugucguaggagcugaucugugcguucagguuuauugaccgaaaggaacacagcccucugcagguuggaggcaggucacugugguugcugagucgggacuuucuguuguguuucauucguggucgguaaaaacagcuagcaaguuuacuguugauaaagcagaccuagcuguguucuuuaagagaaaaggaaaucagaaugugaccuuaacagaaaggaacauuaguaguuuauuuugacugcuguuucuccccauuagccugaggcaaaauaagaaagugggcuuaauaauugaaaagcuuaacuuagguucucagaaauuaaagugagcuuuaagaaaauuaggauuaauuuucuuuuuucuuuuuuuuuuuaagauuuauuuuuauguauaugaguauucuguagcagucuucagacacaccagaagaggguaucagauccuguuacagaugguugugaaccaccaugugguugcuggaaauugaacucaggaccucuggaagaagagucagugcucuuaacugcugagccaucucuccagucccaggguuauuuuucuuguugaagcuguugagugugcuucauaguaugacaacuguguagguuggacaagauacacauuuuguuuauuacauuucaggggaguuauuucacuuuggauuaagaaucgagcuguucauaacacgcccuuuagcauucacugcucuagcagaguggcaccaugacauuucagaggcuuuaggauuugagaugaaaagcuauaaacaucugaggaucaugaagcccugugcuguaguacagagaagaaaucuguaacaucauggacgguccuuagccagauauaaacauuaaguauuuaguuuaguaaaaugguagauaagguaaaccagcuaauuauauuaagaggaaaacgaucuguuugacauguggagacuguagauaguaacuucaguucagugggugacaguagguuaagaagggcgugaucuacacaaguuguaagaagcugaggcaggagucugugagcagagcucagcugccaguuuagauuggcacuuguugcugaguagaggggccauguaguugcuccaugcuugaucagccccagcucccacucaacuuucuccaugacauauucuuugaccauguuuuugugacugcucccagugccuuuuuccagugccucugcugggaaggcaggggucuuucucugguuuacucaacagccauagauaagucagauacucuaagaagugccuguuguuuccagccccucccucuauucccucaccuguuuguuuuuaaccucagcaguaacgcugaagaagacauaguccuccaaaccaacaagcagauuuacucccagcuuuugagagcgacugccaacagaaacucaacucugcuggaaagaauugaagucgucaucuguuugcuggagcagcuugccuccgguagcagccgaucgaguggcagugcuguccccugacugcagugguacuggaggacugucuugucagugccuucccguccuggagcugucugucuguccacucggugcugagacuuauuaaauaugaggacauagcguuuaaucagguccacaguggauacuugcuucccauggcaggcagaggauguggggugguucggcuucuugugaaggugagaaacuauaauggaaccgaaagcuuuguaaauguauuuccucgagaaguacaugguuccuuagugauaacaccuccugcgaugucgcgagacuuaaaauauucuugacguuaaaacacuuagguguaagaugcgauuauuuuggauaaaauguuacucuggccaagggaacucuuauucaagugauuucauggauucaaauggcauguagaaacagugcgcaucagcgucuacuucuaagugacacaaaaguguccccuuuccaagcuguggugugcgcgggagguuuugacgacugagaauugugcaggucuccuuucagugcaugcucugaagagacuccuucucugacuguguaugacauugguaaagaauagguacuaucacuuucucauuuuaaacuugaaacugugaauaagguaagagaauuauuuugaauaaauaagcuauuuauuuaaaauaccuugguaguucccacuugcauucuucacacugcugugauuugaucugcuugcuuaugauaucaaaccuuuacaaaguacauggcuccuaauuuucaaggcaaagguuuccccuacauuccugcuccugggacauucugcugugcccugcugcucuggggaucuuguccagugcccacugcauguggggccgucaagcugucacuaacaguugcaaggaaguccagcauuugcaccaggcagacucuugauaucugguaucuggccacaguuacauccccuuccacaccagccccacuuacagauguggguuucugucacuggagcaagcaggucuccauugcaacaaagcagauuauucucucacuauuugucuaguuccuuguuugguuugcauuguugucauuggaacaaauuugcaccuguuuacaagaguuaaucauugcaacccuuaaaacguuggugaaacuguaaagcuuugagccagcuccucagccuccuuuuaggacgccuguguccuuagcccugcagcaagugugcacacaguaccacagcccuuccuuccuccacuggagggcccuguggaacaggcgaacucaucaggauucccgugcugcccuagaaagaggcuggaguguuaggacuacuugucuccaagccccucuccuuagcugaaaagccuucugauaggaaaauggauuuuaagcaaggaaguagaaauuuuggcucuuucucuugucauagcaauaacaugaaaauuucugcaggagaaauaaaagauacuucucaaauauguuguaauuacuuguguugguuuuaauuaaagccuccugaagua

SEQ ID NO: 4151 - RNA, 24300 nt, Mus musculus
uauaguaagcaggcaggagaugauggagguauagacucgaauagcugcaggaucaaugauaaggugugucuggguacugaagggaaagcuaacaauuuacugauagucugauguagcgugagaaaggaggaguaauuaaaggcaaaggccaaauuuagaguuugaacuggaaaacuguaacagaaauggugaagagaugggaauaaauuacaagcccugcuuuggacggucaauucuaagacagcaacuaucucgaauaaccacucaagccuaacuauccaccaagaaagagguacuuaaacgacuuggaacuagauaauaagucugagcaaucccaggauucaggaggcagaagcagacagaucucugaguucgaggacagccuggucaacagagugagucccaggauagcucagggcgacacagagaaacccugucuggaaaaacaaacaaacaaacaaaucugaagaaaggccaucaguucugugaggcgauaaaagcagucugaccagguuggcugucccagauuggcaguaaauacggucuaacugagauguauaguaaagggaaaacugcaggauaaagagcauuugaaaacggugcaauaggacaaagcagguugccuuuauaaucaacaucagagcgugagccuggcuguguagaagguggagagcggcuguagggaagaggagagaccaaacuucgcaggucucugaagguacgugugcggcugccgggcuucuggggugggaauaacucauccgggaagggcuacagggauuaacguguaggaaagcccgcagugggaaccuggguaaggauguguccuauauaguggagggaaaucacaacuccccacaucucccauuacguucccacaacuucggcugccugaaauggucacgugugcuuucucaccucguccacgauuucgucaacuucauccucuucuucgucacugucguccucgucuucuuccucauccuccaccucauccucuucuucuucuuccuccucccgcuggcccggggcucccagcggccgcugaauuccauuucccaccgcucgcuucuuagccuuagaugccaugucgccggucacacugcgccugcgcgagucccgcccccguccuuccggacucucucuaagccgacucgggggagacaguaagcacaaggucuccgcggauccggcgcgacuagaaagcuccgggguugagucccacuggacuaaucugcuaaauugcuuccuccuuggggccgauugccuagccuucucuuccucucuccauccucccaucuuccucauucucuccuaaucucccccucuguguguagugguuuggcccauccgucugcguuccuuccgccggcgccuggacgccccugugcgagcacagccagaugugggucaguggccucggauccucgggucugagguacgagcauggggagcgcuagccgggugagaggccgcucucgguuaucucggcgugcagguuguccugccucuuagcccgcgagguagguguccgggccaggacuugacuaggacacgggccuguggaccugcacgcugggcuuugcgaucccugacaccgcggggcgggaucccggugcagcugccaaccucgggcucacugguggaguccgcgcacgccggaagauccgccgauccagacagggccagccccgcgccaucucccuaacaaaguucuaaguagacauuacgaccuuugcuacuucagguccacggcgucguuaaaaagaauuuuuugaaaagaauagaacagaaaguaggagaucgcggcaaguuaacgaguguaccccaccucugccaccacuugugacuaaacgaaguacuuguccaacguuucagaucuguuucaaaagaagccgaauuuuuggaaaugcccuaaagguuaaaaccuguaucagauaaaucaggucuaccccucagguuuauuccuuaguccuuuugcaguuugcagcuccuuguaaauauuauugacaaugaaaucauuaaguaggggaaauauuaacuuucugacaauaaacuccuugguucuccuuuuucucaaaaauaacgacagcuuaugaaguauguuugauucucaaaucagagugagcuggcccuagagguaaggaagccuuugccagagaaguuugggaaaugugaauagccccagugaucaucaauaggaaauaggauaccagggaccccccacuagcccagauccccaugaugguauucuguggaauccaaguguccugggagugucuuaucaaccaggcucuaucuuggacaguaaugacaccaggacuccaccucugauaaaguaguuuuaauuggcugccuugguuuuuguaauuguccaaaaacacacuccuauaaucuauugcaaggcuaauaauagcuugccaugcauaccuaucccaagguauaauaauaucccaagguauauaauaacagaaaaaaaagauuuaaaacaugucaauagaauugcaccgagucuccugaagauccccacccccuaugucuuuauaguuuguuaugguaaaguaugcauagccaaacuuagcacgugagugccugguucuuggcucacguucauccauacuguuucacaaccaucacacuauccauccuuugacuguuuuauaccuugcaaaacuauccuuuaaacaguuccccaguaucaggccaggagacagcuuaguggguaaaauacuugguguaccagcauuucccagcuccuucaugcugcaacuguaacccuagcacuggggugauggccaacuaauuuaccgaaucagugagcuucagguucaaugagagaccuguuucuaaaaaaacgagauuaaaagcaguagaagacaacaccuuucauuaacaggguacccaugcauagacaaaaagaaccaguuccccaguaucaccuuucacugcccccuggcugucaucuguauaauuuaacaaagggcuuuaauuguaaucaaaguacucagacaucauaauuucuuuccuucuuucuuucuuuuuuuuuuuuuuuuuuuuuuuuuuuuuuuuuuuuuuuugguuuuucaagacaggguuucucuguguagcucuggcuuuccuggaacucucucuguagaccaggcuggccucaaacucaaaucugcgugccucugccucccaaguacugggauuaaaggcaugcaccacuacugccugaccaugauuucuuaccuaaggcugaacaguucccauggcucacauggccuucauauuuaaucuuaugucugcagacacuuagauuugcuuguagguuuuaccuauuagacagugcuccuauaaacaugaguguacaaauaccucaagucucugcuuuuguucuuuugagaucugcuuagaagugcaauuauacaucauacaauuaacuacuuuuaauuauaaucauacaauuaacuacuuuuguaaaauuauuuuuuuguaauuugcaaaauuuuuccaccaggagccuauauuacuuugcaggguagaaaaaaggaaaggccuguuuguauccucugauuaauuccugauaucaagcccauggaccuguaaauagauggcucaccugugcugugcugaccgcagggaccuuaggcaacggacugauaacuucuggcucacucuuccucuuuagcacagaauuugacuuaaaggucagcugguagccagugguuaggagaaugagccccgggcuucagaucuggauccugauucuauuucuaucauuuauucugcugaccaugggcagauuaaaagacuugguuucuccuucuuguuaagcugcuuugcaggcuaagugaggauuguaaaaugcuuaguccaccgugacaauuugaucugucaaccugacuggauugugagaugcccagcuagcugguugggugucuucccagugugccuguggaggugcuuccagaagggacuugcauguggaucugaaggcugaguggaguacauagagcauguaggcacugucuaaucuaugggcugcagggagcaaaaggaaaggagggcagcccauccucucccuccccuccugacaccuggugcccuggguucucagcucucagcuuuggacuacaaucuauccugucugucccuaucacuucaaacguuacuaacuuuccuaugugucuggugcucagcauguuuugugagcgagcauucucugaaauaaaagguuugccaggcgaugugcuugcuagucgaaaaaggacgagguccuaggacgcuuucuguaacuaccagcaacaagauagcagcugaaucugacagccaagagaauuuuugugauaaaauuuugagaaaggaaaacaaauuguacauagaacuagcacuggcugugaauaauagggguaggguaauggagucacgacauggggaugguugugcauggaaggcaguguguaaaacgugcuugcugcuucaggauuccagguuggguuaguccagaaaguuuuggggguacauuguagcugguguccuuuuagacacuggcuuuuugaaggcuuuuuuccccagaaguauuuguucauaccguagaaauacacacuuuaagguuacccggcaucuuuagaaccgggggaaacgauugcauuuccuuaaggagaucugaaacuaacucccaggaauaaggccacacucuggguuaaaugagaccccaagcccuccuugagcguaccuguucuuucucggagacauccaggcucucugccuaacgcuggagcaucucuccuuacugcccaauucaggagucaaauccagggccugaugcuugcaaagcauggucuguuccucuacccugugcuguugugguucagguuucgacucagacaccauugacucccagaacagucucccugguacccggagagguaagaccuaagcugucagaacccuagguacuaucucgucaccucacagcacuugucaguaccugaaauuaccaagaaaccgcaaguaaauccuguagacuugauucucaagaggacuguccagcaacuagagagacaagugagagauugacuucauuguuuuuuaaggcauguccucugugaaacccgggucuagugugccaggacaggcacaccagcgguugucgagcacagcaaggcuacaggauuaccuguucuccacagcaccauauuuuggcuuuuuaauccccacucccauugcuugcauugugggccccagaagaguucauucuucagcagaaaaaugcuaaguuuuacuugccacuaaaugucauaccagauuccuagagcucccauuggaaggugcauuagagucgaagccaagagacaggcaagaagagauauguguuaggagaugcguuuggagaaaauugccuugcauaacugugcgguuggcaaggcagguugggauccacuguacaaaccaacaagaagggcaggccaacgggacacgcaggcucugaucaggcugaagcugggucuggagggaaaauauuccugcuuuggggagccccaugcuguucuugguaaugccuguggacugauugagucaggcuucccaaagcuaucugggaucgucucccuuccuaaaagucugucagugguggacuuggucauaucuccuaaguaccuucuuagcagcccuuggguaaccauugcaaacagguggaaaccagcuguugguugcuucuccauagcuguggcgcgaggacagaagagagcaacguagaggaaguggucaugcauuuuggcucaagguuuuagagguuagacccuuauggggcuaagauuugguacuguagagcgggaggcgugggcguggcauucuccuuugccccuucuuccacccgggccucucuagaagggugcauucugaggcagguucucccuuuaauccuuucuggaaacacccucacagauacacccggcaugugcuuuacgggucuccuaagcucuuuucaauccaaccaagauuuaacuuauugagguguagcaguacaugccuguaauacuagcacuuuggaggcugauauaggaggauuaccuuaaguucaaagccaaccugggccacauaguuccaaccagccugagcuauacugcagugugguauauuaucuccaaaaaacaagucagagcacaaaguaaaauaagaaauuaggauuuacugucguaagcuuggaaaacugaagugacauaaagaugugugguauaguccaacagugggcagggucccagauagcaggguauggucccacagggggcggagucccaguuagugggguguggucccacagggggcggagucccaguuaguggaguguggucccacagggggcggagucccaguuagugggguguggucccacaggggguggggucccaguuagcggggagacauuuugaggaucuagggaaggaguaggaaccauucuaucuguuuuucacccucucccccauuucucugacaccgacggcagcaauagcuugaacauccuuuccuaauccuuauccaguuagcuggauuugguuacugauguagagcgauucauuuugggccagauuuccuaauguucccuggauggacucuuccagccaucaguguaacgagaagucacuugugauccaugccucccagagcucauuaguuucugcuuccaagugucuucuuuggaugggucucaacuagguucacuauguacaacuuaacuggcguuuauugugagacuauugagugauuuuaaaaauaucucucauauaacaggaagauaaugcucauaacacuuuuagauaauaaagaaguagaaaggagccgggcgugguggcgcacgccuuuaaucccagcacuugggaggcagaggcaggcggauuucugaguucaaggccagccuggucuacagagugaguuccaggacagccagagcuauacagagaaacccugucucgaaaaaaaaaaauaaauaaaauaaaauaaaauaaauaaauaaauaaauaagaaguagaaaggaagaaaaaccauacuaauaccuacucagaaauaaguacuaucaaugucuugguguguauuuucucauauauuuaaacauaaagccaaacuacuuauguaaguguucaugcauguuuuacuuaacauguuugauuagauaaccauguaauucgguuauuugucaagauguuaaugguuuuuaaaaaccuacaucauaguuuacuuaaccagccucucacuggauacuuauguuguuuccaguuauuggaaauuauagacaugaccaagaaagucuuugucuguguugagacaggguuucacuauguagcccuugcuggccugaaacuugcuguguagauccagguggccugaguucaccugccuguaccucccaagugcugggauuaaaaagguguaugccaucacaucuagccuggaaugaaauuuuuaugccagucuuuguguacuguuuugauugcugucuugcauguauucucacaggaagaagggguaugaauuauguaaguuuuuauggguaguacauguugacagcuuaugucuagguugauagaucaccucgggaaacuugguuaacauuuaauaggcaugguuugagguggaaaagccaauauagcuauuuccuaaagggcuuaugaguggcguggcuuauucauuuugaaaaggaaauaauuauuuauuugcuuccuuacucauuuauuuaccuccugaaauuaagaugcuccuuucucuaucugccacugguaugucccagaacacaccaugugucucuggcuagccacugucuggcauagacacuugguuucacuaauggcucucacuugccuuuccaggcaguaucagcggcuaacacgaucucccucagccuuaucagugacagagggcuugagaaagaccaagcccguuuagcucggcacaggcgauugauugccucacucuugccucucuccuuccaacaucaccuaggaacagucugagaucuaaguaagauccauuuccucgcucugccgcagcagcgucuuuuagaaggacugccaggcacaaugaagguucucuuacuaaaagacgccaaggaggaugacagcggccuggauccauauauccagguaaguggccgagccuuauuccgugaccccuugcuccugaaggcugggaugggaaugcuaacacucggugaacuuggugcuuagcuaaugugaugcugugcucccucguuuccggauaacauuuggugauuaauaugacgucacuucccuuauuuucaagacagcccuggucaacccagaguggcauucuuuuuuuuuuucuuuuuuuuaagauuuauuuauuuauuuauuuauuuauuauauguaaguacacuguagcugucuucagacaccccagaagagggcaucagaucucauuauggaugguugcugggauuugaacucgggaccuucggaagagccagucugugcucuuaaccgcugagccaucucuccagccucccagagugacauucuuucguuugcaggagcugcgauuguguggccuagaagccacacugauuccugugcugucauuugaguuuaugucucuccccaguuugucagaaaagguaagagccccgggcuaaggcuugcucucuguacaauuccugcccuaccaagccaugagaauguucaccucauuuuaccauuagacaugaccacaaaggcaguacacacuuaacugauuguggggagacuucucaucggcuucucugccuaaggcgcugucuccuuugucaggaggccaugggcccuggagauagggccuggggaucaccagcauggcucucacagguagggaccauguaguccacuuccggccucugcacagacuaccaggcaggcgcuucugaccuucgagugagcucuguuagagacucaugccaggcuucucggccaggaaggccgggcugaauguaagcccagggcuucugcccaccaccuugcucugcucagcagauacugcaggaaucagguccagugaagucucaaaguguuacagauuggugguggccuaagggugugcugagugugcccauggaugucugguacccaguacugcaaaaaccaaagauucaauacacaguggcucagugccuggcucagaaguguucagcaaaguacuguaucugaggccucagcuggguuuuaccuccuucagagucugguuguguugugaaugcagaucaaguuuucccuccugccugcgccuuacugcacugacauggcccaugcugggucauacccucugcucuguguaucucccggguuguccuagaaggagcuucuugagggaagagcugugacaauaaacggacuuacccacaguccagaauggcuucaggcccauagauagcaauaaacaagugucaaguggguggagggaugaacggguagaagacccaguugucugcuucuuuguggaugcauuuggacuuuggggccguagcucuuugagaggugggucuaagccagccucuguugguuuuggugcagcugucucauccugaaggcuuuggaggacucauuuucaccagccccagggcaguggaagcagugaagcuguguuuggagaaggacaauaaaacugaaggugagccgggcgugguggcgcacgccuuuaaucccagcauucaggaggcagaggcagguggauuucugaguucgaggccagccuggucuacaaagugagccaggaggacagccagagcuauaaagagaaacccugucucgaaaaaccaaaaaaaaaaaaacaaaaacaaaaaaacugaaggugagcgugggucugcucuggaguccagcagacucuuaccugcucccauuuccucugagacacuggaguccagagggagcugcaugcccaacagagccgagugccugggggagcugggucacaggugcccccugaggccccaggcagccauggcugagagcgugcucucacuagcuguuuaauuuauuauauuuaauauuauuuacuuacuugcuuauugggugcauggcaugauaaguguguagacgugagaggacaguccacaggagccgguucuuuccuuccaccucaugggucccagggaccaagcacagcccaccaggcgugguagcaagcagccgugcuggcugaacuaucucacaagcccuccauuaccuucuaaauggucacuuguguguccuacccuaaaaguaggguaagugacgcuuuacucagaggacgaugagagcauucagucucaggggaugcuucccggccccacugggcccuuugcagcauggcuauucuuccucuccauugcagcaggauguggugagccuacccguuuccugaagccaggcugcagccuggcuggcuacuuagcugacucuagugggguaccuguuguacuuuagacugagugccaaauacaguccuggggugugcacagcucugugaccucacuuuacagucaagacacaggcuuggggcuggugaaauggcucaguggguaagagcacugacuguucuuccaaagguccugaguucaaaucccagcaaccacaugguggcucacaaccauccguaaugagaucugaugccuucuucuggagugucugaagacagcuacaguguacuuacauauaauaaauaaauaaaucuuaaaaaaaaaaaagacacaggcuuggagaggucuuccagugaagggaggcaauugggagaugguguuuuugaaguccuauaaggccuggggugcugggguuuuugaaguccuauaaggccuggauucaugcagccaucuuggcugcugugggcuccuugaucuuccuugcccucagugaccuggccuuggaguaagagucaucacacccaaaccaugagguuacucucauuacuagcuggaacaugucaucugucugcucggugccagguguucugagccacagguuuuugauggacacugcauauacucugagccccauagaggagcauccaggauguugcaagggacagaguggguagugagggacuaagggugaugcugcugcugcugcugcuguccccuggcacaaguagauggcucacuucagaucccaagagccaaguuuccugcugaagugaaggcuggggucuaagaaugaaaauacaaacuaccacagugacauuuagcuggccacuuuguauguauagcucauacguaauuucacgcuuugcagccugggagaagucucugaaagacagauggaaugccaagucuguguacgugguuggaagugccaccgcuucucuagguaaggagucaugggaagaugaggguuugaauccuaggcuagauggaugagguuucauauucagauuauauacaauccaaaaccugugagcugcuuauuuguggaauuuuccacuuagucuuuucagaccauaauugaccaagaguaacugaaacgggggggggggggggggaugaaacgguaagaugggaauggggguggggcgugucacacgugccgacuacacuaaccaccagccucauagcaguucguccugccucagcucgguuccugggaacucuaggcugcuugacucacugguccugaacagaguucacaccugcauaagacguuuuucucagacucaguaccuuucuaauagucccugaguaaaaagcccaugguguucccagugaagcuguccuugguggugacagguccugguuguuuagcuccugaauggaaggcccaacagaccucuuuccucuggaagucguguguucccuugugcagguggcaguccugagugggcccugccuuugucuaucuccucggcagauuagccgaguguucacuuucuggagaaggcgagaagccuucaucugucugcuucuucucgucaagagcuuguaggguguaguggcacacgccuuucaucccacccagcacucaggaggcaggcagggggaucucugugaguuggagcuccagugccacauagagagaggggccgggcuagcacccucccuaaacucccugugucugcagugcugcggguccuugcugguugcugugaaaccuucccucugcccccuccauuccagucuggcuacgcgagcccauuacucauuucccgauggaagcugaucacaucucccugaugaaaugaggguucuccaaagagaagcuugcagaacuuagcagcuuccaaaugcugacugucugauaagcagaggccaacagcugaccucauuaucacacgagcaccaaggcagucuuacagggcugguguuuuuggcucauguagauaagugggguucagagaagccagucaagacaaagacccuugucuaggggaggugugcucagggcacccucugaaaggacagccauggucuuauuacuuggcuucagaggacacuucgcugugagugggagaacagccuggacauuugcacuuuaaagguagugcagggcugggcguggugucgcaugccuuuaaucccagcacuugggaggcagaggcaggaggauuucugaguucgaggccagccuggucuacaaauugaguuccaggacagccagggcuacacagagacccugucucaaaaaacaaaaaaacaaaaaaccaaaaaaaguagugcgggaacgaaagagcuucaauaccugaaaaaggaauucaucucuuuguuguuuuuuagugaauaaaauuggucuggaugcagaaggagcgggcaguggaaaugcagaaaagcuugcugaauauauuugcucaaguaagugaagacagacccagaugaaagccacccuccuccgcacaccgugcucucgggacaagaacugacuucccauuggucagcauguggaccggcucuagggcugcugggauuuagacagugauuuaccuuaagcuacugaugggcucuaggcuucugaggaacacagaggagagaucuguagagugcagauuuuggagugaggacaggaagauugcguguguccucuguacauagugucuccugcccucuuccccgucugucuaagccagcuguagacacagguacuugcagcgugucacccagccacagggauugaaguagaguccugcgcagucucagcagaggaacucugaccugcucacaaggucagcagccaggugucuccagccuugcaggcaggucucugucagagcuaucagacccugcgguuggaacaggagaacagggggaauauaaacucugguucuugccucucacugggucuguaacaugcuggcugacccuucuggagacuugccuggggagcugcugggcuagagugcuggcauggcuguggcuuuccucggagguuaggagcugggcaucuucuuuucccuuagcacauugaaugggugaagagagaaggacuuccaaugcuuuucaaacgaugauggauaaaacagaguauauuuguuaugagcuguagcuucucaaggugguauuggcguuugugauuugcaaacgugugugcuaaagucuucugagcuucuccugcccuaagaugcucuuauugccagaaggcucucuagcuuuuacauuguaauguuccucuggaagcugcuccuuaaaacagcccugccuuuuggacugaggccuccuagacuguagacagacccugggcagagccacgagcagcuuucagaagcaggcagggaaugguagagacccucagcaaguuucuggcucuccacuuuuugcaauauggaaauagacagcuguuuugauuagcuuugacugucaacuugacauagccuagaguaacccgaggaaucgcagucgaggaauuaccgagaucagacuggacuguggauaugucugugggggauugucuggauugauaauugauguaggaggguccagcccacugugggcggcaacauucuuuggucaggugguccuggguugccuaagagagcuagcuaagccuacgucugugaaaaagucagcuaggagcauuccucuacagucaguuucuugcuucaaguuccugcucuuacugcccucagugauggacuaugaccugaagucaaccccuuccucccuaagucggguuuugucagagagccuaucauagccacagaaaugagucuagagcaucuuucuauuaauuuuuaaauuuuuuuauuuuuuauuuauuuuuauuuuuuacuuauuuacuuucuaucuugcucacugcccccuccuugucacucccucccacauuccuuccccaucccucucccccuucuccucugagcaggugggggccccuguggguauccccccgacccuggcacuucaaucuauguuagcucuuugaggguauauuaguaucauaucaguugucuuucaaaaccaguuucaaagcuggggauauaguugagaaucagaguccuucucuaguauucaugaggucuuggacucauuccccagcaccaaaaacaauuuaaaaaugaauacuuacauuucuguuaauuaaacgcccagcaccaacacugacaacuaguguuaacaaguccccagugugcucaggagccagucuucauagccagccaaggaagggaggagcuguguuagugacaaaugugucauucaacaugguugucgcaggaaucuaaauuaaagaaaauuccucaggcagacugggcacauuucguaauucagcugccacuaacggccagugccccugugccugacagugaggggcuccuguccucucuggaaguucuuucuuagugugcucugagucucugggaccaaggaugaacgcugugagguuacaggguuagaauucagacucggcccugcccaucaccuccagcaaaccuaacugaacccugcuuuguguccacucaccuucaagcacuacuggccaggcagacuaagaguaagagggcaccccacugaggugagaguucuaaggacugacccugguguagcagagcuuugccgggggugggguggggggagugcugggggaaccuccagcuugcagauacccaggggggcccccucugaucacucuucuucaaagagggagcucuagccacaagguggcuaaccaagccuacauucucuugagccccauguucguuggcagaggccuguugggcaccugaggcauggacagaacuugucuuucccacucccacagugucugcuacuucacaggagacuacgucaguucagucucaggucugugagaguccagggaccaggccccacccuccagugucccugccucuugggagcucccacuucagccaggcuugggaagacagguggacuaagcagugaaagcagcgagcccuugguguggggagacugcuaccagcacuaaaugggcuuuccucacacccacagccaggucugccacucuucagaccccagcugcaugcccagcacuguccuuuaucucugaaccaaccacaggaaaaggugccauccuccagacugcccccgacuuuagguguaaauauugaguguccaagggacccauacucuguccaacuggguuccagaucuuguucccaggguccccuccugggggucaguaacuuggaagaauggcuccuagaacucagggcaacacucugcccgugugcauuggucuauuaaaagggcauaauaaggauacaggugcccagcuagauuuagaggcauagccagaccuggcauacagcuguauauagcaccaaagucugucuuuucaaaauguagaccuaagguguaaaggacagaucgggguguguuuaugagggauaacugccugcucuauaaaugggacaguuugcuuccaccugucucuagggcggaucuuuuuuuuaauauuuuuauuacauauuuuccucaauuacauuuccaaugcuaucccaaaagucccccauacccucucccccacuucccuacccacccauucccauuuuuuuuggcccuggcguuccccuguacuggggcauauacaauuugcguguccaaugggccucucuuuccagugauggcugacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuuucuaggccccggcauagucucacaagagacagcuacaucuggguccuuucaacaaaaucuugcuaguguaugcaauggugucagcguuuggaagcugauuaugggguggaucccuggauauggcagucucuacauggucccuccuuucguaucagcuccaaacuuugucucuguaacuccuuccaugggugcuuuguucccaauucuaaggaggggcauaguguccacacuucagucuucauucuucuuggguuucauguguuuagcaaauuuuaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaauggagcagguguccuucauaccaguugggacaucuucuggauauaugcccaggagagguauugcgggauccuccgguaguacuauguccaauuuucugaggaaccgccagacugauuuccagagugguuguacaagccugcaaucccacuaacaauggaggaguguuccucuuucuccacauccucgccagcaucugcugucaccugaauuuuugaucuuagccauucugacuggugugagguggaaucucaggguuguuuugauuugcauuucucuagggcggaucuuaagcauacucaaauuagaugcaucuguuuggaaggggacagaugugcugaagccauuguucaucauaaggccuuaugagcccaaggcagagggccagugccauuugugagugcucacacugugccccaggcaucuggcacaggcguggcaggguggggaguggcaugcuuugcccugucucccgggauugguucucuccuacaugcggguucuaggguucaaacuuagagcaucaggcuuaagcaccccuaaccaaugagucucgacgccagcccuggggugcagucuuugcaaagccauugugacuucuaauuuauuaccagcaagucuguaggccuaauaaaucuugcauuugcaauuagaauauaccaauaaaguccuaguuaccugcugcuaaugaagaccuucaccucagguuuuguuuaccaaggcauuaaugaguuucucuugaaguaaacuuuguggcccaauuuaaaaguuacaaaucuacuucuagugaguguguuguaacaaagccaccuccuaguuaucuuacuuaacaguuauuuacuaugagacaggcaucgcugugggcacuuauagcuguugacucguuuaaccuggucacucauuauagacagcguccucucacuggcccucucuuugaaggagagaauauuuacaauguaaaaggcauaggaucaaagauggucauguuuaaagagacaaagaagccaaggaggacuguacuaccuuuguuucagauggccuccugggugaacagcgaucccgcucccaugcuccagguagccuucaguugaggcagaagugcgcaucucaguucuuaccuacauccggggcugcugcuuugucuguggagacuuccucaggucccuccucuuccaacuccugcacucagucuucccuggcaguaugaaggggugaaggggaaacucuugaaucauccagacgcucuuuggcugccuuugggacgaagauugcugggaaguugagcuguuuggcuuccuguaggaagagcucuagccccuagcuacuugcaccuucaaccugcaacacucccaggagggacuccuaggcuaggguugagagcacagagccugaacacggcuuugaaaauguuugccuaggagugauaccugcagcacuucacuagaaagagaacucagcagguacccugugaucuauaguuaaucaucccccagucuguucgcucuucauguugguaccaauauuuacagagcaguuugaauaaaacauccaccagcaugucacuguugcuuguacuucaaacacagucgccuccagcuaugccugucacucagcugcuguucccagagcgagugccugcuggggagagguguuccauucuuucugaucucagucgccagugguguguucagaaggaucauuugguauaggaaauacaugaugcuuguguacaaccaacaccugcuacauuucuugaucugauggaggaaaugguugguuuuaguaaaaugcuuugugcucgcuguugagggagggggggucuugcaucugacaagcccgcaguuugguuggaugguuuuguuacaacaugcuguuugcucugucaguugcaaagugcucaggguugaccguggcuuugggucuccacacauggagguggguggugggcacagugagauucagggccacugaagcagccuucugucuuuugugcccuuugggcacuuggucaagaagcuccuggcauggcugguugaauaguaggcagggaacuugucuuuguugaagguggcuauggcggcaguccaaggugccagucccuuacugucuccugugcaugugccuggcucauccagcccuccuccagagcuaggaaaucucugccagcgccaauaccagucuuaguuaagcacaagaccuucauucuaacuagggaccaugaaccagggagccuccuccugacagcucacgaagcaaguaggacaguggugccuuguuucuguggcuugguuuuccaggcuuuucacugacauccccccuugguucuccauggaaaccuucaaggucagcacagugcagcacuugcccuuucugguggcagguguuagaacugagaucuuaaagcagagcugagccuggcccccagccucacccuccugggagcugcccucccugggccucuucgcauggugucacccuuugagcuuuuacaaagcucugacaaugucugcuucuguguccacagagccaucuucagagcugccucuucucuuuccguguggaacuaucaaaggagauacucuuccaaaaaugcucaaggacaaaggugacuagaauuagcuaaggacaccucuaaagaugguccugagacccaggaggcagacgugaccauguucaggcagaguugggaugcagcgggucuccugaugaugcuaagccuuuuuugagagcuguccuagacuggcugccaacauggcugugggauuuauggagcagccaagaucagagcuguguggacacucacacagacacgggaaccagcagcaagugugaguauggaggaaggcugugcugucuggaccucucuuugcugacucagccuucccaccuguggauugauuccauggagcucugcaggucacucagggcugggcaaggccuuuugcccccuaguugagcuucccauuucugaggagcugguucucagagguauggugaccguccccaucagcuacacacugcagagggugcagagcccccauucccacuuccauucccuguaaagugaagccugucugaugguuuuaauuguacccagggauccccauggaaagcaugcaugucuaucagacaguuccacacccugggauccaagggagccugaagagcuacuaugaagaucagguacguagggcuuccagggaacgcaaguccuggcagggcaggccccaggggaggagccggagcuggggacaugagaguguagguguugauuccccuugggguucugucauuuccagccacgugacuaagcagauggcuuugcugcagcuccaucuuuauguaucggugauacaggaauagacccacccaguaaaaaauugaauaaggaugaaaggagaaaaguucauaugaaccucuuuguguaacaccuaccauauacagcggccuugucauggccuuuguccuccauggcauggggcagaggcugcgcccacacugggaagagcccacuguggagaacgcgucuugagucaauggcuccaccauuuccauucagaagccacagccuuuugcucuccuagaacagcuucuguacaucaugccuguccugggggucccguuggggcaguccaagugcagaggaaccaugugggccgucugcucucccucucgccgguggaaguuggcagaagccaacaagaagacuguugauucuagcagggcugucuaacuccaggagcugggggugucuccauugcugagccugggcuccagggagucugugucuucuggccagcagagcaaccaaugggaacggccagccucuccaaccucagccugcuuugugaacaauuccuucaaacggugccuuggugggcugagaauggcacccagccagggaccauaccauuguagagccccuggggcugcuggagcuggaccggugguguugaugaggaguggugucugggagcaaaggcuagaucucaucuuuuccuuuuccauaggguaucccagccagcaucacguuuuucagucccuccggccuuaaauacagccucgaguauauucaggcguuaucuggcagcagcuuugaccagauuaagguaugguauucugugcacuuggccuuuugcuccuuacagucuccuggaauuugcacauugagucagacaccuauaaggugacuguagaguccaagggcccacuacuugguuagugguauucugcauacauugcuaaucuucucugggccagacuuauucuaacuuggggauggcuguccccaaguauuuuguccuggauagcuaacuaucuggccuuccccauguggcacuguccuugguuacuugaggacucaagugaggcccuucuggcagggucugguguagguauuagugccuucccuccuuuguucccaguugaacauguugaccugguucucuagacuagaauuaucucucuuuguuuacuuaaaggauuuacacccacacuuucagggacuguauuuauuaggaguguucaaguaacaugacacuugugucaucugcaacagaauuguccuugaccagacuccacugggacugaggagaagguacaaaguguggccuagaacccagggacaguagguuucaucuccaccccaucccagagcucagucagucuggugaccccaacacuuuggcuuaucacaguugucucucacaggugugacccaccuggacauccagacauccccaguuucagguuuaggcacaggggagcucaaaaggaggaacccaugguuggaaccuagaaaggugacugucaggcugugcgccauggugacaccuagccauggucccagcaguugcugggcagucaucagauuucuuacagucagucauagcuuaugcuagucugguuguggggauccagcaggaugggggugauuguccuccuuaggauggacacugagcacagagagguucaacaccuugccaggguuaccuauagcacauuacuagaagccaacuuuuaugacuguuagugggggaggcaccugauuccugcagucgggauugaagagaaauggcccaugggugcucagcacgguccuggucaggugacuacuuaggcaccugggcagguuuagcagcaguuccaacgaugcucagggguaucuggacgagucaccagguaaccaaccgugaagugcaagugcagcuugcugggggaauguaccucagagcucaccugggcugacaugccgcagugagaacucauacugccaugaccuuacucaguccucaaacuaagcaaacccaagauggagcaaaauagacacuuggaauuacagcuuaggaucuggcugcccguacugccuagacccaugcagcagcugggucacagugaaggugugugccugucuuaaaucugcucuguucauuucuguaacccagggguucuuggcaucuuuagugcaccacacaccaguaguuaaagaugccacuggggucuugggcucugcaacugccaggaaagaaacuuucagggcuaacauuggugauaagggacuguggguuauuccagagccagaaagccaauauaaaucaaagggagucauucuuuaucacugggacuuagugccagcccccauggguacuuuugaggcucacagaggacagaguccugagacccaagcauuggguggcuuagcauucacuuccagucagcucugucccagauuugacaguggccuuccuuccucuguaggagucuuugugagacccaguguuuauacagcacuauuuaaaauacagggcaucaccgaagcuuagagugacuucugaccugagcuuacugcuuacggcugacuuacauauaaaugccacaaaggagccaugccagagcagugagaacuuaaugacaccugccaccaaauggauggaagccauugcauugucuuucucuccugccuucucacagugaucacauagccugugggguggccgucuguguaccuggaggucauacgugugucagugagcauauaucugugcagcauugaccaagugguucacacuaaccacuucaggaaucccccagcagcucaggggacauucuggcuagagauaagaagguggaggcuaagaaagaauugaugccaaaggccucucugcucuaugcugcugggauuugaacccuggccuuccagcuuaugacuguucugugugccugggggauccagacccaccugggcucccccaugcuccacacuugcucccgcccagagccccugaaacuggagcaggccugucugcagcuauagucccuaaggaagauauccacccuagauuuuauccucacacauacccaagcccuaaggauauguacauuguggcaugagguuauagugagauccuaaggguaucgugcagacucugaagccagcuucaaguuagguggcacuguuguucaugugaaacgucacacaggaacgaccucuaaacagaaagcauccagaugauaccugcacacaacccuugcuguggcgcugaggcugugucucuugugucuucuuccuuugcaguuuauagccauuggccccaguacaacccgugcuauggcugcuaagggccugccugugagcugcacugcagagagccccacaccacaagcccuggcugcaggcaucaggaaugugcugaagccaaaccacuguugcugagggcugugcagagccagcuccuucccugugcacgggacagcucacugccucuaggauggaacgcagauucggagagaucuggagaagcugccugugagcaugucaccguccuccauggaguccagcuuggagccuacgccagguucacuggccauuaggucacugccauucgacacagggggagagaaagcuuccugggucuagaaagaaggaacugaaaucgaccauguggugacuugugcccacucuuuuacaaacuguauuucuuuuauguuuaucggugucuugucugcauguacaucugugugcccugugcauagccagugccuggagaagcaaaguaaggguggcagauccccucgaacuagaguuagagacaucugugagcugccauccagguacugggaauugaacccagguccucugaaagaauaaguacucucaaccacugagccauaacuccagccuacuauuaucaucugugguucucagugcaaagugguguucugggacaacagaacaucauaggcucucugaugcugaccugauaagaaugauaaaucgcuaugugugaaguagauuuagucaucauaaauuaaauaaauaaauaaauaauaaauaggacugaucugaguaugguagcacacucaucaacccagcacugcaagaauggagacaacagucaugaauuuaaggucagccaggaccauauagugagacacucuaggcuauaucuaaaaauuuaaaaaaaaaaaaaaagacuuaaaaguucuggccuuuggggaggggggcuguggauaauuauacuuuaaauacagagauuucuuuuuua

SEQ ID NO: 4152 - RNA, 12068 nt, Mus musculus
cagauuuaugcagcugguaccacaguacuauuucaguaaccugccuccuagugaaagcaaggacauccuacagcaagcugcaggccaccuacccacagaaacugugaacaaggaccaggaugugugugacaagugcccagaugcuacugagcagagaugcacaauccagugaccucucccaacauagugcaacacggacacugcaacaggagcugccgaagccagggcagcccuggacaugaacacuucaaguaugauuuuaaaauaaaaaaauaguuuuauuaaguucuuaaaauuacuauuccaugcuuuucuuauuggaaguuuuuaaccaaucauucauaauuugaccaaaauaaagaaaaaaaucauuuuguaaaugugucacagacacauggaacagaacccuacuuuuuguagaggacuugaaucugaauaaaauaaugaguuuuucaguaucucuucaauggguuucuugguaauuacacauaaacaagccugucacugucugggggaaauggacuagacggagagauggucuuucaggguuuccaugaucucauucauccugucgucuggaauuaccaucacaguccgcaaaggcgucaucggaacaucaucgaaggaccaucugccucccagacgagugucgcucucccccugcaccgaguagcugaacuucaagauugccuucuguagcaaaggaagagacaggaaggaaaauguggacaacucagaggcagagcucacugacccaaauaaagagcacugcgucuaacagcggagggaaggaacacucagaauaaaguaaguucagacgcacacuucagggagacaugaugaaacaccaaacacauuucaacucacaggggaccaaaaugaaggaaggaguaacauuucaaggccagaacaagcagccaagugacagaggugacauuguuucuaauuccaaaguuacuuucauggucucacucaacuguuaagguaauauuaugacaaauagaugggacuaaggagaacuguccucaaaugcugauccucauaugccuggcagcuuccuuaguuagcuugggacacuucgguguauccacauggcguuugcauagcuagaccaucuugaaauccuacacaggccucuuugaaauggucuccauuuguacgaguucaccacugaacuggaagcugaccagcgagcucucaggauucuccugugucucugcugggguuacaggcaagugccaccgugucccaccucccagguccucaugcuuccauaccccauguuugcuguuuacuucuuguacaacaaaggcagagccaaaucucuacugcugugcaaagggugaauaccccagcuuugccagucugaccacagaucugauccaagaguccauauacacaacuggaugcagggauacccuacaccccuggggcuaacagaggccugccagcacagagcccccaccucuacgagaugauccccaucacacaaauauauauauauucuuuaaaauuauauuauccaauucagaaaaauaaugagcccuaagauuuuugaagagggcaauggagaaaggauauaggaauacugucuaggauuugggugcccagcgucacaauacagaaagugcuagagauccaccagugggugacacucagaccucagggcacagggcagcuaugaugacugucccucagaucugcaaaugggaaacgucuuagaacugaaacaugcaaauguggcuugacuaucacacuguaagcaugcucuuaagugccuaacuggucccaggcaguacccacaucacccccaccaccuacccauacuggacaguguguuagcaagcagccagagaccacagacuaggugggcuagaggacucaagaggauaagauuuuguuuuuguuucuuuaauuucuagagacaggguuucucuguguagcccuggcuguccugaaauucacuagguagaccaggcuggcuucaacuuagagaucccccugccucuguuccccauagugcugcacuuagaggugugcacagccauggcccagccuaaggaugucuuauuuucaagaacagcuacuagagcuaacagagaugaagcggggcauccuuaccucauagaagaacucuuccucugcauuugcaaacaucagugcccccugcugaaggcuguccugccucuuucuggaacuggacuuuccugcuuccauaaaugucuuacuaaucagcagguagaagcagcauuucccacauggcuuguugguucuucgcgccucagacaguucuuuccuacaagacacagacacacacaggucaccacuggguuacaucuaucuggacccagagaaagccgaugcagcaccgucuggacucugcugcacacuggcugggcugacucaugcugcuggcuauauccaagaaugugaugagccugggcuuugcuauaaacagugaagaaucuaaguucagaaagacuccuacccacuaacaaaugaucucagauucacucaaaaucacuguuuugugcaaauuuuaaaauaaguaagaaccuacacuuuuuuguuguuguuguuagcacacuguugcuguccucagauacaccagaagagggcaucugaucccauuacagauggcugugagccaccaugugaucacugggaacugaacucaggaccucuggaagagcagucagugcuccuaaccacugagccaucucuccagcccaaaccugcacaauguuuaacugcaaauucagaggcacacaggcacagcgcauggcaugagaacaugugacuacacaagcccugucacuaguguaguggcacugcagaaacuucacagauguagauaaccuuaauuccaagguaauaaacagaauggcagugaauuuccuuuccuuccaaaauuaauaagcugccucuaaacaaaacuaauaaauucagaacaauccacuuuggcuccacacaaaaucagcagaaagucguugaauccugugagacucaauaagcaggagccggggcuuagaggaagacacggacaaaccuuggagggcacagggcagugugagcugcagccagggaggcagggaggagcaggggccagugagggaggcagcuagcaugccugucuacacuaacccugggcaucaaggcuccuucccucacuucauucucuaaacuguguaguucuauguuuaaguguuuuucuaacuucaaacuccugcaucaaacaacaucaggaggccaagaaguaggggcaguauuaaggauuggguguaagaaucugacucuaguuuuuuuaguauuuguucaacauuuuguucaaauuacaggcaucugugaauguggaaacugucaagucaaaaguaaaaagugcugaaaauucaucagcuucuguaacaccugaaacuuugaaaauauuaaaauuucugccacuaauaaucaaaucugcucaaggggcuggaugcuggaaaugagcagcccccaugcacuauccccccacccccagccugcugcagcccaggcaaccuacacccacagauccaucucugaaucuacuugguuuguaaaaagcaaccggcugaaggcacgucccagagcugcuuacuggagcugcuggugcaugggcagggcaaucuguggagggacguuaaugaaucuuucacuuagcagaaggcccacaggcuugcuggugucauucaaaagcuuguccagcuguucaaccaugcucugcucacaggucuucucacagaagcuuagaaccaacucuuuaauuuguucagcacacugaguccccuggaaaguaaagagaagguuugcucucugccucgagaguagggguuuccucccacugccguuacacccuaguguuucuucuaaaaauaacuacaccuaacuaccaucccaugauuggugguaagucaaguuuauaauuuacacucacacacuggaacagcaaucuuacuacaccucacaaaaccaguuggaauuaacuggaauguuccuuugaaaacugaagguggccuguggccugcaccuucuucucagagaauaagcggcuggcauagauuuaucagaacucauuucugagucaauaaagagagauaacaaaacccauguuaagggccggcucucaacuuuggaagcugcugaauaaacccucccucuguaugcacacuguacugagagcagagaccggcugcaggaucccgcaaacagauccagcgucgguagcgcugccccaacaccagacacuacaauguuagugaccaugccaccugaagaaaucagcuuuaagcugguacaaaucacuccuaacaagacugcuccacacugagaacagagcaggaaggagcacuugcccugacaguaucacagucugacacagaagacuccguccuuaccgcagaucccaggcuucaaaagccacucagugaaacuaaccuuucuuucagucaaauuuaaaaggcuuaugaagccaaagaucucaucuucauccacuucaucaucacugucuucugaaacaucuguuugcuguuuuaaaaggaaaauacuucaacuucacguuauucggcuggaaagaaguacaacaccaauuuuccacuuugcaaagccaaagcuugucuuucugccgucgcguccugagugcagaguggcaacguucagaacccuuucccuccagacccgucugccccccccccucuuuacauucugaaugacgucauccugcucuguguuucuuuacccaagauucuuuggguuucguuuucaagucagggccucccuguguaguucuggcugaccugggacucccuauauagaccaugccuguuaaucauguauagcaacagccagaaccacauagagaaaccuugacuugaaaaaaaccaaaaagaaaagaagaaucauguauagcuggguauggcgcuccuugcuuuuaaucuuaggcagguggcucucuaugaagcccaggccagcuacagcuacaugugagacccggguuuaugugggaaacauacaugccacaugggcaaagggggaaagcaaacagcaaggaaugguaacgaugaaccaucuuaaacucccuagcucuauucugauugccccuccacuaggagacaaagcccuagccaggguuuauuaaaucuguccacauacugccuguuugcuuguccacaccauaaacucccuucucacugcacucaagcccucagccuggcacacuaaguucucaaggccuccacauugaaugagcaagaugagaugaaccugacuucuaccccagcggggucuaugauguccaguacgcccuuguaccuguuauagcugccuucagcaccacgggcucuuagugcucaucgacagccuuuggcaaagauguuggcuuuguuuguuuguuugcuugcuuguuucuuugagauaggguuucuuguagcccuggcuguccuggaaguagcucuguagaccagguugucuucaaacucagagcuccaccugucucuguccccaagugcugggauuaauggaaugagccaccacugcccaguuggcaaagaugucuuaaguucaacaaaacuagaugaaaaugaaaagguagcuccugaaccagcccugguccuccaccaucucuuucugagcuucuccauacuucagcugacccagcaacagucccgaccgagacccaugcaauaaugccccacgccaagcuuucuuggcucacagaacaaagcaggaauugaggugaaucugaucucuguccaaauggcagguccacaaaccaaacagaugccuguugcaauucuaagcugugggacuuuuacaacaacaggaaaccagaagggccccaggggacagguggcagagcugaguccgugcuggguccucauuuucuauaacucuacuuacugggcaagugcuuccuuaaguagcccuuccuugcuuuuaugaacucauaccauuuuccccucucacugcagccauucauaucagcuccucuggugucucugccacucauuuugcucagagaagcauggcuggcaugaccagggcaucuguccuucccucuccuguggcaauuccgaucacaccugauaucagugacugacaucugcggaaaacucagagcuccagcugcugcucagcaucuuccacacacagcucagcacagcagacgcgaagugugcacacccuguaauccauccacccucucaaccuaccaucuaugcuugcuaaccucagcgcucuagcaaacgugugagucaaccucggccacucgugggcgcacaugugaugccugaauuccugcacacaguaccucuggaccacugcagcaaccucugggcaguccucacaguacuuccuuucagcaggagauaaagaggacaaagcagccacagugucccucuccccaccgaccuuaaucacacucccaaugugguucugcugcaucaggagauucgucagcucggcaguguucacgggggcuuuuagaaaaagcugaaagaagagaaauauuuuauauuaagaucaaaacacaauuucuaauaacaccgcaauuccauuauuuaaacaagaacaaugagauguagugagcugacccagcuggcuguaaaguaacccaggaggaaaacaaacagccagagucagauaaacgucagagaagacagagcccgugguauuuagcaaucaggcaugggaagaagagaaacacaggccauguuguuugaaguaaagucacaguauagcaggugcaggucuguggcuauuaccuaaagaccaaugcucggcuucugagcugcugaugcugggggaggcccucccugcccucccugcccucccugcccucccugccgcagugcacugcguccccucugaacuguaagccaaacucuuccucccuuacaaaauuauuuuuguuuuugaccccaccauguuuggaugugaauuauaagaaagaucagaacucagcgguguccacaugcaaaggaaaacacuccaggguacagcaaacuuuaacacuguaaccaggagcgggacaaggaggaaaggcacaagcagccauucaccugggaaaggagaaaucccuccagcaaggugcagaagacagacagggaaguucuggaaagacuguaccuguugcaguaauuucuuaauuccgccauaaucguuaucugagauggaauaggcuucaaacucaauauucacuuccuguaaguaacaugcaaagcaggucagcacaggcagauuuacagacggcguaggcaggauuuccauucugugcauuuuucuuuugccccauccuuuccuuggucccauccuuucaggucucuuccucucuaacuuaucugcagaacacgucucaggggauugggagugagaaaaacaacaaauguaguauaauguggugguguaaaccagcaacuugggagacagacgaagaucaauaauuugagaccagccugggcuacacggcaagacguuucauaaaggggaagagagugggggucacacaugugcucauaugucacaauacguguauggaagucagaaaguaauuuacagagucaguccucucuccccaucaucucagugcagggaacugaacucagguggucaggcgugggcguggcaggaagugccuuuaccugcugcaccaucucuccugccuaccccagccuuuuuaauggcacaaacaguuaaaacuuuuuguuuuguuuuguuuuucaggacaggguaucuuucuuucuuuuuuaaauauuuauuuauuauauauguauauggguacacuguagcugucuucagacgcaccagaagagggcaucagaccccaguacagaugguugugagccaccaugagguugcugggaauugaacucaggaccucuggaagaacagccagugcucuuaaccgcugagccaucuuucuagcccuaggacaggguuucuugguauagcccuggcuguccuggaacuagcucuguagaccaggcuggucuucaacucuuagagauccaucugccugccuuuuccaucugagugcuaggauuaaaggcaccaccaucuccuggcgacauaaauuacaguugcaauuuuagacuuauuuccuguggcugcuccacaaaaacagaguccucauaucugcuuugcucaccuugcuuucucuuucuuucucucuuccuuccuuccuuucucucucucucucucccucccucccuucuuuccuuccuuucuguaugacaugaucauucuaugucugucugucugucuaucuaucuaugacaugaucaugcucuaucacuugauuggccuuaaacuucccaugccccucccugccucagccuccuaaguguugggauugcaggcuaguccuaccaggcacgccuuuaccaucuccucucgauacccgcuguuacuuaguaacugcuaaguaaauaaagccaagccucacagggaaauuagacuccaggcaacucuggggacuuggagugaucuuguucuccaggcuuugccuuuuggagccaggugaauaauuauuucucuuuggaggcugccuggcaguuuuaucuagaugagaccguguuugcauuuacaccaggucacugcauuuugguccuucaggcuuuugcaucacaugaggaaaugguaugaauggcuugugcacucuguccacauggcaagcguggcaguauuuaccuucuuauacugcuuuuucuuugagaaaaagccucccugggaagaacaggauggccucacaacugagauguucucgcagccccccccccccccccccccgacaucugaguuagcacugcagcccugcaggacuggccuggcuuuagguucaccccuuaugaagccugacacugacaguuacuuaggcagcaugcacagggggugggggagaggaacuguuccuuucuuaugacccacauggcagagugacagaaccaacucguuccuguagcuccccucugacaucuacacguguggccaaggcaccuaggcauacaaauaaacacacacacacaauuaaaaagacacagugugcuguuacugcuuaaaacuaggcaaccagaaaguccagaaaggcuuucuucaaaaagugacaugaacaagaggugcugaaguuucuugguacaagaaacagagacuagaagaaggcacauguccccaaguccccuagcagcuuugguaagcaccuugcaacagaaucuaagagaaaaagccagcuaccccacuuuguccuuuaaggcuggcacugaagaaucugaacuaugacgucccuuuacuccugauacaccauuuuguuucugaaaagcuuugagguugaccuuccaaaauaacuuucauggguuuuuaaaucagagaaaugaauugugagugaauaaauguaucagagaaugaaagacuucaauuaaauaaaaggugaaauucccacugaggauuucagaacaagacauaugcccuaauagcucuaagaguuuccucugcccagcaguuaagcaguuaagcugcucucccgacgacccagguuugauucucagcaccuacacagaggcucacaagcaucaggaacucuagccccaagggauccaacgcuuuccuauggccucuguggacauggaauacaaauagcucguguacauacaagccaacacacauacacacaaaacuuaaaggcacaugugaaggguaaaagcuacacugacagggcugaaaagauggcucagugguuaaaagcacugacugcucuuccagagguccugaguucaauucccagccaccucauggugccucacaaucaucuguaaugggaucugaugcacucuucuggugugucugaagacagcgacaguauacuccuauacauaaaauaaacaaaucuuuaggaagaaaaaaaaaacacucacaagcugggaacucucuuguucucuuguuucucucuugcccucuugagcucuuccauuccccccucccugccucauucccuucccccucuccccacauguucauggccggccucuacuucuccacucucucccucucucugccucuacuacugucuuaccucucuuccccaugcccugaauaaauucuauucuauacugaaaacaaacaaacaagcaagcacagcauccugggcuugauuaucagcacuacaaaaaacuagaaacuagaguuacauaugauuucacugugguuaucccagcuuuaauuucaucuuuugaacguuaagaagaggacgaggaggagcaggaggaggagcaggaggaggaggaggaggagcaggaggaggaggaggaggagcaggaggagcaggagcaggaggaggaggagcaggaggagaaggagcaggaggaggaggagcaggaggaggaggaggaggaggagcaggaggaggaggaggagcaggaggagcaggaggaggaggagcaggaggaggaggaggaggaggagcaggaggagcaggaggaggagcaggaggaggagcaggaggagcaggagcaggaggaggaggagcaggaggaggagcaggaggagcaggaggaggaggagcaggaggaggaggaacaggaggaggaggaggagcaggaggaggagaaacaggaggaggagcaggaggagcaggaggaggagaaacaggaggaggagcaagaggaggaggaggaggaggagcaggaggaggaggaggagcaggaggaggaggaggagcaggaggaggagcaggaggaggagcaggaggaggaggagcaggaggaggaggagcaggaggaggagcaggaggaggagcaggaggaggaggaggaggaggagcaggagcaggaggaggagcaggaggaggagaaacaggaggaggagcaggaggaggagcaggaggagaagcaggagcagcagcaggaagaggaggagcaggaggaggagcaggaggaggaggaagaggaggagcuuuauaguaagcaggcaggagaugauggagguauagacucgaauagcugcaggaucaaugauaaggugugucuggguacugaagggaaagcuaacaauuuacugauagucugauguagcgugagaaaggaggaguaauuaaaggcaaaggccaaauuuagaguuugaacuggaaaacuguaacagaaauggugaagagaugggaauaaauuacaagcccugcuuuggacggucaauucuaagacagcaacuaucucgaauaaccacucaagccuaacuauccaccaagaaagagguacuuaaacgacuuggaacuagauaauaagucugagcaaucccaggauucaggaggcagaagcagacagaucucugaguucgaggacagccuggucaacagagugagucccaggauagcucagggcgacacagagaaacccugucuggaaaaacaaacaaacaaacaaaucugaagaaaggccaucaguucugugaggcgauaaaagcagucugaccagguuggcugucccagauuggcaguaaauacggucuaacugagauguauaguaaagggaaaacugcaggauaaagagcauuugaaaacggugcaauaggacaaagcagguugccuuuauaaucaacaucagagcgugagccuggcuguguagaagguggagagcggcuguagggaagaggagagaccaaacuucgcaggucucugaagguacgugugcggcugccgggcuucuggggugggaauaacucauccgggaagggcuacagggauuaacguguaggaaagcccgcagugggaaccuggguaaggauguguccuauauaguggagggaaaucacaacuccccacaucucccauuacguucccacaacuucggcugccugaaauggucacgugugcuuucucaccucguccacgauuucgucaacuucauccucuucuucgucacugucguccucgucuucuuccucauccuccaccucauccucuucuucuucuuccuccucccgcuggcccggggcucccagcggccgcugaauuccauuucccaccgcucgcuucuuagccuuagaugccaugucgccggucacacugcgccugcgcg

SEQ ID NO: 4153 - RNA, 1806 nt, Mus musculus
ggccuauguauuuuuuuuuuuucagaucugaaaaugucuuuauuuuuuagaaaauggauuccagggagguuaaaaagcaauaccaaagggcauagguacagaacugaaugaagucauucaaagcauccaaguaagaauauggcaauauaaagauccaaaaagcaucucuuaggucuucaaaacaaaacgugugaguaauuccuaacuagugagcaguacagcauuuccuagaugggaaaaacaguuaacauuaaagucuugaaagccuuuuccuugguuaauuacauguagacaguuugccuuugaucaaacuccuuuaaacauggguaacgguauuauacagguccacugcuaaaacagacauguugcaaauuacuugugguauaauguguuccaacaaagcuuagaaaauaaagacauugaguuggcuuuggacuaaguuuaauagucaccuccucugcugacaacuucuuuacagguuggacgcaacaguauaguguguucaaacugugcuguguauaacccuuuaaugucacacagugguggguauggaucuacaaugcccaagucacacagagucuucagagccauuaaguauuuacuuucucccaagcgauccagccaccuuuggcagaaggcaagaguaccgaaguuuucguugaugacauuuaacaaguguuuuguucuuggaagccuuauuggcacauaccccacaucaaaauuuuucauguagugugaacauuccaugucgucaugaaccacgcccuuccccgugcucccaaaggucucaauggcauacaccucuccuuccuccauucuuguagcuuccccuccuuucacaaugggcaccauuuuuccagcgugaauucuauauggcccaauugaauguccauuuaaguuacauauggguuucucuugauaugucuucccaucuauuucuacuucauaggauuccauaacuucuugaauggccucaccgacaucgcagaacgucaauccuauucuaccacuuauauguguuccaaagucuaucuuacagaugucaucauacugcaagacugucgugucaccagcauugggaguguaaugggcagcacaguuguugagagaacacccaguggggaacgccaggacugcauuuaacccauuuuccuuuauuagcuuuugggaacagucuuccaacuucucacagauuucuaucaucaucaucccaggcuugauccagcucaugacauauuuccuaacuugccgauguuagcuccgcagcuucucagaagucguuccauaucuccucucuggccuggucuagggccuuuuuuucccucacuugugguucuccaagcagcuguccgcccaucuuuauucacacucuuguccuuugggaaauacaccauuaggauacaggucacauauuggaacugagggagggucuguuugaacuuuugguccucucuucuucuucuuucucuucuucuucccaguugcgccaucagcaucaccaucuccaucuucaucaucgucaucucucuccuucuccuccagugcuuggcucuccagcuguuuugcuacuucauccaccaaggcuccggauucuucaaguucuuguugcacugcugacacagccccuuugcccuucuucuucuuccgucuuuucuucuuggcggcuuccucggccaugcuggagguucccucuucccugucgucuggauccaggucgccauucaggugacccccgaaggacgcugccugcuccacgcccgccauguugcccaagaaagagagagagagagagaacgagcggcgagg

SEQ ID NO: 4154 - RNA, 502997 nt, Mus musculus
caugacaccgccuccgccgcaaacuuuuuccuccccauccugucgcggcggggaaggaauggaagauggcggccuaggcgcagaguuuccugcccgagcagcggcggcagcagcggcggcuccagugggcugcggccagcgccaccaugacgcgcuggguccccaccaagcgagaggagaaguacggcgugggugagcagcgcgccgccccgcgcccgccccgcgcgcaacuuccccgccgcggcgcccagccuguugccgcgcggugcggagcccggcccgcccggggcuggagcccgcguggggaacccggggacccuccgggguccaccgugcuccucauucccgcgcauucgcucugucguagucccgugugcuccugcgugcgcggggcucccggggucauuguuugugugcguuuuggcuucuucgggaaacuucuguuuggcauccgggacuccggguggacacuuuucauugugcagcgcucggaucugugaagccuccuuuucucgcgugaggaguggcugcgccucccggguugggucggugccgccuuucccgcccuggaugguaggggacacucaggcgcuccuguguccccggggcucuggaaacggaccucgagggcggggaccugguuuugccuuugucgcuucccuaggggguagaaggaguaggguugcaagcuuacuuuugauccaaggagucccgcuuuccucaauggccagacagucccagagcccugcagaccuugucucgccccccagcuagcccacaucaaaagucaggucugucuaggccucagggcucgcuggcauuccagauuugaccauuccguuuccaggcuccugcucucuuuucccuaaggauccucugacgcccagccucaccugagcagagacucugacuugcaagcaggcauuucuuggggauuugcaagcaagcauuuaggggagcuugcugccuuccacccuaagggcugccuuggggcacuuucucagcagcugucuguucuaggcaugccuucagcaccgucuugcaggccuaguucaugucccagcccgcugucuuugaaagcuucccggagacuccagucuacaaggccguguccuuccuuugaacuccaguuacuuauuucuguaacaaguaggagaugguggccaugggggcagggcuggagaagccuagggccccuaccuccacucuaggcccacacccagguuuggaggauuuuucccugcguugugaacacuggagcugagcuccaccugugcuuggccgaccuuucagaggcccauggcagagcugggaagggcuguuagagucccaucuauuuaauuugggaugaggguccuacuuaggauggcuucagggugugggagguuuucucuugggguugcccaggacuguugaaagaacagcuagaagaguggcaggggcaagcagaaagccagauagucggggugcaguugaggaaggagggcccugcagaggacucccggguaguggagaaacuugcccccugugcuuuacccuuguagcauaguaaugggagcugcuggguuugaacccuggcaacaguggguucacauucaucccuguucugcugcaacugccacggugccuugggauuauuggggaggggagucuauuucuuugauuuuuuuuuguuuauuuuuuugggggggggacagaguuucacuauguagcccugguuggucuggcuucauacagaggucuacuugucucuaucaccugauugcuagguuuaaaggcaugcauccucacaucuggugggucgugucgucgcccccccccccccgccucccccccagcauccuccacucccuuuaaguuggaagacuguuuuguugccauuugggagaaagaaauaggcaggcuggagaccucagcagccuugggaaugaaggguuguagauaggaaagaaaauggcuugggagagguugggggugggggugggggugucgggggggggggcaguuaguccaaaccuaguuuguagugcagggugguagugaggugcauaccaguaaagucggaacuugggaggaucagaaguugaaguucaucuucugcagcauaauaaguuugaggccagucugcgcuacgugggagcguaucucaaaaggaaaaaagcuguauuuucuaagcaaaaggccagaaaacauuuagcaguggaaacacugugaguucuuuuguuggguguggggacuucacuugagagagagggaaacagacacagagagacagagaggagagacagagagagagaagagagagagagggagacagagacagagagacagagagagagaagagagaagaagagagagagagagggagagagacagagagagacagagaggagacagagagagaggagagagagagagggagagagagacagagacagagaaagacagagaggagauggagggagggagggagggagagagagauaucaauccagcgcugggguguagguaggguggugguggcacuacauuuugcuguaacguccccuagagacauggauguugccuccagugcgccuuuuguaguucuguaguguggcuuuaccuggagaaguuggggagacauuccuauguaggggcaggagggucucucuccagaggugggaagcaagcagcccaagaggcuguggcugucucagugaagccauacacccucccaaaggcacucuuggaugugacuucugacaucaagucuuuugcuaaugcauuaaucucaaaacuguuuuugcagaguucucacaggagaacuacuaaagugauucccaaccuuccuaaugcuacgacccuuuaacccauuuccucaugcucuggcgacccccacccccaccaacuguaacauuauuuugcugcuaauucaugacugugauuuugcuauuguuaugaaucauaauguaaauaucugauaugcaggauaucugacaugugaccccacacccggagccaugcucacagguugagaaccguuggucuaggugaugguuuugccaggaaauucgagcaaaagugugaaagguugucggguguaggagaaaguggacccgugucucucuucaccaggaugggauaagacagcugagcuuggguguaacaggcaucagaaggcaccuugaagguuagcgucuccaugugucagaguuggggggacaccccagcucucugcgugucugacagucuguacugggaggauccuaguggcucauaggacagaugcucccuggggagguugcaaguucuuauaugcaggcugauuggcuguuucucccuaagggagaguuacuaaagaucccccauacuaacucgagccuucucuuugguagccuuaacaacaggccuguguuucucuccugaggcucugguggguggacccugcuuccacuccagccacuuggcccgugcaugaaucacgagggagaaggaaaaugaucaaacgccaucgcuuuuggaaacaugaaucacagcucauuguucggaugagcuuggggacucuuggaagcauuguuuguaaaugagaugcuguagugauuuauuuauuuauuccggaaaaucgagaugagcguaaagggcugauguguggcucuugccagggcaggaaguggggguucccaugauucauuuuguaggggcugcugcuuguauaggcugccagcuggcuuccccccuaacuccugggcuugguuuggugggccguguucaggggauuggcuuauucacgcagguauaaacuuugaguuagcugucacaccaagggcuuggcuagaugaucuuucccaucaucccagcuauggcaggguccuguguucuagaauuaauacguuuugauggauccuguuugucagauucagcgugggcuagaagcacacuuagggacaguguguucacaguugcggaagguggcccacagccuugugcacagccugaucucuacccugugaguugugauaugcugauaccgaagagaggcuuugcagugugauugagccuaugaaguaugggauggggucacaugggcucugggagcuuggcuggcaggucuuggcagagggagugggaaagagagacauguugaaugggaagcuaggucccacaccagagaaggacuugaugagcaguugcaggaagauguagggguucacuugcagggacuagacugaggucccagaaagcuaaggacuaccaggcagugugggcucauaaaacuguaugauucugcaaacaucccagaugagcuuggaagucgauuccuccugcagucuccuggugggugccuugcuggccaggcuuuuguuugagacccacagccacugggccucuacagaaguguggagccaugcauuugaguaagcuuaaggggaucuaacuaggguaguuuguuauggcaguaguagaaaaccagagccuaugauguggacagcgacauggguucgugagcucuguuaguugcagggaagauaguggggccagcauuccucaccccuccucuuucaggcagagaaccccaggaggaagagggcauugggaagguauauuauccuuggcgcuugcuguuguuuuacuuuuaagaaaacauuauuauauuuauuugugugugcaugcaugcgccaggcgccaugcauggugcacacaugcgugccguagggcaguguauaggaguugguucuucccuuccacuguguggguccacuggggaucaagcucuggucaucacccucagugccuuucaccgccugaccuaucuugccggccuccauuuauuugcuauuuacuaagggacaacuuuaagccagcccuugggaggcagaggcagguggauuucugaguucuaggccagccugcucuacagagugaguuccaggacagccagggcuauacagagaaacccugucucgaaaaaccaaaaaaaaaaaaaaaaaaaaaaaaaaaaaagaaagaaauguaaugaggaaguugggcgugagagcacacaccugccuuuaaucccagcacuuggaggcagaggcaggcaaucugaguuucugcucagccugggcuacacagugagauccuggacagucaaagguacauagugagacuaucuugaaaaaagucaaaaugccaaaggcaagggaaagagagauggggggcuggugaugugaugaugagggacuuccuacuuagauggaacgaacacccauaguccuuaggaaauugauuuucuuuuccuuucuuauauuauacuauacuauacuauacuauacuauacuauacuauacuauauuauauuuuuugagacagaaucuuacuguauugcucaggcuggccuaacuuuguggcccaggcaagugauucuuaaaauccugcuuggucaguaugaaacaugggguguguucuuguuggcuuggucuuugcuucaaagaacacccaaagaccccugggagggcagggaguagugguagaggccucauucauuacccagagugcugagcuggccgcuacuuagggauaaaacauucgauuggauccuaaguaaguuagaacgcacacauuucagucacuggaguugcagggaaacugaauuagggcacggauuauauuuauccaaauccgauuuuacuuugaaacucaaauguuuuaaaugcauuguuauaccaucacucuagaauauuaccugucugaacaggauuguguuagggugugggaaucaguuucaggcugguucugggucacuccuguggcugcaggcagugaaggcagggaccagagaagagcugaguucucugggcggauauaagggaacucagcagcuuuuuuucaguaguacuugagcuccuccauccucccucucucguuccuucuccccccucccaucuucccucccccugcccuucugccucucuccuuccuuucgccccccccccuucauuaaaguuggcauuuucaagcaauguggccacaugcagucauacaaaaaguaagaacauaaaggggucuuuuacucacuuuuucaguuugcuucccaccagacugguuauacagucacugagccagggucuggaugucgaugcagucaagcugcaguguccccaggccucucaugcuguccuuuagcagccacugcuacuucaguacuccccaagaccuggcaauuguuagucuguccuguggcuagacuucugcauuucaaguggauuccuacaguagacagccuccacuggucuuugugcacgcaggggcuucuccgucuuugguccaccagguuguugugucugucguccaguuccucccuucuuccuauugaguguuuuggcuguuauggauaaagcugcucucucucugucucucucucucucucucuuuaucucucugucucucugucuguguaugucucucugugugugugcauguguauguuggggugggaagggagauacccaggaaugcaaaugccgaguccugugguagguggauaaugugacgauucuucguuuucuucccauuuugagagagggagggguggggccagaggucaaugucaagugcuuuuccccaucacguuccaccuucuguuuugaggcagggucucuuacgagaacugaaacucaucauuuuggcuaagcagacuggcuacccggcuccagggaucccucuguucccacccccuuccaucauugcuauauuuaugggugcucacuacugugccuggccuucauguggguaccacagcccacauucagguccccaugcuuugguguaagcacuuuaccugugagccuccucugugguccuggcuauuuagcuuuuaaaagaaacuggcagccuuugcugcacuggcugcgugggcugccuauaccagccacguaccccuuccuuucuguccuuccugccuuugcuguugucuuuguucccuuuacccaggcugacuggagcaucagugucucaggauagcuggagugugugucuccccagggcagccauucucugaugucuggaugucauguauguguggaggccagcaugugcuggcugacaaugauggaggcgcuccagggagggacagcagggccugggccacugaccugagaaguuguuuagggcuggcccucagaagaggucaaugacuaaaguugcuuucuguucgaggaucugagucugauacccuggacuccugcaaguugcccucugaccucuguggguaccaugauaugugugcccuucccccaacuaacauaaaauaauaguauaaagguaauauuuuauuuaccaacaggaagaagacaauuguucguguuuucguggaaggguaguuguucagucugaaggaacagcagggaggggguggggcagugugacuggccagccuugcaagauuagcaguguguaacugagcugugggccacucauccacacgauugcguuugcaauuguuucagugugcugggaagcucuugggugacuugcugcacuaguuugcuuucuguugcugugaccaaaagcaacuuggggaggaaagaguuaagguggcuuacagguuacaguccaucauccagggaaacugaagcaggaaaacaauuagcuggccuugcucagcuacuuuucuuagauaguccaggcccaccuaccuagggacagcacugcccacagagguaugagcccucucacaucaaccagccaucaaguaagugcccuguagaugugccacaggccagccugguggaugcaguuucucaagugagguucccucuuccuaggcguauguaggguugugucaaguugagaaccgcuaaccagcaaagagaggaggugcacaccagaguuggcuuuuagcucugacagguugccgucaagcaccaucaggugccacccccaugcacacagcuuccucaugaaaccuugacaucuucaagauggagaugccgcaggugacuggggcaagccuccgagccuuuucccagccuccuuugcaccucucccaaaagcggggagaacgcuuguugaugugggguucagaggagcuaaugcucucuguaaggcagcuuggaagcacagcuguggauuugcuccugcuaacaugggcagcucuuggggcugucaugaagacccacgugcacaggacguguauuaguuuagcggggcugcuaugaccaagccccugucuggcuggcagacugucaucuucaccucaucuuacucugcugugugugcccuaaccucuccuccuuuaaacaaaugaguccagaccuauugaauuggggcuuuuauugaaaaccuuguuugaguccagccacccaaugacuggccucgcuguccccucuaccccaaguuccauccuggggcucuguggucguucgagugagucuguccccguaguggugcuccuuggggacgcucaggauguguggcccugcuggaugaagcgucugaggugggcuuggagagcagaggcuucuuuuuucuucuuguuuguucccucugcuuuuuguuugugauugaagaugugaucucccagcuugcucuugucugcuccuagcugccaugucugccugcugccacgccacccugccauuugggggauagacucucgucucucuggaaccacaagcccaaauaaacucuuccuucucuaaguugucuuggucauauuuuaucacagcaacagaaaagagcauaauagguuuaaagugagauuguaacuccagcguucagauguucaggcucccgacccagcccucagcaguguaccuuaagacucagcugaguuuccuuugucuucauggccccugggcuuuguuuuguucuuuccuguaagguucccggagggauguggcagaugaaauguccuugggucagccuggaagucagcagcagaguuugugccagaacaaugcgcucgcucaggcaguuuuagaccugaaugugagcaguauuuggugcuguuguuuuucucaagccucacugggccugggcgcucacacacccugcucagauucauuucccgguucucagaagguguguuuuugugacaggagccagcugcacugugcuuccugaaucccagcucugcagcagugacagggauggccuuuggugcugggacugcaccuuugcuacuguccguggacugcacacugucuguuccagggacugccuuacguacugcacugggagccuagcuucucuccccuaggcaaacucacaaggcucucagugauguggcaccacggagucacaggggagcuaaaggggcagggaagggacuggccuugggacaaauaaaugccuccaauuuugugauaauuuugaagccgugcuggcucugugccuaccaaguaagucaccacagcugcacccaagagggaaucuggguacaagcacacuggcacccuccgccuucagcaggcaggugggagagcaaguuacauuuucucgugggugccuguggugcuuagcaugugguggaggacauuaagcacgcucacuuuuggaggcacagagagccuuguuguggauuuauucauuuuuuuugguaguugccuuuugagacaaaguuuuaguuuguagucugcugcccuagaccucacugugccaccuaggccagccucacaaucuccuaaguagcugaagaugaccuugaacucccgacccucaggccuccacuucccgagugcugcaaacacagguguucuuccccacaccuguuuugauguuguuguuuguuuguuuagucauuguuuuguagcuuuggcagcuucucucaggagagugagaggugaaacugggugagcuuuagagaguauuacugaguuggccugaguggcuauaguucuuucugguuucucaggggaccauaaaaguacaggguauaggcucagcuugacguugucacugugucuccgaaagugucccucagccuuucccaggugcuguuuaaagcugugauuugccauuaccuugggagugccucacacaauuugugugccacccugagugauuuguuuaacagaaucacauuagauaagcuuguagagaaauguaacagucacgauuuccuuucugcaucuggcugcuugcuagcugcucucgcaaguguucuggcuauuauguugccuuuuuuaaaauuuuuuuaacccccccccccuuuuuuuuugauauagggugucacuauguaacccuggcuagccuggaacuuuauacauagacuaggcuggccucagacucacagggaucuaucugccugcuucuggcuggacagugcauucugcuggcuucauacaguuaaaguuugcuuuauguuggugucacacagguucacagcucucugccucacccacagcagguagguggagaaggaggaacccagaaguugguaguccugcccacccacgccuguugacacuuucuauuaaucaggauguagauuggaaugggcccuuuggcaucacugaucaugagcaguuugaauguacuucaccucaucuuuuauuuuugaaacgcaaugguaaacaguuguuugcuuuccccagaaaugagaagagaugcagcugagaacugaggccguguuuggugucuguggguuucaagaugauccacaucuugcugaguccaggaagcaaagccuuaagcgucuuuucuguauugacccucccuaucuuccuucccuuuucuuacuuuucucuucucuccuucuuaccuucuuccucccuucccuccuccuuuucuuacucuccgucccuucucccuccccccaucuccaucuucuuucuucacuuuccccuucccucuucuccucuccucacuauacuuuucuguucuguuuccccucucccuccucccugucuuccucuccuuuucccuuccuuccuguucaguuucuucucccuucacugauuccuucgucccugaccuuuuccccucucucccuucuccuccuucuccuuccugucccccauucuuuuuuccucccuuccuucuucccuuccuuccuuuuuuccucccucccuucuucccugccuuccuccaguccuucuccccccaacucccuucuguuuguuucucagcucuguuggguacgggugguacagaguuguccuucugggucucauauucuagcacaguccccagucugaacccgucacagccaauguugugucagaaauugggaugucgugauguggacagacagguacgaguagguggcucauguacguuccagaccucacccugcacaguucugggcgacacccaggaaucuuguugaguauguagauacaguggcaaugggguguggacaugccugaugcagggacccugcugucuacucaggcugggguucugccacugagugaguucucauuggguucuggagcuuuggggauuucuaggggaucaguaaugaaugaacuauggguguuaccuguuuucaugguggccccauguccuguuguccuugguuuggcacauuugugccugauucugcucaguucccagcuuuguagggcuuguccugucugcccugacuauuccucuugcucugagccaggcugcggggauagaugggagggaagauugaggaucuauugugaaugauucugauuccccagacccugacgggaaggauggaaugaggaggggacauagacaggaugggagccagcaggugugucucccugggcucuugaagcuuuguuuccuuuuccggaauccccauaggcaguguuggggacggaccucugcggcuggggcauagccuucauagcucaggccgggagccagcugccuccaucugagaaggagagaccuagcucuuccugcacuguccacauagggagcuuaagcugccugcgagauagaacgaagaagaaaugucugcaggcagaccccguaguuggcuucuguaccccacccuuuaaggauguccccucagccucccuguuucucagguuguacaccccuugugcugagugugaaugauggaaauuuuuaccucaggaaaacacucugugaucacaggagcuaacucaugucaagcagggugcucagccugguuacuucucacuuccugggcuuggucagucuuugucacaagagcuauccugagccuugaaggaugcacuuucugucucugggugggaaccccccccuccccccccccccaccccaugucucagucauugcuaagcauuuccuaggggaagauggccaagcucugacuuguuuucuguugcuccugcugcucuuccugcugcucuuccugcugcuccucugcuguuccugcugcuccugcuccugcugcugcuccugcugcugcuccugcuacucgugcuacuccuacugcuccuguuacuccugcuacuccuacugcuccuguuacuccugcuaccucugcuacuccuguugcuccuacugcuucugcugcuccugcugcuguugcuccuuuugcuccugcuacuccugcuguuccugcuacuccuguuacuccuacuguuccugcugcuccugcugcuguugcuccugcuacucccgcugcucucacugucagcaaagugucucucugugccacugaccuugcacuauguucuaguuauuucuucugucacugugaucaacaccaagaccaaaagcaacuaggagagggaaagguuuauuucaucuuacacuucagucaacguucauuacugaggaagucagggcaggaauucaaggcaggaaccuggaggcagggacuaaagcagauaugguguaggagugcagcuuauuggcuugcucaucugccuuuccuuauagcucaggcccaccuguuuaggguuggcacaguccacaauggucugggcccucccuucaacaaaugagcuaccaagaaaaugcuccacagauauguccaugucuuuuguaugcugccacgaccugcaugaguuuauauguguagcugccuugcuguguccacaagaugaaguuucguucauggccgcuggcucuuacaccuuuccugcccugccucauccaaugaucccaaagcuuugguagaggaggugcacgcgcguguguguguauguguguguguguguguguguguguguguguguguguauguaguauguauguucccuuuagggcugaguauuuugcagucuacuguggcuaaguagcuaguuaugggucucuguuaaucauuugcugcaaauagaagcuucuuauuuaaaaagauuuauuuuuauuauuuuuaauuauauguauauguauguggggggugggggugggggagaggaugguauacgugaucaagugcccugggaaggccaagggcauggguuuccucuggaguggagugacaggcaguugcaagcugccugauguggaagcuggggccugaacucagggcuucugcaagagcagugugugcuccucauugcugaccucccucuccagccccuacauuuuuugucuuuaauuacauuuauuuucaugcaugcauguguaugugggccacuguauguuaugugaaggucaggggacaacuuguaguaauugguucaucgcuucuacuguauggggguacucgggagcaaacucaggucuugguaacauugcuugaguuauccuaccuggcuguuagagcucagacaaugaccuggggaccaaccagccaggccugcauuucuucuaaguguacucaagccagucacuggagaccugucccagacagucuugcucagaauuuguuuguugagacacggucucauugugcagcucuggcugucuuggaacucacuguguagaccaggcaggccuugaacuuacagagaucugcuugcuucugccuccugaguacuggaauuaaaggugugcaccaugccagggagcucgcagaguuuuauuuguaaaaauaaaagcacuuuccaagccucuuuuuuuauuuuucuaaaauaauaacuuauuuucuuuaacauaauugacuuuaccagggacaaauaaugacuuagcaggaggaaaaugugauuauuuuucuuccaaauugccucacuucuauuaacuuaguacgauuuauuucaaguccuuucugucuuguguguuuggcugcccauuucucaaaggugagagcguguguugggcuguuuagcccucauucugggccacugugaacccuuaaguaguucuugguggggugcugcccuaagaacuggccuggugaggcuacagggauggaggaccucgggucagagugguuucagggacuaccguucacaggagggaugaacuuggccugugagccucaaggugacuucugguguuuuugcccacaggguuaguggucuccucgaccccugacucugaggaauuuaaugccuuguggucugauaagccacagugccuuuucacaggcuucuuuggcugucuagacguucuuuguuuccacuuggcuuuccacuuggcuuuccaggcucacccuugucuuccuacccagcuugcaaagcaaggcuuucuuauaauucucucugaaguaccacaauucaguucuccuccaaucccuguguccccuguuccacugccaggguuguguagauccuuuccuguguccccagcaugugguguguggcccauguguauaggugaagggacagcuuuuuaucucaacagcccugagacuggagucguguguguguguguguguguguguguguguguguguguguguguguguuacguggcuuguguugcugcuuccaggcuaguguugggacccacagaguggucuaguagauguauggggcagugaccucaaaacucuuuuccucucuugugucccggcuguuugaaugaguggacauaugggguggguagggugagucauauuuuuauagcucagauauucucuugguaaauugggacuaucacuugcauuuuggggauuuuuauggucuuagauuuucucccacugaaucuugauacaaggcuauuuuucaagucucguuugaagauaaaagacuucuccauccaguaaugacuagaaggaaggugaaugaauguauaagcggaugccauuugaguccuggcuccagcuccacaguguggcucaagcaugucuguggucucagaugauccgucaguggagguucugccucuggcuuuuccugccccaaaugcgaugaaaagacaggugucaaaggagagaaucgaugccaaaguauuuuguaaugccaaacauuaaacagcuguaggggacaguuagcagccucuguucaaacugagaugggccgcuuuucuuguccaguuuauuugauaagugugcuagacuuugcauaccaagaggcaugguccagggugcuuggagcacugauagagucacugacaagugauacugccggaaaauguuauaucuauaaaaacaguuugccagcuacucaaaaaaaaaaaaaaaaucacauauagaagcucuguaggaaugaauccucccccucccccccauggguaugcuuccuauaaaaauaaugauaguuuaaugaugcuacacgcaaauguugauaguggcucugcucccaguacgcagaagggaacaugagcaaguguccaccuuugaugaguggauaaaacaaugaaauauuacugagucauaaauaggagugaggcacccauucaugguacaguguggaagagcuuggcaaacauuaaugcuaagagaccaucgauagucacagaaggacauauauugcaggacucugcugauauguguuaucuauaacaggcaaauccauaggcaaacagauuaauggcugccuggggauagaggagggaaaugauuacuuagcaguccguguuccuuuacugggaugaaaaucuuuuagaaguagguggaggcgagggagacucacaauauugugaacuucaacugcuguguaccuagacacuuuaaucucagcggugagaaaaugaagacuagucauagcucuugagcccuguuuagcguaugggccucacauugcucacaccugcuuauggucuuaggguguguguguguguguguguguaugugugagugagugugugugcgugcguguaugcacacacaggugcaaguaaaggcugacaccagugucuuccuugaucacucuccguacaccagugucuuccuugaucacucuccauuacauuuuuuccagacagagucuuuuucugaaccuagagcuccacuguuuugcaagguuggcuggccagcaagagcgucaggucugccugucucucuauuccccagugcugugguuauagauguuuaacaccacaucuggcauuuucuuuacauugauguugggacucacaacucaggcccucaugcuugugugacugucacauucauuacccacugaaucaucucucuagcacucagaaucuuuuuuagaacaauucccauuauuuucuuuaauacuauuuugugcuaguuaugaaaagaauguaaacaauauagaaaggcauuaaaccccaaaucucagaagucccuauuuagcuguaaucagcauucugaguagauugcugucucugucaaccaaaaccuauuugcuugugagguguugagggcggggccugucuuaguuucuuuucuauugcugugauaaaaauacuuugacaaaagcaguuuaugggaggaaggguuauuuagcucacaguucaaggguccagucuaccauggugaagucaagggagcaggagcuugaagcagcugguugcaucauagcugcaaucaggaagcagagagagaugagugcugcugcuacucagcuuucuaucuccuguuaauguacucagcccaggaaaugcugccacccacggugggcaggucuuccuagacccauaaaggcaaucaagaugacccccacaggcaagcccagagcccugucucuaagaugauucuagauuuugcccacugacaacuauagugccuguggugguuugaauauucuuggcccaggaaguggcacuauuaggagguauagcuuuguuggaguagguauggccuuguuggaggaagugugucacugugggcauggauuuuaagacucucauucuagcugccuggaagccagucuucuccuaguggccuucacauaaagauguagaacucucagcuccuccugcaccaugccugccugcaugcugccaugcuucccacguugaugauaauggacugaaccucugaaccuauaagccagcccugauuaaauguugucuuuauaagaguugccuuggccauggugucucagcaauaaaaccuuaacuaagagggugccucuaucggcggccucccuaagaguugucuuucuucuucgaugugaggacuuggcacagagaggaugucugggaaccacauaucaaacaugcugaugcuuucauccuggacuuccagcuuccggaacugugaugcguuuguuuuacugcugaaauagcaggcagaagaggccaccacaucaugccacguguaaggagaagcggguggaaaagcaggaggaucagccagcaggccgcuugcuccuucaucuggcuguggacaugagguuugggagguagagcugagcuggucugucucuggaaaccucuguuuagcgucauaggugaggcaagagacccuugcagugcucaagucugggcugggguaggugcaaggugggugaaagguuugaaaaaguuagggaacaggaacccaguucuucagggucuccaccucuucagaccuguugcuccagauuaaccaagcgcaaagucuccauuggaaguuuuugucugacuggcauuugccuguggggaccagauguggucaagggcucguggacauuugucugcauggcgucacccuuugauuucugugauuuauaggcaggaaugugaaggugggauuagcauggaaugagccuucagaaugagaaaucacaguccuuggaaaugaaggauugggcaaacguguuucuuaaggacagagguugagcgauaguggcucacaggguacagccccaggacuuguguuguugagcagugcagcgucauuugcaaaguaggccacucacuuucagauauggccggcagcuuugugauuugcuuuuagaucugucuacauuuuauucuauguuuuuaccaguuuauaacauuuuuacuaggagacuggggagacgacucaguagacaagagaguguuuguuguaacuuacaagaugugaguucaaauccuaaauaccuacaucuaagcugaccagagucuugcaugccuguaaccguggcauugagguaguggucagguagagacagacaguucucuggagcuugguggucacuagccugucuguucaaugagaaacccuuccucaaauuaaagaaaaaaagagugagaacaauucaggcagauaccugcuguccucuggcuuccauguguaaguguauaacacacacacacacacacacacacacacacacacacacacacacacacucucuucauugggcuuuuuaucacuaaucucauagugacccaucuuggcuuggaagugugucacuacccgcuccucccacuacuguggaauagcagaguagagacuuuccuguuuuuauuaacauuucugguuucauauagccugugugugagccaguaugacuaacuugccacaggcuuguuccaaaaugcuguuguuuacacacacacacacacacacacacacacacacacacacacacacgauggcucagugguuaagagcacugaaugcucuuccagagguccugaguucaauucccaucaaccacauugugacucauagcuaucuguaaugggauccaacgcccucuucuggugugucugaagauuaugacaguguacucacauauauaaaauaaaauaaaauaaaauaaaauaaaauaaaucuuaaaaaaaaaaggaaguuagaaucagguggacuccauugcagguccuaggccuacuucuccuugcugguuuccuuccccccaaggcauucuggguacauuuauaaacacucaaauuugcagaauugaugucuucucucuuaccugauauuuguuuaccuuugaucagcugaagucugaaaaaggcaaguggaaaauuccagcgaugaaugacucaugucuuaaauaacugaguacugucuauugcugcuauugcucuguuauuaguuacuuuacugcucccuuccugggcugguuuucuaauugauccuugauuguaaaauuugaucauguguguguguguguguguguguguguguguguaugcaggagaaaaacgccacauggagaguacucagcuugguacucucguccuucuggcguccacugugucacaacacacaugccuguugaugguggggacugcugugcauguguguguaggagaguggguucccugcauagggagcaccaggcuaguuaaagccacggcgucagaggguuuuccuccgacaugugagagguugagagugucugcuguucuugaaaaauuauuauuacacuuuauuguuuuauguguauaugaggguauggguaauugccacauugcacgugugcaggucaaaggguaacuugcauuuaguguucuuuucaccauguggguucugggggucaaacucugguccccaggcuuggaagccaguggcucuaccugucgagcucucuuaagggcauugaacucuuuucuugagaggaagggaaguuguuaggaaauacccagauuguccaggccgugugacugcugacugagagguuaaacuuuccugucuguguaaugccgagugagcugagaauucucugccugugaaaagucaaagagaaagcaaggaauaaugggugggcauggacagcuagcuggcucuccgugcccaagcauggccaucugggcauccgcagagagccuaugacuggguugaauggccauggugauuuuauuuaauauuuuacuuuuguguagguguguauguauguguaguguauguguaccuguguguacaauuguaugcacaucgauaccagaggagaaugucaggugucuuguuuuagcacccucugcuuuaucccuugagacaggaucucucacugaagcugggacuaggcuggcagcaagcccugucuuugccacaaauagcacaagggcuaggggaguauauggcuuuuuacauagguagguaccuggcuuuuuacauagguaggugcugggguuucaaacucagguccucaugacugcauggcaaacgcuccuauuuacugaacgccacccauccuugcucugcugagcaugcaagggcuguagaggacuucugcaagccaggacauugccggugcugauuuggagucugaaagaaugaggccaguguaggugacaucucaaggugaccagggguguaccucuuguguuuggcuggaauugaggcaggggaaugaaugcccuugaugggcucaucucaugguguggugaacuguagguucagggugauauaggucccagugugauagcugggagcaggggagguugggccuugaaacagcaagaaaggucuagaagcugaaucuguggguagcucuuggcuaaguuugaagccgacugucugacuugguccuggccggguuaacucugugugccucucuuagcgugccuucucuacuaugagaggacugacaggagcuuggucagcgcacaucgacucugcuuaucaccuguagccaccugcccauggagugccacccgugaauaaagaagccugggaguugucccccccccccccccccccccgugacagagccaucuaaguuuucuucuguuaaaccaaaaaacggaaaucccaacaacucccccuccagaaagccccaagaauacuagagagcuguuaaguagaaccaucagauuuccauccaaauuaugugauuuuuuuuuccucauucuaaaacuacuuacauguucuagucugaauugagauuucuaggaaaaguagacaaaaggaaaaagauugaaccuuaaaagccauuuucuuaucauuugcauauauuugcauuucaacuugagggaaaacauagcuacuuaaugccuggguccaguggcuggaucauuucauaaauauuaugugaugcaaggcaguauauauugcagauuaaacugugacccucaaucccuuuaaaaggguuaugguccuaauugaguauucccagaauaugaccuaguuuggcauaggaucauuacugugaguuagcaugagguuauccuggaguagguggguuuuucagccagucucacuauguccuagugugagggacgagcugugcacuagugaccagagagaaaguagaguuuucugucaaacuccagagaggaugaggaaggucuauggagcauccagaacugcugaaagcuagagagcuaaaagaagggauucuuguuaagacuuggagcacaaccaugcugaccccugcuccaaugcuguguaagaaaacauuucuguuacaaaugccugcauuugugguauuugguuauggagcugcagagagcuggugcaaaggugcagucaggacagaaaaacuuggccauuuggaaggagagacucaugaggaaauaagacaagaagccaguguggugcuuugaaugaaagugcucccauaggcucgucauauauauugaugauagacucccaguugagagaacuauuugggaaggauuaggagguguggccuuguuggaagagguaugucacuggggcugggcuuugagguuuuuaaaggucugucuauuuccaaugugcucucucugccuugugguugugucuuaagauccauguuuuuagcuacuucucuagugccaugucugccugcccucugccaugcucccuuccucaaugcucauggacucuaauuuuugcaucuuugagucauaaugaaaugcuuaauauuuaguuaugucauaacuuaguauugucacagcaauagaaugguaacuaagauacccagugaagacauucaucagaugcaggauaaagccagagucagaggaaggaagcagagccuccagggaggaggaguggugucugacgggguuuccucaggccgugcucuggccuuuuguauugguugcuguguucuggacugguggugggcucugcuccgggugccucauacagcuggacuuguacacuuccucuuccucuccucuccucuccucuccucuccucuccucuccucuccucuccucuccucuccucucuuuaacucuucucucuuuuuucccuccccuccccuccccuccccuccccuccccuccccuccccucucccucaucuuaucaccugccuccaacugaugcauaaacaggcaucgaggaauuacacuuaaguugucuuaguucccuugaccgccaucuugacauagacaaggcuuacccgagugucugucucaaugaaagaauuaccaggaucagauuggccugugggaaugucugggguggcaggggguggggguugucuugauuauuaauugauguaagaggacccaacccaaggugaaaggcaccuccuucaggcagguagucuugggcuguacagcaagcuagcuaagcaugagccccagagcaagccagccaggggaguuccucauugcuuucugccugaaguuucugcuugaguuccuacuccuaacuucccucaggggugggcuaugaccuggaaauggaagccaaauucucuuccucccuucagcuacuuuuggucagaaugcuucaucauagcaacaggaaggaaacaagaacacuguccauuugaaucauguuuuuagaagagaggggcuggagcauugauguugucuccccugugcuggguaugugaugauguaagcagacuccagggccagccuccaguguggguuugaugagcauucuaggugaaugggugguaacuaaccacugucucuccaaggggcaggcuuuggagaauauucuggcacaggcaacugcuuggcagagggcuagaugagcugucgcucauuuccagagcauauucugaguucuuuucuuuauuuucucuuuuagacuuauuuacuuaguuaaaacauuuaucugucuaauuuuauguguaucuguaugugccugaguguaugugaagagcguugugcgcuaccauguggauacugggcauagaaccucugccuucuucaagagcaguaauugcucuuagccacugagccaucccuccagcaccuagauuuauuuguuuuacuauuuuauguuuauggauauuuugccugcauauauguacauauaccacgugcguaccuggucccugcagagguuagaagacggcauuggaucucuuggaacuggaguuaaagaugguugugagucaccauaggugcuggaaaugaaacccgguucucuacaagagagcuacaagugcucuuaagcacugagcuauugcuccaggccuugucugaguuucuuuauuugguccuucacacguuccuucagccaacagugaauuagagcugccaacauggcaaagacaagguuugguaucucccccagagcauuggcugucuguggcagagacggauuugaguccagucaguuuuaauucugaggugaguauucucaugaaagguaccugcccgaggacguaacagagucagucuuguuggagauccaauagauagaugaagcccgaaaagcagaaaacaaacuagcacccagccuacugaagggacuggacagacaguucaauugccaaaguaauuguguacaagccugaggaucuguagagcucacuuuuaaaaccaaauugguguguugguacgcauuuaugaccccaguucuaggaaggcagagaugguagaucuggagcuuacgggcuggccaggcagucuuaucugaugagccucaggcuagugaggggcccuguuucaaaggaaagguagauaacagccaagaaacaacagcuaagcuuguccucuggccuuuaugugcuuguguguaugugugagcacgcgcaugugugcauacacacacacacacacacacacacacacacacacacacacacacacacaccagauggagaauaaaacccaaaccagagaaagggccuagaguguucagaggcuagagagcuggcuguuggcacccauuuuccaagggccaagccccgggcuucaguaugaucgauugcuguguucagggcugguggugggcucugcuccagaggccucaugcagcuggacuugcaaacaugcucagccuuauuaaucuccagauccuaguuuaccagaaacuaaggagggcugcuuccugcuuuccauuuauaagcaucguuuugcucaauuugcuguguagccagugucgcccuagccuggggguugaucuauugagucuagacgaguauuguggguaaguauuuaaucagugcuggguguugauauucagucucuggaggcauuuauguguacugugugagaaccacuucuugguccagagggauuguaagaaguccauccaaacacaagacgggucuugcuugguagcaggcucccuuuccagcuauagaucgcucagaugcagguagaaguucguagaagcuaauuugcauuggaauugacucugcauccuauugccagguuccauuuuggacuguguggucccuggaauggccugguaucucaagggcuccaagacugggcuugaugaguccuggcaguacucuccugguuggagaauuucugauauuuacugcacccuccaucuguagaccguagacuagauagccauugcuaccauguggugcugucaugaggauuaaauaccaacacaggagacgggaagauuuauuggacuuccccugcucuggucuaguagggaaauggaucuugcagaccgacugugacaagguugaacaugcaagguguuguucuugccucacgaagggaccagagggcuccuauaagggaggggcugccugggacagcuuccucacagggucccuggugagcuugggaagaugaugaagacaugaggagugcaaagguagguaaugagagcaggagccugugguggggcugcccacacuugggcacuggaggcugagagagaggacaaaugggggacagacagggccaagugcagugagccaggcaggcagccuggaaggggcuuggucauccagcuaaguuuguaaguccuuugcauuuucaaaauaaaugcauugggguuucucgaaagugcagcuagccaguugugaggaaacagcccaguggcauuuacugcauuucaguguuguguggcuguuaauugugucuacagccaaaaccugugugccugugugagguggugacacuuccuuguuuguuuuucuaucuuauucauugaggcaaggacuuucaaucaaacccagaacucgcugauauggucagugucucuagucagcuugcuguggggaucgaugugucuuuccucgcaggcuggaauugcaggccggcugacaggcccugcaauuauguggguucuggagaucugagcucugguccucuuguuuguggggcagguuccuaaccccugagccagcuccauagcccuguguucugaagcuuucaaaugcaugcaagccuugguugucugguugcuuuagcuugcugugguuuugagguuaguuaucuuguauaaugugucaguacuuccuauauaugacugaaucguuuuccacucuauggauagacuucgaauuuauucaucugccauuggacacugggucauuuauguccucaggauacuuuacccaguccugcccugaucuucccugugugaguacugguuuggacagguauucaguucuuuugcagguaggucuggguguggccaggcacacaccucucccucucuuuccugaguccugaaguggagaugcagccaucccuggguggucucccuagcugugcucuucccugcacuuacacgcaugcgcauuuagggaagggggagccccuucucugccucucugggaaccagagcuuagguuguggugguucugagcuuacugcugaggccugaaaagcaggcguggccuggggccccucaccucgaucacaagaguccagggcaagguaagauuugucaaagaguagagcuacauaaaacacagagagacaaagcugacugugcugccuggggucaguguccuuggcaaaaaggugcugggcucacaccaaggacccuagguucuagacccugcaucuccaguucuaugcucucagcucucaguucuuucugcguguggccucuuuuuggcuucuggaccuuaugguggcuuuuuuucuccuuccguccuuccuuccuuccuuccuuccuuccuuccuuccuuccuuccucccucccucccucccucccucccucccucccucccuuccuuucuuccucccucccucccucccucccucccucccucccucccucccucccucccucucccucucucucuuucccucucuuucccuccccccuccccuucucccucucucucuccaucucgcuuucuccucccuccuucucucuuucccucucuuucccucucccgcuccccccgcccuucacacacacauaguuauggaagcccucagcacuagcccaugguguccacagcugcacacaaaaucgggcaauuuaaccaccagccaugcacgugcaugcacacacacacacacacacacacacacacacacacacacacacggaguuguggaagcccucagcauuagcccauggugucuacagagaugggucuggagcacacagagggacucugcccuugcuucccacuucgcugcugcugugguccugucauugcauuugacccuggcuuguggcaguaucacacagacauguguuuucuuugcaugcuaggagaacuuuuuuuuuuuucuguguccaaaucucccucuuaaggacaccaugaaagcugaaagcccguguuccaaacucauuguuccucccaaaugcccuuugagguuucgaaagcugugcucagccaaggccuuugcuucuaaauguggccuccccacccccacccugagccuuaaaacaggaaguuugcucugaauuaaauaugcaugguugacaggaugauauccaacccugggcauuuggggccacucuuggugacuugcuucagcggucuggcuuaccuugaugggaauugccugagaagguagcaguucucgaaagaggaaagguuuauucuuccgaaucccagugaggucagagagaaucugguucacucaacacucaauauucaucuccaauaugucuaugcuagggaacaaacucuucagcccaaauaaauccgagugccuccuccuguagcuggcaggccuccuguaauucguuuaucagggaaaauuugacuaggauugacggaaaacggggcuggcauagcaagcggcaauggcuaacuaucuuaccagggaaaucaaaagugucuauggaauuacggugacucuguuauauugcucggccacuccaccaaguuaacccuccugagggugauuaggcguaaccguaaaugcauagauucgggaaguccagcagauggauauacagacaaaguaauuaugaacugugcauuuacauauuuuccaucacaguguuucagagaccugcugguccaggauuauuugccuguugucgucugcgaggaugacauugugaauguuugguuugguggauucaucuuuccugugaacuuagucagggcacugcagucccagggacucuuaggggacuccuuguuguaaacaguaucugggggaucgaggaaaugacuuugcuuacucuggcuucacucuucugugguuccggaaaagcuaguguuugaaucugcugugaggauuugagucugaaugccccuaagaggcucaugguuuguaugccuggugcccagcugguagaguugaguuuuaggaggcagggucuagcuggcagauguagaucaccagggcagagccuuugaagguucugccaggucccugguuccugugugcucucuguuuccuugucugcuaggaugugaucagcuguccucugccauguucuccagacaccaggaugcucugcuccagugccagggcuaagcagcucgaggcugcacccuccgaaucaaugaggcaagguuaauauuuccucuuuuucauuuguuccaucaguucuuuugucucaaugacaucaaaguaaugaauacuccugccuuauauuguuaucagggaacagcacgaucuagauaguuuguaaagaaaagauacuacuuccaggucuggaggguugugaaguccauuaauaaagaacuacguauggagcucacaaugccuuggugaagugacaagguauaugugugcucaggugucucuacuucuaaagccauugaugccuugggccccaccucaugagcugaccuaauucucauugcuagucuucuggagcccugccuuccagucccauuagcccaucggugaggagaugacguuucuagcacgugagcuuuggaggacccauccaaagcauggcggaugcuuuaacuucaaagggauucccccaaagaaugcaagcaagucucuguuugcagauugacauuucucuacccucgaugcuagcaucgccucugaugccgugugccuuugugugggccuuauuuaggugugcaaaaauggagcguguauaccuagaucuagugugcuuugugguugaggucagaguucagugucggguuucuuccuuuauuguuuccacuuugguuuuuuugagguagugucucucaccggaccccacugagcccuccugucucugaccacacagugcugagguuauaggugugcacugccacaggcgccuuuuuguauuagugaugacacagacuuuaaacccacacccuugugcuacagguuacugacugagucaucuucccagaugcuugauccggucaaagaaagcuuauuucuuacuuuuaauuguguauguguguauuuguguguguacauaugagugcagccuauggaggcccggggacagcagucuuugaucccucguagcuggagugagcgguggccaugagcucugugacucgggugcuggcaacugaguuuaguccucuggaagagccgugagcucuucccugccgagccaccucugcagcccugcuuggcacaucuuccaaaacgcaaaaauaaaagcaaaugaguacaguagacuaacaacuacagaaguuuccccagagccuugaucagagccugaguggauucuccccuucugaggaaagugugaucgcccuuuccggagugcucuccucuucucaggucgccguuacaggugugauggcgaagaguguggaaucccaugugcaggaauguuguggguauucagucuuugaggcucaccagagggggugugggcugggaguguggugugcuggucacucuggugauggcucccuuucagcugaguccugagugaggcggagcuugucuucagcagacuggaguuuacccucaggcuuggguaggagcagacuguggguucagauggacuguggguucagaucaggguagguugugugcugagaugucaggguuagauccuaaaagaugcauuagcauuggaaaagaugaaugaaccuccugcuugcucugaucugcaggaagcugccuuaaugggaggaaccagccuuggaggagcaguaucugggaaccggggccuggggagaagcaagaugucuugaaggggcuuacuuuuacuguaaauaaaauccgcauugcgaucuuucauuaaaagauaaccacaauaaguccuuuugggaagcuucuaaggggaagaagggguagccucugauugcuccggcugggcacuuguuuacaagggacuucuagagagcauuuacagagauggcacguuucaugccauuaauauagauugcuuugguuuucucaggcucuggggaucuuaauuaccauuuaaaaagcaaugauuuccuuuucuuggucauuuaaagaugaucacuaaaacaaaccaaggaaagguuuagaguagaauguccuugaaccugcugcccugauuucuuuagagggcugauuuuccuguggucaagaguuuugaucaggggccagacugcccagggucacaucccagucuggcguguguauaggguggggucacuucugcacgccuuaguuuguuccucugugaagugaggauaguauugcaguugugacaugagugucaugguguuugcauguucuggugucugcaggcgucucauaaauguuguguguauguguaauuauuuacuuaccaaguaggaaacagugcugaggggugagaggagaaagaacugccagggcaggguccugggugcagcaacaguucguaggugcuuuaaagaguagaugugaauucaugauaugaagcccagggcaaucuggccucagucuaacugagugugcuuaguuagcgaugcagagaugagcugaucuuuauuauuauuauuuuuuuugguuccggccuucccucuauccagcccauaguuuguuuguuugucuuuuguuuuguuuuguuuuguuuuuuuaaaaacuuguuucucauuacggauggcugugagccaccaugugguugcugggauuugaacucgugaccuccggaagagcagucagugcucuuaacugcugagccaucucaccagcccaagcugggucuuuuuaagcguucugcaccaucugcuuuuagcagugggugguuguggaaggguuugaggccacagaauaacacugggugauguguuaguguuuucuagaagaagagaguugauaauaaugaaucuauauuaaaaagggauuuuuuuuuaaagauuuauuuauuuauuuauuuauuauauguaaguacacuguagcugucuucagacaccccagaagaggguaucagauuucguuacggaugguugugagccaccaugugguugcugggauuugaacucgggaccuucggaagagcagucggcgcucuuaaccacugagccaucucgccagcccuaaaaagggauuuuuaaggucaacuuauguggugggagcugaguacccacaguaacaguccuaacacuggcggggguggggaaccugagaauugacagcugacucagcaguuccuaaugcauacugaaggccuggaggauuucuuagccacugguccacaguggaagccugaagaagcuggguuuuaaugucagggaggaaagcagcagcagcaggggcagcauggaaggacucacaagcuagaugggaaggcaagcaggccaaaagggaagcucuccccuugauccaccuuucucuggcugccacaggaaggugcugcccacauuuagggugggucuuucacacuucagauaaaagcccagcaagcugugucucuuaguggauucaagauccagacagguugacaaccaggaucaaccaccacaggaaagacccagugggaggcagauaaagagggucugaggggaagcuguggcuguggcagccuggccagcagugugcguggugagggagguguucagguguggggagagaugaccccugguuucugaguccagacacagcccuggccgugggggugagagggcagucuuugcuggcagauucuggaucaagaagcugugggacucuggaacaguuuaagggguuaggaguccacaaguagauagugacaguucuguggaugugacuugggugggaagaguuggaagaagagguacagcuaagggaccuggagcuaggacccucagcaggacagaagaggaagggugaagggugacccaggaagacccugcaggaggagagagugcuggggaaagagucugggccagagaagcuaugguuaggauggccugcggguguuucucaguggcuggguggccugggccuaaugggcucagagauuagaauguguuccaucugucacaaggcugcuggcuggcaggacucuuccuuggagucuguggacagaggcuacccguggucuuugccacacaggccucucuccauagcucacggcuggccuugcuaaaccuugcaagcgaguugagggcaggaguagacaaguguacugagaacacacaggacagaaaucaguccuuuugugacccucauuccugucggaugccuuauuugguugagggacccacacuaacugggagacacuugcaaacagcaggaggugggugucuuuggcagucacccugaaaguccauucacccuagucucugaggcuugugacuucuuucugggguuucccugggcaccugcucucuccagaugugcuggcuuucugcuaucgagcacauagcacauguuguggguaugaagcagauagcaugcugggguccuguuggaaaaggggcaguggacucugggcuaaaugacaacagauccuaugauuguaaggcagaagccccuuuggggaaucacauggaacucaguguacuuaaauuuuuuuucacauuuguuacauuuguguguguguaugugugugugugugugugugugugugugugugugugugugagagagagagagagagagagagagagagagagagggaaagagugcaaguggaggucagaggacaacuugaguaaauucuuuccuuuucugauaucaauuuauauauauguaugcauauacauauauauguaaauguauuacuauugagguauagaucaaugguaaaacauuccacuugaacaucaauagacucccuauucauaaauggaugccccuucgguagcucacaccuucaaccccagcacucccaaaacaaaggcaggcagagagcucugugaguuugaggccagccugaucuacacaucgagagguugagguuggccaaagcuagagaacauuuuuuuccauugcuuauauucaugcauauauugcaguguguuauauaaggacaucuuccuaacagcauacuugguaugcugagccuguucccugacauaggcccuaccuuuucauaaauucucacaugacuggguuaaccuuugggaguggcagggagauggcaagcccuaguagaggccuagguggagacaggauucacccuugguagguuggguguauccaccuagaaccuuguguucuucucuggccaugggcagauccugaaguggggauggguggagccacuccugagaggcaccccagccuacucuuaccuggacacuguccaagccccucccaguuguucccuuccaggaggcucugugcaugcuuucaaagccauggcugggcggccacucaacucccuuuuauccuguaacuaaauagaacucuauucgcaggaagggauguccagagggaugggcuuugguuguaggccucuggccucugcaaggagcaaguucagcacccagugucuuuucucugaugguugcaggcccaggguugcagccccugcugaguuugguugacucuguccuaucugugcaugucacuguagaggugguugggacacuuugauguucccaucgcuacuuucagccugugggaccucaggagacuuauucuuuugggguuuacuguuguuacguucuaguaaccauggaacauauugacaaguguccucaagaucagagugccagagggucagcuggguaucugaugcagacuuaucaggugccagagaaggcaccgugaggagccagcuccugcacugugaacucagggaagccccuuacuuaaucucagcuuggucuggagaacccacuguuaccaccaggacccuugcuugugucuaggcuccauguaggccugggguccacagagguccacagagguucacaguaggcagcguucaguggaacugucaggacacgcuauaacaaacgugccgugaagauuccuuccuuggugugauguaaaaaaaaguugguccccucuuuauaaggcugguacuugggaaccauagcuugucccggguuuuaguucccaccugcucauucagucuugaaccuuugugcagcaagcaaccaaaugaccaaacauguagacuugaguggcugguuaagggauacuccugugauagaauuaugugcugugcacccucacaccccaaggcaucaguagcucacugcuuguauuucagaggaacaaagagcugggccgcagauggaucucugugugaccagaacucgggguauugaauguccuuucucugcugcagccaucaaucugcguuagacagggauggggcuggaguuugacugaugccggaaggauccggaagggaaaggauuacugagaauauuucauccaaaagggacuuugugacaaggugugcucgugacagcccuugugugauguuagaugggauuuuguaugacuuuuguuuugacaucuggcuaguuuuaugagagcuuuucuguaaaaacccagggaccaguggcuagccagaaaccuguauugagcuguccagggaggcugguguuccccagagugugcaagggucuugguuaauauucuagaugugacaggagccuggacaaaacaacuuaaggaaagaaggguuaauuuugccuccguacauuuugguuaggggugggugugacagcaggagcuugaggugacuggagacauuguaucuauagucaggaagcagagagggacaaaugguagugcacagcccccucccucucuccuuccccccucccucucuccucccccuucccucccgcccuuuuuauucaucuauguucccagcugugggauggugcugcccacacuuuuaggguauguuuucucaucucaauuaacccuagucuagaaacucccuaacaaacaugcccggagacuugcccaugcuccuaaguaauucaugaucuuguuaaccgucaacguuaaccaugucgcuggguuguugccagccgugaugcuuguugcuuagggcuaugcccaagcacuuaacuuuucccaccuucuggcucagugaauguagguaauaaauagccuuuugcagucucuaugucuuauaaugugccuaaaaugggggugcugaguagcccccccucuugugaguuucuguagugguaaacuugggucaauuaagcucagcgugccuccagaggacaccagugcagcuguuccauggcuuuuaccaugguuugcucugguuggguccauucgguaguugagacccaguuccugguuagucuuggucuuaccuccuucccugccaaggcucugagcuccuuugggaguugccuugcauaguguggaucuaugaaugcccugcuguguggaucugagaccuagugaggauuccugaguguuguguugaacucuguuuacuggaaggugaauuuuccuuagagggaauaugguacagugcccugcccucuggcugcccucugugucugggauugucauuucauccugucucguguauacagugcagugugguggccccgcugaagcagagggagcugcagaagccugagcugugaggccgagggguaguacuuuuuguuugcuaugugcagggagguguucccagagcaggaugaguagggucuccaggcuaggagacugcauaccucccuccuguucuugaccucagaguccuuguucagacauaagagcacauugcuuggcuggacucuaugagcaacaaacacaaggaguaguuugcggagugucugguccuacuuggucggagugaagcuuaugcuuauugccauggugacagugauggugguugguagucauauuguggcgguaguguugcuuauacagaugcuauugguggugguguggugacaguaguggagaugauggugacacugauguugacaguggugagggcacacuguugcugaugugggugaugugguguugaugauaauggcuuucaugguuacguaggugccgugaugguauugacaaugguuguagcaguggugguuauacugguggcuugaugguggugauguugucagugguggcuaugaugauuuuguagauguugugauagcguugaugaugguggugguggcuaguggugguuaugauacugauguugauaacguggugguggcggaggugcugaugugcggauugauggggcaguggugcugaugcugccugugugacguuacugaugcgggggcaauggucauggcagugcaguggcagugaggugggugaugguguggaugcauugugguuggugguguuguggucaugaugcugauuugacaugacuggggaaccaugaugacacggugugauugguaaugacaguggguucuggugcuggugcugaugucacaugauugcuggugacaguggcaauguugguggugcugcuaguguugguagaucauggacaugguggugcagauagacuuccuugucuguuguuccaagugccuccugggccucuaucauucauuagugugccguuguccuccuuuguggcugggaaauucucugcaacacaucuuguggaggagagcuugccaguaacguuagugccaugguggcugucggugcucagcccugguaccacucagagcuccgugaagaagggccgugugaagccacagggaacugcaaggggauguguuuucuuguguccagucugauggagcuuuaaaaguuacagauggaacaggaguggagagaugcucacuuuucuguucagaucauugaaaacaauccugagcgcuccugucugcugagcaucauggcagacaugcugcggugcguuuugcugucuugcucucgccugccugcccuggcuuaucugcuccagcuuucgucuuauucagcagcuacuccauaagcaagcaaauaggguuuuauagccucucgcuaaguauuucucaucucuugcuaaguauuucuaccacagugcaaaagcaauuuuauuaugugaggcuguauuuuuauagucaauugaaacgacuauuaaaauauaacauugcuuguagggcucacaacagcucugcccuugccagcugcagaguccuggaaauagaggccuucuggggaaucagggccuguaccuugggccugaggucugugccugcuugugggcccuccauguuuguuacuugucuugaugcuggaacaacauagucaacaagagcaucuuaaggcaacguuuauuuuggcuuauagugugagggaauacaguccaucaugguggggaauaccugguggcaggggugugaggcugguugugucuauagucagaaaggagagagggagggagagggagagggagagggagauagauacuguugcuuaauuuuguguucucuuuuuuuuauuacguccaggaucucccacaguggguggguuuucuugcuuaaguuaacugaaucuaaauaauuuuucacaggcuugccuaucugcuaaguaauuuuggauucccucuaguggaccaucuaguggaacaucacagcugaauccaaaaguucccacacuuaauuuaaggccuuguagucacaucuugaacuucucucuguaguaccauauauguaggcuuucccuuuuugacagaccuuucuuuucuugaucuuucaaguugguggguggucggcccguucauaguguuaagcccacgucagugaaaucauuuggcaauucuuuuuuuuuugggcuuuggaagcugcacaguagguuacccaggguggucugguacuuguauagacuaugcuagcaauucuccugccucagccuuuugagugccaggaugacaggugcaggcugccauucucaguuccaugguaauucuaugcuuaauuuuuggaagagcuguccagguggcuuccccagcagccucuuugcaguaugcaaucuaucuguaaaggguucuggcuucuucagauguuuguauuauaacuuuuuaauuauagucauccuguuuucaauuuacagcaaucgucaaauaagagacugcacugguauuuugcgaugggcucuacuacguagccagucccagaaauaagcaccaucaugggcuggcaggguguuuuguaaaaugccaucuaagggaugucccuggcaggccacucuuuguaggcagggucuugcuuacuuuuucaggcuggucuugaaccucugaucucucugguuuugucuccucagcacugagguuacagccauuugucaccaugcaccagucccagugucugucugggcagagcacuguaggcacgauaggacucuccccaggucucaguugcucaguucucuguguucaucuuuaaugucccuguuacauaauguuugugaguguuucuuugcccucuguguccaggcagcccaccacaaacacuacucccaauuauugcacacugucuucucuguguuuuuggguacucuccaggaaagacaaauuuaucaagcguuuagcuaaggcaagauuugucuuguguccucugggggcaaggguugggcacuggcuccucucuccacagugcuggaggcagguguuccuccuaggccucauuccuuauauacaacagacagaaaagacaggugccuuguccaaccacaccaggcccugggcuuucucccucaggcuaagcuggcaugggucccucugaagugcaggcugucccccuucuccucagcagagcaucugggacaagccccagcugccagugcccaguguugauucugccugggaacaagagggcagugugugggcugcugggccauuagcauccgaguaugcaaauauaucccagccuugcacccccgcccccugcagugccgcccuugccugagccaaaguuuaggaaauccugggauuaacccugaagagugaggcuuguucugguucugaccucuagauucuaagagugaucuuuaugcauggaggcgcugccucuuauaguccuauaaguccuacuuagacaugcacacccucaucugggccauagugacagggaagagagguccugggguagggcagggaccaggaggaggauggaggauacagacgucuggagugucacauucaccugccuuugugcuauggggagacaguuccuaauucauucauucucucucucucucucucucucucucucucucucucaugcuguguggguggguauaugugcccauauguauaccgauagagugccgagguugcauuugacaucuuccuggaucacuuucuaucuuggguuuugagacagggucucucacugaacccugagccagucuccaucacccaguuucagguuuacagauguguucuacaaagccuggcuuuucuguaagugcugggaauccagacucagaucuucauguuugcauacugagccccguucccggcaccccuguucccuccuuaagcugacaguauuguucagcaaguacaggcuuggaguggcacugacuggucgaccuccuaggcaacaucucauccucacccacgggugcuaugguggcucuugucacuccguuucacagagugagaaacugcaccaaaggagcagagguggggcuugcgguugagcuccuguuggucuuuccagucccagugcuggucucagcuagagcgaggggccugcuugccuugaaguggaaccuuacagggagguagcaggagggaggauuugcuucauggaggugauguggaggggcccuuuguuucucagguggaggacgcaugugccuccugucuugcucauugggugcacagugggaccauagugugaagggagccugcccaugguggaaggaggcggcagaggacuuggcguguugacaagucaucuuacugaaagaggaaugacugggaacugcucugagcucugcagccucugugcagcuccuucauuaacaccccugugugccccacuuuauuguuuaucucaaagagggcuugauuguuuuuuaaucuucaauuuuauuuuuuaucaaagcuuaggaaugcaacacuacacaggaggaauuucaacaaacucuagagagucaaaauucaucucugggaaugagagaguucuguccagagacugucugccaccauugcuguucucugguuugcaggaugggugggggcaaccucgggcuuuggggggcuuaguguugcuccuagaugcuuuuacagugugcagcuucucccagaagcucacuccccuggucaaggcugaauuccuauugguugaaagcaaguucuccgaaagguuaaagauggaauuauagucuuagucggaaaagcuccacagcgaguaccuuagaugcccuucaguagggaaauagguaaacucacggugacguaguuuauguaacgaaaugaacaugcgaguaucacaaaaggucagguaaguaggucagacgugaagauagacuugugcuuccauguaugugacuaucacggugggguuaggauuguggccauauuuaugucacccugaaguccuugguugguguaucaguacagcuuugugaaacccuguguguuggguacugugaaguauaguugugaggggagggcacagggugguagaggagggagucaugugaacaguagagucucgguaguauuguggagugcagcacuggaugacaccuucuguauacucucguuuaugcuuauugguuuuggcuaaugacaggcagugaacacagaggcacauaggcagcauuugguacugacuugucagaguauuuagggacacuacugacagcaugugugaagguuucuacacugaggugacaggccaggccaggcagaaggagcccuggacacaggcuugaggggggugguucaugggugccuuuguguucugaucuagagacucaucucuucacgaaguagcauagacucuuccccugucugauugcuggcuuugcugguaaacuucugcacauguaaaauuugaucuaugugcauagccugucauuaagaaagccaguuagaaagugaguggguagagauggcucagugguuauaugcuugcugcucuuccagaagauucagaaccccuaucaggcuacucaacaagugucuguaacuccggcaccagggaggcuaaugcccucuucuggccacuauaugaaucugcacucacaugucuuuuaugcacacacauacuuaaaagaaagacaauccaauuagcauuuuggaaguuucuuugcuuuuccccuuauugguugucauuaauuuuagacuuuaugaagagaggagaaaguggccuagugcucuacaggacaagucauuugaaguuuuccagaugcucaggaggauaaaucaguauauauggccaagugacaucaucaccaaguauuagcauacaaaugguucugaguugagcuugucuguucccaugguagagaccagcuugccucugcccaggagaucccaggucucuguuauuacaagacgguuacuuuuauagaggaccagguuggcaggaccagguuuagagccaaaugaguaggauggagguccuggcugcccuguucuccacuagaacucuucccuggggacucuaguguuggcauucaugggucuuguccucagcggcugcugguuugcagugcucaggcccgaggagcaagcacccagacaguucagaagccucuguucuccucauguucugucuugaagaaggugauugaagagauuagauucauccgggcagugguggcgcacaccuuuaaucccagcacccgggaggcagaggcaggcagauuucugaguucgaggccagccuggucuacagagugaguuccaggacagccagggcuacacagagaaacccugucucaaaaaacccgagauuagagcuccucccuaucuagucuuuccaucucuuugccacugaacaaaauuuaguguaagaguagaugcauccuuucaucucagcuccaaacuuugucucuguaacuccuuccauggguguuuuguucccaauucuaaggaggggcauaguguccacacuucagucuucauucuucuugaguuucauguguuuagcaaauuguaucuuauaucuugggaauccuagguuuggggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauagcuggauccuccgguaguacuauguccaauuuucugaggaaccgccagacugauuuccagaguggcuguacaagccugcaaucccaccaacaauggaggaguguuccucuuucuccacauccaugccagcaucugcugucaccugaauuuuugaucuuagccauuaaggauggaccauguagagacugccauauccagggauucaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccagagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauuuaaaugagcuaaauaccuaauaaaaaauggaaaaaaaaaaaaaaaagaguagaugcauuuguuugcccucagccaaguucuccccuccaacccucagccuagaugucugugugugugcgcgugugugcgugcguuugcgugugcccgagcacacucaaaugugcccauggggcauguauguggaugcucucuaccucucuccccccccccuuuuuuuuuuuuaaugauaggaucgcucaguggccugaagcucacccuguagaccacacugacugccauuaagcugcagggaaccuccugacuucgacucccuagugcugggacuauuggcaaguuuagcuuuuuuuauuuuuuaaacauggggucagguucucagcugagccaguuccccacccuucagaguccuuucuucuuugugugugagcuugcacaagucccuugaugugaggaugggaacguucuauucuaggacugacuucaugacaucuaggauuuuacuuuuccuaccuuggaaaagcaauaaagcugccauuccccagugcccaccgugcuuucugugaaccugugcguuuuggcacuguggccuuuuggaccagauaguaauaagauagucagagauaagacagacagugauauuuuauucugaagaaagauauuaaaaugucuuugaauugugccugucaguucaauuagaauuggagcaaagacgcuuuccuaguucuuucucauacccuuaucuccaccgccuguccaccuguuuccauuuaaaaggcagaaagaacuauugaauaacaaaugacagugccuuuauccuaccgugcccugcucuguuuuuuaaaauuauuuagaugaguuucuagauucuaauauccaaauaguucaugaaaucuggccacaggggauuuuauucgcugggaaacaaccucuguauuccuaagaaagaaagauaugagccuggaagaauagugagcccugcaggaggaacauggugacuuugaaaguaguuuucuuccucagagaauccaggacauucugugagaggccugugcagagaaauguagcuggggugagcuggugccuggcaccucuccccaguuuccugugcccccuuugaaccuggugcccuaaccuggguagggaggcugcccaagccaccggaguuugcauagggaaccugaggaugcuguacgauucuggcuuagugguccauggccagucugucaaggcaucucucauagggcucuggacccuccucacugcaucuuuauuuuuguuuaaauugugacuaaaaagaaaaacccauuacauaaaguuugccauuucgaucaaucagaagcauucaguuuuggcucguuaagcauauacugguugagggguagccauuuugaccauccauccccagagcucuccucaucuuccucaucuuccuccucuccucaucuuccucaguaaaacugucauucaagaagacuugccuucucccagcacuugaugucugauaccauuuccuuucacugagugcaaucguccacauugcaaaauaugcuaaaacguucuuucccauaaagccaagaaugggaguccacuggauauaucagauauguuuuaucuucuguugauggacagguuucuggagucacaccugucuuuagaugacuguaaagagugcauccauaaacgagcaaacgaguagucugcuuguauuucaccugguuauuugcacauugggugcguacauauuugguauauacacacugagucuagaccuuugcuuacagucacauguacacacugcuaggucaugaccauucaguuguuggugacagcuaaaccgcuuuguauucuugucaaugccacccaugaaagguugggauuuuuuuucauauucacugagacuuugcuuuuaguaggagggcaguggcagcaguccugugcccgugaggcagcagcuucuugugguuuuugaaugaaugacugcaugaggagagaguggcgaugcugugccuauuggccuguauucacugcaggaauuucuguucaagucuuuuguccauguuaagacagccucugguauugacuugguaggaaguuuuaaaaacacguauuuaauugugggggaagcacauaugugccauggcauagugugugccgcagcuugugugugugugcgugcgugcauguguguauaugcauucaugugcacauguuguguuguauauguagaguucagaggacaguuuguaggaaggguucucuccuucuaccuuguguauccugaggaucgaauuuaggucuucagguuuggcagcaagcgucuguacacauggagccaucucacuggccccaaauuauuuccguagccaagacacuacaucuugccgggcagugguggcacaugccuuuaaucccagcacuugggaggcagaggcuaggcggauuucagaguucgaggccagccuggucuacagagugaguuccaggacagccagggcuacacagagaaacccugucucggaaaaauagcaaaagacaccacaucuuauuagaauugcaaaugcuuucucucauucuguggguucuaggaauaauaucuucggauguauucuuuuucacuuugaucacauccagccuuuuauuuugccuuuuguugucuguguuugguaguguauccaagaagucuuccagguuuaaugucaugucuuugccauaugaauuuugcaguuuugacuccugaaucauuucuagcuuguuaauuuuugugauggggggggggggaauccagcuuuggggauccaguuguucccaccaccaucuguugaaaucugaccucucccuaggagauggucucgaagccuuguugaaauugcuuguccugggcacagggcuuucuccuuguccuuugaucugccuguuggugucuaugccuacaccacacuguugcuguggcuuugaagucaggaaaaugggaggccccagcuuuguucuucucuuucucuuuccucuuagcugcucuagagucugagugauggauacuucuguuugugggguuucaguggaacuaugccguagcuuuagauugcuuuggauaucacugacaugcugacaguuugaaaucucucucuccaagaccaugagugucuuacuauggauaccuuuccauuugugcgugucucuucauuccuuucugcagcaucuuauaguuuccccgaguguagcuucuuuuuucuuccugggucgaauguaucuguauucauucuuuuuguucuuuaagaauuuguuauuagcgugagcauauguguguugggcacauauucugcggucagaggaccauuuuguacagucaccucucuccuccggggggucagacuuagguuuucaagcucauacagcugccuucgccgacugaggcagcucacuggccugguuuuuauuuuuaucuuuaaaacaucuuagaagcagcacuuugaacacuaucauuucugccuggcucucagaaucuuccugacacucuccuuccuucuuguagcacacuuccaucuuccauccaugcuccccccugguguuagaggaucuguugugugccaggaacauuagaaauuuguccuaggacaucacaguuaggucuuugagggccccaaagucaaggagaagaaucaccggguaagaaaugaugggugauccagcccugccugagacauuugcucuguagccucugccagccugacuugggcaccaaugcagcagugucuccuuuugaagggacaauuuagaaacugcagccugcagcccccuggcaacugaugugugugucccuuucuuuguggugauggaagggauucccacaggcaggcaucaucgcuaguguugcuugcagaguccucaaugacuauagagcuaacuuucucuccucucagccccugcccuuuaagguccaauucaaaggguaugucuuaguguguccugauuuuuuuuuuccuuuuuuuguuuuuuaaagauuuauuuauuuauuuuauguauaugaguauacuguaacuguacagauguuugugagccaccaugugcuuucugggauuugaacucaggaccuucugaagagcaggcaguuaucuuaccugcugagccaucucaccucaccuaggauuuuuuuuccuauccaguauuuucugaauggcccagcaugggaaagguuaccccuuagaggucaggcuucuaacuaacuaacuaacuaacugcuuccuggguacccagcucuuucuaggcucaaggcuacuuuagagugggcuagcuaggagagggucugggcuugggaaaagcugagaggagacucccagcacaccugcucuccugacuugaggccaggcuucuggcuguggcagaugggccugcaggagcgcagagggagggagcccggccuccaucuucccaugacgguuucucaagucccgagaucauggguacccuugaacacuuuucccauugaaggcaagaugaagggacugagaucacaaacagagcaacucaucuucacagauuggcaugaagaaagaauuuaauuaucuuuuaagcugcugccugaaaauccugcuauccuguuucaagcaagggugugugggaccuacacagaacucaccuuagcugcugugaggaggcucucgguccaguguggguggguagagcauauaugcuuagacccaaaucagaauugcaauugacuggauaaaccucuagcuuccggaucgagucaagagcacccugaagaggaaggaacugucaagguuuucuuuccuccgacugcaaaccacccaagaggggauacuuuaugaguuggcucaaggcaggauuuuugcugagugccuucaaagcuaauauagguuuccuucaucuaacacaguggugcucagucugugggucacaccccuuugggggaguguggggugaucuucucacaggggucaucuaagaccagcagaaaacacagacauuuacauuauaguucauaacaguagcaaaauuacaguagaaaugaaaauaauuuuauuguugggggucaccacaacaggaggaacuguauuaaaggguugaagcauuaaggagggugagacccacuggucuaaggagucaugguuuggggagguacaggggaagacauuucagcaaggucaugcgacuacccaguugguaggaggcucaguaauaagcgguuuauucuaagugugcgcagaaccuuugauuaaagggaacaagaugggauucacuuagaaugugaacaaggauguggaguuuaggggugggcuuugcaggcagagggggcugugaagaauggagaagaaccuuuucucagcagcaggaacagcucauggugugugguggugcuagagaagagcaaguggacgaagucagguggcauguacaucccacugggcuugggugaugcugugcuggguagccacucucagaggaaaggcugagugagggcagagugcagcgugucaucagcgcuggggaagggaaggaguccguggcucucuuggagacuguggaggguuggccagguaguuugggugggagacagucugggagggaagacauggagcgguagggcugccuucaacaccuccugccacucgaagcuugugaacgacguggaucuuacuguugccuccuuucgucccucacucccuuccuccuucucuccuucucagcacucaugauucaauccaggaucuuacauuugcugggcaagugcucugccacugagcuguguccucuccucacguuuuaauuugagaagagucacugaguaauucaggcugucuuugaauucacacugacucggaacuggugauccuccaaccguagaguccugacuagcugagauuaaaggagugaccagucaggcccaguuacuguuuccaucuguuaagugggucaaugggcugaacuagauuuuucccaugugagaguagugaaguagacucccccacagugggacuucaugucaucaggugcugauucugccccccucaagaagugacauagcuuuguaaguguggugaugaauguugauuugauaauccugguuuuuguuaaugagauuuucuuaguaaggaaugagaaaucacaaguggagucuuuuggacuuggguggcccuuaggauggcacaguguugguacaaccuguuuguuugucauguucaaagcuggguauugugauuuuucugguauaaacccagauagagagaaauggaaaacauuucucuacucacgguauuaggcaguuuuaaaaaaaaagagguaaauuagucugaccacaaaaagcuguagcucacaaugcuugguucauggaaugugcauagugccugucagucaacuccaucagcaucaucaucaucaucaccauugccaucaccagcagugacaguacuugugguggcucaauauuaugucaucaucaccagcagcaucaacucuaggaccccccacccucagucuuaccgacaacauuggugccuggaagaucccuucuuccucuugggcuucugagucaccauuccuccugauauaacucacagcuguuuccaagaugaucaggaaccugagccgaggucauggcuuugcuuuccucaucucugauaaacuucgcuaucugagagacaggccagagugcuaacuucauauuuugggaagaagauccauacuuagucugggcuguugccaguucuuaagaaaugaguaguuauaagaaaacucaccacucagagggagagcucuaugacuggcuugucuccuccauuaucauagaggccaugucacacuucuacacuggacuccacuuuccaggaaagagaaguuuaugucccugugcauuggugcuuggugaugucacccauagcugggccaguaaaaaaaaggugacgggggccugagagauggcucagugaguauagugcuugugguacaaacacaaagaccugaauuugggucccuagcauccauguauaaagguaggcauaguagugcaagcuuguaacaccagugcuauaggguagacacaaguggaucccagggacucagugaccagacacucuagcauuaaagaaaaugucuaguuucaucgagagaccugucucaaaaaaaauagaggaugacauucuaaagucaaccuugggccuuuacaugcaucugcauggguaagcacacccucauacaugugcacauacgcauauaccacacacacacacacacacacacacacacacacacacacacaccaccaucaccaccaccaccaccaccaccaaauaaagguaaguggucuucaagauggaugugcccacgacccagaaguauuugccuagaucugagugagauaggauaagcguguucuccagggaaggaguuccuaggccuuagucaaccauaacaaaugaaggaaaucuuccggcuugcaucucuuagcugugucaagugagcucaggcuaagcccagauguuuauugcugccuuuugcaagauggcccugugcuccugaccucuccuucccgaugagggcaauguuggaagauuggccauaagaaggagcaagcagccuuacacugaaugcuuuuagggcuuauuaaagacaacuuugcccccuugugcuuguuuaucucauauaauuugagaaucgaaacuauaggcacgugcuugccuggauccaggguccugcaauggagaccaguuccagcagccuucaggagugaauauguuaauuacaagaugccacuuuacagucgucuugcacauuuuugcauguguaugugcacacauucauguguaggugggcauguccauacagagacucaaagacaucuuugcuggucauuccuuugccacuauguaccuuguuuuuuugugacagguuuugaagugaccuggaauuuaccaaguaggcuaaaucggguggccugcaagccccagggaucucauagcuuccaccucuccauuguugguauuauaagcacaaguugggcuuuuuuuuuuugaacuguggggucuggagauucuuuugucugccagucuuucuuugcuacuaaaacacauccucacaaauuuggaaccccaaagcaccacacauuaauuaacuauucaaagaauuaaccaaacgaggaguugguucucuaagaaaaucaacaagauagauaaacccuuagcuagaaucacuggagggcacagggacaacauccuaauuaacaaaaucagaaaugaaaagggagacauaacaacagauccugaagaaauccaaaacaccaucagauccuucuacaaaaggcuauacucaacaaaacuggaaaaccuggacgaaauggacaaguuucuagacagauaccagguaccaaaguuaaaucaggaucaaguuaacgaucuaaacagucccauauccccuaaagaaauagaagcagucauuaauagucucccagccaaaaaaagcccaggaccagauggguuuagugcagaguucuaccaaaccuucaaagaagaucuaauuccaguucugcacaaacuauuccacaaaauagaaguagagggaacucuacccaacucauucuaugaagccacaauuacucugauaccuaaaccacagaaagauccaacaaagauagagaacuucagaccaauuucccuuaugaauaucgaugcaaaaauccuuaauaaaauucucgcuaaccgaauccaagaacacauaaaagcaaucauccauccugaccaaguagguuuuauuccagggaugcagggaaacauguguggagcauguacuccgugagcccagcauauaggaccaucuggaccuugucuccuccauucuggacuguuuauccugugcccuugucucaggggucuucgugacuacuuugagccaacuauguaauccagaauuaauguccccaucugaaaacccuaagcuuggugacaacugcaguggcgucuucggacauguugggaacauuugcacuggguucugggaauuaagaugguaauuucuucagaauaucacuguuuuaucuacccuauuccuuugucagauauucuuacauuguggaguguuuuaauuugcugugaauuuugaguuauucagucaucagcauuaacuugagugcagauuuggggacagugcuguggucaugacugucuggugauuuggggccacgugccaaucauagagccaugccauccuucacagauaagauugugggucugcgggcucauuuccaaguuacauuuaugguuuuggaauguguguaugagauucucggcccucuuuucacugcuucugaauagguaggguucuuuguggggaaacacuaagaaaaaaaucauguguauacauuuugcauguucacacaggcccagauguguuuacacucaauguguucguuuuauuucauuuuuaguaugucugacuuucuuuuuuuuucuuuuccggcucucuaacugaguaggcaugcuggaagcgaugcuguucacggcagugauauaaaagcauuuaugguuccuaaaggcuuaagaauauggcugugcugaacuggggacgcucagcaucugcucugggccgccuuuaccugcgccguuaucuccuguuaaagagucacuauaaaaugcuaaauaaacuuaauaacugguaacaacccacuuugccaguuggggacacuuacauuuuaugaauuugggggaaauacuugagaaaaugggauuuugcagguauguguguguuuggaggcuugagaugggcugugagcccgagcaaaugcccuugcuuugacauuuuagaaggaacucggaagcugagcauuauucuuugcagaaaaagugugucacuucccaauucaauaaaggacuuuggugucaacuaaacucacagugggccagauaggucuaaacaugccugucauagauggccuaagccguuaccuucacacgcccagaaaggggaacuucaguugaggaguugccuccaugccaauggcuugaggacaugccuguggguggugggaggaccuagcucucuguuggcaguaccaucccuaggcagguuggcugucuaagaaaaguagcugaacuuagggcugggagcaagccaauaaacagcgcuuuuccaaggucuccacuucaguugcuaccucaagguucucaacuugagccucugcccuggcguuuuucaaugauggacugcaauguguaacuacaauaaacacuucccuacauacauugcuuuuccuccguguuuuaucaugcgacagaaaaaaggagcuuggggcuacugcuggguggguaguggguuucuuugugguguuggggaaacauuuggaaucuaggggugauaaguugcauaccaugaauauaaccaaagcccaagauugcauacuuaaaucacauucucuccccacaauaauaaaaaaaaaaaaaaagcggagcugcuuggaauuaggaaugguuaugaauuggcacauguuuaagaugcgcccuuucccuuuuguguguggaacugaaggcugcucaugugaguuuaucuagacugaauauauuguaauguugaaaauaauccuuucugcuucugcuaaugcauucuccugucacuuuuccaacagccuuuuacaacuacgaugccaggggagcagaugaacugucccuucaaauuggagacaccgugcacauccuagaaacuuaugaagguaagugaggcuugauggcucccuguuggggauuugggaugacgcuucagggccuucuggggggggggggaagugcuucucuguuagggugcuacauucucaggauggacacuuuccccacagauagaugcucuuccaggcaaagguugcucgggcagcuauuuguuaaauucagugaggcuuuguuaaggccaacuuaaaacuaagcaucauauuuuuaaccccuaaaugcuucucacuggcucguuauuuugcacauauauguaaauauuuuuuguuuguuuguuucguugguuuguuuuguuuuucaagacaggguuucuguguguagagauccaacugcuucuggcucccaagugcugggugggauuaaagaugugugucaguaccaccgggcuguguguaaauuuugacugaaacugacugacuuggugagagacagauuuggagaauucaguguguugcucugaugugugugaugaguguuuuaaguagucuuuuuuuguuuuguuuuuaaguuuucacuuugauuuguuaauagugugucucaggggaaacugcagcugccaugcugaccuuuuccuuugucugugacccccauuuucuucggggugaaaagaucacaaguuacaugggcuaugguucaaggaagcaauuguggcuuuucugaugcucuugguuagugccuugcacagccugcgagccacuguggguguucugcggugguuguuacugaguguaggggcaucggcgggcgggcagcuugcuuccuuacuucucucuuuuuaggcaucgcuccccucaguuuccuuaagguugguguuucugugucugcuggcuuccuuuucugccggaaaagaugacuccauaagcaguguuugagucccgggaccugauuuaaauaaccaaauugcuuucagaucggguucagcgaaagccuuacaagugagagaggaaauuguagacagcucauaguaaccaacaaauugaacuuccagagaggucuucacacuccacuuugcacaggagugagcugugcuccgcuucugccagccaggcaagcggggacuggcucccgugucccucagagacauggcugagaagcaaaacccuauuaaaaaaaauccaugucuugccccuuauuucuuccucugaugcaggaagacucggaagaacucuauuccauuugcaccguuuacuugcaaacugugugggggaugagggagucagcucuguaugccuagaagcagcuggagcuuggcaaaaaggagccccaaagcgaaugaguggcuggcugugaugggcgccuucugcuuguuuucaguuuugacagcugacaguuggauuuccuuaucugcucucccguacagauugccaguggcuucgaggaaacagagagagaaauuaaguugaggugaaggaucaggcaucucaucucagacacuuuuucugaucugaagggaaaugcugauagguuucuuuuauuuuuuuaauugccccuagcuacuugaauguggaaucccugguuccuccgcucagagccucagugucuuuccugaauaguuaaugauuuccuggggcaccuggcuggguggaguguggugucuuccuuuacuucuggaggacacuguccccucucgcccugccaccucagucacaucagugggccuuguucuacacuaaccucacagugaucugcuaguggcuuugacuuccggucuucagccaggauuaauuugcaggccagucuuggaucugauuaaaccagcagugucuuuccaaaagacucuuuaauauaaaaugcuuuucccuuccugggcagcuaacuucuugguggacucugggccgagaaauacauuaacugcaucuuccagaaacugggugacuuuaucaucaaguaaagauaccacugccaaggcuucccugcgccuacauucugcucauggcuuguuuuggaguuuggcacaguuuccaucuuucucuccucuccacuuuucuucucccucucccucucccucccccucccccucccucccuccuucuguuuaucaaccuugauuuucuuuuucuuuaugguccaggauuucauuauauauaggaugcugcaaacacuguaacaucuaagcgcccacucagucucccugugccccaugcuaagcuggauucccccuuuuuuucuccaccucccuuuuuuccuucuccuuuuaagaugauuagccuuuauuacaugcaguucaaagaccacauuuaccuuacaguuaauugcucucugaggcuugcugagguggagggugucuaacugcagcccaaaggccauaugcaggugaggacagcucccaguaccacccuccagaaaauuguaaacguaguuaagccuuuaggagauuucucucucccugucuuuuuuaauuguaaaaacuugaaugcucuuagcaugagugcuguagacaacaacaaccguuaaaagguuggacaggcuugcuacagccaggaaagguaccuaacuucaggucacagcacuguggaggugggcagaugcacucagugcaggcucuugccuuuccagucauuucuaguguugagugcuaaccagucacauggaaacacuagucccagcugcucaagaagggacucuggugcuguguaaguuuccccagggcugcaugcuguuucagggcaagccugaagcacuguacaaagguugagaaauuaucuuuuggauguggcgguuacaacuaacuaacgcugacuaauucagguauuugggugauaaugcuauauauauucuuccaacuuccuaugcuggcauauggccucccugagcucagggcuguauuucugcuaugucugucugucugucugucuuuccagugggugucucuuuucgguauggaagagcugauacaugaagggcagcagcaaacccugccugggaguuguucuaaguguguuaucugccagcugagcaucuuuuuggccagccuugucccuuccucuccuagccauucagucacaucccuucauacucauggugacacccuccucgucacacuaaacucccuugcacgcaucacucaguguggcuaggcccuguuugucuuaggcaccuugugggucaugagcagaggcugugucuguaauuggugugcuuaggaagguucuagugacaagugaaugggccccgcuugaugaagcaauaauuugugcagaacaugccggaaagcacuuagcuuagaaaugccauuacaaaaagaaacugccagcuagcuaugcuagguuaaagauuucucuucugacugcuguaacucaguuccuccaaacaauaaaaauaccucugucccccaaaccaaaacaaacgagacaccaccaccaccaccaccaccgccaccuaagccuuucuuguaccuggguucuugcucuauguguuguguauguguuuaccuuagguagguguuuuacagcuuuccagucucacugccuucucuuuaucuuguuuugcucuuuugucugggucucuuuagucuuggcccugucugccuugugagcauugcuucauguccugcuggcaguaaaggacucucaacucugggucuccaagauccuguugccaggaaggagggcuugugucuauucugcucuacaggggauacagcuaucuucaggcuguuucccuaggaugguaugcuggugauggguauaggguuccugguuuuuaugguggggggggggguugaaggucagaugugcucacuaguagcugcugucuacgcugaauucugagcccaggcugccauguucugauugcucugauuuucaccagcuuuauuuuggagcagugguaggagguuguugaguuuuugcuucauugcuuaguaauaaguuuggguucucuucacauguguguagguuguuggguuucuuugaugaaucauuuguauaguuugauccuuuuuauuuuuuaacauccuuuuugcugacuuuuuccccccugcugucuuucuuugauauucuaggacaucaguccuuugucacuuucagagaaaaaggggcauacuaauguugaaugugugggaaggacauuguagcaguguaaaggacguuccuuuuagacugagugguacaggcuuugcauaacucauuagauuacggcgccauuugcccggagccuauaaugcuguaacugugggcacugauuccagguuagucuagcugaaaccucugaucugacaguggcuaucggaauguuugcuauuuggacacuugacauuuagaacaggcuauaucccuacucgguguguuugguccuuauguuaaaagggcagagaggguucuuguggcccuuccaagauuccuggacuuccccuuccccuuucuagauauaucuuucuaauuauuccuggaggcccuuguucaugucagcagcuguguauagccacuuucgccaggauuacuuucugggaaggcugagggacccaauguugccaugugcuguccuuccuuccuuccuuccuuccuuccuuccuuccuuccuuccuuccuuccuuccuuccuuccuuugcucccuucccuucccuucccuucccuucccuccccuccccuccccuccccuccccuccccuccccuccccuccccuccccuccccuccccuccccuccccccuccccucuuuuguaucauaucuugcucuuguggguuucuuuaggcucuggggucuggugccuaagacuccauaauguugaaucucucagaauuuccccacuucaccuucaaauacaaccugaugcuccgcagagucccguggaacaaacaacaacaacaccacaaagaguuaugggaugucuuugaccuuacgaguuacuuucuagaaacaagguggccagaaucagucuuuguaauuguaagaaaauaucgaucugauuucuuggccuggugggauuauggggagauggguucauggccaugggucuuuuggcauccuuaugguguccaauaugcuggguaggacucacccauucagcacuugaugugaaugaacaguucaagugucucuccuuucauugcccacuuuccuuuucuuguauaacaagaagggauaggaaguuggagucaggccaaccccuaagggggcagggucuaugagugcuuggccugggugcuuccuugggaguuguccuugccacagaaguacuuugugagacucuggcugcuccagggcagagccuuacagaggaaggaagugggcucucaauagguuuucuguuggacagucuuugaugauuccagacucuggaaguugugccuggagagaucuugagucagaucagcagauggggaguuggggggcaugcacaaggauccugcugggaacaaggccucuuuuaggacuuaacuuuugauuuuugaugggauggguugaugaggcaggcagagaugaagugggguggucagcacgugcagggagcgagccgugcucuaugggacuccucuauggcauuagggugcuugucuuuccgggucuggagggcagugacuucugcaaacuuugaagguuuugcuuggaguaugcugugucuccuaaccauuucaacccuguguuuguuuagggugguacagaggcuacaccuuaaggaaaaagucuaaaaagguaagucuuuuccauuaaacaugucucuucauaaauuaaaccaugagaggaaauaaauuccaucuuauuuauauauaagaauguuacuuaucucuuucuugaaauuuaccauauauaugggcugagauuaaaaaaaaugaccuugaguuggauucuucugaauaaagaugucugcagaaaucacagcuucugcugggaaugcuuaucuauaaucccaguauuaggcuagccuggucuaccuagugagaaccuguccccacaaaaaacauuucaccuaggugauuaguuccaggagugaauuguugaucuccacucauggagggagaauugauuuuuguccugauagaauuuugcaucuuguugaaccacuguguguagccaugaacugagaauaaucccuucagaagaguaaaaugccgccaacaguuuuccauuuccuauuauccuugguaaauuagcaaguuugcaaagcucacacauggccauuucccucuugccuuauggcaguuuucagacuagcuuagucaaguuaaaagagccugauuuucuagggugauuugcaugugugagucuaugaauauccgaaucaaaaacauacuaucacuccucagauauugugaagggcacucccauccacaagggaguguggcuucgacauucuuagcuucacaaaaccuaauuauggcucuucucucuuacucuguaaugcuauggcauugcaguaaugcccaugcuaagcuaugguuagucuguccauguuaacuuggaccuuuuaauaucugauugugguugacagaugguucauuuugcuucccagaauuggccucucauuacugcuguauccaacuagacucuguugugaucucuagucuauaauagggcuuuggaauccuagugguuuccaugccagggccucccuguucuguauccucagaggccugggcuggccuucaccagcagggcuagaguuccaugaagcugugaagccuccuuuagggauaucacccuugaagugugcagauugggggaaccauggugaagauuucaggaggcaagacaccaggaguauuaggguuucucagugguaaagugcuugcccugaggauccaaguucuaucucuagccccaauguuaaaagccuuaaaaucugggugguggcacaugcucauaauuguagcacugggaaggcagaaaguagagauuaucuggaacucacuggccaacaaggcuugucucaaaaagcaagguggaugacuucugaggaagagcgcuugccgcacgcaugccuacauacaugugcacacauagguacccacccugaugguuagcauugugcagacuccuuuauuacauagggcaaagccacccugcugugaggaacacaggccuaggaaggcucucacuuuuccuugaugcucauauguugccuagcaaccccauccccaucuugggcucucccacucuucuaguucagggguucucaaccuuccuaaugcuguugacccuuuaaaacaguuccucauguuguggugaccccaaccauauaauuauuuuuacugauacuucauaacuguaauguugcuacuauuacgcauucuaauauaaacaucugauaugcuaccccaagggguuugugacuuuuagauugagaaccacuguucuaguccuuuucaaagucagaauuuuucuuccuggccccaggagaccuaggccuucuaccucaugauguccuaaugcugcaaaagggugugguuauuuucuaccugacauccccauuggcuaaugaggaaauuaaagccuugcagaggcuaaaguuugguugcaguugugugaaguggccccaagcagaugcagagaagcagcaaggcccuuaggagucuugucugagagcccugcaugagcauccucugucuagauauucauagacauguaguugggcugggcaguggcucauuucaaaucucuaggcauguccagucucauccagcuguaauuucuccuugguuuucauaauauugagugcugaggcugaggaauuucuuucuguggacuugacagggcuggagugguuugugucaccuccuucuaaacccacaccuauucgaguuccagugaaaauaacguguuacauguacaccuacaugucuuucugggugucuuggcaucuggguccuggauuggaugaccuggaccucuugauugcucagccugacuccuuugcuugaugucauaguauuucuaugugugaaaucuguucacuuugcugguggacaauguugcgguaguuaguuagccacucugugcuccagacggguugcaugcacacacccaccaagagcuauuuggauucuucaaugaaacacacacacaucaguuaauuuuaauaugccuugacuaguuuaauagcuggacauuucuaauucuucccacugcuagcaaacacuccccuacuguacuuccgaguuaacaucuuauuuauuuauuuauuuauuuauuuauuuauuuauuuauuuauuuauuuauuuuugguuuuucgagacaggguuucucuguauagcccuggcuguccugaaacucacuuuguagaccaggccucgaacucagaaaucugcuugccucugccucccaaguguugggauuaaaggcgugggccaccaugccuggcaguguuaacaucuuuuaaaaucuagauuuuaccucugacaccccaggccuauggccauuuacccugauucucagugaaguggccuauggccauuuacccugauucucacaagugggccuuuaggucuggccuuuucucuuccccgccauggucauccuccucuucuuccuuucuccugguuccucguccaugcaaauccccaaagucucacaucagucuaccugcccaucccuuggccauugguucuuuauugauugaucagaaaccaauuggugacgaggaccuuccugauuuugaggacuggauuaauucaaaucauuagaaucgaccuccaacaggacagggcaagcagagaucagcaguaucugcuagccacuuucagcccucucugagcccgguuuccuucuaagcaugauugcccauuugcuuucuggauguccaguguagccccuuguuggcagaugcguccagucagaugcuccuuuuuccccaauagguuaucuugaaucacuagggcacuaacugccuuucuguuauguguaccagucaucucuggcuugugcagccugagccucugggagucacugguuugggcugcucuggaucccaugagucaggucuugaaaaacuacuccuggcauuccacagaccauguuugaaguugaaguucuucucaagagaccugcuccuuuaagcaggacucgacugagccacaugucuacauacacauguguuuaugcugcacacgggagaguuagaggaggguagaagcauaggcuagcauguuuccucagcacuucugcagauggguggaauuucacccaccuucggccuuuuaccauugucuacuucauacagagacugaugaggggagccccagggcuguaccucaguggucaguggacacuugugacaaucagugguuuaagccaacuucugauggcagucuuguuauuuuauaaaggggaaucuguccucacaauugguuucuggcaucagacuuguugcaugugccaaugucaaggucagcagugcagaggaggggcaaccuguggaggagaacauuuccuugggccuuugugaaauuguugcuucgcaaacauguggugucuguuuuuugcuaagacaucugcacagucugaaauacaagcugauugggagauucucuuuuaugccuuguguuuucuucguuguguugugugugaugcuuacacuugcaaaauuaaugguuagccagcccccuagccccuccuccucuggggcuauuguuugauuugcagucaguauuugcauggauaauaaaaauguuuuuucucucccuccaaggguauauuuccugcuucauauauucaucuuaaagaagccauuguugaaggaaaagggugaguguugaaggaaaagggugaugagucucuucuggauauuuaaaugaaggauuagaugauuucacauggcacugcugccaaauaugugguaggguaagacucggagguuaagauaauaccagugggguugcagagguggcucauugguuaagagcaccuacuauuucugcagaagucuugaguuugguuuccagcaggaaugucugcuagcuuacaacuaccuggaacuccagaaaacgcacuuagacucauguacccauagccccauacagaugcacguguaaauacacaguuaaagauaguaacaguaacucauuauaaaagauaauagcucuguuugaccaugaugauauagaacaauaaaggaacucgugacucagucaucuuggucauugcuuuggcccacuuaaggguucaaggucagcaccuuagcuguggucaucucuuugaagcagaggucaacuuggggagguguuggugucuaugagcuacuucauuugagaaugaucacccuagauccuuagcugaguuucuucuccccugccccagcccaugaaaucuagcaggguaugguacagaauugcgggggaaugaacaguuguuagguugggaccugugugaauucaugugucagcuaauugagauuuauaacuccccgaggucaucagacuaauguguaagguccuuaaaagaacauucauggaccaggaacccaugccaggugugaacugggggaagacagcauucaaaugucuucuuuuuuggucucucccucaucuucacauuccguuaaauauguaaauuauaaaauuacuaaucauaugauuacugcauaaugacaucucuuuggcugauuacaaaauugccuuucugagcacuguacuuuuaacauaugaaaaggacggcuuggguuccuguacuuccccggcgcauaauuagagggaagggaauaauuuagaggcauggauggugcugaccugcaagauggaauuuguucagacagauaaaauguuuuguaugcagaauucucgaaaggaagacaaaaguaaguuagaaaaguuuugccuuuuuacggaaauaauugaaguucccauuuaaugugcuucuaucugcuagggucacagucuuuagauaagucugcuuguauaggaguagugauauuucaaaagcauuuugaagcagaugaaagguguguguuuccacaacauuuauucggcggcacgcuauuaugggaauguagaaucaccuggauccaggcagcaggcaggcagguccuguuggucuucuggggucagguuuuaggguggcgagcaggaaccgcaguggagucgagcagugcacagguguccugaugaugcuuucugcucucagccuuugcuccacaccuccuuuccuggcucugaccuuuaccucuucccacuguaccuggcugcccagcugucucccccugugagauucuucugcccaagggccugacaggugaccacuaccucuuccuuucuucuagaugcugcagaaaucugcccucuuuucugcugguccuuccucuuguccagggcuggcucagccacuccuucacuucauuccuuuugucucuuuccugguuuauuaucauuguauucauucauaccguuucuuccucauuccacacccccacacacauauguucuuucucccaugauuuuccuuuuguguccucucccuuccaugacuucucucuugccuggccucuccuuucagaacucuuguccccaucccuuccuucauuuuuuuuuuguuuuuuuuuuuuuuuuuuuugguuuuuuuugguuuuuuuugguuuuuuuuuguuucaugccuguggccaugauaaugugcuuuuuauauuuugucauaacaaagcaauucccauuuuguccccuccucucugcugacacagaauugccugcagcaauggcuacaguuggcugcuauuuucugugaagcccccuguggguacugagucccuuguacucuuucuuaccugcccccucacacuacuuucagggcucggaccuuucuuugagaccucuucccugugacuuggcccauuucucgcacaccuggaauuggucuuccccgggcuucuauccuugcuuuuucuuuggacccaugguucaguugggcagagguuaaggacuuaagaaucaccagucaagagugguguuacaugccugugaucccaacuccuuaaugggaggaagaagcaggauggucaguaguuuaugucauggcuaccugggcuacaggucacccuaucuccacccuacucccagccccuuccuccucccuagaaaacuagcucacaguugcugguuccauuccugcucuacuccacucacucuuuuauagaauuauuucgaauugauaaguaaaacugcuacguacucauggcgucuacucuacauguacauugcaggguggcagguugagcuaguucacauaggguucuuaggagaggcugucuucagucauacucaucugaggggagaacacauacaaucugcaguucaggccauguuuaaguucauaguguguuguuagugacacuggccaccaugcuggacaguacaacucuuggauuccuucucucgcuuuaauguuguguccuuucuccagcaugugucccuuucacaguuccugaugcacauagccaggacucuuucccucuguacugugcucgcacgguggaugagcaggugguguuggggugguacuguccuggccuugggacucccucacacuuaucugaugcucaggugggacucuuuccuccaucugauggucuuguccccagguaauaaagagaggcauuguugucugugccuuccugaccucuaccaaauacaaaugaugugauuuuucaauucuggggaaauaaagcucacaaggccgugccugugccgauacagaguuaaagccaagucagagacuaaaucuuuugggguagagaaggucagcagguagucaugguugggacuggauagaccgcucaugagcaccugaaacuguaacuuagucacacuucagcaaggauaauuggcccaugcaucauuaaagaaugaguuuuauacuugauagaaauguggaaauaaucuuuauuuaaaccugugcauuucaauggcacacaccaacuggguguuguuuaugguagucugagagagauggguauacacugaauauauauauauucugaauacacuuuccuuuccccccugcccuugguguucuagagacuuugguggcugaucuuucucuucuucaucuuacccugccacacaaggugcauggcuuccaggcaggauaauguguagacaucuccaugcucuguauaaagagcuugucguuuguaggcauauucacaugugugcaagcaucauuauauuuguguguuuucuccauuggcuuaaccauugagcucuauagcuccuguagggaccuagucagguacagcucacaaugaagucacagaaucagcuucuuucucccucuuuuccucgcaggcaacaugaaaccgucaucccuggggaccucccccuuauacaggaagucaccacaacgcuucgagaguggucuaccaucuggaggcaacuuuaugugguaagaaacugggaugcucaguuaaagauuaaaaauccagagcgguguuucuggucccuguaccaaaauagacuuuuccuucccugggaaccuagagaggagaggcucugagcagggucuugcuucugaaggacagagcaagcaucugaucauuguuuuagcuacuguuggggacccuguggccuuugaccuuuguuguguugagaugcaguuugcuuacuauauugaauaaacugaacuaaaauggaaguuagccuuggaucccucuugcuuuguguuggguaaagggaaugugguuucugccaggucuuugaaaggacaggaccaggcaguuucuguugauguuaccucugaguauauauuuugaucaugaaaaugaaaaucuuuuuuuugcaccgaaaucccauaguuuugaagacuuaguagaugguuacuaguaauuauucccuucauuugugucagugauggucuuagggcugaggaguaggcuagucuugauguauuguguccgaggugggcagggauuauuucacauucuggcucugugugcaguuguccaguucuuauuaaugcagagauguuggagcucugacaucuuccauuuccuuuccccucggggcauuucuuugcacauaaauccauauuugcagaagauuaccuuuuguuaagccuguauuucuauucagcguguugauuucucauaugcuaauguuauuaucaccgagcaagggcucuggaaggaagucagugcguuaauuucucaggaacauagaaaacuuccuaaagucuccacagcuguucgcugggcaggcuuguuuuugauuauacagugguuuccuauaaauguacaguaauaagcacuugcgguaauuguucaucaaauguacucacaaaccuaaaagcaugaaguuagccaugaauguuuuguguaaaucugagcaauuucauagucgguauuucauguucaacuuagcaauuuuuaaacaaaaauaugauaacacaacaaacaggaguugccguggaccggucagugaguggacacugucaguuucccuguuguucggcauccuuaaccauuaucaucugguuccuucuccaaauggcacauucaccucugauggguugauguuguuagaucuguacaauggcaagucagagguccuucucaguauagggaugcacucuuuuagaugcaaucugcuguugcagaccugucuacaaaacagcuaugucuuuuauaugugagagaacagcaagguggauuaguaugaugaaaaacaccauguuuugcaauaaauucuuaguuuggaccucuuuuaguuuucauuugagaaauccaagugaggagcuuggcguggugaugggcacucggaaaucagaggcagggagaguaggaguuuacggcugaaguuucugcuguguucuaucuacucucugcaguguuguuuuuaaacaacaaacucccaaccauucccuuuuaccagugaagacucaggagccaaacacugugguaaaagccugcucccugagagaggcagagaaagggcccagcugaccuuccuaugccucaaacaccccggaaggagaagguuucuuuucuuucuucaugcccuuaaacacauuccucccaacacagagucccuccuuuccguuacuuacgcucacucccugucagcugguuucuugcccugccucuugaccuagacuugacuuuauuuagcucugggguuaaaggagucuguuagggcugagcuacacuacaacccgguguauccaauucacagucuugagggucacaaugggaucaaauaucccacaccacugcaguucuuggcacaguguuuggucucaaaaaauacuuguugagugacuagaagaauaguuuaagguugaggcuagccuagucuacaugacgcucugucucaaaacaacagcaacaaauaaaaauaaggggaagaaggagaaaaaaaggcaggaauagaacgaggguaauguacaaacagccuggagaggugccucggcagguaagaucacuugcugguuuuuucuagaggaccaaaguuugauugucagcacuuguaucuggaaguuucuaacuccaacuccaggagaucagaugcccucugcuagccucugcuguaacaacccccucccucacacacacacacacacacacacacacacacacacacacacaauaauauaacuugucagagugcuguguguuggguaggugguagggcuguuuuaaaaacuuuucuaaagagggguuucaaaugguuuucaaaauaggagcuagugaggagggaguaucucagauaauacagaccagagcuccuuuuuaaaaacagcaauucuacauuuuaauuuuugaacaaugauaguguuuaaaauauuauuaauuaacucccacuuggauguugagaagcugaacauuguagacaacuuuagucuucuugaugagcuacaucaacaagugcaaaccuguggggguucuuguaccacaaacccaauacacaaaaggugagacgggucaguuugggaucuuaucuugcaguuuacugcaaguugauguagaagcaaaaagaguauccauggauagacauuuucugccgcuguauguugugagggucacaguguaccagggaaggcugguacaagauggcuuaucugucagcuggcagcauggucuugggacccaggcaucuccaggugagcaauggggcagaacugucaugggaagagaguacaacagucagugcuuccaggcauagccaauauuugacauggugacaugccagucuuugcuaacuaugaagcucaggcuccacgauggagcaaugaaguuugaagagggaaucuccuaauguuuuaggugaguuuauaguucuguguuggaaacuauccucagcuaucuggcugccuucaugcauuggucaugcacaggaugcugcuucgaguuccaggccagacugaggcucaagguucuguucuugcuguguucaaugcugaggacguggcuuacuucuuguucuuucagggucucauaggaaccaaauccuauacaaugugcucuguuugaugugugaaccugcucuucuuugacagucacuggaucccaggaagcagagcauauucuacuuuaguuugaagaacgauccauuugacauaaucuccacugugcuguuuuuuguuuuuguuuguuucuuuuuguuuuuuaaaucagagcccuuacauuuuaacuuucucuccuauguagcaagauaauagagagauguuucgaagugugcgacacaugaucuaugaccuuauugaauggcggucgcagauccuuucuggaacucugccccaggaugagcucaaagagcugaagaagaaggucacagccaaaauugauuauggaaacagguuuguuugugcaaauggugauuucaugcuuaaauuuuccacaguaauagcacaacccuaggccuggaggaugguucaauuacauuuuaucauaaaaccaaacuucuaauaucaaaauaaugaaguggcuuacauucuaaucugguuuauccugucacccuugaaaccuguagucuuugcuguguaagugggggaguugugaagcuggguugggguagccccucauuuuugcuguuuugucccaccccuguuaugauauucuacuuauaauuuuacuuucuacucauagcauuugacucuagauuauuuccuguagucccuuggucugucagacuagacguuagaagucaccaugaaacuugucccuagaguugacaugcuugaucuaacagacagaggcacaauccucuuaacuuacaauugagaugaacuauacguugccuuuuugagauguuuccauuuaugggagacauccacccugguuuaguugagugucuugaaagauggcucacuccugaaaacagcaugcucuaauauuagcugcugggaaugugacugucuugguucuaucucugcuauaucaguaguuaggaugaaguuauggccuuucccaucugguacccauuugcuuauucacauguuacacugcaagaagccuuaaagaugaccugguccugcauuuuccucaggcccuauaaccucagaaacaccugggcagguuucacuauacucaauccggggaccugccccuuggguucugaguucugcugucuggucuagguuaagagcucagucagacugcuguuugggugguggaaaacuuaagguguagucugcacccuuccccauuuuuacaccugaggauguggaggugagaacaggggcugccuccugcccaucagcucagaaucuuagacaagccauagggccuuugugaauaacugaauuauugcauaauuuuguuuucugacaauuccccuuuuaauguaugaaaguuuccuaauaucacauuaggugugacuuuuauuuuuaccuccaaggccagagacuccagauauagaguauuagacacagcuuucaugaaacccauuacaagacuaccugcuuucaaaagcuacugacccaggcccacacucugauuuccugagguggcauccauccccugagacuagucuuuaaucuuguugaggugagacuaacaccugcacagaaccagcuauguauugguugcagagaccaaauguagacugguugcugugacugacaggcugcaucauaugguggcggcauugggcuaaaaugugaggagcaaaggcauuuauuuauugauugauuaauugauugauugauuguaugccuccaaggccagagauuccagauauagggcauuagauacugauucaaugaagccuguuucaagacuguguguuuacaaaagcaaaccuuuggaacucugauuucauuuuguauuggagaagccuguuuucaaaguuagguucagagaccaccugcuuaaucuggcugcaggaaacagccuaaguacguuacgccauggaacaauccuguuaagacagaaaguguuuccaaauguaauuuacugcuuugauaggaaauacaaccuuauuaagacaaguucaccugaggacugcaggccaggauucuucuaaagccccaugcucucugcuuauccucccccuccccccuucagagagugacauaauaauaaauaauaauaauaauaauaauaauaauaauaauaauaaagaaaagcauagaguguuugguuuugggauggucucgucucucagggagcaguuuguugcucucaucauuaucacauacguauucuugcuuuuaccuuuuaccugagucgggugggguuguggagugucuagggaacugugggaaauaugguaaaggucacggacuguuucuuuacaaagauggcuguguaaaacacagagacaaacaugcauacaccuuuacucggauucaccagacagguccacaaccauaccuauccauagaaaccugcuuguacauacacauacacacauagauacagacagacacacacacacgcacacacucugauuucacagggagguggccauccccuucuuuagacccuuugccaucucuugggacuagucucuaaccuuguuauggugaagccaacacuccacaacagaaccaacuguguauugguugcagagacccauguagacugguugcugugacugacaggcuaccucauauggugaugauguuguggugagaauauugccaccccaucuucuuucuaucuuuuauccgaacuacauaacugaccucacugagcuucgguuuucuguuuugugaagugggucugaccagauuuucuaucuggacugaggugacaaugacaucacaugauacucauggugggcuggcaaagggccugauauauaucuuccucaagguggccucaccagguauagcuugucaggccuuuagccugggccuccaggagcucacccacagcaccuacaauucauugaccacgcccacaucagagcugaccccacccauacaucacugacaucauucauaaaaugcugacccauggucuuggucuugagucuuagagcagguucaggguugggaugaguuggugagauuugagaggcuuuguccuguuagugaaaguuguuacauagaccucgauccuucagaggcuuucugccaucauguacccaugggucguauacaugugagggugcagaaugggcucuaaugacccgcaucuuccacaguuguuagucaugcauacuucacuuggacuuugaaggucuauuggaaggugaaggcuuuauugaaauauagguaacacugagucauuuucuuucucccagugugacauauuuugaauuacagaaagccaugccacagaauggcauucucugauaucuguggaugggucccaguuucugaggcauuucaucugcucuguggcugggccugacacugugcuaggggacccccucucuugguucaugcucuccaugcucuggauucuugguauucuagaauucuugauuuggaccugguggugagggaugaagaugggaacauuuuggacccggaacuaacuagcaccaucagucucuuccgagcacacgaaguugcuucuaaacaaguggaggagagacugcaagaggagaaaguagguuccauuccuuaaugugcacuuugccacuuugcacagcagguggaaauggggcagggggugggguguguggggguucagggagggggcacccccuccuuguauuucucaccaaccauguugaauaucagaaaauguuaaggaaguccagaauugacacuaaaaagaacauucaaaaagcaaguguccagcguguuucagacaaggaggagugggguaaagucaacauaaccuacuaauucagcaaguauuggccaggcgucugccauguuccagggacugggaacauaaugcagagugagacacagaguucuugggggcaucaaucauucagaaccccaaauuaaagcuagcuaccaguccagcaaccgucauuccaguuguugauagacacucggaaggcccaugcucuugcaaacacuagucauuagcuguggcuggauaggcaguguguugucugagagcaugcaguggggacacagagugacuguaugaguggcaugagaugugacaguuggcagugucuuuucacuauucuacaggggaaauaaaagagccuugguuauaguccagguugcucacauugacuuucuaccuuucuguucagucucaaaagcagaacauggauaucaacagacaagccaaguuugcagccaccccaucgcuggccuuguuuguuaaccucaaaaaugugguuuguaaaauaggagaagaugcugaaguucucaugucucuuuaugaccccauggaguccaaauucaucagguaggugacuuccccauugcggguauuuuaucaauugcuuuucucauugcugugaucaaaauaccugacuagaagaaucugcacuggggaggguuuauucugacuuacagucggaagaugagacccaacauggugagguccugcuugugggagcugcucucagcugaaggaaaugggcugguuaguuugucaacuugaaccaagcuggagucaucugggaagaaggaucuuuaauugagaaacaucccucuaccauaaucguacuauaggcaagucugugggagcauuuucuugauuaaugacugcuaugguaggguccagccuacuguggaaagaugacccuggguuacuuaaaaaacaaacugggcaagccaagaagaacgagcuaauaagcgauguuccuccauggccucugcgucagggccugccucugaguuccagcccugacuucucuucaggcaggacuguaggcaguacagggaggugaacacguuguuccccauggcucuucuggccacaagccucaccuuuacuuuuuugcaagcguuuugucuaggaaugccaucuguggcuuucaacuuuuugcugucucucugagcuguuuggcuaguugugugugccaaguauuuucucuugucauacgaagagucauaauaaacaucuguugaacaaaaccguuggaaacccaucagucuuuaauauaacuuuaucuuuauccugauuuaaaaaaaaaaugugauuagacugugugaagugugugcauaucuauauaucaaacucuccuguauuuucacuugaaguaucaaaauuugaaaauguaguguuugcaggaaacagagcacguaggugauuuucacucucauuucugauaagugcuuucuuucuuuuugauggagguacaauuuguauuuuacggcuugcucggcuuuuuccgaaggcucugaauuaaauauacauuguucccaauucaauacucggcucuguauuguugucauucuaaacauucagagaggcuuuucacauuauaaauauugaaaugucauuugcgaauacuuguguuacacggguuaacccaugguguagaaagggaaaugguuggucauacccuaccugccccgccaagaguuuaucuguggccuagcucaggcucuguaagcucaggggucagaugcauaguggaucuucauauuguuaauuaugaagucuuaugggauacauugaguacccgucuauguuugggaguuuaauuugauccuguuuuuuuuuuuuuuuuucuuuuuucuuuuuucuuuucuuuuuuuuuuuuuuuuucuuuuucaagugagaacuaucugguccgcuggucaaguucaggauuaccaaaagauauugaucgguuacauaacuugcgagcuguguuuacggugagugcacccauggcuguacauguugagugucauugaguccugcucugauggcuguuuuggggacuucuuagcacugaaugauuccuaugggguggugguggugccaccugggacacuggcuaaucccggaaucccugagcccauugugaaaauuucuaagcuugcucuugacuuaguacggcuaggagagagauuccuuccugucgcuugagcuaguguccaggucgcuuagcucagugucugcuguuacuuuauuccuuccugucacguaaguaacuuuaaaauacccuaagcuggucugagaacagacucuuaguccauuuuuauccuuuucaauuggacuuguguugaaucauaguucuccacaaugauguaugaaaauucauauuuuuaggaucuggggagcaaagacuugaaaagggagaaaauuaguuucgucugccagauuguccgugucggucgcauggagcugagggacagcaacacgaggaagcugacuucggggcugcggcgaccuuucggcguggcugguaaauacucccaucccuguuuuuccuugcuaguuucagaccauucacuuugagaaaagauagugggccauuuugauuuaugccuuuaacugcuuggggggaaaacaaugucuuaguucuuuuucguacaguuuggaguccaccugcugugucuaggaugcuucagguccaucugguuugaaagcagaucccagguuuuacugagagagacagugagucacuuucccacacuguggagaagccagcacucgggaggcuugccgagugguggacaggcacagccuggcucuaagaugaggcgcuaaaugagggcacaauacagcuagccaugagcuugcugauguccacaucucuacuugguggugguggcuguacaagaaaguaagauucugguuauuugugucaaggaacaauaaguguccccacuagagaugacaucuuucaaugucaggcauguucuucauaaugcugggaagcaguuuucuuucuuauaguugcagggcaauucuuucaccagacuucucugacacuuuaucuccccgaucuucaagcaucacauuguucuaguucuaucuuguugcugucauaaaacacuaugaucaagaacaacuuagagaggagagaguuuauuuggcucacacuuccaggucacaauucauccuuguggggaaucaaggcaggaacucaugacaggagcuguagaggacuugcuugcugucucacccucuugcuuguucacggcuaugcucagcuaccuuccuucuaugagucaggaccaccugccuagggaaugguaacacccagagugggcugggcucuucuacuucuauuaugaaucaagacacccacauagacauauccucagagcaacccgauaaagaagacucucaacugaagcaccauuuucaguugauacuaggcuguuucaagcugacaguguaguauaugaggagaauuuugacucuugauaccuagcuguuauuucuuguaugaucagugaucagugacaguuuuuuuuucuuggcuaccagaaagucagcacuuaauuuuuacucaauuaaauagacuguuauuuucagacaaauuauaggcuuuggaagaauuagacugaaaauaaacaguucccauacauuuuaccccgcgccagcuuccuccucaucuguagcagcagugaauguugccuuuaugacaggccuucaacgaaaacugugacuucucuaggagaaguccaugguuuauaggaacauuugccguuggcauuguguauucugucagggugugugugugugugugugugucugugugugucugugugugugugugugaauauggaagucagagguccaagguaggggucuuccucaaucacuuguuugucugacaccuuuuugagauaaagucucccacugaaccuggcucucauugaucuaucaauugagccccaggggucuucuugccuuccuguucaccccagagcccuguuacagucacacaccaccauuccagacuuguccuugggcgcugaggucacagucagguccucaugcuugugucaggcaacuuugccuauugagucauccuccuggccucguucuguggguuuugacaaauuuauaauaaugguuugugucccuuucacagucacaaacuuggagacuuaggcuguugcaccguuaggcuguuguacuguuaggcucuccagugggcugucccugugucauuauuauccauggugaggugagauguugaggguugguuuggucugucagguacccuggguaagcuuggcauuuccacccccgagaguugagcacacaguguaacuuacuccuguuuccccaaaccucucacauccuuagcauguccagcugagauacucaggaugcuucaguggauuagaacuuuccuuugcuugcucccaccugcauggcaguuuuaggcaaauacuauuuuuuuuuucuuuuuccuuuuuuaucuuggguguuuuauucuuuucugaagccaucagagagaucugugacaugauaauguaaguuucuucuucaggccuggggacugcagguucucuggguauuagaucguugcagagauccugcugauacguucuuugugacagcauuguuagguuugugaaagcaaagaugagaucuagccggaggcggacagucucucccucuguagauuaaaauggggauuuugcccagcuuuuccugguuugguugugaugaaguucugggaaguccuaugugaugaagugugggcagauugguggucaugguaccugcugaugcugugguacucuuuuugugcccguaucauucuuuuuucuuugguuagugguguaugguguuaacugacaucucaggagucauguuacacgucagauuagggacaacagaucugauaguucucugaccuuggaggugccaugugugaagugagaggacauuugggccacugucuaucccuugcacuuagaucucuggcugugaggacauuguugucccucuccggcuaaaucucaucuuuggucacucugauguucacuugaauccuugguuacccauuuggauugaccuuuguuccuuuugucuccugucuccucucccugguacucugcaggcuuaguacugcuggauaccaaucaccaggagagaaacucuagucucucuggucuguugcugccugaauucuugagagaugagccucuuucuuccugcugugugauuggcuggugagacccuguaugcuacagugcugcccaguucccacaugaguugcugcagaggcccugggaggccucuggucuuagguaguuggaccaugggagguccauuaucauggccucagagagagagagagaucucugcugcuuucacagaaauuccccacugacucaggccuagugcaggcuccuccauacugccuccuggcaccacacucuggccucugcagucgccugaggaccagcuuucugacuugauagcuggaguaucuacuuauauuucuuuuuacuuucugccccgagacugaggaugaauauuuuaucuugugcuuuuauaguguagacuuuuuucuuuaauuaauuaauuauucauucacuuuacaucccagucacagcccucucccuuccuucuuucuucucagucccacccucacacaucccuccccugguuauccccuuaccugcuccuuccagaagggaccccccccccccacuccugccuuggguacuacccccuuccugggauaucaagucauagcaggaauuagcacauuuucucccacugagcccugaccaggcaguccagcuaggggaaggggaugcaguggcaggccacagagucugaucugagacagcccccauccuaauuuuuaguagacccucaugaagaccaagcugcacaucuguuacaaauguguaaggggccuagguccagccccugcaugauuuugguggguaguuuagucucuaugagccucuuacauuuuuuauuggcauauggcagugcuccgaccuuccccgguccccuuccucaugcguugguauugagcauacucuggccacguucucccuuccuggcccagacuugggaugcccauagagcaccucccagccacagguucccauuccuguuaggcagcccccuccucauacuugagaaggaagaccgacuuuuugguagugggauucugcccauucgcaugcagugccuauguccacaugcaaagauuuaauuuugaggcguuuuccagaacaaucucugcccgucugugucaacagagcuaaaauuuuaaaaugagaaaggcauucaugcaccuuuaagccuacagguuuuagucuuuuauugaaaauaauaugucaugaucccuucuguuagaacauuugauaaugugaaagugauuggcaguggugggaaaaucauggacacuuuaugaaaaaagaaagauaauuaaauaaaucauccauaauuugacagagccaggguagcacaucaacuuuauuuuuggugugccuuuuuucuaacuucucucugcuuuuaugggaauuaccuggccagggaaguucauccuagguggugccauuacucacggugcaggccggguucaguguucaguuugacagaaauacauaagaccaaagcagcaaagcacuaaucagugugaggcuguuuuguuuggucccuggcuuucuucuuuuaccagcuucacuauuuguagggugguaguggugugcucauauuuuguaugugugcucuuuacauacuaagauacuuagcaucacauuguggauacuucaguuugcaagguauuguucaggaguuagggcuuuggggucuacagucuauagguacugugcacucagauuagcaguccuuuacacuggggcucaggguguggugggugcucugauugcacauagggaagucgcucuguugaaguugcugaaugagagcguacgugugguccuccaugucuccuguuuugugcccaaugaugugagugacuugcauggacgugccaugucaucaguggcuguagcuguagguccuucuuucucccucucccuugaagccugcuucucuaucuuguuuccugcuuccuuugugcuauauuccccuuccccccuuucuguccuccucuuugaaucccugcccccugcugugccauuguuccuggguccaccauacccucacccuuacacaugauccuguugauuguaaccagaguggacauuuuggauaauggcuucucuccuuguccacaucacaaauaaggaaggguacagccuuggacuguggggaaacaucaaguaagcaggaaucagaagcagcuggugaugcuguuuccauugucagagagcaagggggcagacaggaagagggacuggcuucuaaaaccccaaggcuuguucacagugacccacuuacuucagcaggacuccauuuucuauuaagauacagacuaagcaucaaagaccugggccugaggggacucuucacacucacaccacagaccugagcaugguuauguagguucagucaggggaacuagucaccaggaaagaccuguggcacucucuuagccagaugcgugagugagaaaggacguuagagaaccuuugcaguucccuuuaggguuuuuaagcugugguuggcauagucaacgucacagagugguuaggaagagagaaaguugccuugaguaaagccccaaaugccaccagagcuagacucucauuuaauacagauaguguggacacuggggaacuugggucagccccgugaagacaagguacuaacgugcaggggcccaagguggugagauguuguuagacccguggcuuugggaugccuguuuguucuagucuguguaccucaguuuccucaauguccagcagguaacugagggucaaccucaagcgucccacugacacaggcaccagcucuuagccaaagguuccguuuugugauuuuaucauuacuaaacugugucugaguuacuuuucuuaucgccaugagcacauaccuguuacggaagcaacuuaaggaagcgggugcuucuuuuggcuccuagcuugagaauacagucuaccaugcuguggauggcacggggaugacaccgaggaggccagguaccaagauagugaggcaguguaggaugaaugcuugugcuuagcucacuucuccucuuaguucaggaagaccagccuucccaccuaaagccaucuuauuuagacggucccucacagacaugcccagaagcugagggaauuuaguaaaacucuuacaggugugugcggaggcuugucuccuaggugacuucagaucucuugagucagucuuaacucucagaguguuaugucauuaugaguagguagcacugcuugcugcgagugcuguuuaaaauaaaaucaaaugugugaaaugaaucuaaaagccauuucuuaucacacuugacaccccccuccaacauccccucccccauacacacuuaggugcccguugaugcagaauagcuccuucuuauaagacuuuguguuggacagcagaucucuagagugacaguuccauccacacucugggccagccaaaggaaauuuuuucaguggaauugucucuuugagcuccuugcccacuggggccagcauguucaugacuuaaucugucaggcgucuugggauaauagacuuacgugugagaagauucuuuugugguagagcauggucugugcuuccuuuguuuuuuuuuuuuuuuuaacuuucuauagcgguggcaccuaagccaaaacaguuccuucuguuauuucuuuccccagugauggaugugacagacauaauaaacgggaaagucgaugaugaagauaaacagcauuucauccccuuccaggcguaaguaugagauaauccugcccuuaaccaacuacaacacaaaaaucccacaguuaauaguuuacugguaagguuauucauuaagcccagucaggauucauuuauuuuacaauaaugaggaaucuauguagucgcugcuguggcacauggaaucaggaacugagaggacaaugaaaugauguuuguguauggucccgauguucccuguguucccagaauuaccuuaucaguagaaagauuacaauuccacagugagcauguuucuuuacauaaucgauuuguucucguagcaauucacauuuucaaaauacaauacuuucagauucaucacaagagauugcugcuuuuuaaaauagaaaccaaacaaaguaaugaugacuucuuuuguaaagggagaaauaacaccuuaaagcccguaaucaggcugcugaguuuucugucuugcuuuuucgcucagaugagcagguuuuagcuuuuccuuuuuuucccuuuuuccuuucuuuuucuuuucuuuucuuuucuuuucuuuucuuuucuuuucuuuucuuuucuuuucuuuucuuucuuucuuucuuuuuuuuuuuuuuuaaaaggcuuuauccacuuaugaccugaggucuuuagagagggcgagggaacaugggcaaaacacuuggggccgauuugugagauuagucucugauuugaagcuagaacccaugggugagguuacugacgugaucggggccacuccuguuuccaggaggaggcaggacuggguacuucagguugauugcgggaggcagccuccuccaggggccugacuucccaggagaaugagcaguugggguuagagugaccugcucugggacucugcagcuccucccucuguccucauuucuuuuccaucuuguuuuuaugcaaagacuucuaagcuuaagguggcuuucagguggguaggcguucacugcuuuugaggugcugcuugagagauagggggagcuugugaugaugggugucuggaaggaggccuguuguugggagagagggaggcgugguaugggcuucucuugccucaugcaugcuucgugagggaccaccccacucccugcagacuugagaaccacuuguuuaggaugguggaaguguggcauuuuuguguauuaaugaguacccuuuccugugccauucuaucgaagauuuuacaucuuguuucgaggagugacuuuagacucagcaucguguagacuaaguugggcuccaguaccacguguuucagcacaggcaauuggaggcagaggucucuuguggcuuaaaugcuuccauuuacuuuucugucuggucucugcuaaccacuagccccauguggcucuuuauauuaauuacagcugagucguauuaaaacgcagcucuucaauuacgucugucucuuucgaguguucagggccaugcagggcugguuguugccauaguggguagugucuugguuucuuuuccucuugcugugauaaaauauccuggcacacggaacuuaaugggcaagguuggcguuuuguuguuuguuuguuugcauuuugugacucacgguucaaggcuccaguccaucauuggauuguguguuugugcucagcucacucucuccauuuuauacaguccgggaucucagccagggaauggugccacccauagugggcccguuucucaccucaguuaaagcugucaagauuauccccccucccugugcucguccugaguucuagcucucacagcuugacagugaacauggccuuugcagaagggguguaggugcuccuuucaucucuguagccaguuauccuggguaaucccaggcaagcauagauagcugccuucuauagaacccggaaguguccuuaacacacacaggaaauauucccaucugggaacacggcugaccaagugguaauaaacaaaacacgcuucugucagauuauauuacucagucccuuugaaaaacgacagggcuuccuacuguuccuaaagcuucaauuuuaucaagaccacaggacguaggaaugcccaacaguccgacuaagugaauuuccuuauuguucauuugucuccucuaaagauaaacaaaacaaaacaucaucaacaacagcaucaaagaccaaaccccaagcgaaacauuagcuuuggguauuggaaaagacagugagacgaucuaucagguuuugacuccugguuuucagcuggccuuugagaucacugcuuguucccaccaggcuuucccauggcaguggaaguccacuucaaacagucuuagugcacggucaccuguuguguuaucugugagucucacucucugagaggaugacggcuacacagauuaauaucugcagggaauagaagaggaaaguggcaugauucuaauagcaaaauaagccuggaaaccguucucucggaaaugucaugcuaaugagaacguguuuugcuccauuaaaauggauuuaucaccucacaggguugguuuuagggagggaaacaguguguauucucucucgcucucucguucaucucuuuuuaacuuggugaaauaaauuagaacagcgcuccuuugaguugcuuggcucaagugauggaugacauaguccuugcuccuagaauugauuuuaagcguucuguaccugauguaugcuuucgcacccuuuucccguugugcuugguggcaccacacaguguuucuccugaugcauguugccugugcucgcuucucucacgugcauggccucaugggccuaaggauguugguagucuguauuuugagugauguccaggguucagcauccagacaugggaaccaugaauucuguucucugaaggacugagguacugaagguaggagcuaccuucacauguggccaccggagacccuuugugaacacagugaggaaccaaaggcagggcuucuuaagucauuagguuugagugcuauuucaggggaagaaaaggguucuuguuuuuguuuucuucuucuucaucccucuuuugcccuugacuagcucagcauuagccaaguggcacaaacagccaucaauauuaaauucagggucucucagccacuuuaguuucagagcagccccuucauacuguccauuagcaauggaguggagcccugugcacauggucccugggaguggggcacccuccucagucggaccucucuccugugguucgccauuuuccugaucaaugcuuucccugucucucuugucaccuauccugcccuuugucuuucguugacucaugaugacucucucauacucgguggcgaugcucuuuugugucccccuguuacugucacccacgggucucugugccccuuugucuccuguggucuugguugccccaugcccuccaggcucgcguuggacgacgccauucgacacaagccgcugaacaugucaucccguuucucacccaggguggcaggggagaaugacuuccuucaaacugucauaaacaaagucauugcagccaaagaagucaaccacaagggacaagguguguaucacugucauuuucugucuguggguggguggggaauuugggcugggauguuccuguuggaacuagugggacagggggaugauucuucccacuggaugggcagcucugccagcucucgaacugauagccuuuguaguuuccugggaaccagccucccagguaagugcagaagaggacaggagugggauauggcuggggcucucugaauaacagagggcccaggagccuggagcacaggagucagcucuuuccuuugacuccugcuacuucccagugcuccucguucucuuuccuccgucauaccuaacaaaguaccggaaggcugaggacuuagcuugguugguacagugacagcuuggcaugcagaaagcucugaguaccaccaccaccaaaaauaggcuuugaugcuuguaacccuagcuguugggaggcuagcgagaucagaaguucaaggucaucuuaggcuaccccgcuacaagucuaaacaaaugagcaaggaagucaacaagucaaaccugaaccaaacccagaucccagaguaacagcaacagaagccaugaguguguccccugcccaaaagccacgggcucaccucaucucaugucccuccccuuuagcaugugcucuuguccugacccagaacugccgguguucuguaacugucccucuguccccgaaggagaagggacuccuuguuucugucaaccaaguagccuccucccuccuccuucccaccuuccuguuccccuuccugcucucaucauuuuuaauaucacauggauucguccaagcagcugaccuucugccgccagagcugaugaaucaaucagcuuucgcugaugacaguuggcguugggcuggccaggagaccugccaaaaacccacugcucaucaagccccaccucucacagggaggaaaguaagucaccuucagagaugggggacucuaacccugcuuuucacauuugggaaaauccauguaccggguugguccuugaucugguacaccagacuauguacucagagaagcucuguuuucccaagcaguguuuauugagucugaagaauguucuggaaaagggagcucagaucaucucuguaguuagccuuggcuuuacccaacucucuggccaacuccauuuagaauguuuauggauuauagccuuuauacauggagcaaguuuaaacuguaccaaggccucaccccuuauagauuacagcucuuccaguuugcccuguauuuuuaaaccacagggugucugucuccucagagguaggagcuacuacaaggccuggcuguucccuuauuucuuggcucagcaaucucuaaccccugcagaccucuaguuccuuuuguagucuccucacgaugcuuuguuuauuacagacucacaugggauaaauaguaaaaguguuaggccaacauccaaacagccaggcucaugcacgggucacagccagaaucuaugagcuacacagcaauggcauggacucugacugguaccuggaugggguugauaacaccugguaccuuggacuaccagagaguagagagagguuucagaucccaguugugaaugagagacaagaauguucauggcauuuuccaagggagcuacaaguaucuuucugaaugaacauacugagucuuugcaugcugauaaugcaaggauaaucuuugcauauugagccaacagcaucggggagugaaguucagguagaucuugaccuuuccuccggcacucacacauacaaacuaggucauuccucggagaguggauggaggcuuggccugggcagccacuccuggguguccugggcucuucccgugggcuucuguuucuaucagaaugacccagguaccuccugaugccugcucaucuucccagucuuagccagaggacccaggauggaugacaaggagaugguaaucucugcaagagccaguggauuuuuccacgcucgccuguccauguagcuccucugagcuugcucuaggcccgggcugauuccaucucuguagcauccagcuuucuugucacaaaggcagagaguaucaugaacacccucuuuccuuugguugacugagcccagagucuuaugcauacauacauaguaagcauggugccaccgagcuacaucuauggccccuugauucuuuucucuuuagccugcaugauucugguuccugacucggaguucuggauguguauauggacagcagauccucaugcccacgccugcuuccguuguuugagggaguguugaauaugcauuguguguuccaucguucuguaaaacacaugucaauucuaaacauacuuagucuguguaaucaggacuauuuaauuucuauauuucaauuguagcaaauugauugugucaccaauauucuacuuauccaccaagauauuugagcagacuguugugaggguauuugaaaggcagccucucugauguuauuuaaugugaccagguguaguuugcuggauuggauggcagaaucagggaagaagggaacgagguaaaguacccagccccuugagggucuguuuaaguuucugcaugcccagaguggccuguuauccuuuaaugugagcuacauaaagaagcccauagccuggguguauggagauaaagacaguuccugggagcauaggcuagcgaacacagugcagcuccuuuacaguucuuugugcacaugugcagugcauuucccgagacaugcuacaugugcccuuuucuuggugccauccucugaugucauucauugagauccccuuucuugggcacccuuuucuccuugggacucucuccugaucugggauuuucuaucuuagaaaaaaaggaaaaggaaacuuguagaaaugggcgcaccuuaaacaaguuguguaggcaguucccggugucuauggcugggucugcuucuccacccucuauaguuccugcucccuggcaucugcugaaccucauucuuuucucaccagcaucugcccuugucuuucuaccugagggccgaagggacuucuugcugcucuccuucccacuuggguuucaugcuuugaccaugugggugacacaguuccugucugucaucucuccagcuccuccucaguaugagcugcaaguggagagacccuuccacacaugcuuugggacuuugucucccuaaccauguguuccuacgagugucaccuggagcaggcuuucguuuggaggacagugcagagcaacaucuaaggaugcccacagcaggugcucugagagccaccuuccuacacuuugucuuuccugaauucuguggucaugaccccauguuggucuuuccaagccccucugccaucuuaggcucaagugcuggccuacaaccucuccugacucaguauuuuucuuuaacuucuaccugcagcugcuggguuuugaggucagugaccuggcuugcucuugagcucucgggaccuccucagagcaucauaguccuuaacuggccucuagaggcagaccuccauggugggugugaaccucuaaguuuuuuccugccuuucucagccucugccauaaaugccaccuucugauuuuuccuaaguugagaugacuucaaagaaccguuaguccuuggcacauagagggucccacuucccuucuaugucacagacuuacugguugaucgcacaggcaagguuuguaccuggacggagugagugucacugugcuggaugccucuugccuggacauuugccugaauauuucuguauacgaugcugcucuauagauuaaaagcuuuucagccgcugaaauugucuuuagccacacacuugagguauacaugacucuuuuuuuuuuccccagguuuguggguaaccuugaaauuacuuccuggagacauccaucagauucggaaggaguuuccucacuugguggacaggaccacagcuguggcccgcaagacaggguuuccugagauuauuaugccagguaagguucgccucucucauggccuuugagcuccacacagaggucacuagccaugaagagcgauauguggauaggaauaugcaaaagcucuuguagagagaguguagagcacauggcauguacauugcuagguccgggguuguuaagaauaacuuuagugcucaagggcuaagagcacacaguugugggauacacacuuuggucucugggcuucuuguaggauuaggauucucucuaacuacaaagcucacauguggggaggccaugggcauugcauuucuuauuuccugcaaccaugggacagaugccuuccauucuauucaccuuucaggacuuguguggguuauuggcuacucugucugcugacauggcagguaacugaagugggcuagccuggaugacauuguugaucccuguaaagguguggccugucagucuuguucacggaagugggauggaugguuugugagcuuacgguuuauauuuggaccugagaugcaccugcaugggagaagguuauggugcacuggcuugguauuuuaggauuacccucaccuugacagaugcuuuaggucuucuugccccuuccuguaaaugugagaaaaaugugagacaaaagcaauuuaagggagaaaggauuucuuuuagcucaccauucagaguauaguucauccuggugggcuuaauaagccuuaagcagcguaauagcugggcagcuguuugcccuucauacuguuugggaucuauuuuccuaucgauaaccccaaguuauuauguuccaucugggcugcucuuaacuccaauugggcagcccucaggccaugcucucuuaacccuuaacccacgguggcuucuccuuccuccucuccugcacguucuucuuccuccugguccucuucucucccaaaccugcaaaaccuaaaccccgucuaugucucuucugugcagcuguuggaugucagcuucuuuauucaccaaucagaacuaacuugggcggggagcagggucacagggucuaagugcagacuccaggcccacacuuagcauuacaauagauaguuugacaaaagcucaacaucuucuagcaucuuucucuucuacugcaaauggugucuuugucuuuuucuaugauugugcagaagcauuucucugugggaauggugaacauaggugugaggcugugguccuucauccccuugacgucugauagcccaugcuacuucucucccugcugaggguuuuaggaaacucauauauagcccucacaaauaaaauaaaauauuaugauuuugagggcuagagugauagcucaguggcuaaaaugcuuucgaggaccugaguuuuaaaugcccagaacccaccuaaaaaaugcugggcauggugacaugugcuugcauggagcggauuuggagagaggcagaucccuaaagcuuauagcuagucuauugaauuggugaggucuaggccagugagagacuguccugaaauagaauguggauggcuguauuacaauggagguugucuucuggccuccgcagcugcauauacaguuguaugcacauaugcauacaggcaaagaucaugguuuuuguguuuugauagaauuuucaggcggagaaacauacaauugaggugugccaaagcaauaaagcuguuaaguggugucaagggacuuaucugaggucccacagcugauaagugguagguuuuagguuggaagucuugcuuccugcagccccagccucaugcuugaaucauuuuaaccucucuuguggggaguaucugccauggcggccgugcuuccuucuugaguagcuaccauggcuguuggagcaacccacugggaccauuacaauaaugacuuuuaaaugcaacuuuaauuuaauaguuggauccauuaaaagccaaaauagagcaauuuuuuaaaaagcacaauaaaaaaacaagaaagcaagaaaaggcuuuuuuccccuuaagaaguccucaucguuaagcaccacuggcguccgaugcacucugcuuuucugugcagagcuggauugagcgaggcuggggccaggcagccuuagaacggguuagcagagcagugacaaugcuuccucuccaucaugaagcuaaggaagugcgcagcucgcacguucucaacagaaagaagacuccguucauuuguucuaaucuguccucaucacacuuaaagguccacuuuagacuaaaaugcaugagguuuauguggcguuacacccuugauaucccagcacuuggaaggcugaggcaggaucccuguacaucgggggccaccuuggguuacaagugagauccuaaauaaaagcgaaagaaaacaaaaaccuaccuccgccccuugcaaaacucuguucgguucuuauaguucugcaguucuauuuugugcuucccacuugaucccgacagcuacuugcuagaagagaagaaccacauagaaccuucucugugaccugccccuguccuugguccugguucucaucccuuuaggcuuucaguuuaaggcuugaauucagacaguucaaaggaagcaaaggagaacuagcaaagaggaaugcugguucucuuaugcgugugugcacuggcugcugaggacauagugauauuccaugggcggcuuacaaaugucucuacugaucaugggaugcuacaaagggucuagguccuuauagcuucaucaguggcauuggggccacucugacuaccucacagagguacagagaugaaguugauacaaauagguuuugccgugucuuagaagccgagacuguuuuguaggaaauauuuuagagccaucuaauacaguauuuauaagugcuuccgacaauuuggcuaaauucacaguuacgcuaugaaugauggauugcuauuaaagauauaauuuuccccccaggugauguucgaaaugauaucuaugugacauuaguucaaggggauuuugauaaaggcaguaaaacaacugcgaagaacguggaggugacagugucugucuaugaugaagaugggaagcgauuggagguauuucugcugagucuugucuguagaauucaaguucaacuaugcaaauguccacuugggcucugcugcaggaacugaggugguuuugauuggcuguguuaucucauauguuggcauguguaugggugccugccuucuuuuucccugcuugccauuguguucugggaauccaagccacuagccugucucaggggaucccuguagauuuuugaccacauuucuugcucagauuuauaacgggaucuuguuucuuacugcaguccugcagaaauaggucagagaucauuacuuucaauaucugagagaugaggagauggaaucugagcaguaacacuaucugcucagggucagagaaugagguggacuuuuaggaucaucugucuugucucucauaugcccaaagugacgaauaccucgucuucauagcaaaagcagccagcagaauccaccagacuggcccgggcacugugguucccucugaugagcagagcgggugucccucuagguaccacuggacuagacagcaauugcugggcuaguacuugggcucagcuguguguaacauggcucauaucguuucucccugucuggccuugucuggcgucacuuauuucucuagaagccuugagguauacugccucggccucuugggcaucaguggcaugaaucugguugaaguuuggcaggcaauccucguggcuagaggaauacaucuugcaaccuccuguuugguggacaaccuuugcuuuaggccugcugaguaagucaggcaaguguucucagauugucauuugaacugaguuggggaggggacaggagaaguggcagucaagguuugccccauguuucaugauugucuguaccuccagggucugaggcuauuguguagacugaccacuagcacaggcagaccugugccuucguucuggggcccaaaugcagugguuuauuggcagccugaugacgaccgcuccuccuuuacuggguacaacaggaauauguagggaagacacugugauaucuaauguuaacacuuugaaaaacuaaauuauuaaaaaaaaauuagugugugugugugugugugugugugugcgcaugccuacacauguaggcgucaguucucuguuucuaccaugcagguccugggacugaacucuggucgucagacuuggcaccgagagccuuuagccacugcgcccccuuagcuugccuaacaugaacucuuucuuuaugccuuuuccuaaagcacgugauuuuccccggugcuggcgacgaggcgaucuccgaguacaaaucggugauuuauuaucaagugaagcagccucgcugguuugagacccuuaagguauuggauuucuauggucauuuccucccuggggccugcuugugaaauccucccucacaccacagaaagcaaaguugcucaagguugucaaggacccacccuaggaauuucacuaauacguuuacccuuaucucccucaaacguaaaaagaggacuugaauggaaaugaacugucacaucuucaagauagcuauggucuuucucucccugagucugggguguuuuguggucugcugccgcuguaccacauaggaaggaucgaggugucaguguguggaggguacuguugaguacugggucugcuuuuugugaccuugccacaaugcuuuccuggugcagcucauagcaccaugauaccccacugucauguguaaccaugaccaccaccccagcaccuacccuaagaaccugaauugaauaaaguaaagccuggccccuggaauauagauccugacaugaacaucugggguagccuuugcuuacaggccacaugcaugaggccauguucgcuggccauaauggaacaggaaagcuuucuggcugcggcugccggugggauguagauaccuuuauguaguggcuacaaugaagacaacgaaauagaaucugagcggugugcaucugaguguuaacacaaaaaauagcuggcugucuagcagaguuggcuugguguccuucacaauauuaucuuguuuaaauuuucaaaagacauuuugccuuuggcagaaaucauauacggaugagauagacaguguuuucauuucucuggugcccgaguguuuauccuggugcugauaaccagacugaauuaagcacuuccugcuggaagagcuugggauagguacucacacauccccauuugauucuucaagguggccauccccauugaggacgugaaccggagucaccuucgauucaccuuccgccauagauccucgcaggacugugaguaacgggccacuuuaucaguguuuguuuucaagggaagggccuagcaagcagcaccugcucugaauugcuucagcacauggcugucaucuacagugaugucauggcuccugggccauuucuuucaucugaacuugccccuggaacaucauggaagagaucucagggaaauugaugucaugcuucccucugggauggauggugccccugcuccuugcuucucuuucucaugccgcucuuccucaucuuuaaagauuauuauuuuuacuuaugugucuaugugugugugugaguguugguuuguggacucgagugcagugccaguggagguagccacggacgucagucagauccccaggagcuggaguugcacacuguugugaguugcccuguguaggugcuguggacugaacucaguuccucuacaggagugcuuaacugugagggaucguuccagucccauuucuucuuugacucaccccaugccaguucuauuaggaaagucacugagacacaucaaaccauuuggaaaauugccucucaguguucuuuggaauggagaacucgaacccucuuuguauucgugggugauugcuggagcuuagcuggagcucucacaggcauugaugcaaccuugcccuucauaccaagccuagaggaaggagcgggucuucacauuuucuccuuucugaaagaacugaucucugauuacugaagcccguuccaucacacaggucaaauuaagagucugcuacggguauagcuccaggcuaaacacuaaacuaucacggaacgaugacacaauuacuuccuguccuccauugacugaagugugugacacugaguuggguaggcuuacagcuagaugggaucugugacaaggauguguuacaguguuauacaguguuauagugugccuccgaugaccacaugggggccacacagggagacaauuaguucuagacucugucgcagauuccuacagaaauggcaucuauuagccugucuucagcauccugcugggucccgaaaggacccuguuacuggaugaagugcuccucugucuccauuugauaguuucuggggacucaggcccucccugucgccagguguaugugauggaggaucacccaacaguggcccgcugggcugaacacaccccaggcuuguuguuggaagguuuguggucuucugcggaaggccacugagaauccugagacuucggggggaguuaggagggagagggccuaaguuccgcagagcuggagagccauaugugaacaucagcuuacaagaugugcaagucuaggaaucgguuaaacaaaggcucuagaacagcuaggagcccacgugguggaucuguaugugauggacgaagagcauggcagccaccucucacaaucccauccuagcagugagaaacggucaggaguugaguuagagggccaccgguugucaggugagugaagaccagcuaguggagaggugggguuucccuuacuuagggcuuagucaccuuugggucagcaggaagagagaaagagucuagucaaugcacauagugcccuaaaaccccagggugaugggcacagucaaugacugugcgcuuacauucuuuuuuuuuguuuuuuguuuuuuguuuuuuuguuuuuucgagacagggauucucuguauagcccugccuguccuggagcucacuuuguagaccaggcuggccucgaacucagaaauccuccugccucugccuccugagugcugggauuaaaggcgugcgccaccacacccggcgcgcuuacauucuugaggcugacgugggagcuucacuguguuguauggaucaaauauaacuagaaguccuuacacagucaguuuuccuggccugaauucucacguuauaugugaagaacucuggguagaggcuuuugaguuaguggccccuaaaacggcuucgggucuaaccugugucuuagcgcuauaguacagugccuuuggugaauggcuuccaucuccuggucuuuguuauugccugucuauacaccaaggagauggaggcuccuuugucaugggauuuguaugcaggaccaccugaggaaugauagcccagaauaaaaugugaacugacagaaacgggauguggacagaugggggcuggugaaagggcuucucugggcacaggugugaccugcacaggugccacagcccagguguggccaggauguaggucagcacucugcugagaggacaggaggagcuuagguacucuugaaaagguggaaagaccaucuguagagcaggcuuggcuuccuggacacacaucaucccaagguugguaagaggcuauggggccuccaguuucuguggaggaagcauaguugguaagagaucuagacuccauggaggacugugucagagucacucuggagccacuuucuuaccaaauucauuccccuuaauuaaugaauuacacugggguauagggagaucuccagcauucuaauuuuccaaauccuuguuuuucucgucaguuuuaaguacucauuacagacaagaugcuaucacccgacuugccaagacacauuugcauaauuaaugaagucuccaaggccauagcuuaugugguuuuggagacauguugagcauuguaaaagugacgcucaugagaucuuguuugccagcuaccgagggcagccguaggggcugcuacagcugagucugaguacacaagcccugggucugagaaagaaagaauucaguacacguugucuaccuuuacuguuuacuagccacacucaagcugcuuucuaccuuagagcaaguccuggagaagaagaagugaugggaugcccccugucacaaucuguguuggaguagcuugguguugacaugcaagcacaugcccuacuggcaacuuguuggccauguagacacaucgauucauguguuacacauaugucuuucuggauuagagcaggcuugucugggugcggcaguucuggcuacauaaagugcagacuccugcuguauaguuuauaggacucugaguuugugcuagaauaauccaucuacuuuugcaguggcucuuagcaggcaugugcuggacagugacccuuccuugaguguugaagaugcagugguaauggacgaagccccuuuuugguaccacucagugguaggcucaguagaagcugucggcugauaauugccauugcaugcaugucuagagguugcugcuccuggggacucaagcuuagcaggaguggguccuuaccacuugauacagacgucucucacauguucugcugcuguucauaaagcaguguuuuagaugaauaaggcacaucuguucuguuucuacaucucuauuuuuugguugguugacuguccuuuaauuagcaagcauuuacugagccccuguuguauauaaggcagugcaacuaucaaaauucacaagaugcggcuucuuggcuauugaggucauggugugaaaguuuugaguuccucaucuggaggaggauggaugugugcuccuuccaagucuuaccucuguccuucccuuuuggacagacuuuugaauacucccuuugacacucuuggcagcuuguggaaaucaucucuuuagucuugacucuugcuuguuaccuuacuuuaccugucccuacuacuccauggcucucacucauugcuugccagccacauuggccuuccauccccaucgggguccucguugcuaguggacauugcuguugcacccuuucuucuuggcaugugguccaucuaccuucucagauccacuuucucugaccauccucccacagggccgcugauccuuuauuccugugcaagcguccagguuuugcuuucuuugugauguaaaagagcuuaccuuuuuguugguccucuuccuaacuagugccaguauuuguugguuaggcuuuauuucaugugcuggaaaauagcauacauacagacauauacacauucgcauguauauacucaugcacacacacacacacacacacauacacacauacacacacauauauauauauauguauacauauauauaugcacauguauauacauagauaaauauucauauacaaacauauauacaacuacacauacauacucauacauauauguauacauacauauacacaucuacagauauguacauauacauauuacauccaaaaauauacauccauacauguauauacacauguauacauauacuuguguauauaugcauauacauauauaaauauauacacacauauaugcauguguauauauacagauacagacauauaucuacauauguauauauacauauacauauguacacauauagacacauagaaacacauauauaugcauauauauauugcauacauacacaccuacauauguauacucucacacagacaaacaugcauacucagaaacccuuagauuccagggcucaguagacagacuagcaguaacauaacaaauccccuacccccacauaucugccaguguugaagaccaugaagaaaacccaucagaugcugauaccauauaugaaugggcaguugauuguuuuagaugcuuugaagaagccugaagcaagggagagcacgagcccuccaugcaggccuggcuguugcacuuucuugcccuccaugcaggccuggcuguugcacuuucuugcuaaagacccuagaacaucucaugggggggggucuucuggcccccagagauagguggugugcacuaggacuccgugguuucucuauugcuaagcaguuuuccucccugcacuggcccuuucccauguccuagguuuauucccucguucacaucgcagucucucuguucuuguuuaaaccaagccacguucaguuuggcuccucccacuuacuucggguuguagcggugugagcucccuucacucuucugcaaaaccuuccuggcuuuguccuggaaucagcucuggguugcacagucuccccuucccugagacuuggaacuaguucgaggacagucgauccuucugaugcgaaucuuccuguuggugauugugggguuuguuucuccgucccccauuggcuucuccuguguacguuggcgauugucuaccaggcgucuuuguagcaggugcuaaugucacuuuguccugacuguaguugaggguaaugauugguuuucuuugcagccaaggauaaaucugaaaagaucuucgcacuggccuuugugaagcugaugagauacgaugggaccacccugagagacggggagcaugaccuuauugucuacaagguacgcaccucugucccaggguacccugggcgcccugacuggaucaggcccuagugaagcccucaccugagcugaacuguuagcuuuucaugguugugacaaauaccugagcaaaacaauaaagggagucagggugugucagcgcuuucgguccugguccuuccugguggggaggguguggugagcagcuuauauccagguggccaggaaacagagaauacugugggaggagacuuuguuuuagcccaucaggguccccagucuucauguguaccuaguuucaggagguaacuuuccccucauaguuaauucucugugguggacacgcuucgagguaugcuuuaccaagcucucagaacuucccacuucagucaagccugcgaucaagaugaacaucucaguugacauuucucaccggaggacagagcugcuguguagcauggagcugcauuuaauuauguaaaugagcaguuaugauuggccagcccuuuugcuguuccuaacgagagacgaugacaggcaauaacacguuccgugcuguaugcgaaggcugaggaugggcguuaguccacaggacgagggaagaugguugaagugcacuguagaacacaguguggaagggggcguggggguugaaggaaaucauaauaauaaggcaugcagaaccuggaguguggccuccaugaauguuguuugauacaaggugcaaucaaacccacaggcugaagccaaaaagcucgaagaugcagccacauacuugagccucccuaguaccaagggggaguuggaagaaaagggccacucagccacaggcaaaggaaugcagagucuugggaguuguaccaucagcaaagacucuuuccagaucuccacucugguguguuccacgaaacugacccagaacggugaguucuagaauuccucccucuccaacacaucccuuuuggcugcguguugaguggaggaguuuccugugggugcguggacgucacccacuguguccuuugauaaggaccuccauagaugucgaugagcuugggaagaggaaguggcauccgucagaguuuaaaacucacacuucuauuuugggcugaggacuaacuuagcagggagauuaaacaaugggaggacuuaauuuuauuuuuaaauguguuuauuugugguguaugugggggcagucagaggacacacuggcuucuuuccuuucucugugugaacaguggggcuugaacucuguucaucaagcuuguuagcgagcaccguaaccacucuuccgucuugucagccuuccucuuggagaaguuuuccaggcaaaagaaggaaacaaggcaucauggggaauacacaagguuugaaaacagaucagagaaauggaguugaaccuucauucuaacuuaacccuggaaaugaccuugaguaacgaagcuuuuaacccagcucuucccgcugguacacaugugaauaaugccugcuuccggagcguucuggcuaguguauacacacugucagaugugagguacucccuucucugugucuuccucugucuugauucuccuugagauaauucccaguuaucucucuuuggagaaguugauuggccugauauguuugggcucccugcuuacagugugagauaagaccuccuugcugguucuaguccaccaagcucagccuaauguggcaggucacucaucagcugaugccucggcccugggcugacugaguucauuucccacugcuugcagccuccucggagucauggcagcccgguggcgauacuucuuauucagggcacaccaguaccguugccgugacucugucuggaggaggcagaggcucucugcacaaauccuucauuuaaaagccgcguccuccuaauguggccguaucauagcugugcagagacuuuaugcucucuugaaauggagcuugaaaauccaauuuuuuucccucuuaacugccugauaggaguugugauuauuaauguccgucauuaucaggaaucacaucucgguguugccugucagucauggcuggaguuugagauuugccgaggagcaggcaucguuugggcuugcacuggauuacccuagcauggaagaagcccguccuuuggaagaugggacucuggaagggagaaauguugcuguccugagggcugaggcgugccagucaggugucuuucaaacuuucgccaccugcugcuuccaucucucuuuacauuuuacaucucucuucauucucagcuuugcccagugaggcuuucccacccuuggccucccuaguaaaauauuagugagaggcugugagucauccagacacaucugaguuguuugagccuaugugaacaccgauacuuggagaccauuuggacacuuccugguugccaagucaccguggguuugaaucauuucugaaggguucuuacuugcugccugugguaaucgcuaccagcaaaugaccccccccccccaucccccacuucccagaaggacuggauuuguguaagugggggggggggggagggaggauugugcaggaguuugauucucagggacaugagucagcuaugugggcuccagcuagugacugggcugugcaaagaaugucccaguacuaggaaugagauucucagcguguaccuacauugggguacaugaacuaauguuugugccucauucaaugcaggcuaagggugguguccccagcugggucauugaccccaagugugucugcuuuagugucucagcaggugcugagcucugcucagcuucucacuuuggaggaagccacugucuuauaugugggucaguguuccagaugcaucgcuaguugucugaaauuugaucauaauuuccuaucaaaacaagucucauccacaguaucucuuuaaaacaugcgggggggggggaaccucccagggugguguguggaauacuuucuuaccuuacagcuccuugaaucucaccauuugcagggugauucccucccugguacccagugagagagcccuggucucugcagcagcuguugccaagcaacaaggaaauuccaaagugaugcugcucacugaacagaaggaagaaucuggcuuucauuucaugcaagcauugauaccccuuuuugggauugugccaugccaggaguguauaagaugggggugcccuaguuggcgccugaguguggagucccaaauucuccucugagggaaucauuuuuccugaaaccauaauuuguucucgcaaaguuccauuacuuagggaaagaaaagcaggggcugaauuauucaucaagguuuguauuaaagaucucuguccucagcgcugugugggcugccauaggggauaggacaagaacuguaagaugcgaucccuccucucaauuagcuuacuguauaaugagagggaaaggagucaugaaacaaaggauaauuaugaacccagcuguguugaguccccgggacuggaggccuuuccugccuggguagcucugugggggagggacaaacuuuuuccuucagcacugcccaguggggugauuugugaauuuucucauuugaacuuuuuccucaaauuugcaauacagagcccagaugggcaguacaaauguuauaauccaaguuuuuuguugggugggaugggguuugguugcugaggcaggagaauuuacaaguucaaauacagucuggguucugcagugagcuccgggcuagucugauccaucuaaugaucgcugacugccccucuacccaaaaaggggggaaaaaaaccuccaaaaaagcaaaacaaaacaaaaaucccucaaacaaccacaaccaaaaaaaaaggaaaagaaaaaccccaaaugaacaauaacgaaauaacacccucccaaggauaaguaaauaacuagaaauggaaaguuaaacuauagagaccagacucaacccagucacauggugcgugauaccagcucggaaugauuggggcuuaggugaugcauuggucuccauuaaagcgacauugaucacuccugagacggagacagagacggagacacccucaacccuuggaucagaagggucaggccaagauggacccuuucuuguuacuuuacuuucaguuagaaucacaacacgucaacuuccgccccaaauuucuagcuccuuuccuaucugaaggacgacugcugguuuuauguuggcuguugugauaagcuugccuacauguuuuauuguuggauucuuuuagcugcccugcaaauuaugcagcgccgcacccgcuguucagccaaggagacaagggaaacucccugcccaguguucuguaguuacugugugacucagcuggcuuuacauaauccacacuguaugugggugcugagugccgccccccuccgguuuacucuucuagucaucagugaugcccgaggugauaagaaacacaugagaaucuguaugggguguagguggcuuuuguguggucugauucugaaauuagaaugcaugucugcuuaucgaauucuuaccuagauccaaaauuauaugcuggcuuuccaguguuaacgggaaccuuggcuuuauuuauuugucaauuuguuuacuuuggugcuuguaguuucuucuguagccgaugcucccgcuaacccauauaagcuguaggugagauacaguuugccaguugcaguuuugcaagaaauggcauagaagcauagaaauauaauuguaagggagaaaguaugggcacaugggcuuuccuagacagggaugggauucugucuuccuaccguaaagaacaucuuaaugucuuaagcggaauccuucaagcuuuaaaaggaaaaaagaaaaaccauccaaaaccccucgaggccugggaagaugucucugucuguagccugugcucugcaagcgugaggguaugagugugggucuuuagcagccacauaaaagcaagcagcaguguccgguuucuguaacccuagcacuugggaguggguggguacaaacaggugcauuccuggagcccagugcccagcccauugaauugagucaaacuccagauucagugggggacguugccuuacaaugauaguagaggaauaaauacucaaggcuggacaucuacccaugcacuugugcaugcaccugcauacacacacacacacacacacacacacacacacacacacauacacacacacacacacacacacacacacacacacacacacacacauauacacacacacacacacacacacacacacacacacacacacacuacagauaugucccuuuucuuuggaucuuuggaagcuagaauauucaauccuggacagcucagagggcagcagccagcugcuuuaaaaggguucucaauuuuucacagucuucguuguuccauagauuauccaguuuguaguuucaggacuucaauuuguuuuauauuauuuaaaaaaauagacauuuguucuugagcaugacgagccauuugggggauaagggcuuggcagcucuuucuguguggguagcauuaguaaguguuccagggguuagcagcugucuccaauaggugggggucauccucugccccauuugguuccuaaaugcauguugaaagcuccuucauggaaaucauuucaugguaaauguggcuagaaauagugaauucaacuauaucacuauuauguauguuagcgcucaguaaugaaguauuuagcaagugaaccuuuugaaaucgggcugaguuuucuucugagauguauuugcagagaaccucacauacucugugaauuccagacaaaguccguguuguuaugagagcugaaucugcuguucuguuugcaguggaccuccuggggcuguugaaguggagauccaacaccaaccuucugcagcagaacuugaggcaguugaugaagguggacgguggugaaguggugaagguaacgagggcugcggcugcggagggaggcuuggucuuguguuuucugccuguuauuauguacugacuggggaagugccagguucugguuauaauugcuuaacaaugacuuaggugugugcgcagugcugcugaacucucuuuggaagggcuaagcagcuuaacuuggaagugugaacuuggaacccaucugcucugggugcuguuuucucuuuugaugaguccugaaugcgguguugacaaugcucaauggccuccuucagcuagcucagucacugccuuuuucucuagguucuuaguguuuccugagacacgguggucuguuucuaauccauggggauguccuguuuguacuggguuguuucguucuuacuauggucauugucaccauccuugcaucugacucaugauucuucaugugacucagaagugaccaggauagccagcucuggguccgguagacuauuccaagcaccaaggguuggaccuggucauuucccaccugugugagugagcucauguccuagccucacauuuggacucuggacaaacauuagguacuaauuaguguuguuugcuuuugcauguauuuguuuuuaauguuuucauuauuugagaauuucaugcauuuugacuguguucaccccuuccccuccgccccucaacuccucucagguuuaccccacaccucacacucuccucuccaacuaaauguccuuuuugaaaaaaauguaagaacccguagauuccaacuugugaagcccacagauuaccacucaccaaagcaucaggagcuacaaccuucaggaaagcggaggcucccagaggagcucuuaacagucccuagugccucaccgagugggaggggcucaucuggucugaucuuguacaggcuuugugcagauaacugcaggugcuguuuauuccugagaacagcuagcugucccauccugaagauacuuucacucugaaucuuuuugagcucuggcucuuagcaucuuuucagccccuuuucccaguggucccugagccuuggugagggaguaugauagaguuguaugguucguggcugagcacccugcagacacucucugugcuguguagguaugguuccuuguucagacccucgccacucaguguccugaccugggagccuucagucagagcagugaucugaacuccuguaagcaucagguucuaucccuauguucucuaaucgucugugcuucuaacguacugccuccuccacccccuccccugcuccuucucccauguuccauuaaaggggcuugaaugacauucccuugcacaaauggaaaugucaucaugguuggggugauccaucugggcuaggggacgcaggcuagcugguuaguggccuaugaugguucauagaucauuucucuacugcuuaguuggugcauugccucuucaguuccucacccucugugagaggagcaugcaguaagggacugccuuaucucuggaaaauuaauuacuuaaaauggccuuaauuaaccagcaaugugcuuaacuucggcgugaauuaauuugguugcacuacuuuccugcauccguuguguaacugcucaaacaugcucuugcuaaucuuaaaauuuuaaucaucucuucaguccugcucuuguaccaauggcuuggacaacauuaauugcuuuuuagacuuccuuggauucuaaauccccaguuuagauggaaacuggcuggauaaaugaaaguacuuuaaagaggugcguuuaaugaaauauugucuuucauuuugaagucucagugucaugcauucaugguacuucuauugacuugaugucacaccaggggaaaaaaaaucuagaaucaucuugucaucuuguccauuccccauagcuaaaguauuauuauaucucaauguucgcccauggaagugcuuuuccuagcuuuccuucuggugauuauugguucuccuggcugagcuggguccaccuaaccaccuuaccugguuccuucuccucugcuacuguauuccagccaugcuuguuccuggagagaugaacugaguucucuaagccauacaguaggacucaagccaugugguuuuauagggcucuucuuuauuuagagacauugagagguggugggguaucuuccauuuauuccaugacuuccuuguguguuuucguagcugguagaggauggacagcagugccugauggauugagaaaggaauuuguacauguagugggagaaaucgauucacaugaagauggagaauggcaauggcugccugauucuucacuugguagcucagagauuaaggggaggggugucugagaagcagaccuuuggcuauauguagggaccccuucugcaugcuugucucugaccaacagcuacuguguccagagagggaggcucuucucuguccaguuccgacucugggcugccgaccgaccuugucaucuuuuuugaugccauugguaggccuauggcagggaguuugcaggaacugugaugagcuggcuacucagagaggcugcuggcagggauacuaggcuguuagcagauggcaugaaguuuugaccuuugcagugauuuacaaucugaaaacuauggggaauguaacaagguuguacaaacccaaaccaucagaguugauaaagaucuugucauguccaggcucgaguucuugauggaaacaguaguuuaucucuugcuaguugucccauuuucucgguguaguggaggcuggguagcauaguacagauuucugucucuccgagccucagcucuccugcuaguuuuucugguuuuaaagcauaaagcacagguggguaguuggagcuggcacuaguuugggaagagguucuugggacuuguguccucacucuucaaaaggaauauacgaugcuuuguguugucuacgagggccuuugggugcucugugaaggcugaacuucucaaaaucugggcccaauaucugaugcagccaucccugugcuauucugccugugacuacuucacccacuuacucuuuuuuuuuuuuaguuaaguauuuauuucauuuacauuuccaaugcuaucucaaaaguccccuacaugcucccccacccacucccccacccacccacuccacgaccaaugggccucucuuuccacugauggccgacuaggccaucuucugauacauauacagcuagagacacgagcuccggggguacugguuagcccacuuacucuuuaaaaaaaguuuucccuccugguuuugagauguaacuuauauaucauaaaauuucuccuuuuacucuguucaguucaauagcuuuaauauauuuauagaauuguggcacaguccucaguaugaucuaagaacaguuucucuacccacaauagaaguucaagccugucagcagucacuucccugagccucuggcacuacggucuaguuucuuucccuguauuugcuucuuguggacauuugcuauaaaggaauugugcaguguagcuucugaguccuuaauggacagagugucugugcugucaauuccccaggacuguccugucuccacguggcugagugauggucccgugggaggauagauggggauggacagagagcauucacuaugcucacccauagucaguggauggacaucauuuguuucauuucccccccuuuuuuuuuggcaaugauaaacacuguugcuuucugucuuuugggcaggcuuugcaugaucauuaugccuuucuuugggauguuuaggaaugcuaccauugaguuagaggguuaauauagauuuaaguuuuugaggaauugucaaguuguucuccagagccucuguacuauuuugcauuucucccagcagugagugcacaaaggcccccauuuuucugccccccucucccacgcuggacugucgucuaccuuuacaguggguggggugugggcaucugugugguuucagcugugugucccuccugagacuaaugcugaggcguuuuuacuucguucuuucaugggcaguguucuaucauaugcugucccucucauucuuggccaucccucccaccgaggaucucacuaguucaguacaaucuaauccaguucaucucacgccuccuuuagauuguggaacuugggugauggaucuuugacgucuaauuuguuucauaguuaagugagugaugcuuugcuucccuguauggugauuucugucgcguuucaguagacaggaguagcacugcaccaguuacuggaguugcauacgccuuuccagcacccggcucuguuccucagcugcacgcagaugcugucucgcauucucuucuuucuggcucagcugguagaagguauuuucuuuucucagcggacauggugcuccgugacuuauguacauuacucguggccucugacgcuugguucguaagaaugagucugacguguccuuaugaaaauguggaagagacuugagaagggucucugaguggagugggugacauagggccucucccagcuccagucuucuucugguuggcccagggugaccuccuuuuguguggaaaucagucauguggaauuuugcuucagucaccuguuaccugaauaaaaucugguaaauuacuaguuuaauuacuuaauucauacauuuauugaggcaggguuucacucuguaguucagcugggcccaggacucccuuuauagugcagacaguuguccugcccaggccuccucaguguugggauuagaggugcauaccacaauuccuugacuggggaaagguggguaacgucaguguugccagagaccaugucucugggggagguaggaugcagguacaguucagugaccucuugugucuuugcaguuccuucaggacaccuuggaugcccucuucaacaucaugauggagaacucagagagugagacguuugauaccuugguguuugaugcucugguaaggggccucccuuucauccucucagagggugagguguucuuucaugcugcagccuuugaagggggaagggacccaucccagucaccuugaaagagagucaaucaaaaaggaagcccggaggagugcaaauauacuuugaaugugaaacuauaguuauguuaauacccucucuaggguagacagauauaaaucugggaauggccucugccuggaccauuuccagcucguuuccugauaucacaguggauaauuccaaaaugguuuuccuugucccacucacgagaauguuuugguuauguugauaggucuuuauuauuggacuaaucgcggauaggaaauuucagcauuuuaauccuguuuuggagacuuacauuaagaaacacuucagugcaacauuagccuacacgugaguucucuuacguuauuucaaaccacugcuuuauucuccgauguuugcaaucauuuuccacugugacuuuggccuaugaccauacguuucuccacucaaaacucugaguuuacuggcauacuuuguauuguuauuguuuccuucuuaacagaccugaaaaucuuguugaaagagaugcaugauaaauuagccuuacauuuuggaauaaauccacguucuccuucacaccuuccauuuaucuuugaaaauuucugcuuauguucgaugaagcugauguauggaugcugcucccugucacaucgcagccccccaauaaacaacugaugaaugaauaaauggauguguuucuguuuugaggcuguuggguuuuucuuagugaacauaaaaugcaguuuuguauucucuagcuagccuccuugcuccuuaagguaugucuucucuuuucugaaacaaauuguagcuauuaagcuacuuagauuuuuuuuuucuucuguccauguaggacccuuguuucuagcccucucugaggauacagggaacuuauggggcuugggccgucaagacagguuaucuccuguuugguaacacaauucugaaugcaggguucgcggacuuaagugacagcucuguccuuuaugaauugugugaucuuaggcaauuugcuuaagaucucuggccuucagccuuuuugccuauuuaaaaaaaaaaagaagacaauuguagacuuguuugagaauucuaaugaauuauuagagcucaaaaauaaagccugauguguagagagcaagcacuaagcaguuguugggguucauuugcucuguucaacuuacucucuuauguugggauuuaaugacauguauucaaauuuuguauuguguaauugcauugaaaacuuaaaaaaaaaaaaagucaugcuauuucuucaagaacaccauacuuagaaguuagucuguaaaaugaguccagggccccaucugugguucuuaggagacuuugugaaagccuguuuucucugacuguguagcugugaacucaagguccagggaugccagcuuaugaagccaguggguggcacaacccuguguugggcugcauaucccuucuugcccuguacugcaugcuuaugagaggugguggguagagucacuagcagggguaggaguuguagaagcuacuuaagcuugcagaacaagcuguguagagccuuuuauuagucuucuguuacuguuuacucugagcccucuguuggcucgggggagaugcccuguagguuugaauauuggacauuuucuuauagacucugggaaaggaacaaauuggggugccuucuugccuuauugacuaagcaauggcuauucagggauuguagauguggccagaugccuaagcacguagcagagucuccauauguagcugauuucaaauuuuuccuguaagcagggcuaaucaucuguuuugagaguagcuuucauacuuuaacucaggaaacgaaagcacuacugaguucuaccuguaguaucaaaugucuggugugugccuugcucacugguggaaaaauaagauagaagaguuggaaucccuggaguauagcucaguagagugaguacuuacguagugggccugaagcucuuaguuuuaguucuagcaucuuagggccugggugugauggguuacucucugugggaggagucaggaggaucagaaauucaaacuuacaggcuacguuaguaugaggauagccugaauuauaggagaccccacuuaaaaagaagugguguguggugugugucuguauuuagguuuggagaaauuaaucaacgggagaguuuaaagccucauuuugucuuuaagcucagaugaagcagaggcaagaaucaguaccccccgcuucugucagugcugugugcugaaaagacuuguguuucggaaauagaugucuguaccacguucugauaaaccgucaaucuguuguuuucuacaucaaccacaagaguuaauaaaauaagagucuacauguugguagauuaugaaaaauaggaacucacauauuugacauuacacuuaagaaaguaaaaauucuuuuccuaugaguuaaaaaaaacauuuaaauuauuuguucacaugucuggauggguguggguauaugcaaaugagugcacaagcuuguggaguccagaagaggacaccaguucuccuggagcuggagugacaggcaguugugagcugcccuaaaugggugcugggaaucaaacuugguuccucuggaagaacaggaugugauccuaaccgcugagccaucucucuggccucuaaaacagugcaauuuugauucuguggaaacuuugguuccuaagugaugaaucugaguauucaaacuuugaaacaccaaaggaguaagcuuugugauuuguagcacccagugaaugccgucccugcauauguaucucuuuccauucugggugcucauaauguucugugggucaguugaaacuccagcacugucuaugaagaaccuccauccauccugcucccugaagaccucagcaggucucauuaugcauccucauccuggaacucauuguauagaucaagauggccucgaagucacagagguucaccugcuucugccccccuagugcugggguugaaggugaauucugucuuuugccuuucaaaggcugugugaauagagagaaagcucccagcagugggccuuccuuucagcaucuuagcuucagcacagcucccugcaauggcaguuuauggaggcugggacaucauggcugugaccagaauugaucccauugaaaagagaaggaggugcuccuaugaggacugcuuuucauguaaccuucaugccauggcucuuuucugucucaugcauuagaucucauguagcuguggucugcgucccaucaguauaacugaggcuccauuugcucugccccauuuugacuuccaccagagguuuugaucuuuaugcagucaugcaauggccaugcagauuuauuuucuggguuugggccauucucuuuguagaucauaauuauuauuucaauccuuucuuugacaaaugaguuggaaggauucuuacucacaagugugugcuauggauuuuuuucuuuuguuguuauuuuugaguggugaugcgaauaggagugaaaagauaagcuauugugaaucuuggaaaaacaacaggagcuguguaagacagcuuuguaacaaguauucgagguuucaaggaguggccuuugcuuugccgcacuucccaaugaaugaaucacagugccagacuccauagcagauggauccugcaggccaacuuucagaacacacaguuugcaugcucauacaggcuggcccccacaauggcucugacuuccuuucuggagugcuuuaaccuguucagagucagggagaccuuauucauuuggucacuuacaaucuuauuuuuuuaucuaauuaaccuuauauuuaggggucuggaggaugucucagggacgaaagacaccaccggcugugcuuucagaggaucacuuucaauauguagcacccacacggcagcgcuuggcagucugcaacuccuccgacugaugucagagguccucucuuucaccaucuuguuuuuugaggcaggaccucucacugaacccggaggucagugaccugcuuaguucauauuuauaaccuuggaucauaaaacaaaucacuaaaucuuccuccucugucacugccucgccagugcugguauugugagcacaugcuacguccgugccuggcuuucguaguggguccuggggguugaccuuaguccucauucgugugugauaagcauuuacccugacccacugaccccucacccuaaaccauacaccaugguaucuuggcuuguuuaaaauuccgaagugggccuggagaaaugucgcucucagagaagcagccauguucccaguucuguaucagcucuauucugucuucucucaaacaccauguacucuugugcaccuggccuuuuuccuucagcaugauauuuuugagauuuguccauauugcucuaugugucauuguuugaauugggucuuuuuuuuuuuuuuuuuuuuuuuuuaaucucucagucauaauugacucccaugauuuguucagucauuauugauagaugggcuggggcggagcgggggguggcugcuaaauuccugguauucugcauaaggcugagaauuccuguguuuuauagacaugauucauuucucucggguaaaugcucaggacuaaaucugccgagcagagagacacacauguaguuuaugaaauuauugucuugcuuuguauuuccaccagcaacucaccaacaucuuuuuguguagauagggaagguguggccaugaauguagcuccauaggcacagaagccccgggguugaucccuagcacaaaaaacaaggccugauagcaaacaucugcaaucccaacaccuuugacguggaggccagaggauccagguccaaggucaucuucagcuucauagugaaugucagccugggugacaugagaccuugucucacaacugaacugaacugaauguaaccgaaccagcaacccuaccaauccauguuaguggugguagaaacuacugucuagccucucccuuugcacacuugauagcugagcaguguucugcucgccuucaugauuaaauuacuuaugcaacucaggaugggcaucguguugcuuauaccuuuuauugcuggagaugaagcugagggagauguuacugaaugcaugggucauugcugcuguaugagaggccacaaaguggaguuccugaugucaaaggacuggaauaguuuugcuuuuaacugguaucaaugagaaaauacccugacugagguuguugguuuccuuccaaagaguaucuuucucauuuauccucuccucuugucuuuacuaggcaaacauuucacuuguuauuugcuuauauaauuguauuauuuacuuuuuuucugggugcugaggauuggaugcagggccugccuccugcugcaggcaucuuccuacugagcggcuuucucaucccugucuuauucuaauuuacauguauuuguuuauuaaugaacuugauuacuuuuuaaaaauuacauuuaucaaauuuuguuuguuuuaccucaaccuucucacauacccugaaggucugaaugaaucuguuaccauuugaacucucugguuauauguaauagaacaaaauaggaaaauuugacgcuuuucccugugccaaggauuuuguaaaaaggugucuaugacugggugugguggcacaagucuuuaaucuuaguacucuugaaccagaagccagucuuuucuaucagugguucucaacuauccuaauacggugacccuuuaauacaguucuucaugcuggggugauccucaaccauaaaauuaucuuguugcuccuucaugacugccauuuugguuacuguuaugaauuguaacguaaauauuugauaugcaggacaucugauaagugaccccuuaaugggucuaaacccacagguugagaaccacugaauaauaacuagacccaggacagcuagaacuauaucaugagacucuguguuaaaaaacaaaaacaagcaaucccuauccccgcaaggcccccaaacaucagaagcugugaauuccagagucacaguggacaacugauuuguauuuauuuccauagucaugucugccgugggauaguucaugugaaaaaugaugaauguguaugugcuguggcuugucgaaacuuuuuucauguuagugauuuguuuuacgaucccaguuuauaaauaugaacaugagaaauacaguuauuauuuauguuuuaaaaauuaaauguuugggggugaaugcuauuacuaaguaauguaauaucuauccuaaauauguuauuauuuuuauuguuuuauccucuuacuagagauccuuaggaaaugcauugaaaauugagcacuguuuauuugcauugccaucgaacaauuucccauucaguuuaaggccuuuaguugcagcaaauuagcucaccugagcagguggcugaugguucugagugugggacucuuucaucucaccccuguaaaauuccugcacugccaggaagguauuuuaucaggugcuuugccugauuagaaaaccuuuaugaauaugcauauuuuuuguauguggaagccagaauaaaaguaacgauguaaacuucgcucucagucaauuuccaguugugauuucugaauccuugauugacauauauuccccuguggaccaggaagcugaccaagguguuacggaccuacguggccagcgcagagaagccgggagucaacgagcagcuguacaaagccauaaaagccuuggaguacaucuucaaguucauagugcgcucacggguacuguucaaccaguaaguguucagugaagacccuaagaaauccucaucugcucccccaacccccgccccugccuccuucuuucuucucucucucuccuuggucuuccucucuguccuugacuccucuuccuucuucuccuugccccugucaugaccaaacacuccuagauaaagggcagauguuccuuugcccaugcugacccugacagcuuccguagcugucccugcagagguugcgguaucccagaggcucagaaagugugccugugagccaaacauugucugcugaaagcguuugucaugcuucucacgcagcgcugggcauccaccaagggcuugccaguacuuuucaguauaucuucauagagcaaaaagccccacaagagcaaacagagacgaaacgagcaaugaggagaaaaugccaaaaucaaguuguacugccucgugggggagcacugcagagccccggccacuuuucuccuuucaguagaauacuguguuucuccaggcacaagagcacccuugggcgcucugccuagggagugguucauggcaguugaccaccuuucgaguuuauuuugcuuuugaaagcaaauugggguaucuaugaauagauuaucucagagaauguuggucuuuuauaaauugauacuuacaaccuccauggcugugcugauaaaaugaagucacuuuuucaucuccccagcaucugacacuaccaguggaggucgacaguggagguguaggguauggagugaacucugcuuauuuuuggacagugccauuuuuuuuuuuuuuuuuggugggggugaccuacagugaaugugugcacuugauagguguucuagguugauugguguucuucugguagguuucuacacacagagacgggcuuugugaguccaccaaucacugcagagagcagggcacacagcauguuaucagugaaaacuuggccuaaacuuccuuggaccccuaucggcaccuauuuuuucuaagcuucagugucaccugccugaaguggacagguucaugaaugccaagaggaaaaggggaagaaaacauagggaaugucgcagcagcgugcuacugauuauggagaccagucguggucagaaaugguguuaucuaccaggggcagggcaacccuuccugugcaugggcugaguguguuuuguuuacccuaggguucucgugguuaagccaguagucauagaaagacucaagguuggaggcgugaggcuucgcgcuugacuggcaucucaaaggcaugcucuuaccacuugugggguauuggcauggugcuuugaugcguauggauucugucuuuuuagggugcuuaagcugacagugauuuucuguucugugagaaugagaacaagguaaacuugccuaugcucugcuguguauugucuggcuuuauuuuagucaugccaguuaugugacagagaacucugugaccccgagaaccuucauuuuaauuauuuuccccccauuacugcccucuucucucugcauaugucaugccccacguguagggcucaguggacagcuuguaagaguugguucuuuccuuucaccauugaguuuucagggaucaaauucuggucaucagcauuggcagaaagcgcucuucccaaccagucaucuugccccuauuuuucucauuucuuuaaauucucucauuacaguaacauaggaaggugagcuagaaagaaaaccuauaauaguccggugauguggcuuuuaucauggcuuaccuaaaaaauuuuaaucuugucccaugugugauccgugugcugcugagucagggauuugacgagugucuccagaggccauagugaggauucucucaucccucagagauucacaagaguggccuguguauuuggguugucauagcaaauguugacucuuuuacauaacagcguugcauuagaaaugacuaugguccuucaguccacugaggucaauuaccuguaggaaauucagaguuacaggcaugagaucuuagaacccugguagcucagauuugcucaguuugaucagucuuaagguguuuagggaauauguuugguuucuugucaacauuaaaaguccacuuagguggcuuuaccaagugaggcucccuuuacccacccaccauguauaaaaccucuagccuggagaagauuuuggcuccccuucccuuguuccauguuguccucguguucucaacauccaggaucuuucuauccuguuaucuuuaaagacucuuucuuuuucucauguccucaaagauggcucugccauuccuagcaggaugccgauaaugcugaacagugacgucagguuauaguguaggcagcuguaccaggugcucuuagacagagccuucagcuuucucaucucauugacagaacguugucacaugccagcccuagcuuuaagggagauagaugagaacagagcugaugcagaguuuauugauacuuucaacaagaucuaaguugcuauaguaaguauauauuagacagagagucuccacucucacccucauacuuucaacccaaaguaccuggugcuucuaaugcuuggucuuucccuaccucaucucagguuuuaaaucaucuucacguaggcucuguggagccuuucucuuucaucagagacucuuguccucagcaucuuuuucguauuuucagucauugggauacugcaugagcgauagauagacuucuaggaaacagaguugccuguaagaaugugacauuagaauacuucugcucaggucucuucucacagguacuaacucauaucccacugggucacugccauaaaauccacaugacaucucacaugggaagugagucuacaccaaagggguaccuccacauccuguuccuucccacucugggaaucagagagccugccuucugguucuuaugaucuccuuccaucuucaaaagguaucggaagagacucugcccucugccuuauggacucugacuccuccaugucgccaccaugguauauaucccugcugccggggccugaacuuuccuugaagcccucacuuguugcugcucucuguuugcccauaguacuauagcauagucccaguaguuugucucaguguccuguugaaucaugugcuccaacuaaaaccuaacuugggcaggacacaggauguaccccaguuaggggcucagcaaugcccucuuuccuaggcugggucuucagccuucaucucucccagguaggucucagcaagaacuugccuuacucaaacuaacauucuuugcuagaauagcaugcaguuucuaagcgccaagauugugcagaaaacaaaucaagcaccagcuaucucuaagagacaguagaguccugcacucccaaggaccuugucuggagucauggccuuucuuacugacucaugggugucauaaugacuugguguuuugcucuccacugucuuuuuccuuuucuccuucccucucucuuuuuguucuagucuccuuccauaaauauguaauaacuuaaguccugucuacaucacaguuuucauguccuugucaaacccuucugcauuuguggguuuuagcugccuaccaggaucuuugagggaugaaagaacauaugugccuuucagaguguaaagugcacuuguagccauauuguguagauaugaggaaauaccucuucuuuauaucagaggcugaaaacugugagguguuuuaguaucuuguggauuccaggggcugaaaacacucaugcccuuccagcccgagcugcuucugccaaaaguuucauuuccccgccuauaauauccuaugacauugucauuccauggcauuuaucuuugauuucaagggcuugauuggagucuuagcccauuccuguuuugaauggguuacuugaagaggcagcagcagccugguuuccuugccgaggucuggaauauuugacuaacagaggcuuuaagcagaauauuuucagagauggggagagaagcaaagcggagcuuuuaccuacaguguguucauugacuugggagaggagcaguuguguucacagcugggauugacaacugucucucucucucuuuuuuuuuuccaguuggaacaaacuuuugaggucuauucuuuuucuccuuucaaaauggucugcuguguuuucaaguauaauguaguugcuguguuaaauuuggggauaauugcgaguaauuauucuuccgaagaacaaagagaugaaacuugggagauagggauauugaugcuuagcgugcuccgucccugccuuucugugguacagucccauuccauacucuuuguucuacuuaggaagcucuuuuuugucuuggaaugagaauagcagcucuggcccaaacaaauuugguucauggugaacccagugaaagcuccaggcaguuagaggauccucugcuguuguuuuucugccuuuuguguggguggaccacauuaaguagaaagcccaaagcagacacauccugcagcagaccugcugaaugcuggccucugucuagccauugcuuggcgccgugacucccuuuagggugcuguaguuucugcuugucaucugguguuagcuuugugaauaauuaguuauugaucauggcuaaguuaugcugaucugucuuugugcucuuuuuccuugggucacaaaauagaauguagaucauacacaaagagccugucacaauacauuguuaaugaauucuuauugaaaguagaguaaggaaugaggaggucucacucaucaauuuauuuauugauaaguuucugggcuccuucuacccaucccuuccuauacuuuaaaguaggugaaaugaaugacucuuucugguauauuggauaaaaccaggauggaaaguucuagagacuuccugaugaucuuucauuacagagagauguuucagaagaguuacugcauacauagugcuaagcacucauuagccugaguguacuguuugccaagagagcaacucauuauuaaaauguccucccugagagguucuucauaggauugcagauauauuaaaagcucauucaucguguuuuacagguuugaaagaguuguuguuggccuacagguuuauaacuguugucugcuauagggauguagucuuuaauugacuugagaguuuuccccaaugucuugguuagcguguacauuucauuccucauucuuuuguuuuccaacucucgguguuuuauguguaagccucccuugccaccuugcccaggcuugccuuggaauuccugcugugauuucggguggucuuggccucauggcgauccccuuuccucagcccugugagaacuagaauugcaggcaugaggcucugugcccagccuaaggucugucuuuugacaggugucaaucuuuauuuaccaaucucacaguucuuuacauuggaaauuccauuuguuucuauauaauguugugagguuuuagauucuauuucucaaccuaaauugagagagagagagagagagagacagagacagagacaccaccaggagauuuucuaaagcaaauguuauuuucuugucuguauccuugugagaauggcagaagauuguaauuagaacacggguccuauuaaacugugaacaucuuuaaagaggaugaggcaaggggauguuucuaaggaccaagagaggaagauuacaucagcuauuuuugaauaaucaucuuugccuguagcgaauagacaagaaugauuucaguccaagguugcugggcauaucuuucuaaaaauaucaagcuguggugcccauccgugcacacaugugcuaugcagggucucuccuguuagucacugugggacagucaugcugaggacauucccuucacagccuccagccuuagguacuuucaggaauaggggcugcaccgaaaacacauuuugauucugacaacuuuugcauuuuucuuuuaaauaaagauuguacuucuuaauacuuauuuaucagcagcccuguaguuagacucugcuuguaaauuguugagacacacugcuccccugguugcucauuuggucccaugucagggacagaagugauuggucuuugggaaucagugucauacccuuucugccacagggagccaugagaaagcuuagcaggaccaggucucuggagagcucugcuggagucuguggauaaauucuuuuccucuguucuguucuuuggaaaugguuaucuuuucaagcagugagccuuccaacaaaaccagaaagaugcaguaaauauaaggcaugggauguuuggaaauaaaagaacaaagaaggaaauuccauuugcauauagaauuuggaaauggcauggaccaugagaguucuaaaaccuuuugcaaucaauaauauguuccaucaauaaucaaacauaauuauaaaagcaauucuuaaucauguaacuggaguuaaaagucagauuuaaucaccuuaaacacaauacuuaaaggacuucaaaacaaacagauguccagcuguagagauggcucagcggcuaacagcacuuguucuugcuaaagaccuaaguucaguuccuagugcccacucugcagcucacaacuaucuccaagucuaauucagggggaugcaaugacucucucucucucucucccucucccucucccucuaucucuuuuucuuucuuuuauuggauauuuucuuuauuuacauuuccuuuccaaguuucccucccucccggaaacacccuaucacauccucccuccuccugcuucuaugaagguguuucuucaccccccuccucgcauuugauuccccuacacuggggcaucuaucgagccuucauaggacuucugaccauaguucucauacauauauacaggcaaaagauagucuuaaaaaacaaaccaaacaaacaaaugucacaaagaaaacaaucauuaaguuuuaaccauuuguaauuaaaaaaaaaaacaaacuaaugcagcuggcagaaaaaauuaucuugagaaaauagaaaaauguuuguauccuaagcuaguuuuuuuaaguuuuacuaagaacagauacauagaguuuuuauuugcauaaagaaaaaaagagugggacucagugccuagguuaggguuuagagaauacuguaaaugcuuuauaaacaugcauaaguuuccuuugguaagaucugucuuucccaaaucuccagcucacugauggcaacaugcuuaagguuucacuuggucccuuucugucuuauuccucuucuuccuccuccuccucuuccucuucuuccuucucucuuuccuccuccuccuccuuuuccgcuuccuccucuuucuccugcaccucuucuucuucacuuuggaccaaugccugcuauucuacuacuggacaaaaacuucauuuuuguaguaucugaaaaaaauucuuuuuuuuuuuuccccuucuguaucaaaaacugucucuuccucauaguaauucugugugucucuucccugccugcuucccgguuccagugugacuuggcuuucuuccuuaaauggacgcuuuaaaacaaagcucuaaaacucucugcuuuucgacaguuacucuuucucacgaagaaaggaugaauuuuauauguuacaaguuuuccuucucaacacaugcuugauuuucccauuuuauucucccauauagaauuacccaucagcucaaguuugaaguagucauuuuuguagucaaguccagagaggaaauccaucuugaauuuuuuccauauauugacaacguauaaagauguauauauauauuuuuuucgagacaggguuucucuguguagccuugguuguccuggaacucacucuguagaccaggcugcccucgaacucagaaauccgccugcuucugccuccauagugcugggauuaaaggcgugugccacagcaccuggcgaagauguauauuuuaauagaccaaguuauauauuguguuacauugcaaucaugcaguuccuuuguauauuuaauacuaauuguagacuuuaucuuauguggcuaauuuauuuuuaaauauaccauuuaacacucaucuaauuuauucuuugacuauauauugaugaaauuggagauguuacacacacacacacacacauacacacacacacacacagucuuuauuuucuguuauuuccuugucaaagacaaacccuaaaagauaaguaucuguauuuaauguguaggaggaaauagauauuacauuauguuuuuauuuauauauuaauauuuaguucaaaguuaugguuugauuuugauaucuagcagagauaguuacaaccugguuaacccauggaauccagaccaaguuagucuucuaauacuagcagguaucucuauuuucauuuugucaaaaaauuccuaagacagugagaugguaauguaaauuuuuuagucccuaaaaagauaguugagugaaaauuuuauuuguggcagaauggaacaaguuaagcucaccugcuuagauaauggaacuuuaagauuuuuguaguuuuaugaagcuugugaccaaauuauucagccuuagcaauucacacagcuuacaguguucaaauaaaccucuucuacuuguauuguuguuguuguuguuuuucuucaucuacaugaauguagggguaaauguuuggauauuuucauuucggcuagaacucgguaaaauaaauuuccuaacucccuugaauaacuggauacuuuuagugucagaaaaaaguguggauugaaguugaagacaaaacauaaggaauuaaagcaaaaguuaacauuauuauuaaucaucaucaucaucauuauuauuauuauuugcagauuauauugacaugagaauuuuauauccauuaugcaguaaaaaaaaauuuaaaaacacuguagauaucauuggugcuggagcucuuguugaaguuauuaaccuuugauggcaggcucagcugacccuggcuaaguuaauucucccugaacuguugcuggcacucaagacaaaaagguuaccuuuauggagucauccccaccaaaacuggcagcacccaacagaugagccuucauagaaauuucaccucagagaaaguugauggguuccuggagcucugccuugcuuagugaagggaucccucggauacacugagauaaagucaauagggugccuuaacacaaaagugccaaccuugaucccugaauggacucaugaguccgaaaaagcugugcugugggaauggagaauaccauagguuccauauaggcucugcuagaguugacuguucccuccaaagggauaguauuccagaccucauuguggucaacuuaaauaagaaaaaaaaucugacacccgucuauccauguauguauguauguauguauguauguauguauguuguauguagguaugaucuacugucaaacauguuuuucauauuuacagucucucuuaccuaccuacuugucuuuugaugaacucucuaucaucuuucuaccucugucccuauuuuuccauacucuuauucauccauccaaguuaauuuuuauuaucaauuugacacaacuugacaccuagaauuauuuaacagggaaccucaguugaagaauugcuuccgucagaugguccuguggccaugucuaugagguguuuuccugucaguuggucuaggacauugacucucaaccugugggucaugacccuucguggguuguagaacaacucuuucacaggggcugccucagaccuucugcauagcugaugucuacauucugauucauaacucuagcaaaguuacaguuaggaaguagcaguggaaauaauuuuacgguaggaggucaccacagcaugagcaacuguauuaagguaugacugcacuggcaagguugagagccaaugaucuaggauguccaugccacuguguaaccccucccucuccacccacgugguucugggcuguauaagaaagguagcugagcauaugccagggagugagccaguaaguagaggucuuuggugugugaguuccugccagggcuucccucacuauagauugugaccugaagcauaacauaaauaaacccccuuucccuaaguugcuuuuggucaguguugucuuacagcaauggaaaagaaacgagaauauuaccuauacgcucgucuguccuauauaucuuuucuguauguccauaagucuauuauauauaguucucuuuccaucucuaucaucucuuugaauauauuucuaucuguucucaucagucaaucaucucuauaucuaucuguuuaucguuucucuauaucaguuaucuaucucucaugcacuaaccucucaucugucucucacuucugucugucuuucugccuguaucugucugucuaucuguauugauuaguuuauugccugcugugauggaacaacauuaccaagcuaacuuacagaaggaaagguucauuuggauuugagguuccagacagaaagccagauuccagaauguggagcagaggcagcagccagcaggcaggguggccaaggagaaucugacagauugcaucucucacugcaagcaggaggcagagugagagaacugggaauggcuugccccucaaagcucaucccgagugacauacugcuuauuccuggucacaccuccuaaaucuacugaaacagcaucaccaacugggaccgagcuuuuagucaucagugcccaggaacagcauucucauucaaaucagugcauuguuauucugucugucuguccauccgucugucuaucuauccugauccugucucucccucucuagauaucauuucucaauuucuguucauaucucccuaaucuacugcuugacaaagauuccccaaugucuuuauuugggaauagcaguuccaugacaacugcugcacauuguggugggagcauguaugccacagcaggcuguggacauauucagagguugaggcaagggagugauuuuccagaacaaagcauggcauggcauuagauacuugaaccguaguuguucgacauggugauucauagccagauuggcaucagucccagacugagggggcagaugcugggcaaagagccuccauggugguggcauuguaacugcugugcagaugcgugaugauauuagacacacacacgucaguucuccuucuuagaacuuccaggccuuauuuauuuuuaaagacuuuaacuauccugugcaugcuugugugucuguacgugggugugugcaugcgacucaggguucauggauggcagaaaagagcaagagaucuccaggggcugggauucuaggcagcugugauuucccugagcaggguccuggcaucagaaugcagguggguccucugcaagagcaaucuucucuuaaccacugagcaccuccacagcccuguauacuuguuuuuuuuuuuuuuuuuuuuuuuuuuuuuuuguuuuuuuuuaguggucuagcacaaaaugaauccauauggauuauaacaauuuuuauguuguucucauuuguuugauuuuuauuauuuuuucuauguacuuuucuccuuguaagcaucaugcuuccaguuucuucccuuucccccuugccuuauucaauaccacguaauguuuucugguucccaucuuauuuucugcugucuuaaaauguuaaacaucuuuuacuccuuuuuuuuuuuugauaauuauucuguauggaaacgugccugcuaaaucuaaagaauaauuuaaauuaccuuuacuucuccuuagaaaaugccagcuacauccagcauggcagaggauggugaugccauucuuuuuguccuuggcauuaauguugccaugcacuuuaagucuacauguauuuugagcucugucacacaaagcuguuuuguguaaucgguauucacugggugugcucuaggcauggacuugcuuuucaugucucuuuaaauuucagguuucccucaggggucguuuuccuucugucaaaagaguucaccauagaauuucuuuuagaagaaaucagcuacaggcuuuguguauaugaaaaugauuuauuucauguguguguuugaaagauacuuucauuugacacagcccuccagauuggcaguuuucuuccuccagcuguucuucuauuuuuuucugguuucccaucauuucuggugagucugcuuucagacucacacuuaacauccuuaaagauagaguaauaugugucucccccuggcugcccucaagguucaaggucucugugcugauuugcaguucuaucguggcuguacaggaucacuuuucuuugcguuuacuuugcacuggguguuugggguuugggauugaagucuuugaacuucaaaaaggggucucuccugaccuccuuccuucgaauaccuucccuuucuguugguccuagauccccucgcugugccuccaucuuccacccuugucucuguauuuuccuccucuguuuaucuuuguaguggcuuugccccagguugucuuccauuucacuauuuuuguucuugcugugccugcucucuaguuagcccaugcagugacuucucaauguuauuacauuuuuaaaauugagaacuuccguuuuaaagauccauuuguacacuacaaucuuccaccuugacuuucacuuuuuuuccaccuuuuauuuucuaacauuccaacuuuuuauuuucucuaauuaaaaagauauguuuuaguuucaauuuugugcaucuuuguaugucucucaguguguaaacauaugcauaugguacccacagugggcaagagagaauguuuuaucuccuggagcuuguugugaccguaauguaggugcugggaaucaagcuaggauccucccuccgcaaaacuuuucaguguuguugacuacugagucaucuccccagcccucauuuucccucuaauuuugauguucccaucaauugacuauaagacaucuccuguguucugggucauuauuuucuuuuucucuuugauuuggccaugugaaccauguuuggcugagauuagugagcucugcuugaaggcuggacuacaccuaugcaaaacuguggaagucccaaacuguguuaucaucuuccugagauggcuuauuccaucuacugauuuauucaucuuccuggucucugggagacuuuccuucggcaugacgguacucuaaucguggucauuucuguugcugugguaaaaggccucaacaaaaggcaauuuuggggagaaaaaguuuauuugccucucaauucuaggucacaguuaccaucuauggcaagucaaggcaggcacagccacauucaggagcgaagagauaauuguaccugccugcugucagccagcuuguguucucuaauauguucaagaguaccugacuagggucuguuuccacccacagugggcuagguuuucccacauuaacaauccagagaguacuccauagacaugcccacaggcuaaccugcucugcgucauuucuuauuaaaguguucuuuccagaugguccuaggcugucuuuuaaaacuaaccagagccugucuuguauucccauucacucugagcaccuugguuucuugagagccaguggugggcugugugccuuguagaggucaacacuucauuuuccaaggcucuccagaguccucacccagaaucuguugugguucguuuugcuuuguuuuguuugucuuuuaucuucugugucccuuuccuugguuuuugaaacccaagccauuucuuuuggagacacuugccaguucuacuuggcuuucuccaaguuuucguuuguguguuuagucuccuccgccaugcggcaacaggagauggcaaaugucauauccuggggugacagcaaguuguagcuuauuuacgauaaguagcauauaucagcacucauggaaccagcauacaagagccucauuguccauuuagagcgcaucugaggcucuuggugguauccugauuucuauggacucuuaaaaugaaggcccucguguagugccauggcugaaaauaacuuugaauuuaccaugauaaugucauuuucaaaugguuuuaagauccgguuauguuuagacaauuaaguccccuuauguuaguuccguaacaucaugacaccucccagauauuugcagccgugccugccauuguuccccuaccaccugcgagcagaaguucacaacucuauaauuuuaaugguucaguacgucauuuaagcaaaccuuuauucggaaaccuuuauuuacaaaacaggugcgcuggguugcaauuucccacuuuauacagaauuccuugcuuuagagaggaacucauuuaaauguaagauuaccucugggguaauuaauuaucaccgaguuuaugaaauuuuccauuguguacaaguuucaggugggguauauuuuuaauuaggcaggaaacuaguuuauauuaauaaaacaucugaguugcuacauuuuaaaauguaaaugcaacuugcuguaacugcuaauacauaauuuauagaugggacuucuuuaugaugagcagcauauaucagcauucacacaaccagugcacaacaucccuauuguccauuuaaggcauagccaaagcucuugacaguuuucuggucccuauugccucuuaagugaucacgcugggguaguaccguuucucaacauaauugugaauuuaccaauagaauguuguuuuucaaauugcuauacuaguuggucacauuuggacaauuaacucuccuuauguuacuuacauaacauuaggaguuaagaauccuggcagaaggccugaagauacagcuccacgacagaggacuugccgggauugcaugaggccagggcuccagccacaguaccacaaaaucaaauaaauaacagauaauugaaaacuggcacaaagugugucaagugaaaauuaugguuucuuuggggugggauuaauguugaagcgguccaucauacccuugcuuuucuuucuucugucuccuuuccagacuucccuuguguaucucuucucuagauagguuuaugaacugugucaagucccuagcauuauguguugugacuaaguccaaccugaugcauggcuccauaguugugugucaaaucagacccccuuuugauggaugccagagauagcaccucauacucgagcagguccccccccccccccccaucaacucccuuagguauuguggaugcagggugaacaucagggucuuucccuuagguacuguggaugcagggugaacaucagggucuuuuccucagguccccacaauguuguguguuucuugcaggcuguaugaaaacaagggggaagcugacuucguggaguccuuguugcagcuguuccgguccaucaacgacaugaugagcagccugucagagcucacagucagggugaagguaggugcuacaacguucagccaggcuuaggcagcuccugucugggcugagagacccuuaguuaugaguguccuugaccucaccaagaccuaccugucucugccccccaagugcugagacuuaaggcaugagccaucauguccaacccacugguguugagacagggucuacaacucuaccuggaguuugaaaauucggcuuagccugacugggcagcuagcuccagggaucuuucuuucugugccugcuugucuuugagaauauaagugugcaccacugugccuggaguauauguaugcuucuacaaacucuccuuaugccaugcaugcaaacgccucuaaugguugagccaucuugcuggcccccuguccuguuuuauaaaaugaguuuugcagcauugaauucaguucuucaugcuuguaaggcaagcacuuuaguggcugagccaucuccccagcccgucauuuaugaucaccucgucuuguuuugcuguccuugggaugaaggcuggggaccucucuaggacuuuuacugcuauggaguugucccagagacaggguguggagaggccccgaagagcagccaggcuccugcacccuagggcaucucgguuaugugggcuuuuaugggcugauuuaugaccaagcaagcuguacaguuuggaguucgcugccugcuaaaauccagcuaggaacaaaaagcaaucuucuaagugagcccuuguagcuucacacuccacacggaagcugcagcuuuucuucuuuucuguuuuuuuuuuuuuaaguggauaauuucaaaugaguuucuuguuacuauuguguuacaaauguuuuggacaggccaucuuccagcugaaaagcuuugcugugcuaucuagaaugaggaugugugcgcucagaagugauuccuugucccacugacaaaggugacucucccagcugaccacggugugaccucaccucuuccuccagaaugauuccugccuuugucaugugaucucucaguccaauuuugacuugaauuucccccagauugaugaucugugaggaaagucguguccugcauacauuagaaguuuuagguuaguuguuuugacaguaugauauugccuaaggcugcuguaaccuuccaggguuaaaauuagcuuuguaccaguaugcuuuacugaggaauguagugacauuucagagaaacaggagcacacugugcaagaauagauaaaaaaacagucccaggaaguuucgagaccagaaguaauuuuaguuggcuaaauauacucuuauauuauuaaguuugauugggcuugacuggugucugccugccucccugguagucgagucauuugucaguggagcccagaaagcuuucccuccgguggguguuucauuguaagacauggauaaauucagugacguucaugcuugcuucaggccuuccaucugcacguuggaagacgagucucuucuucccuuacuguuaauuugguauuguaugaucucaccacauuugcucuuuuguguugccgaauuaagggaccugggacuugggccuuggcucacacaccauuucuacucuuccuguuuuugcccuauugaaauggaaauagaauugugcggcaucuuagguuuuucuuacugagacauuuucuaggauuaaauauuguuucccaaagggccaccacugcuaugcacccuaguucccuggugcugcugucauacaguucguguauauguucucauagugcaugugccuggaagugugugcaugugucuauauguaugugcagccccgugcaucucuguggggugcaagcauugugugucugugugugaguguaucugaguaagcaugcauguuugugcugucugacuguguggauugccaugcaugcuuguuuauuucucugugugcauucauuuguagugucuuugcuguauagaugaagcugaaaauggcuugugaaaaaugucagccccuguuccacaugaugcucucaggcaguuucuauucuccucuucuagucuccuuuaguguauucuagacuaauguuguucagugguaaaauugcuugcugggaagcccuguguuuucagcaagggcuaauggaucucagcccacauuugcaagcagugcuuuuacuguucuuuggggcucuuucccaucuuuccugugcagcauagaaggaaucugucaucauaguucucugagcuuuccccacugucuugcggagccacaggccccugccacuugggcauguggcugggacucgagucacgacuaauugaauccaaggcuccugaacugagggugaugcacagacgugugaguguuugucuccuccauggacugcccuuaggaagaaguccucccaucuguccccuuucucacccucucccggugcgauuuccaucuggccuuccugaaaggagcuguguugggaugcugucauuguguagucaguuggauuggagcugaugggugaguuuuucccuccaagaggcaugauuuuaaugugccuaaaaauaguaccccuucuucuuggucuuaugucuuacgucaaauucuucagcauggguaagcuggcaucucaggucugcacugcuucuugcaaaucccaaaguuuacccuucuauuuuccucagauaaacagucugaaugugugagggugaugacaacuaacagucagauaucacaguuugcaccaaugggaacucuggcuuccuggagcuuugaccaacacggugcuccaugccugguaucagcagugccuauucacucccccccuccagggcucucucauuugccucccuguguucaaguucagaagacagaagaguugcucaucaccucagcucucugaguuucugcugggauuuuucucuauauucagagugcucccacauggacacagauaugaugagucacguguuguugacacagugucuucccucggugcaugugggacacugcuucccggacucaacugagaucgauggagaccugagaugcucaaaucccuugcaaacaugaacaagcauuugcaaauaaccuuuguccagcccuuauagucuauuacauuuuauuauuagcuuaauuuuuuaagaggaaagauuucuuuugccaagugcucagcuuaccaccucaauacaucuagucuucucuguauaccuuaugacaccuaauucaguguaaaugccauguaaauggugguccugaauacggaauggugagaaaaaaagucugugucguuuugguucagacacauuuccucacaucuguuuuuaguuauugcuugguuaaagaggcaggccuggcagcauguaauugauauauauauauauauauauauuauauacauacacacacacauauaauauacacacacacauauacauauacuauuauacuucuauaucuaucuuuggcauggauuugcaauagagccauuaauauaauagucucagucucucucucucccucccccucucccucccccucuccuugucucucuuguauauacauguguaccugcccauacauuuacuuguggggagggcugaaguguaggauccccuuggagcuagagcuagaguuacagcaguaguguaaacaaugugauuugagugcugggaacugaucuugaauccucugccaaaucaguaugcacccuuaauggccgaauuuucucucuaucccagggaugcucaacuuaugggucacaacucccuuggagguugaaagacccuuucacagggguucccugagaccaugagaaaacacagauauuuacauaacaauuuacaacaguagcaaaauuacaacuacgacauagcaacgaaaauaauuuuaugguuggagcucaccagaacaagggcaacuauaugaauggguugcagcaucaggaagguugaaaaccacuacaguuuaaccugacucaccagugcauuucacuagcacauuguuaucuggugcugguuguacuguugcucauucaauccacuuccucuuucaaaacauagaguugguuucccuuuuuuaauguauguauguauguauguguguauauauauauauauauauaugcauauauauauauacacauacauacauauauauauauauauauauauauauauauauauguauauguauauaacacacacacacacacacacacacacacacacauauauauauaugcagcuuuuuaggacccuucuucuauggcuggccaugucuaguccuggcagaauccuugaaccaucuggucuaccccaagggcuucaguuucugaucccaugguuguucugugacugcccuuugaacuuuaaagacuuaucugucucgugaggcgucugugcuuucuaugccuggugcauagauggcuguugacuuaguuuccugugcauauaguccugucuaggcuucuacuuaauucccaguggcauggagcguggagggaacuacccagugucucagcaccuacuuuguucucugguuauugucuguguuggggacaaaggagauugugguggugaggaggguagccagugagggacugggccauuguagaccaacagacagccuaagaaagucacauuuugagucugaaaguuuugcccaaagcaaacaguauugucuuucuuuuacucccuuugguuagaaguuagcagcggucgccguguggcaguggguaguacaggaggugggcaguguggguagccacagccacagcauggugugugccuuacuugcuaguuuccuguauaucucaggcacaggaugugauguuccccaugaggacuuuccaggucaugucacugcauaaggaaaagacuuaugggaugagaagauaggagcagcugaagcuacacccaggagcagccaaccaugacaggaauggcuacacuugguugagaaucagccacaggccaggccuucuagagaguaccgcugacaagaugccagaguccagaaggugaaagaccuaguuagcauagagguuguauuaauuuucugggauggcacaaagaaacuucuucauaugcaguggcuugaaacagcauagauucauucuuucauaagccuggggacuggaagccuggcauccuggcaccagcagacugauuccuucuguguagucuggggcagaaccugguaguccucagccacccucgguccauagacacagccaucuggcucuagucugcaucuuugcaugggggcucugccugugcgucugcaucuuguguccuuucuccucuucaguuauuuggaaccagugcucacacuacugaagccugacuccaugccaacuuaauuuuauccgagaaagacgcugucagauccuacucacaacugcucuggauuugcauguaaccuuugauagaaaaaucacuucaacccacagcagaagucuccauguguauaaguuggaggaagccagacuagugcugcauuccagugucuguguuauaguaggcggaaugaauacugggguuugaacuggugcagccuuuccguuggcuucaccugugcugccugcccucagcuucucagcuuugauuugucaaggcucccuugaaugugccuggggaagacccuugcccaguaaaguuauggcaugugucaguuaagaaucaacagcagagaagaaggcaauggaggcaauauguuaugucuuccugacaagaagcccuuaguuuaugcuuccaaguccauuacuguagucuuugguuugcacuucuucagggguuuccaaaguccagaaacugagaauucagcccagggcuuccugcuuaguagauucacuacaaagguucuuacagucucuauaggaccacaaagcauaaucaaggucagucuggagcccccuggccaggugcacgucuuccuuuguccugucuguguuacaugcaggagacugcugcaacagccagcuuuacagaugugcaguaguaacaagauccugcccacccacucuccuucagcaugccugcuuuugcaugguucuccuuccagccugagagagaaaauuguuacaaggaugauaccuaacauuuguguuuucuugcuuuguuguuaaaagccagcuaccuguccuggugaacguagccauaauuauagcuguaaucacucugugccgguuugggggcaugugccugagcagacaugccuucauuugcucaauccagugauuucucaucaaaauaacuuuguuacuguugaauguaagggcuuugcuuuuacacucuuaacccuacagugagugguuucauuaguacagagugggagagagucaucuuuuccuuuaaccugugagugauuucuguguugaucaccaugacccucuuuguguuagaggcaagaauuugaguugaagucuggccaauuuaaccauuccaccuacucugucuuuuguuugggcuuaaggggaaauagucuccuuuggugcuagaguuucuguucaggagcccaugauuuccuacucguuccaucuuggucuucaggacucuccgguguucuucccacacauguuuccucuggcuugcauccuguuuccugccaacaaugccauuuagcucccuuguucauccuccaucacggucaggauuccuucaguaucuccaaguagcgucgguccugaugggcaagcuuccuuaugccuagcaacaaucauuuauuuguucagcuauuugaaauguuuauuuuggggggugggggaagcauguaaagaggagucucagugagcaagagguuugcacuuugugccuggcacuguguuaggccaggucgggaguaauacauuucaguauguuuucucauggguacaauugagugaacaagacaaggauaaaccacauggguaauucuauucaaauucacacauguucucacuuuaugacuuauagcaaauuacuguuaagaaaaauauggauuagauaagaaaaauauggauuagagagauggcucagcagcuaagagcaaugacugcucuuucagaggucccccauuuaauucacagcacccauauggcagcucacaacugucuguaauuucgguuucaggggaucugacacccuuauacagacauacuugcaggcaaaacaucaauauauagacaauacaaauuaguaaauuauucaaagagaaaaguuagacagagcaaagcaauggaaaauauacaguuugaaaagacaggaugucucgggauggaaauauuuuggagaguucuggaaaguuuaaaggaaguguaaaaaaggaaguguugaguggggaaauuuugggcauuguggucuucaaaagugagacauuugucuuuuugucugaugcauugcuggugcacuaggaggcugaggcaggaaauguguagguuugaggacagagugggaaacacaacaaguccuuguuugaggacaaaauagcaaaagggccuggaaagcaguucaggguucagaucauuuccuaguuaaugugugaggccuuuguuuaaccacuaguaccagagaaaaacaagaaaacccaccaaccauaaaaaggaaacaagaauaugaagucagagcuacauucuauauauauauauauauauauauauauauauauauauauauauauauauauauauauauauauagugagacccuguguuaucccccuacccccaaauaacaaaaaacuaguucagagauugcaccuagcuugacuccauagggaagaaucagauccuugggaaggucagaugauggaagaccaggauagcaugguguauccugcucuagucaggccaccacuggcuuuuccaaggguuauccuagucaugcgugcagaagagggugcaaaggccaagggaggaagcugggggugaaauaaagcaggauacccaaccccaguccugaugacauuuggagaugguaauguuugacuugucuguuguagacacuuagccgcauugcuggcccaugcccaggaaccaucuucaucauaauugccagaagaaucucuuagauguuaugugugguucccagacugguguugcccaugugagacuccaugaguuacggggcuggugauggagugugagauuaagauuaugguacuuagucaaaugugaaggccucuaccaaucugugguagagggugggaagagauaagggggcagggucauguuauccaccaaauuagauacagacaacuaugggcacacuuaaagucuguauaaauucugcacaucuucgauuguucaucccugagacuuugcuuaugagcuacuguguugcgcuggcugucccauucuaucauggggaccccauacuugcucagggcagcauguuccgagcauacacuugccccuugacucauuuuccacucguaauauaauaaaaucuuuuauuguuguugaagauuuaauugauaauuuuauuuauguaucuguaucugguuaugugcacacgugaguucaaugucuggggaggcagaaaagagcauuagaucccuggaagcuggaguuacaguguuucugaucugccccauauggauacuggccacuagaguucggucuucugcaagagcagcaauugcuccuaacugcugaacuaucucucuaguuccaacacaauacuaucuuuaaccaguagucccucccucuccccuuccccccucucccuuuguuccccugucccucuaccuuuguuccucugucccccucccucucccuaugccccucuccccuucccucugucccucuucucccuucuuuuccuucucccaaucuuaaaccuuugggauaacaucuuaugccugccccuugccugguaucccuuuaguguguguugucgguggcuggcuauuaguuacugcugcaguguugcugggcaucauuggaugccugguuauauaagaagcuggggaaguaccagauuucaacucccauaugguuuuggggaguuuaucuucugcuuuuuugcucugguggauugugcagugugaaauaauccuaaucccuccuauuuguguggccucucgguggccaaagcuuucugaugcauguaaucucucaggaucccucaguaccacuauagugcccauacaaaacaauaaugcaagggaagaugaaacuaaggacaggguuguagaugcaaacggcuccguuuucacagccaguggcucuugucugggucuucauaugcacccaucucuuggggucuuucagggauaugcuaggguggguacagacugaccagcagagcugaagauuccagcccucagagagcugaugcgccucacacuuagggaaacacauucagcaaggccgugccucuuagcgcugaucaauuauaucuagauuuuacguuucuaguguauggggcauauuuugggugcacauugcagacaucuuaaauaagaucuaaauaaaaggaacaaaaccccuuucuguguauagaucagaugucaagaugccaagaacaggugaguucuagauucacucccauucuaauccacaccuuagaguuacagugugauuauugaugccaugcuucugaaguuuagaggagaaauuaagaggccagacugucugauaggcuguuuuagaagaacaacccuaggggacugccucuucucaacucaacaggcaucgcuggaaagcugccauugccucugcucagacugcgcucagauuugcuuucgaaagcccgguguggguugcuucagguagguggaagcccggcacccuaggcccgagugugccucugcuuaacaguuaaccuccuuucagugcagugauugugucuccacuggagugagaaaugucuaccaucggguagaacguuccauucuucucacuauuuaaugauccccauggucauacagugacuggcucuuugagagaauguccauccuucuaagaaugccuuucugggcuggggagauggugcagaaugugaaguccuugccuugucaaccugaggaccuggcuuugcuccccagaacccgugugaaaaacuggugugugaugguguacaguugucaugccaguacugagagacagaaggaacccugggcuucacuggccauucagccaugccugccucaugagcuucagggcaaugaaauaccguauuucaauuagucagucaacuagucaaccagguauucuaucuaucuaucuaucuaucuaucuaucuaucuaucuaucuaucuaucuaucuaucuaucuaucuaucuaucuacuguccuaucuaucuaucuaucuaucuaucuaucuaucuaucuaucuaucuaucuaucuaucuaucuaucuauccauccauccauccauccauccauccauccauccauccacccacccacccauccauccauccauccauccauccauccauccauccauccaucccuguauguauguuaaugguaccugauguaugauauccagggcuguccucuaggcuccacacacccaugcacaagugcauauacagacauguauacucaugucccaaggucucuagaacuuuuuuucucuaagcaggggauacgggcagagguccugggaaagaagaggccgcugaaacagacauggagacauaauggagggaguggagagugaggacuuagagcaacugggaggagggcuuggggacaagcacgugugucugaaacuauuguaaaccugugacucugugagaugggcuuuaugagauguucuggccuguuggcuguguugaugcaaagggacauugaagucuucacugagacauggugcucacccugcaugcugauuagcgcauguccugaagcaagaggagcgggaugcuuaaaccuucccaggaagaaugacaucaaguugaaauaguguaaggaagugagggaaagacucuucauacucgagcuuugaaaaacucauuggcucugucagaauggauauuuauaaauuggcaagaugcuuuggaguauuacaguuguguacauucucuuaguguguguguguguguguguguguguguguguguguguguugauaagacugcacauuagguucaguuggauuucugcacuacuccaggaguuauguuggcgagugagggagugagaaguccuauccugaaggcuuccgggcauuuacucagggauuugagaaucccagguaggaaggccagacccuaauuuccuguucuucacuguguugcuuuuccccugagauuacuccaauccgauuuuaaauuauuaugccggauuuacucagaauccucggccauccuucugaugagaaggucagcagcguaagucucuguccacuguggacacagcaccucaaugauucaaggagaauuauuuuucccuugggaaaacccagacucaguaccguggguuguauugggaaagaggcacagccugggcagggcuguaaaagaaagauguaucauuaaaacaaaacagaccuuaaaaccuguguacccuucacauuuagccauucauucuuaagagacugucuacccguguguguguguguguguguguguguguguguguguguguguguguguagggguguucagguagaggccagaagaaaacccugugucucguuucucagaugccauccccuucauuuuugaccuaggguuucuccaucaucugaacuuaucaaauagguuagacuggcuggccagagagccccagggauccacccauaugugagcccccagugcugacauuccaagagcaggucacucagucuuaguuuccuuuauccuuuuuuaaugagaugaaauucagguccacaagcaugaaccugacugaacucucucccaguuguccgggguuuuucuuuuuccucuuaaaccucuucuauccaugcaaacggugaaggaggcacagcauucccugucacucgauuagguggaaacaaagaguauaaucaacuuuuugaaagggaaaauuugagaauuuucugagaaguacucauuuuugccauaaaauauuuuccaugguuaccucugacaaccagaggcagagguacucuguguuagucagucagcuuugaucacugugacaaagacaaaugcaaacaaugcgaaaugcagaaaaaaugcaaaacagcuucugaagagugaagguuuaugccugguucugguuucagaagcucccagacagaauggguuggaucugucccuuuggaccaguggcuaggcacucugucacagucucgccauguuacaugccccuguagugacucacuuucuugccacaggcaggggucccacacugcuuugcaguuuucugcuaguuugcaccuuucuaagggcugcccuaucuccugguagcaacacacuggggaauaagcuuuuaacuaccuggacccuugggggacauuuacaauccaaagcagaguauaucugagaaagucagugagcaccaauuccuuuuauugcuuuucuuuuaaauaauucauuuuguauuaaaguggaggacaguauuucaguuuuucucccuucucaggccuauccucaugugauacuuugcagguugcuugugacucagcccaagcgcuucuccacucuugaugcaggaugcucauccaccucuuuggcaggucucuccuacuuccuugcuuccaucuuuggccuugucuguuacuggggacacaggaacaaaccacagcucuacuucucugauuaauuuacugagguuucucucucagacuuagucuggaugccccccaccuccuugucugagcuagcucuagaugucccguggguagcagauggcuccuggugaauggggcuugggcuuuuuacuucagugucuguuaggguuuuacugcugugaacagaugccaugacccagacaacucuuguaaggacaacauuuaauuggggcuggcuuacagguucagagguuuaguuuacuaucaucaaggugggagcauggcaucauccaggcaggcaugguacaggagaugcugagaguucuacaucuuucagcugcuagcaaaauauugacuuccaggcagcuaggaugagggucuuaaaguccacaucuacagugacacagcuacuccaacaggaccacaccuucuaauagugccauucccugggcugagcauauacaaaccaucacaucgucaucaugugaugugucaucgacucuugacccuagcacagaugacagggggucggcuuuuagcugagacuuuuguuccuuccuggacugugacucagggacagggaaguaaccacaugcuaugaaauacacaagcagauguaugagguagagagaggccagugcuggccccuuggauaggaucacugaugaacaaggcuuacgugagugagcacagugcagacacauggcucuugcucuucccaauuuugccuucuccuacuguuucaggggaccuucccuugugaguagguaauaccuucuuaccacuaaguaacuccacaaaguugggucaaauucaugucuaacgaauggcugaugaacggagaaauaccugaacagcaaauuccacugaaaacaaacaaccaaaaugcugagcagggauacauuaagaaagcucaaagaacuggaaaacagggcugcacacuguauaauacuugagggaccccuggacaucaagguugaaggcagacucuuuccugcaguaugugggcugcaucucuacagcauucuccagggucuuuccccacuuuccccuuccuucugaugagccugcucuguuaccccggcauucauuugcauacaccauccucaucuuaccucaggguuuggucuuuauccuucauggugguaucuccucuaccuguucccuuuuggaaacuggauguaugaaugucccgggaacuucccuccuacucuggggccuggcuggaguucgaguucacucuacagaucuccugucugucaacacugagcaguggacuaggcucucagggaaauggccucuagggugguuguucugugggaaaguuauggagcuggagagauggcuccgugguuaagaagacauucagaaaacucaggcucaguucgcagcgcccauauggcugcucacaacugucuguaacuccaguuccagggaggucuguagcccccuucuggccuccauggacaccaggcccaugugugggguacagauauuuauaucuacaaauacccauacccauaaucuaaaauuauaaaugauuuuuuuaaagaaaaagagaagccauuauaacaccacugucugcaagucugucugacuggaugaucguucuuaaaguacauucucaagucugcuuccaauguugcccccucccuggcugcugguguaacagcuagcacuuuaauguauggcuacuuuaguaugugggcagacauaaugugcucuauauuccuucccuuuagaguguauuaagugcucauuucgugccaacuuuggccucauuacuagcccgaggccaucaguaacagacagugaaagauguucugucucuaggagaagaagccaggcauuugaccccccagggcaggugacaggugaggugguaugucauuagcugucaggaugacagacuguaggccagauaggggcccagagugcaaauggcccugaaaccccuaucaaugccuugguuacagcucagaggauuggcucugagcuuugaggcugagaauuaagauggcugauuauaucaagggacacuuuaugugagaggaugggggaggaaggagaaggagagagaaagaugguguggaugccuuguuuguggaguauagggaucuuggcuguacucuggcagucuagugguggcgugugugagccccagcucacauaaugaaaacugacauagaaguuuauuuuuuaaucacacuuuuacaaaagguuaagauuucccagggguauggaaauuggggggggguuaucucucaguaugaaaauuacaugaguuuugaaaauguuaucuuauagacuucauuauugguucuuuuauuauuaccaugggauaacuuucuucauuuauauauuuaaauaaaauaugccuuuaauuggaaaaagaauuuuccagaaaccuugccuguccccuugcagaguuuuggggcuuucacugggagccucuuuguagggugcuuggccucucuuucccccauggagcccugaugucccauucugagagcugcuuuguggggguuguggacugccaugucuucccaauucaagauucuccuacuagcuagaaagcagcuguagggaauccuccauauacccaauauauugguaaaauguguggccauuuuuucaguguguuuuguugaguggacgacauugcauguguagaugucuuauccuggucucauccuucacucccuggacacacagcucccgaguuggcccuugguucucacugagcccaucucaugccuucccugauguuuuuucucugguagguugcaauaagcauuggcugaagggauggaugcugggcaagucccuuccucccugggauaucaucaauaaagugcgggaagguguauuuugggaccaugagguauuagacagagcucugugaacaguaaugcguuuuaagguuuguguccagguugcuugguucauggugcauuuugugggcggguguuugacugagauuccauuucaguuuucugcuugugguuuuucuuaacuuaaggacagcguauuaugagucgcacaaauuugcuuucagauuccacaaucugacaaccuuuccuuugauuuuuacuacauguaacacuugaaagcgaugaaucuuaaauugagcuguaauuuaucggcagugaaauaaaauccauacugacguggacaguucagucaguuuucaggaguacauauucugugaacccccaccccgccuuaguaaagggcaucuccguuccugguacccgagugucugcuggguccauugugagggaagcaguuugcauucuuuauucucucagaauuggaagcucugaguuucaucugggcuggcaguucugguuccuguggacuuaagcuuugcacacaagugagucuucuuguaucugucuauaaaacaccaggaaaugugucaacugugucccaaaguucugaugguugcacucaucccuuggggcucucucuagaacaaaguggucaccuccaaggucaucuuugagcaucaaaggaaacucugcaaggucacaaagggacacaaugccauccuuaacuuccauugggaacuaauuucucauaagcaugcauagagacagaucuuuuaagugugugaguuugagagcauguguguguguguguguguguguguguguguguguguguguguguguuucugucuauuuuggcguaccacauauaugccuggugccuguggaggccaaaagaagacauuagaucccuuggaaccagaguuguaggugguuauaaaccgccauguaggugcugagaacugaacuuggaucaucuucaagagcauucuuaacuguugcuucaucuccccagccccauagaaagauuuuucuuuuuuaauuuguggagucuaauaaucagaaauggcuuuuuggaauuguguuacucuuuuguauuguaaagaaauuguagcucccggaauuagcauucuagguuguguaauauuuaacaucuuuucuuugcucauuuuuuuaaaagcucuguuaaguucaguagagcagucucauuuacacuccacuuauucauaauuugggauaauuaauguaguggcugggcugccauucaccucucccagcuucagaacacagggcucugccagucaaaugcauaucuuaagcagauuagguugcucuuggcaugcuuacacuuccuagagggaagagaucuuuucacacugcgggggaucugagucccucuuggcucuuacuccaccagauggccaacaaggacuuuagaagugaugagcucagguccccuccagcccagaaagccugagaucuugccaaugucauguuaagcugggauguucauuuccuuugaaagcuuacaugaaauagcauuucucuuggaaaucuauuguucuuuauauuuucacuagugccuccucaccccccacuaccaccaccauugguuccagggucgggcugauuggcuuuugugauacauacaguaaguauuuaaaagcuaaaauauuccugagggauucuuuacugugguugcaguaccuggagcuguuaggguuggggaagggagcccacggaagagucauuucaggcaugucagguuugggacauuacagccccagugugcucugugacguagaaggagaccgacccuaaauaugaauuucaguuucugugucacagguuccccugagucuggucccaaccagccuggguagaauguuaggcuguucaaaaaucugugccauucauuccaugcuugaguuuggucuuuccuuuucaauaauuuaauauuuuuaaaaaaaugacaccuuuggucuuuuguucuuuagcauggagggucaagggaagcagccugcaguuugccucccugaccucugcccuuccaguguguacucauuagcuugcgauuguuucuguaaccucuucccagccuggugugaucucacaggccaccuuuucugacccuccaagguuguuaaaugagauuucgcuuccucuaugaauuaaauaugucauguggacuugaaacauucccaaacucgcagugcuauguuuuggcaaaauaaauacuauuuucagagaguucaacccuguggauuaaaacccaugucucuucuuauuaagcuaggaaaugauuuuaucaggcaaacaauggcgaguuuacauuuccucuuucgguggaugacccgcugccaggcaguuucacugucugcacauaucgcaguccuugcugcuugauucguaggccccaugcaugugugcuucucuucgggcucaagacuucuugauguagauauauauggugcuuaaugcuuuccugguccuuagggcugggaaagugauguauugcucugugacacccaaccaagagguugcuugcuauguguuguuuguaucuucccuguccuuuucuaucucuucuuuagacagccucugguacuaaaaaugcagaaauagccaagauggaguacggaauggggauggaguggggguggggaaucuguguccuggcccagaaccccaggcaaucucugagaucuccuacccugccuuggacuaacugaccugcugggucacaugaacucccuuuaaaaaccccuuuauggggagaucguuuacauuuaaaaauagcagcgaugguguuugcagcauuggacacacuuuggaaauguggguacguggcacagucuucaccauucuggcgaaggguccauugugcuucgucuuaugcugcugcuucucaggaagaggacgaguugcgacccucacccugagugaaggaucccccugacagcagcacagggucuccugugccaguggggucuaugcauuggucaagaagcaacuucccugggagaagugacaagagauugucuggcaagaguggaaagagccagagccuuccccuuggcuuccauccuccaccucccuccuugagcuacuccuuguagcccuuucaucauucugucuccgucucagcacugcacagugcugugccuugcuagccugagccuuuucucuggaacucccauccccucaucucucccaguuggccugcuuaccagucagauaguuuucccuaccccguguagaauagcuuuauuucuucauauugguccuagcauaccaccuuucaugcccaggcccucacucauucccagaguccuuagcaaggaacucuuccaaugagccacacagcgcagaaguguuggggcuguucuuuaaaugucauucuucaguaugucacaggucuuggccaucuagcacuuuggcugaugguggacauguauuauuagccaugagcaaacagacauggagucagaaaaugauucuggaauuauaccugccgugguauccaugaaguguuaaaugugguaugacacauuccugguugcuuccuggcuggcuccuuccuugcauaccucauccugguagccuuggugauagugguacacuggaguuguuaguccuaacaagcuagaugcagacacucaucuucaguggacucauuagaggaauaaaccauagugaaaagcagagaaaggagauuuauucagcgcggccacauugggcagaggaacaaagaggcucagugacucucuucaagcgcagguuuggguucuugacaauaagguuuauguuuaaguagaaagcaagagguaugcauaacugagcaguccuggucaagcugugguccugcucauuuagcagucucugcugucaggcaguuuggcaagaugucagauuguaucaaauugcuuuccugcagacaaguuuccccucugauuggcaccagguuucauucuuuucuuuuucccagcgugagauuccuggggaacuuccucagguccauuauuucaauauucugacagcuaaaggggaggggcacacaugucuccauggacuaccuguaucccugccaggacagucacagugcgcucugauucugagcccucaucuuauccaguuccugguauuguuugcgccugaccugcccgcuuugauccgaaacccuucagacuauuaaaauaggaguuaaucauguaagaaagaaacucacuaacucaacuucauagugaggauguacacuuccuguugcuagauaauaaaacagagugcacuaauuugaauuccguauaauggaugugauuagaaaucauuucccuauuuacucauagaaagggcuauaaauggaagaugauuagugagcucuguuuaauguuucuuuccuaaggugauuucuuaaucuuccaaacaaauuccuaugauagagagacgaaaaagaaaaauccauuaaaaguuacuuuagaccuuuaagacaccguucaaggcuuuagggaugggcaaacuuucugucccuuuaguagauuauggcucugaagagaaaacaaguccuagccaagagcugugcuccauguguguuaacccagggucagcaggcacggcacggcacggcucugaccacaguacugcacugccuacacugaucauaaacgcagcagugaaccucuccauuggaaauagcuguaauuuuccaucucugucuauauuacuccugaaaauuauuauucagaauaaauaugucuaaauccuuccagaucccauuauuucuauauuguucuauaauuucauaauuaaauaaugcuacuuuaaaaaaaaugcuuuaucuuuaaauccuucaccaauaaucucuugucuguaauuguggguaucucaugacuuacauuuaauuaauccaugguuggugagcacuugguacucgcugcaauuaagacgauaauauauaaagccacagugaaagacaugugcguuccucccuggauuuggggccccaaggucuguaggcaucacauuuuaaguaacucuggucauaacaguaaugacaucugguccaaagacccuuugucacacugaagcaggaguuuagucugguugcgucauggaugaccuuuccccgagaugagggaaaccauguuagggcuccucaaggugucuagacacuggccuggagccuacauggaaaaauacaagguggauaacaccuccauuucuagcauuugguguuuucugugccaggugccaggaaaaagugacaagcggguaagugagcaggagaccaaagugccauuccuucccaugagcgccagggagaaacugcauguucugcgaccagaacucagauaucgcccuguguucuucgcagagacauugucucucaugaugauguuccaucucugggcaggagucacacagaguccaggaaaagugaggaaaggaugggggauuggaugcaggauggggucuccacuguguaagauggcugaucagagagacaugcaacuccagaagaguuuggcugguaggagagauguuucuggguccugguggcugcugaguguuuuaagaucacauuagccuggucuuguggaagagaagagagcuuguuuuuguuucuggcugguuuacugcugucugucuuuuuagcccuuguugaaaggcuuauucccucucuccucccuucuucuucccguccgucuguccauccaucugucugucugucugucugucugucugucugucugucugccugccugccugccugcaugccugccugccugccugccuaucucccugccugcuugccuucuuccuuucuccuuuccuugacagggccuuacuauguagcccugaguggccuguaucuugguauguagaccaggcucuccuggaauucacagagauccaccugccucugucuuccugguguaagugcucagacuaaaggugagacuaaauacuaauagguauuucucaggaucugcugaagggcagaugauuuggcagaugcuagggagguagagcauuacuagaguccccauguauggggacuuggugaggcaagaggagauguguugaaaggaggcuuucucuucucuuacuggacuaccccagaccuggacaggccucuagcuaaaggagauggcucuccagcucuuaagaaacaggucuggaagagccccuuggugucaaaggaggacccaacuuggucuucauaauuaauguaacucucauuuaaacagaacccccauauuuccuccagucaguguccagagggccaguggcuuucuuacagaccuaugaacauuuuuaucuauaucauuuugagacagcaauaaaauacugaaacacaucugccugaaucuuccauguugguuuggcaagauuucagaagucaccuggcagaaucaauaaaaaaggagcaaggaaauguaauguauacuuggcauuuucucgcuggcaugaacacaauuguuagaugucauuuuaaauaagccuuuuaaaggucacauuaaaaauagaauaauuggcuauguuguacagcucauaaaauaucaugaauauguaacuaagugauaaauuuuaaaaacagccacuccuaauucuauaaaaauagguauugguggcuuggcuuagacauucccauuguucuuaaaacuugccaggccuuaaguauucuaaauuggagaaaaaaaauguuggccagauugauguugguuauaacgaaauuaccagugucuaaaaauucagauguuuagaugauucugugauaaggaaacaaauacagagaccccgagccagacacugugaagagagugagagacuuuagaauacugagcccuaaaggggugucuccuucaaauccugccugggcucagggaagccugaggaagaggaggcaggaagaauguuagaguaccagaggaggguggacaccaaggaagcaagaggacugaugugcguaugaacucacucacagagacugaggcaguguggugcacaaagccugccugcagaggcucugcaccaaaugggcuccaagagcugaagcagacacaagcccccacccauaauccagaagccaucuccaauugaugccacuuggaaaugauaauuuaguuuucuccaagggagucuugcugcacaaacagaugacucuuaaacguaggcuuuguggccagcaguggaggucaauggaaagcaaacucaacagcaaccuuggacauuccuccucauccaugauguuggccuuucuucucuuucuuucuuuuaucuuuuucaauauuaucuuuaccuuuauuuuuaucccccuccuccucuacaggucuuuugcauguguguuauggcuucuggguuugggcuuuuaaggcuuuuugaaugugccaaucaaugaaugggccucuguuuccugugccuuuuuuggggcucuucuguguuuguuuguuuguuuguuuuguccaauuccaaugugacacuuuguuucgucucauuacauuuuauuauuaucccuuagaagccuauuuguuuccuaaugagagacagaaagaguguggaucuggauagaaggggagauguagagggacugggacaaguagagagagaggaagccauaaucagaaaguaucauuugaaacaaauuauuuucaauagaagaaaaaaaaagacaauucugugagauggacuaugcagcagaaggaaauacacauaugguguggauguuagcuacauguuaccugcaugggaguuauguacguuaguagucuguuguguguagacgcuuggcucucaucuguauuuauauaauagauguacagcuaccagugugaaauucucaaggucuccacagccacaucaugcacagagaccaagcaccuuccuauucagcugauggguauggugaaagauauuuguuguuggcugccgaagccuucagaagguaaaggaagauggguaggcucguaggacagaaacacacccgcagcagcuucuacccagagucccacgucuuaauacauuuuugugucauuuugccuccaugacuuauuuaguuuccuaaagcaugagccugugugugugacacauggcugcuuaguuagugccagcacuccagagguugagacaaguggaucucuggaaguuccaggcuagcuuagucuacuuaucaacuuucaggccagcccgugcugucuuagugagacccugucucaaaacuaaauaaaacacccugaacuauauacggcaguuagcgaaaucauuugguacacggcuuuuugucaugcuaaagccagaacauuggcuucuuaaguggaugcugaguuuuccuggagcuagagcaugaaccucaacaguauuauaacauggaaaacugaguugguugagccaaauauauucacguggagcucagacucugcugcucaugggggcauggaaggggagggaggggagcaagagagcugagagcagaggugcuuuagguaaacuuuccagagaaugucgaguagagacuccuggagcucugaggaucuguuauaggggguuuaggagaacuccugggcgcuaaccauucuaguaacuuguaaagggcucgcuugggguguaguugaggaauucuccacgacgaagacacccaagucauccagucagucuacagguucauuugcagccaugcuugcuggcuccuuaucuugcucacuuguucuuugagguauggaugguuugaggcaagcuuuggugaggacauugggaugaagggcacauggccucacagagguaggaaugacaucaucaaaggccgccugcagcaguaauuaauaacguguugucauuggcuagguaaagacuacugugacuccaagugcacauguggaaugugucccaucucucacccaggcuuucaugacuguguuucugugcacuguuugucaacaucugugccuuccacgacccagagucagggaacuucauuuuucucuaaugccuauuucacuucauuuuccaauaaaugaaauuauuuucuugcccuugcuuuuguauuagauuuuuaaguuuucucugcuuugcugaaaacaguccuuuccuaaugcagagugaaagccagcagguuuucucugcucauguugccaauuaauggugggguuggaaaacuuauucccuauuuuauuuaacuugauacccaguuagcugucaacaagugucucaucuucuacauuaucgucuguucaggcucauggugacgucauuggaugcugagccuuucagcaguugguugcugggccuuuuggccguuguguuuuuauuucacuguucacuguugucucugaugacauuuuucucuuuccuucagucaauuguggaagaagcaggcacuuuuuugucuuuuuuuucagagaaaaauacccuuuuuuguuuuuccuccagauugcagagcuaggaugcuguucccacgccugcuuugaacgugcccaucacaaguuauuaaaugcuauuaaacugacugacugauggucauguuccagcagaaaccucaaugcucuuuuucagucuguucuugcuuaugucuuucugugccaucuuguuugaguucaaguuaaucucucacuucuauuauugcucugaaaauaacaaugauuauagugauuucuggguaacuuaucauuuguuugaaguauauagaugaauggcagcuugaaguauauauauauauauauauauauauucacacauauauauuucucuuuuacuguuacccaggaccaggaguuugaauuuauauauguggacucuggaaauggcucugggguuaaaaguguugguugcauaaagcauaaagaccuggauucagauccccagaacccaagcauguugcuguccuuucauagcucuaacacugggggcugggacaggggcagagacagccagauccuaggagcuugcuggccagccagacuaacugcgauggcaagcucuggccucagugagagacccugacugaagcaauaugaugaagagucugaggagcacacccagucucuccuccuagccucuacacauggggucuuggguaugugccuugcuuugugcaugcacauguucauaccgccccccacgugcaauucauaaauaaacacacaaguaaaugcacauguguugaguuuuccauuuuucacaugcuuaauuguucuguaugccagagaccccuggccugaaagagacuuagaauccugccaccuccagaugacacuugucccaaagguuagagaaaaagcucugcauuuagaaacucccuccaggaguacaacagccuugguggacaagucuccauguguguaaggucaggaacaugauagcugagguguagaggaggaggaggagggggaggaggaagaggaggaggaagaggaggaggaggaggaagagggggagggggaggagggggaggaggagaagggaaagaagaggagggggagagggaggagaaggaaaaagaggcaccuuucuuccccaggaagguggaagucagcagaaggguuaauagcuucuaggguggaggaggagccagggaggucuagugagcuguggagggacuuguguguuagagagaaaaguuaggacuuggugcuggaggagggggucucuaaccuuugaugguccuccacaggaguggaggcagggaagggcuuuuguacaucucuuuaggagaugaggaaccagcuucauuccccgugggcaguaucuucucuauuacuagcagaaggcugggcugacaguucccaggcuguuaggaggagagaucucugacuugaccuguggcauacaccugcugggcaugugcuaggcauagcaugagacaaaggagauagcccagaaaaugaaaggacggacugcaugggugcuggaggcugcugugggcaccaaggacacagcugccggcugccggcucaggcggugccaucagagcccacagagccuccccacgcuggguggaccucugagugcuauuaggggcaggacucugauaacuccaacuuugcauaugcucuuugaugcucacggacacccuuugaugcccaacaaacugccucugugcccugcaccucauccacuucauacaaacuacuagguuucacuaugagauuuuucaagugaaauugguguuuuguaauauuuuaguguaugugaaugcgcaugcgugccugugcguaugcgugugcacgcugguguagggguaugugggguugaauccaggugcccauggaggucagagguaucggaugcugcuggagcuggauucuagcugguuguuauccaccugacauggguacuagaaacugaacuucuugaucuuuugcaaaagcagugagcacuuuuaaccacugagcuaucucuggagcucccaauuuuuuuuucuagugauuguuuuccucucucucaugccugucucccccuuccugcuuugacccugucuaccucugaucaccuccuucccucuuucaugccauaugguuuagugagcuguuaauuugaacgucucauuuccccaguggguguggaucgccccguguggcuucugugcguacugguccugacugaagagcagugucucuaccuugaggacucguaacuggaggcucucugucuagggcuaggucacagcaaaucugugaccaugccugcagguccuugcuggaagcugugugcucucugacuggggaugggaugguuagagaagguacuaagaaagggagauauugacugaaagguuuugagcgcgccucaugccgggcuuccuuugauucaaggggccuucuagugcugugcugcagcaagucauaaccacaagcugaccaagccauucuuacaggcaaaauguaucagagaagaugggagauguaauaguuaggguuacuguugcucuaauuaaacaacacgauccaaaccaacuucagacagagagggucuguuuugcucacaguuccacauaacagguaaauggacaucagaagcagagaaggcagggacucacucagggcaggacccuaggggaggacccgaugcagaggccggggagggaugcugcuaacugguuugcucaucauggauggcuugcucagacugcuuucuuacagaacccaggaagacuaacccagguuugucuuccugugacuacaggcugugcccucccuaucaaucacuaauuaagaaauaucccuuggacuuuccugcagcuugaucuuaugcagguauuuucuucauugagcuucccuccucucugaugccuuccuuuguauugaguugacauaacacuagccagcacagaagaugggccugugugcuaccugcuggcugugccccagagaaaccucuuuuggaaucccgaugaucuguuuuuggacaacuggaaguguaagcugcccagacugggacaccuguuacagcacccagagcugaguaacauggacagcagaaaucaaaugucugccuuuugcgcccuccuggcuucuccucucuucuuguacccaugcuguagcucagcuuccucucaguguccccuggcuucucucaugacuuguguugguaccauuuuuacugugguuugccagucuguaccagucugccugcuagcuuuauguucuuugucucuuuucugugguuccuucuuccacacugucaucacccaggcuucuguguccaggcauggccccacucagcucuggugauucaccauagucacuucacccaugggagagaugaugccugagaagggaugucguugcaucagucucuccucugaagaagaugcugucugacaugaggaagguuuuguuuaguuucaugguuccucuccucuccucuccuccccuccccuccccucccccucccccucccccuccccuugucuuccuccuuccucucucccccacucugucccucugguuguuguugguggugaugaugcugaugguagaguguagagucccaguccauaccuugcauugguccagaacucacuuuguaccacacaggccuuaaauuugucauaguagucaagucuuagcccccugcaugcugagaugauagagaugggacauuguguguagcguuaaguugccuaagcuuuucuuuauguauuuuggcaauacuuagagaaacuccuucucuguauuucaguguaaguugacauccuguaucuucuucaauugcuuucuacuuuauuuaucaaggcagggucucuuguggaacccuggaccuccaaauccugauaguccagccuuccaauuuguucugggagucccuugucucuucuuccaaaguucuaggauuacaagugacuacuaccauaccugccuguuuuuuuuuuguuuguuuguuuguuuuguuuuuuauugugggcucuagggagccaaacucugauccuuauguuugugcaguaagugauuuaucuauugaaccuuugccccaaauaugguuuuuuaaaaauguuacuaauuuauuauuauuuauagcuucugaugccaaauguuugggacauaaauuguagcuuguuugaaaaggaucauggaaacauguuagccuacaaaggggagggugguuugggacagaggaaguuuugccuagugacuaauguugggggcauggguugguucuccauccugguaccauggaggcuuauuaauuagugauggcauuagcaguggaugcucaggagacccaggggaucugggaugccaggcagcaauauuggaaugcauuaacaagaucaacaaccucagaucaauuucuaagaucuuuucagccacacagcugugucugaaauguaugucugucacuguuggagaccauugugugugucagucacaagcugucaaggcucagguugugacuuggagucagggaguuagggacaguauguccucauucuucuccaauuugugugugugugugugugugugugugugugugugugugugugugugugucugugugugugucuguguucugacugugcccaaaugcauguaacauaagguuuaugaguuauaaccaucuuuaaaaagauuuauuaucuaauugugugugcgcaugcaugcacauguaugagugcagagggugguguuggguccccccagagcuggaguuacgagcaguagcugggagcugaauuuagguccucugaagagcuguaaaugcucuuagcugcugcaucgugucuauagcccuguuauagaccucauaacaugagcagaucugcugcgaugggagcauucccacugugugcccguguuacuguuccaauauugccauucaagaggaaacccuauacugauggccauugaucccucuucuuuguuaccccagcagccaacagcucucaucuguuuccgacugcgucuauucuauauuaaugccaccaggaagcacguggccuuuccaaugguuucccacacacacaguucaggauuuguuccucuuguagcaccuagaaacuucucaugacaggccgagugugugcagaugagcccuacucuguucaugcuuacauccuugauggacacuucugcuucugcugugaacacagcuuccaggaucacuccuauagagaauuuuaauagcucuuuuacauucuuugcuguauaugccuaguuuuggccaugccaggucgcacaguauucucccuguuugucaagaaugguguccuauuuuuauuuauuuauaguggccucucccagguuacuccauugagugauagacuggucccaaauuuuccccuuucaauuaaaauaagaaaaauuacaucuguuagaguugaauacugacucuucccuuacacgcuguguguuaaaacuuuauuaucuggaauugugauguuggaaagugcuggagccuuuaggauccagggcauaaugggaagucuguguuugaaaggggaugugaacucuggucuuuccuuuaacauuuuuuuccuauucaggaagugcgcaugcguguguguguguguguguguguguguguguguguguguguauguaugugugugugcuugugcaugucugcauguguauauguguaugugcaugugugcauguguguguaugugugugugugugcucgugcaugucugcauguguauaugugugugugugugugcauuuguguguaugcaugugugugcgugugugccuguguguguguguggggggggggagagugcuccacugugcacucccuacuguugcauagagaacccuugcuaaaagcccagccucaaaagcagaguugcagagcauuuguuaauuaucucagguauuuuuuacaaacaugggaaucuguguguauuacugccuacaucuuccuuuucugauacaaacaccuaccucauuuaccacuggacuuaggguuuccucauacacaaauaugauuuuucuguguaaagguccuaguucuggaucauucuaucgucaguacgguggcuucuuuggcgguuaacagaauucuugagacuugaaccauauauaugauaaacagauauauauaaugcacaguuccagcagaaggcuucauuucccugcauguuaucaagugguggaagccuggaggguaagcagagugguaggccccuccuguuuauaggacagaaccuggagccuuuaugccuuaauuaccucuuaaaugucucucaguagcaucacagcggugaaugaacuugaacuuaaauugggaagggggcauucaaacacaggacuguuguuaggacccaaugugcguuuagggugagguugaggcgagauggacaugagccucuaguucagcagguucagaaaggcugggguuuggcuggggcugguuguugugaguuggcugggccuguguuuguuuccuuugaucucagguccuuucuuaugugacuuccaucccuguaccuuuuggggguugggggcacagcauggcagcagcaaggcagcagacaagguagcuaugaguagcuugccuugccuugcaagaacagucugggggcuccacugccuucuugcauuggucccaccugcccuguggcacaugcuguguucucugguaugguuccuaaaagguuccauuugcccaggcuguccuggcuuugaggaaagccagguauucauaaggugcgguguuugcucacuguuuucaaaaccgauucacugagguucagaccuuucagcugcugucuccaucuguccucuucugaauuucaaguauguuguagauagucccugucacuuggaaguugagcuuugccuccuggaagcugucuagacagguaaccaauuugcaccaaucagcaggcccucucacaggauugcucuccuuuccccaagcucucccuaaagugacugagcuggcauaaggaacuaagaaagagggagggagggagggagggagggagggagggagggagggagggaaguugagagggagguucgaggggggagagagagagagagggaagggaaagggaaagggaaagggaaagggaaagggaaagggaaagggaaagggaaagggaaagggaaagggaagggaagggaagggaaagggaaagggaagggaaggaaagggaaagggaaaggggaagggaagggaagggaagggaaaggggaggggagggggagggggagggggaggggagggggaaggggaaggggaagggaaagggaaguucgauaaugcaguucagguuuguucuagcuaaaucaggcuaauucuucuguuuagcaagccuugauuccugacaagagcauccccagagguuaaggagagcacagggauguuuuuugucccugcauugauuggcuguuugucuuccucucugucuugcucugccucuugucaugggucuuuucuccuguaucugccauugguggcugcucuucuaggccacuguggcuuuuccugaagucauugcacugugguggcuuuuacacuugacccuacacuugacucauucucuucuaguuucccuuuaucugguauagggacaaagaccaugugucugucccaacuuucugugugauaguguuagagaugugugugggagggagagagcagggaggggcaugcucacuuagccagggguagauacagugaaagaaauuacuguggccugaacugaccgacucuguugucugcuggcucugaacuuaccaagcugacucaaagcuuacagacuucuaugcuguggggacuccagguaacauagauauaugaaucaggaaguucuagggguguguguguguguguguguguguuuguguaugcacguguaugcaggagcuaguuaaagcuuuuaguggacaguauuccaaagugcuaaaaacauuuuugcauaauaaagagccccccucucucccaauggucaguguucuccaaagaguucuaacccuugcguuguaagugugggagcaugggcuaaguuuaauguuuauuaaguguuggugguacuuggcaauagaugcacugaggauaaguaacucugguagcuccgcugagaacaggguuugagugcauccaagcgccagaggagagaugaggagugcuaccaggaaggacaggacuguggcauggaagcuugaugaccacguaaagaggugagaaauucgagaugugggucgucuuaauaggauuggcuucagcugucccuuuguguggauucuguucaggacaccacacuccuccugcugcaggcuccuguccauucucuaucaucucacugugucuaaccacuuguccaguuucaucaagaccuccacccaagggugcuccuuggcaggcguguucuuuauacuuuucuuuaacaaacucuucagacauuucugagguauuccagaaccggaaccuugaaguaagucugucugucugucuaucugccugccugccugccugccugccugccuaucuaucuaucuaucuaucuaucuaucuaucuaucuaucuaucuaucuaucuaucuaucuaucuaucauuggccaagaaauauccuaagaauagaacacacacuugaggucuccccccaagcauguacaaugaggauuccagaaauggccccaguuagacaugaguucaguccucaaaacucacaugaaaaacaaaaacaaaacgaacaaacaaaccaaccaaacaaaaaaacaaaccucggcaccagggugugguacuucuaaucucauuacugaagagguaaagauaauguauauauauauuagcucaaaaaucuacaaauggaaucuuuuuaauauguguuuuucuccagaaauauguaaauuaauaaucauuucauacauuauucaagaaaaacuuauuuuguaucaccgauagcucuuguaaucuuauauaaagauaugcuaauggauuuaauuaaaauaauuaugcugaauaauguauccugaacuuuacccuaaaauaguaucuauuaaucgucaucaguaguaauauuuuuaggcagagagacacucacagcauuaaacugaugcuggauagaaaauucauuuuuuugguuuuguuuuacaguuuguauuaaguuagcauucucaugagaggcauggcaaugaaauuaugugaacuauaaaauuuaucucauuuuuuuuuuuaaccugaacuuuuuuacucauaagaaaacuuuuaaaagcuucugugguccuuuuuauggguuuccuguuucugcuucuggaagguucauuucugugucuucccuguccauuuccauccuuuugacccaguucaccuucuucgggguuuugauugcagaauacuccuaauuccugauuacucagauauuaagagauggacccgauuuuuaaaaggguacguggcagcccgccugucuccuuagagaagcagaaacagcuuuuccugcagcugugguucugugacuggcacuguguaucucuugcuggcuuucaaugguggaucuguguuacaguguacauucauucauccucucggugucugucugucugucugucucucucucucucucucucccccaucuuguaugugcagggagguauaucugcacauaugugugaugcucagaagucagcuucaggguuuguuucaucaggucccaugcaguuuguuuuuuguuugagacauggccucucacuggccaggagcuaggcuaauuagcuauugauccccaggaaccugcuugucuucaccucuucaguaaugagauuagaaggaccacauccugguacccagguuuuuuguuguuguuguuguuguuguuuuuguuuuguuuuguuuuguuuuuuuguuuuguuuuuuaaugugaguuuuggggauugaacucaugucuaacugggccauuucuggaauccucauuguacaugcuugugugggggaccucaacuguguguucuacucucaggauauugcugggccaguggauguguguccacagucugaagugcauucagaauuggauccgcccaucaggauggacagauaaaagcuccacccaggcagugaaccucuagccuggcucagaucugcugugauguuucuuuagcuguauuuuaaaucaaaugaaaagaaauaaugggcuuuuuaaaaugaagcauucgcuuguuaaguuccccucugacuuaaugaauaggagaugagcagacagaaccaaaaucagugggcuugccugcauuccugcagagggccuuccuuucuuugauaaagacggucauaugguagauggccuaugguacuccagcaccgugggauggguugagagagacaccacuuccacccucugcuccacucaguucugucucuugggagcgucccagaggcuguccaccaucucccuccaauuccccacccccagaaaugggugaguggucucccacugugcaagguccaggaagcaaagagcagcugugcugaggccaccauugaggagagcuugucacauucucagcaggccuuucuucauugauugaacuaaaauaauaaaagccaaacaaauccagaagaaaugggaaaugcacuguguugcucuuugagaacucugauaggguggccagguucuaagauuuccacugaccugagacucaggguggagagcucugcugucagggugaauuaacauuuggcgcaucugcaugcuguccuguggcuacuguggcuguagaacuugccagagucuguuguagacugggcauccauuuguauccugagacaagcuuaucuguucauggccuuuuucccuuccaaugcacccuggagucauccuguuagccguagcuuuacuacaugguagaauguuguucaccuugcagaugguggauuccauccuuguuccuaaaugcuagucuggagcccuguucucugucacccugcacugucucuccuguccacucugucauuauuggugcauaugugagcaccgauauuuuucuuugggugucucucuagguaagauugugcccagugucaucugccugcaguguuauacccaugccguauccuuccuguguguugcgucuuggcuuucucuuaaagcagcagcccuuccucuugacccaggaccugaccucagaacagugaucucaggcuagagagagcacugauaccuucugcuaaucuuaggcuaaguuguuagcaagcagugggugcucuggacaaaccccaggauuuauuaaaaauggcauaagcacguugugguccucugccagggggcucacacuggcccaggggugagucaggacugggaaagaggggaaauagaacucuucacuacgggaacauaagauaugguguuuucuaucuuagcuaagggcagugacaggcauggcuggagguggagaggcggguguuguuucagagcccagugaacacaagcucacauucuuuugggagcccuggugguugguauugcuucaaaagaacagaagacauccuucucugugaggagaagaacaagccagcuuuggauuccugccuaugaggaugucucuagguacuuaauagaguauuucuguguccuggaguguaggaucuaagcuagggguggaggcuaggcugauuaacugagucgcacaugagugcgugcgugcgugcguguguguguguguguguguguguauguguguguguguguguguguguauucuucccuagugagaauugagcuagagggugucagagcagaggcaggagccuagcuaaaaggcugaggcauuggaugggguaucucuaguaaggagcaggugacaggggcagggcaaguuuaauaucagguagcuugcagagccuagacgaaaugccagcaggcagugaggaagcagggugcuuggguuguuguccaaguagauggcugacaguccaggcuguggaguaaggaggcacccagagcccagcaggcgugcuuuaggaccggugugaagcucaggagaaagggggagugcacaccaggggugggaggaggugagaucccagggcccacagguggaggaacccccuauggaagagggcauaggcaauagggcgccccauagggugcugagggaagaguagagcgagaagaggugacuggaguccugaggaugucacagaagacacuucaucuuacagcacuuuagaucuguggucucucucuucuccuucaccuuuacuucuucuaagauagaaggucuguaauaauugguccgcauuccagguuaacgggcuuugugacauugcuggccucuagugcccugcuuagcaggcauggacuucuaugcgccucccugggacauccuuggguuggaaggccugggacaaccucacuggggaaaccugguagaacucugucugugacuugacauuccaacuguccugcggaacccugaacugaauggcucaaggccaccagcacaagacagccccgcucaagcccugucuguuuuguggcugucugcuacauacuugggaagugguguuuaugaaguugcugcaggcaaugauucuuuguuggcuucaguauaaaagagcccauccacaccuucccuucuggauguccacaaacuaaacaagacacucuaaaagaccacgcagucagccuuugcagacacucauuauuaaaugucaccauaaauacuuucuaguuuuccagaccaagucugagggaguugaagcagaacauuuaaaaccagaaagaaaugaauuuuauuuagugcccuuuuuccccccaguagaaacacaggguuacuaauuggaaccccuugaucucuuugguguugaaaggcagugcuaauaccugcaaagaacaauggacaccgaaaaucuacagaggagaguuacaggacaaguugcucacuggcccuguauguucucaugauugugugucuacacauaugcauauguguguggaggucacucuucaggugucaugccuuuagacaagaucuauaguuggucugcaauguucccagcuaagcuagguagccaaguauauucuaggggucaaccugucucaaccacccaaucucaugucaugugacuugcaucuggcuccugaagccuuccacagcggagcccagguacauucucuguccccuccccccuuuccuccccauaugcuuccauucuaaauauggacauauaucuguugaacauauuucuagugauauugaaaauuaaggcgaaaggcuccugcauaggucagacugggacauuuguaacaugcucauauuuuucuguuacaugucagccucuguggggagggguuucuauauuuucugccaacuggcuuaugucauaggcucaucuuaaugccaggcaguucugacacuuuuuacagagccgucaugcugucacauggaagaaugccagccacugugacaucccuccauucucuuuggcaguagauugucccucacuuuccccugcaccaugcuaucuugacuuuuccagaauauuuaaaauauaguuauauucucuggccuccuggguccccugucuuccuuagcccagugcgucugggaucugccugcccggguguaacucuggauucuuauucauuguauggauucauuucuugaggaacuuuugggcuacuccuuguuuuuuuauugguuaccaauaaauaaggcugcugugaauuauucuaugcaggguuucuguaauucuaacgcauagggaugcacugaugggucuuguggauucuuccugccucacugcaacaagcucucaggacuguuucuagcuuuguuuccuuauuuuuguauuucgacuagcagcacagagaugcugagcaucccugaagacaauggccuccuuuuagcaauucugugagauggaguggucccucucugggguuugcuuuacauucuccugauggugguggugcugagaucuucuuucuccucacuuccuccacuccugucuccuucccuucaguuccucucuuuucuucuccuuccucccuuccuuucuuuucuuucccccagcugccccugaucuugcaaauacccuugaacuacucauccuccaaccuucuucaacuuggagguucugggauuccaggugugcacugccauaucuggcugugcugagcaucucugcaaacacuguuuauuuacuuaucuuuccuuggagaaggacuucuaccacucuuuugcccccugccccuuuucuaaagugcugaguuuucuuguuuucuuauugaguuucugacucugugaacaugcuggauuggaugaaaaucuuugucagaugggggggggggguucauagccaucuucucucugugugcgacuccugccuuguuacccaaacugcgucauucagagauguggcucuuuguuuugaauguuugauuuuauagacugugcaguuauuauugugugugagaaauuuuuguuuagccaaaagucacaaacauuuuccuuuaaaaguuucauagucuaaguuuucguuugacauuuaacuuuaaccugugcaucaugugugacucuggagugacgucaucauuuggugaaguguuuggagaaugggugccuuugguacaaaucccucaaccauauauauucagggaaauaauuugagaguguuugggcaggguaauacugauugcugucauguuuucugguauuggggcagagucagggguggcacacuaauugcagucauuuuuccaguacccuacauggauuccugcuaucuuguucauuugcuuuugguugcuuucuuuucucuuccuccuccuccuccuccuccuccuccuccuccuccuccuccuccuccuccuccuccuccuccuccuccuccuccucuucuucuucuucuucuucuucuucuucuucuucuucuucuuccuucuucuucuccucccucucccccucccccucccccucaagacaggguuucucuguguagcccugguuguccuagaacucacuuuguagaccagacuggccuugaacucagaaauccaccugccucugccucccaagugcugggauuaaaggcgugcaccaccacugccccaugcuuuugagcuuucuuacagucccuugaagacauucacaugagucggauggcaucagaagcagagcucuguguggcaccugugcuagagucagagauaggaugcgacagagccaggucagaacacugaacuucccuaugcuuucccaagcuggauguagucaacgggaagugucucuagcuucucccgaauucacacuuauagcuaauucugucagcacucccugugaauaagacaaaagucacuaaccugugcugucuguuucuuccucugacaccucucacuuguacacaggaugccuccuagauguaaggauaaaggauguaaggguuacagggcucuguguggcaguguaccaauugagcauauccuugggauugcuagaguucuaucuauccauccauccauccauccauccauccauccaucucucuaguguguaugugugugugugugcgugugugugugugugugugugcgugugugugugcacgugugugugcgcgcgcgugcgugugugugcgcgcgugcgcgcguguguguguguauaugcgugugcguguguguaugcguguguguaugugugugugcguguguguauaugcgugugcguguaugcguguguguguguguaugcguguguguguguauaugugugugugugcgugugugugugcgugcgccugugugugugcgcgcguguguguauaugcgugugcguguaugcaugugcgugugugugucugcgugugugugugucugcgugugcgugugugugugugugcguguguguguauguguguguguguauguguguguguguaugugugugugcgugcgugugugcgcgcacguguguguguauaugcguguguguguguaugcgugugcguguguguguguguguguguguguguguguauacauacuugccagaggguauguguggaagucagagggcaacuugcaggagcuaguucuggccuccuaucauguggguccagagucagggacuugggguuugcuuggacucaggucaucaagcuugacgacaagugccaugacuccacuaagucaucauacuggcccacuucugcuuugaacuuuugcugaaaaugucauaccccuuuccauaauggcugugcuauuuuacacuccuaucuguagugaaaaagguuccugcucccuugcauccucaccagaauugcuguugucucuguucucagugacaaccauucugacuggguaagagggagcuccaaguagucuuaauuuucacuucucucaugucgagggauguugaaacaccuuuaaaaguauguauuggacauucauuuuucuucuuuugaaaacuaucuuuucauuuuguuagcccauuuguggacuggcaguuuuguugauuggcaguguuuuguuuguuuaauuucucacaaaacaaggaauucaacagauuacuggauaaugaaauugugguuuauguacccagucggauuuuauucaguaacagagaaaaauaaaaucgugaauguugcauggaaauggauagauuuggaaaauauauuaagugagaggacccagaaccaaaaagacaaauauuucauguugucucucuauggggauacuagcuuacgauguacucaaacacacacacacacacguuuguguuuguauguauguauuauguauguguggauguaugcacguguguaggagugacuauggaccacagaggagaucacgagagaagggcggaacaaggugauugugcacaggagggaggaagagaggaaggagaccccagggcaagcagagugggggucagucaggggauagaagagaaauggggaggauaauuaauaaaaauucuguacugcaauuuaauaguguauauacuaauuaaaauuuuuaaaucaaauacuugaguggucaggucuuacauggugaauggcagguaacagaauagacucugucccugcacgugagcugugagguucugggcuuuguagaacagggcuucuucaccucuuuguguuagcagccccuuucuccugaggaauuuugaagugaccucagguauccaggaaguugaagcagguguccaaaugaaucagguaccgaggacacauuagaaaucuauuugaaaacaauuaccaggccuauauagaauuuucccauuccuccaagagcaaagcaaauaugcauauuagugauugguauguacuuguuuguauaucucaguacagcccaaagauacgcuaaugagaugcuugcccaggagugguagcaggaaaauaucacaagucuuuccuuccuguaaauuaagccagugcauuucuguaauggcagaaaauguuauuacaguaaaacuacagugauuccuuaacauguaauaguuugggaucugaacuaucuuccuugugcagagcuccugacccauguguggugugauagcaugcccagugcacaguaggcauggugugugugugugugugugugugugugugugugugugugugugugugugugugugcagagccaggguuguagugaaguccugcgauguaaccugggcagacacugccggaaacacccaccgucuccaggcauaaugcaugcuugauuuuugagucaaauuuugggccuauguguauucagaacuuuuaugguggccagacuucuucagccccccauguucagguguggggacccagauggagauacugccuauagcuuaagacgcugaaagacacagaggcgaacaccagagaugacugaguaagauugaaauggucuuucacuaaacgacacagacagcagaaagaugucuuuagaguguaacagaacugcuuccguggaagcccacagaggauuaggucaaaagguauuuuuguagggaacugguauucauuuuguuacaguuagagacaaauauaucugcugagcucacagugugggcacuuaguuuuacaaguuauacuuauuggcguccaguauguuaccuuucccccccuuuggcccuugcauguauguuuaaaggacagaucauuuggucuuggauaaccaauugcuaugcucuucccuaaggaagaccaugucuucuucucuuguguuuuccuuggucgcucauguucuuugucuaguguugaguccccacgagcuuccccauugacuuuagaaugccuguugguguugucuuuguucagguagcuaugguguugagacuacauggguacuacucuucuggaaaagucccuguucugugacucuuauaaucuuccauucucuuuucuguaauaccuuuuuuuuuuuuuuuuuuuuuuuuugcacaaggauacaaaagaaaugcccauuucaggggaaugggauuuuguuuuauucauuugucauugugguuaagccucaucaggaagaagguucucaucuuggauuuucugcagaccuuuaucagaauuacaagauuauguuaauauuugccuacccgaauucugcucaccaacccucuuucugguuugcagggggcagcccugaaguacuugccgacgaucgucaaugaugugaaguugguguuugaucccaaggagcucagguaagcuuccuggaagcaaacauuugcugcgcagcuuguugccagagcccugaguuuggaggaugcuguaggcugccucagaccugccgaggucaaugcccuggaugguguggaguuagugcuguggauucuguuuuucuauggagaaggcuuuaccugucaacagccacuacguugguggugguuguuggaaaaugguuuacaguacggugggacugugauccaauguuagcucuguuuccuugucugucgagggagaaaauguuuauuauggcucacaguuuaaguuacagcccuucacgguggggaagucaaggcaccaggagcuaaaggugguguugcauccacagucaaaacagagaugccaaggaauacaugcuaacacccagaacucuuucuccgcaugaugugggcugggagcccaaggaguugucucacccacaguuaagaccagucuucccauaucaaucuaugucaccaaggcaacccucuauaggcaugcucagagaccugucucccaggugauccuggcucuugucagguugacaguuaacccuaaccaacacagcccaauuuuuccauuuuauauacuuuuacuguuuggguuucacuaugugguggcuggcuuaguuugaauuuucagcacccucaaaaaauuauaugggcucuguucuccucuccugguagcacccacaguauuagggggcaggauaauuuucucucucugagcccuccuaaaugaagggcucugagccacaggccucauggucagaaguugccaccuauaauuuugaugacaaugaggaugacuacaaugaugaugacggcaaccacgaaccuucugagggggugaucauuggccauucagaguggacuauuagccuagggaccagauuuucccuucuccguaugugccccuuuccagggcuuuuuguuguguaauugacagauccauggcuuucugacaagugcuuugaugguguguuuagccuuugauaccgcaugugagcccagcagcucaguacacccgcuuuauguuugacacaaugaacuauguguaggaaauagcaccauuugcacuaaccagacccuccaaauaucuaagaggacauuugucccugaggagucauuuuuccuucacuuuauauccaccuuaagccauuaauaucuugaaauugaagggccaggggcuccuggacaguccucucucugauuugccugagauuuaguguccaacagggacauacuuauuuccugcuuccaaggcauugacauuaggguucuagcuuagcaggcuccaaauggucaaagugaaaccuaugugacccccgauguuggucuucccagcuguguuucugcaagguccuuuucuuggaguguggcuuuauaggguuuucccaggaccagccccacacaugacccuuccacuuguucgaugucaaauccuaagcccuuccugaaucuucuuuagacaugacagccuagugucuaguuuucaugaaccuucaagggauccaaguggauauuugagaagcacggggcugacgacagugagaggauauggagaggcuugucuguugugagccagagccaugaccaguccuguccucgauagcccauggagggacacuaucccugcuugggauuggcaguuguaccacgagcuugaagcucugaggaagaccuauuuccccugggccaugugccuucacucucugcucugugccuacaugagcuucuuuaaugccuucuauaccaguuuuacaaaugaccuuaaaaucacagacacacacacacacacacacacacacacacacacacacacacacaauauuuagaaaaucaauuuaugucuugucuccuuuccauguguuuguaugugugugcaugcucucaugaguauuagaagagccuuguuauucauuguauaugugggugagugggcaggcacaagccuguguguguacguguguguguguguguuuguguguguguuugugugugugucuguguaagcccaauauugauguggauuuuccucucuguugauuuuucaucuuguuucauuguggcagggacucucaaucaaaucugggguucaccaacaagccuauuuuuguuaucaagcuuacucugaauucccccccaccaccaccaccuugggauugcagaugaguguucacccucugcauugggggcagggauacuagcacugaagugaauucuaggguuccaaacucagcccucuugcacauacacucacauacacucaaauaaacuuacaugcauacacucccucacacauaugcacccucacacauacccucaaacaaacauucugucacacacucacugacacguauccucucucugucucucugucucucucuguuucucucuguguuucucucucuguuucucucuguuuuuuucucucucugucucucucccucucucuccucccccuuucaggucagugguguuuuuuuguuuguuuguuuguuuuuauaaucugcgucugcacuuaagauaccuuguuuuccugagaugaugucuuccgugugguuaguuaggagugccucugaugccaucccaucccaugcuggaccaucauguauuuaaacuaccauaggcaucugcuaggcguucucacaaaguguugugcgugcacagagacugcacagagaccugguuucauguuagccuaauuuugcuugcccuugguaacucagcugguaagugccacagguucaaggugaacauggucuuuuugauuacagagaacaugcccuaguugacuguguccaguuuucaucaugacagaauaugcuaggauauuugggcaguugcucacuuuuuggguacuauaaaaaugcuauuuuaagucuuguacaaguuuuauacauguguauauauuauauauuauaugauauauaacacauuguaauguguuuuuacauuuuuaggaaauucucagacaaggccccuuuccauuccaaccuacauagcuugaaggaucuaauaucuuuacauucuuaccacacucaucauuauauguuauuugaauuuuacccacucaaucuauuguaaaguacaaaccaauguuuuaaaacacauucucaggguggucuuugggccuggauucuauuacggccucuaucaauccugguuuugacauuucaaggcucuuucccacccugcugauugugcaccaucuugggacagcauggguugcucaggcuggcucugcuucugaucagugucccuugccuuucuccucauagcaaaauguucacggaauucauccugaaugucccugcgggcuugcugacgguccagaagcucuccugccugauugagauuguucacagugaccucuucacacagcauggugaguggaucccugggacuuggcaaauugguugguuguucacuuaguucuccuaguugcccuaaggagcagaggugccucucaauucaaacagcuugccugcucuaggcaggcuucagcccuuucaagagaagggcaacuguauagguaauaggccauugagaguggagggggaagaguggguuuguaauuugggagcacaucgguguccuguauaaucagcauacauuguagcucuuuaaaugugccauugucuguccuggggaggcaaucacuuacauccuagcggugauugcgagggcgaaaauauccaguuuuuuuuuuuuuuaaauuuagaaguaauagcucugucuuauuccaacuccugguuuuugacagggcuuccuccgaucucguuccgagucaugaggacccuaaagacucuuguauccccaagaaccuucuaucccucuucauuagcuucuccucccguuugauuaaucauuuucuauuuggacagauugaauuaauauuuuacaccugccaagcaauuuuauugaaagcucaaaaccuuugcauaaucuccaaccucugucauuuaucggggccgacuugaggucuggugggugacagccugucucuguaacacagauuuauucucuuccauuugugaccagacgguugguggcuccauucuucuccuucuguccucaagcacagagcugcuucuuuucucccuugggcuguuuuggugaaagugcuguccccgccaguccugcugcugugcugcugagcuguguguuugcuggcucgucuguuuucaucuaacucugagaccgcucuggcauguguauaggggucgggcuugguucuuuaucugaguggaaguguuccacccucuccccuaaaaaaaggaagagaucaaauguggugacuuucugaagcaccuuuccccacucuccucucuggggcggagucccuuuauaucauuuaugaaaguccucauugccuaggacuugagucacaugaucuggauggagcucuaaguucugacaucuguaauucaggcuuuuacucaacaacgugaaugguuugauuucugaggugucuucaaaagcuacgggauaccauggugcccauaaaaaguugcuaagaaggugaccauuggggacauugcaaguaggccuucccuuguugacuacaacugaagcuagaacaaauacauuucugccccgauuuauauuugagucuuauuagguuucaucauuagagaaaugugccaauagccauguauauguaugcauucucuccucaauaucuccguacucucacauacuccacccacauuccuccaucccuaccacacauacaggcaacuagcacucuuucguuuuuuuuuuuuuugcugcugagauaauaacuuaacaaaagcaucuuaaacaagaaaggguucauuuuaaugcacaagucaacggcacaguucucucugggggaaagauggaagccacuggucacauugcagcugcaggcaggaagcagagacagauagauccuagggcaugucuccuuuucuccucuucauguauuguaggaaccauggucagaagguggugcugcccacuuuuagugugggucucccaucaucgucacacuucccucacaggugugccuggaggcuugccucccaggugauucuagaccuugccacguugacaacacuaagccccauaccccagacccuucaugccccacacccuucuaggucucauuaucuucuccccauaccaccccuguaccccuagacuuuaauaccccacucacgcagccuggauccccaaucaccaucacugccaucaacaguaucuucacugagugaauacuuauugccaacugagucagucucucucucucucccucucucccccucucccuccccccaucucucuccccaucucucucccugucucucucucucuuccucugucucuuuucuuccucucucuuuggauuaugaaauuuauuagguaauuuuauuagguaauuucagagugccacacuaggacuguauauccuaguacaaguaggguuuguguucaaagugguugugaugaggggaccaacaccaggagaaccagaggaggcauuugaaaacauaauugcccuuagcuacaguaguggugacaaguggcuucauuggagacuauuggcagguguggauauauguuuggagaaguacuucuguaguuuugguggccacagugcaggauucuggcucuggcagaauuuuccaucacagucaugaugaggcagucuuguauauaaacaccuccuuccuuaccuucugguucuauuuuauuuauuuauuuuuguuugaauugacacaacagcuuccauucugauccuaaaaugcuuccccuccucuuccuccuccuccuccucuuccuccuccuccucuuccuccuccuccucacuuugguggagauuuucuucugaaaacauuguugaucgguguauuuagaacuugauuagcugucuccuggcggacauucuaguuccucgucugaaccacaucaaagcagaagugacuggugauggagaaucaggucacgcccacuucagucacucaggagcaauaggagacuugagaggaguagcacccucccuggaauucaugguuaaguucagccugucuguccuguagguugcuaaagauugggcuggcuuauccucuuaagagagggagggauuuguguaaaaucaugacacacaacaagugaaggguuaguagaaaauauaaaaugaagcccaccagagcaaaacaaauggcgacuuucggagacaucaucuauccuucagguuauauuaauuuuugucaaagacaaaccagugugugagcuacacagcuuauuguucccagagaguuguguuagggguccuccaaccccuacccuaccagaaucuaauucuaaauguuucagagaagaaucaacacuaugacugaaaaaaaaccacauaauauucauaguuuaaucuuugaugagaguuuagcaauugacaugguuuaguuauuuuuauugcacauaucauuuuaagauaacagucaugacugacagccucacaauaggaccuucaggcuuuuauaaauuuuauaugaucuuuagaacauuuucauuaaaaauaaauaccaagcaucaugggaaaauaauagucauuuguuuauccagcucuaaaauaaucacucaaaagacucuaagacaaauacaaacuuaauaacccuccagucuuguucauaccuguaaaccuagcacucugaaggcugagguaaaauugccaugaguucuaggccauucugggaaacauugagugugauacauugucucaaaacaaagaucccaaccagcuagcuagccaugcacacugagcagccaaccagccaugcacacagaacacagcagcagcagccuguagugcucuuaagauuccuugucauuauuguccaccuuccuaucuagagcaacacagccauuuuaauuuuuuagcagaagguuuaaauuuucaucaaauuuuuuucaaauccaaaagaaucuucuuuuuaaauaucuuuaaaccaaaauauaucuuuguauuuguuguuguaacuuucuucauuuuuuucuaacucaaaagcucuuuccuuucuuaaauuugcauauuauauuacuccuuaaaauguucagaguuauauaaaauuagccccuuucucaauuaaaaauuuauuuuuaaaaauucuuauuguuuggguccuuuuauauauaguuacaugugugaacuagaauuuucuauucuucauagcuuuucuuuguagcaagaaguuagacaggaggccaucuugaauugacuuuccuaucugcuaaugauuccauuuucucaguuucuuuuuugcuugcuaugauaaaauacucagagaaaagcagcaaauggagaaaaggaauuuagcucacagguccagguuuuaguccaucaugauugagaaguugggccaccuggaguuuaagcagggggccacagugcacccauagucagaugaaaagaggaauuaacacaagcugagagagcucagcucauugucucugcucuuacauccuagguccuacccacaauuaacauggauucucccauaucaauuaguauaaucaagacaguaucucagaagcccaaccauaggcuaauucaauuuagccuagugguuuucaaccuuccuaauguugcaaccccuuaacacaguuccucaugucauggugacccccucucccccagccaagaaauuauuuuuguugcuaauucauagauaugguuuugcuaccauuaugaauuauaauguaaauacaugauacacaggauaauugauauguaacccccgugaaucauuguuggaccccuccccaaaggcgucaagacccacugguugagaacuguuaaauagccccacacccagacucccuucccaggugauugcaaauugccagguugacaauggaaaucaaccauuacacccacauauguagucucuccaauagagcauaugaagacaaauacauuuuaauuugcacuuacaaauauuuccuccauuuuucuuaauuuaauaauuuugagcaauuuuucaugguuuucuuaagaaaacugagaaaucucauacacuuucucacagcuuuuccccccacccccaaaggaaaaagugaaccugacauuucuguucucucuacauaggaagucauagucaagguuauggucuucucuguguauuuauucuuugaucacaccuauugcuguaccuugugguuucugagagaggcuggccuagaacucacagccugcagucaucacccuucacaagcugggaucacagguuccauuaacauccaagauaggacaacauaccccaacccagccaugaaaucugaucaagcauguuugcuaacaguccagaaggcaacuucaguuuuaauuucaucaacaguuuggugagacaaaguaauauagaauacaaacacacuuguuucuggaguugagucuguguucuauuaauaaagauauuauggaacuaauuaaggugaccuguuacguuauugaacuucaacauugcuguuggccaucuuggaacaacauuuucugucgaggcugcucccagaguaacucagauuagaaaggaucuuuucuguguuucucuuuccuuacugaccauguuuacugucucagaguucacgagccuaacugaaauuuaaaaaguucuaugcaacauuggacaauaaaauuauuuugccaggugucauaaauuauacugcuaugaauucuucucacguggcagguagaggaaguagggucauacguacaaggucauucuuugcuacauagugaauuuuaguccaugguaagcuaugugagagauuuugaaaacuaacaaccacaaaauuauauaaaguugacaaaaucaacaagcagaagaauauaaaaagaaccauauugaaaaguggaagaagaaagagagacacacauuuaaaugccuuuguauauuaacucuaauauuacaaucuaagaauaauauucuuagggguacucacaggaauuuagauaugcagaagaaaaaaaacuguuauacuacuuagacaacugaugcaggaggauuguuguauacuauagaccagcuugggcuaugcagagauaacaugucuccaaaaaguacuaagauuuuuagaacccaaagggauuucgccauaaaaagccucuaaggcauuacccugagcugaauuggauuaaaaaguuaaggagaaauccuaacagaccacaguacagaggccaugaugacccauuccaaaccauccccagaaguucuggggucacuauaguggguuucaauuaaauucuguuccaaagcuguuaccuggacuauaggcaagugugaauuaccuuguuguaaacuugcuuauggauguauauuugcaacagccucugucagagucuugugauaguuaccauaagacuaucacguauuuguggcauguguguguguguguguguagguagguagguauuuauguuuuuccuuauauucauguguacgcauguguguggcggucagaggucaacuucaggugcuguuucucaugguacugucuacuuugucaucucagucagguucucuugcuggccuggaauuugcugacuugucuagauuggcugguaggcaggcccuaggcaucugccuuucccaaccuucccuguauuaggauuuaaaaaccauaccacuguauggagguuuuuacuguggaauuuuggaauauuuuccucggguccgcagcuugucuagcaagcucuuuugcugacuaggcugacuccccagccccagccaucaagcaaccaugucuaaguacccuucccucacacccuucaggccucaucugcuaguucuggguuuucauuggggugaaucccucuaucccgcuucccaaagcuccugguuuccauguaggcaaugagcgucaacugugagguaccagugaaauguccucauguccucgaccuccgcugagugcuguugugagggacaccuuaguuacauacguuaggagauauuuuuuuuuucugaacuugugccuccuguugaauaaguaccuaaaacauucagccuuuaguaacaaauauguaaagcagaaauucuccuagggauuuguuucacgggaaauguuccucccccuuccuccccguaaaacguucucucuuucgucagcuacugggaauccugaaggauccugcugcuugugccuggugcuccucucacccuggcucacggaugccugacuaccucuucccauuuagcugcacuguuuauuuccgcuucuguuuuccgagucucauuuucauacacugucuuaggucuuaauugaaccaaacaauguauagaugauuugaguucaaaaugaguuaauacuaaccuuuaaaauaauccauuguuuuaaauauaguggcauacuuuagucuguguguguguguguauguuugugugugugugugugcauccauccauccaucuguauauaugagugcaaaggcuagugugugaguuugugugaguauacauacaucugaauguauaagugcaaaggcauguguguguguauguguguauauauacacaugcaucuguauauaugaguggaaaggccuguguguguguuuguguacuuguguaugugaguacacaugcaucuguauauaaggugcaaaggccugagagugcauauguguguguguguguguguguguguguguacuuguacacaugcaucuguguauaugagugcuagggcuguguguaugugcgggcaggcaucuguacgugcacacaugcuucuguguauaagaugcuaaggccucuggugagugugugugugugugagugugaaugugugucuguaugugugcacaugcaucuguauauaugcgugcuaaggccuguguaugagugugugugugugucuguaggugugugugucuguaugugugcacauguauuugugaauaugagugcuaaugccugugugugagugugugugagugugcacaugcaucuguguauaugagugcuaaggccuguguguaaguguguuuguguguugugugaguguguacguguucacaugcauuuguguacaugagugcuaaggccuguaugugugugaauguguguguuugugugucugaacgugugcacaugcaacuguguauaggagugcuaagaugugugugugugugugagugugugugugugugugugugugugugugugugagugugucugugugugugucugaacgugugcucaugcaacuguguauaugagugcuaaggccugugucugugugagugugugugugagugugucugaacgugugcucaugcaucuguguauaugagugcuagggccugcgugugaguguguaugugcaugugcacaugcaucuguguauaggagugcuaaggucugcguguguuuguguguguguguuugcgcguacacaugcaucuguguauaugagugcuaaggccugucugugugugagugugugugugucuguacgugugcacaugcaucuguguauaugagugcuaaggccugucugugugugaguguguguguguguuuguguguaugucuguucauguacacaugcaucuguguauaugagugcuaaggccugugugugaguguguguguguguguacauguucacaugcaucuguguauaugagugguaaggccugucugugugugaguguguguguaugugugaguuuguacuugugcacaagcauuuguguauaugagugcuaaggccugugugugagugugugugucuguauguguacacaugcaucuguguauaugagugcuaaggccuguguuugagugugugugaaugugugugugucuguaggugugugugucuguacguguauacaugcauuguguauaugaguacuaaagccugugugugagugagugugugugugugugugugugugugugugaguguuugcacauccaucuguguauauguguucuaaggucugugugugagugugugagagugugugcaugugcacaugcauccauguauaugagugcuaaugucagcaucagacaccuuucuccaucacucucuaccuuaccuuugauacaguuucucaccaaauaugaaauuuuuuucuuuuauuacauuuugucauuggccccuagguaccuuccugccuuugucuuccuagcucuggguuugcuaggcaccuguggccaugcccagcuuuucaugugggcucuggguccucgugcaggcaaggcaagcacuuuauugaaugagccaucucucccagcccugccuugaauuuugaucucuauaguaaguuguacccagccuaauaagugacauaugugaaguguuuuaacccacaaugaccuuguagcccaggacaaaaucagccuggagcgucucaccuugcagccaaucagcaucugcugccuauguuagacuccgcuuccuaaaaguguucugaccacugaguggcugcccucaaaccuuuucgaaugcuuugaccaagaugaaaauucccccauuuauggguuuuggugguaagaaucuuucuguguugggagagcacagaacgacaccauuuuucucauuugcaggcucugcccucccaagcagccaacugcugucuucucuccuugucuggaaaagaugaacagcugaaaucuucuggcuggucuauucucacaaagaugccauuacuuuuauaaaguaguccgugccacauuuguauaaauauuuaaagucaagccauuuucggaugagauauggcagcuacgguuuucaugcuuucuucuccgucuuggguccugauccuuagaacuuuguagaaguuggcuuugccacccacucuauggaaugugcugcacguauguggcaugcucccagugcaauagugauagaauccucgaggucacugugggagccccagggcaaaggcugggcuucagccuaaaucaccuccaguucugaaccaagcugagaacaagaaaaugacucacuuugggcacuaauuaggguuguucucugggaaaacagcuucaagcagucuugaagauguguuccagguuucucggaaugguugccguacuuacagauuuacacucgcaagggauugugauaauuaauaccuguugccagccaggaauuguacucagugccagcuuaagcuaagcuaucauguggaagauguaugagcacucucuugucugggguguuucgcagcaagaaacauauuuguacagauaacuagaggggcuguguuuccagccauuaaagucuggccugguccuguggucagcaugccuguggguguuaacuugacaguacauagcuacagcagccuugcuuuaccagagugagcuguggacucucacacacaaguuccugggggcucagguuagugaaacccaggcuguuucccgcuuucucucaccacgucucccauucauagacagggaaagggaagauauacccaguggugguggugggguguugggguuacaacgagugauagauagguugucacaggagguugugcuauaugaacuggcguuggaggccagccuucuucucuguuguauucuguucuggcuuauggauuucauggugucaagccccauaugggaggauggaccugccucuggguucaguauacuuucaugugggaaaaaaagggaggaaauuaccagaacauuaaagcguagaaugaaggcuggaauauauacuuauauccccacuacccagcaucaauaauagugagcucacagucagacucugaagcuaauuucagacuauacagugugugccuagauagcaauuacccagugaaugacauuguuccagacugaagauguagucuaggucuaguucuuauguuggccugccccacccaucccccaucaucugccuuggauguccuguuuuugcuccuaugccgaggugaagggccuugggcugauuaacaugcugugcaugagagccaaugaaugggcgguaauggcuuccgagccuggucucugaugugacuugccuacuugaaagcuggcuaaacagauuaugugcugcgcagagugaugacucuugaauaucaucugugguguggcgcgagcagauuuucaaagcaagauacaaagagagggaaagguugacaucucauaauuugugcauuuguggcuuuguucccaugugauuauguuguugcccacauaucugacaaaagcugggaaaaauuaaagcuuaaauccuauuacagaaaugaaaaguucuaguguaauuaaaucaaacgucggaacugagugugggauuuaugcccacccaacuguuuuuauguugaugguaugggaauuggaauggagugaguccaccuggcuagcaucacuguguaaccuagucaagaggacucccugugcuugcaggggggcuucacaaaauggagguucuuuuuggaacuuucuccuuguacucauacuugcucuucuggauccucgacuguggggaagcguucugauuaacacggaauaguuuccuuguuuucccagacauagcuuuuccauuuccccacccugguagggaccuaggugauugacagguuucauuuuacagcuugauccauguuuuuucuuguaucugugcuuguuugguuuuagaggggagugugagaucggaugagucacgucugaccauguuugucuuagaguguaguagcagguuuugguauugguaguguuuuaauacccuggugguuguaaaccuguuauuuccuggcagggcuuugguuuguuuguggcuauugcuuuccugguggcuggauucuugcugugagcaggacagggaagggagccugauggucuuauacuccuuccuucccuuuagcagauagacccuauccuagcuggguacccugguuccagguaaugcuggguagaauagcaagcaagucuacguugaguuccugucgcugagcccucagugauggucuguggccugcaaguguaaucuaaauaaauccugugcuuuccagguuccauguugacagagucuuuuaucacagcuacggaaaucaaacuaagggcagacuccuuguccaacagugcucaccugcccuguggaaacucauguauccuaaguucugaauaauaggaagccucuuuaaaaugcagggcaagggaguuuaaaugauguguuucacucuucuuuucaaggugaauaauucucucagugaucaaacagaguaaaacucuuugcuaaugguggaagcauucguuauagcagucuuucgaaggcccugggccaugcccacauacuuaacaggacuuugagauuaggaaauagugaagucagagugcccuucacaguagccagacccuacauagaaagcaucuaucucuaaaaacugcccuguucaucuauuucugcugcguuaggucauacacacgagaaacuguguauucagaacguaauaaaacauauuguuuuaaugcuuucaucuaccaacagaucaaaacaguacuuauugaguuuuucuacugugaaaagccaaaucuuaaacccugaacuauucuccaguaguuuuguuaacuugauagauguuguacacagaggaaaaauagggguuggggcuaauuuugccacagucaguuaaugucccacucauaaggcauucuggaacacuuuaauuagauagcugugcugaugacuucuaaugaauguugccagcugcgaacccugaaaacuaacucuuuuaaauaaugcuggaauauaaacaucccauucucuuucaagcuuccucccaacccccaugccucaaggaaacuuucaaucuuuaucuguuacccaauaccuuuuccaucccucgcucuguaggucucucucugugucuuucauuauauguguuuguccagaggccacuuguuacagcaguacacacuuuuagaaauagcuuauugaauacaggaguuccuuaauuauacccauuugaaguccaccauaguuuauagaucaccuaacacauauucaggaguuuuaguuagcaaguuugauuccucugagagacugcagagucauaaacauacaaauguagaguuggcaaagacuaauuaacucaauguacagaugaaggugucagaguuaaauaagaagcccuguauguaagcagaggcccaggcagggagcuguccagcacuguggugcugauuaaggcucuggcuuguuucagauccaucaucugcacacuccuaaaacuguuucacgcccacugcaugaguaauucucucugaaagcugaauuuucuucaacgcuauaugaaggaaggaaaaaaauuacaaauaaauggauaaaugaccacaucuguaaauuaagcauaaauaaaucauaugguaguguucuuauaugucuaugggguuuuaauaguauuucucuucucuuucuguggggguggcaguaguggggguuguaguuucugaacagauugcuagagccaucaacucuuuaugguguuauuaaucuacauauuagccucuguugacccuacuuugagcccacugcugccaggcuccuguuucuguucuuguauuuagauguaggaagagcagucuaagaacuggcuguccucauuuguuuuguaccuaaucaugcuaucacuagguacauggaacgcuugauucugucuaggccugaacauuuagcucuuacuguuaucagauguuguccuggaccaguggaaagucugcaccugccaggauuuugugucaugacucuacccugcaacagccauuacauaaaucuauugcuaagggcacagaccuuccuccagagugaacugccuucaucugcaauuucuuaacacucaucucuauuugcuagcgccaccaagaguggcaugugacucugacuaagugcugugucuggccaucuacuagaucagccagcagcaugcaccacccuacccaucaccuccagaccauggauccugugucuauuuucuucucuuauauguugagaaucuuuccucagggaagcagaauuguagacuuccuugucaaaucaacaggcuuccucuuugaccugcuucucuuuacuuagacaguagacugcucacaugaccauauuuuccacacaaucuuuccuucuguucuauuucagucuaggcuuugugcguguguguguguguguguguguguguguuugugcgcgcgcgcgcguguauuuacauggacucauuuuguagccuuuccauugguuuuucuuucccaucaccuaaggagacgucauaccuacagcaauuccaguagaacgucuacuauucuguuguacuucuccagucucaaagguuaagagggucuacugccuaaugcucaucacaaacauuucuucuacuaugcaaggucucaugcccaaacacaggaguaauauauuuggccagguuuuaaaauguauuauuuuacauuuauuuauccuucucugugugcccacacaugcaugccacaguguguauguggacuacuuguaagcauggguuccucuuucaaccuugugagccuugcagaugggauucuggucaucagacuggguagcaauugucacuacccacugaguuuugcuccccauuguuuaacagucuucaugccucucugcucgucuuuccaauuuccaaagccucuuacuugcucugucauccucucaauuaaaauuccaugacauuagguaccucaaggcugaaucacagauugacacaucucugauccuuuuagcacacaagcaaguggcacuguucugaccagaauacuuuacgaggugcugcccagcugucaggaauggaaauguuggacuagauaucuguauaugcucaguucugcagaucugcaaacaacauuccaaaacgguggcuugcugguaguuucuucuucugacacugcaagcuucguaacuucuuacuuacaaaugacuuuggaggaaguggcucuguacuugacauuuauccauacccacaugggugugcacaggcacgggccuuuuaucaccaaguucuuugacuugggagugugguggcuaaugccugcucagcauuugcuuagcaguacaguugcuggcuguauuugucaccauguuccagguuccugcaucuggacagucuggagaucaguagauggcuucugcgaccccuucuaggacagauagagucuuugagccgcugcugcuuaaagacucguguagauggaggaaaucacuugaacauauugaaacacgggcacaggguuccuaaaugguagggaaacaagaugauugucuauaaaagaugaauagcaagcauuccccauuaauauggcucuuacuguuuaauucucauuaaaaguguuauucuggcuuucgguucuaugcagcacacacaagguuauuaaaugcacuuuauggaucauuuguuuaaugugaccgaacuaaaaauuaagaagcacauuacucaguguucauaaaaaugaaugcuuuaaauggacaaauucauucucauuuuugugucuuauuuuaauguagagcuguaaugggguuauagacggauauucugcuuggacauuuauaagccgaugaugccuguugaauaccuuuuauaaagauuaauauuuuuuacucugugcccauuaccagagcauuaaucauccuggcuuuggcccucacagcugcagaugagcagauguugaaugauuggagucugugaccaucacagaacguggcgaagggagugcauggaaggugguuggugucacccucauggcaauuuguauagaauguggguccauagcaaugccuuccccuggccuggguucugggaugaguugccauccuugauaucugaauauggcagaauaaaauauagcagcuaugcucuuugcuguuaugccuccaguggguacugacagguaugaagaaggccugggcccuccugugauagggugaguggucugaaagcuguggccuugagcuagcuucauucauuaaagugaagaauuggaggggcuucuccucaucugcuuucuuacggccuuagccugugcuucccacagacauagacgaugagcccuggauaucauuuuaaauucccuaguccucagcaaauguaguuugaagcaauguaagucagucauauauuuuauccagaaugucauugcagucugaauucuaucuaaaacucacuaaugccuugcuuuauauucuuuuauccaugccgagucugagaaguucauuguguugugacugauagcacaauuuaaaugcuaaauucguacucuaucugagacccuggaucuuuagucuucaauguauaauacgauuuauuuuucuuaacaguuguuugcaguaacuagauuaaacaccacuuuuaaacaucugaacuugcaauucauuuauuaaaauuaaauccagcucuaugguuguaaacauacacauuucgaaggcaguuugacaagaugaccauuuagcaaaauaguaauagaaucugcccuagggcuuguuaccuacacagccaaggacuuuuggccagaauacagugcuaggcaugaaauuccuuccugcugaauaauccugaaaucuaaucagaaugcaguuaauuacugcauagcagcgcugcugcuacuauacuaguggauccaccuuacauagaagguugguauugucguauuaauagucaaucacaguucuccuauuaaugggggagaugcucuccaggccccaccccuuacugagggucuguuaaaaauuguuagcuucuggagagagacauuuuuuaaggggauggucacuggcagguuuucuuugguccaauaauguugcacaccuaugcgcaaauggaaagugcuaauugacuuagugucuuagucauuuguucuauugcuaugaagaaucacuaugaccaaggcaagucuuauaaaguaaagcauuuaauuggaggcuugcugacaguuucauaggguuaguccaugauuaucagggcaggaagcaugcgggcaagucuggaggggcugagagcuuacguccugaucugcaggaagaugggggagagaggcaaggagggagggagggagggagggaggcagggagagagagaugcugucuuuauauaggcuuuuaaaaccucauugcccacuccccagggacacaccuccuucaaaaaggccaaacuucuuaaucuucccaaacguuccaugacccaugaaucauauauucaaucauacaagccuaugguggccagucacaucauaaaaggacagaugauauccuguaggaaggggaguuauugugggugaugggggagagggaaggaauaugcguauacacagauaagagucucaaauaaugagcaaauuaaauccaguuguuauaaagucuaccccuuggaugcaacaauuuggcuucguguccacugaccaccauccuggaccgugcaacugugaguucuuagugcccauuuucuuggggaggcauuguauugaccacuuguguucuuucuaagagcugguguuuacuccugcugacuaucugcuaaguucauauggaugaacuuaucaaaagccuuuuuaagaauaucauggcauugcugggcggugguggcacaggccuuuaaucccagcacuugggaggcagaggcaggcggauuucugaguuccaggacagccuggucuacaaagugaguuccagggcagucagggcuauacagagaaacccugucuugaaaaaaaaccaaaccaaaaaaaaaaaaaaaaaagaauaucacagcauaucagucuugugggccugcaucccacaguuauccagaggcuaugugucaaugguugauuugaaacauguaaaacaaauguguuuuuccuuuaauauaagcuuauuucuuaauugugcugggaacagauucaggcuauuucuuuuguauuacugguuuucuggauaugauauucugucuuugugaaaggauauuggucaugcccaguuggaaugcccacuguguggcauuggagacgucugucauggccaccauagguuguaaaaucuccaggcaugauggagcauguacuuuucgugcccuacgaugauuuaacauguaagaacauuuaacuucuguagauugaaauacagaucagggaaagacccauuaaacaugaacguuguucguuugaugaauaugguaugguauguacuuauaacucuaaaauuuggguaacugagauaggauuaugaguuggauucauuccagccugggcuacauugaacguuuugucaaaauaauaaaguagguuuuuuuguuuuuuuuuuuuaaauaauacuuaauguuauucugugcuuugggagcaggcagcagaauagcuacuguguggguagauccagucuaaggccaauggaaggcauuaauuuuccugcuguauauucacucaaagagccuggccuuucauaauacaaauugcacguacaauaacacaaauuauaaaaauuauaauuucaacagcuaguauucauuaagggcuggguacaguacuggacaguaguucugccugcacuuuagucuuccuaugaucugcaugcacuugcaaaguaaagcaaguuaacacacaaaccugcccucuuguucagcuguucgcuauuguccagacgggcucugaaaccauccagucaagccagaaacccuguaagauggaagcauucuuguugagggcguuuguccuuccgcugucugccaagguuggggcugggccucuguggauggcaaggccuucucaccacuuagcaggugcaaauuguugugguucacaaguaaaaggaacacguaugguaguccauaguaacuaacucaccucuaagggagagaaaguaauauguguguguguguguguguguguguguguguguguggcgcauacacacacacacacacacacacacacacacacacacacacucaggccuuggguuuacaugcugagauuauuucuuuuauugaacaggaaacucuccucucaagaguuuacugcccagugcaaagaagcauaguuaaugccguccguauuuuugguggucugugugcguggaccuggagguguagaucaugacucuuuuggccuauguucccaacaguuacucgggacauuggguuucuuccguugaggcacaguagguuucugaugacacagugguggacaaugcuguaagcuacaguauagucuuggaagucugcccuagaucacuggguuggacaguauggccucugcccuucagggccgucugacaaaccuccugaucuaucuggccgauuugucuaucucuguucagauguggagcugaaggcggagauaauuuugugaugaugguguugcugggccugggccucuuucuuagagcaucagcggagagugauuugugucaaguccuuccugagacaccaucucccucugucuucacaauuauagucuucucuucucgauuuucccagcacagcuugacacucaucugucaagccaucaucauggccaaugacuuuuuaucuucucagagaggucaguggaggaaauuuuucugcucuuggauaucuuguuuuauuuuuuuuuugccccaguguaaccuaggcuaguguggaucucauuaaguagcucuggcagacuugaacucaaaauuguccucuugucuuagccuccugaguguugguauuacagauaugaggcuucaaguccagcuuaaaauaguuuuaaacaugacaaacugucaguggaguugcuucucaccaagacacagagcauaauagccaacugaaguugcuaagaccuagugaugguugcucccacaggggaaccuaacauggugggcaguaccuccuuggcugagaugagugugcagaauugccuccuucacccugagguaauacugacaaauggaauccgcacacgcagucagcucagagaacaguguaguccacuacugcuuucccagcagaauagauaacugggacuguaaggccaggucuuaggcugggacaacuguuuucagagccuaacaaccaguucucauugaaccauucagagacagauccgugcuggccaguucacaaagcuuucuacucauuaugucuuagcacagugguuaaaucuauaaccccuuaaugcagcuccucauguugggguaacccccaaccauaauauuauuuucauugcuaccucauagcuauaguuuuguucucauuaugaaucauaauguaaagaacuguuuuuuuguuuuguuuuguuuuguuuuuuccucauggucuuaggugaccccuguaaaggugucaaaaguuacagguugaggacaucugccuuagaagcucugccucuuuuucugagucaccuuggaaauucaugugaccuccaaaaugguggcagucacaggagaguaacuagauggacaggcauagcucagagcuuguucuauguugaguugggcacauagaggucauguguucccagcagaagcuaaagagggcucagcuggagguauucaguuggcgcucucugguagcguccaucaugaacggcagggcuugggcauuguucaccaagggagcauuuuagguacuggucuggaggguugcugugcauuaggugucacauacgucucaaggcagcagauguaguuaaaaugaaggugguuguagcuugugaacauugaagcucuauaggaaaggcaucugcgguauguuguugauagcccguuccaggggccauuuucuuguacuguuuuccuuggauagucuaucuuuggccaguucuuacaucuugaguggcagcauaccuuggcauauuggaguaugugucuuaagcucaaaagggcgugguccuaucagcaaaacccuucuauggggucacuggaaaggauucuguggggaauuaggauuacgucuucccaacacuggagacccaggcacaaagggccaacuucccagcucacacagcacccuugcuaugugcuguccccucugccccuggcuuucugcaggauucuaggcagcuccuggugucauguccagcaguguuggccugucuuaugcacuacaucugcacagugguugauuauuaaaauguggugucaauagggaagcaaaauaugcauguuagauuaccuagguuuuccuuuguuuguuuaucuccaugaccaaauaucugucaagagucaucccaagggauuaagggauucuuuuggccugugugccaaagucacuguagcaggaacagcucuggcugccacucaucaccacaucacauuugaacagaacagagagcaaaaggcagcgacuccggccacagcugcuuuuuaaauguucucuuucuuauucacaccuggaccaaaacccauccuacagccccucccauaaucagagacagucugcuguccucaguuaaagcucucuggagcaacccucaaagacaaugcagagguauauuguugaggucauucuaaagccugacaaguugucagugacgauuauucaucauguauagaugcaccgggccauuccucuucuggaauguggaauuccuccuagucucugucuagggggaagacccaaguggaaucugggaaugcccugguugagcuaucuaugugugucucacugggagaccauagggcagaggggcuuguguuauuuauuugauucuuccugccuugccccggaagggacuuccucccaccucuccuuaaacuguuguucuugggagaguucagcaugggcuuugagugcagaguguguuucugaagguguggaggagcucuuucauuguugugugugauuuccuuuuccuuccguaagaaaacuccuggaacauuaaugcaaaacaugcuuuuauguaucauuaaugucguaaauucuaaaauguacaguccugaaaaccaacuacaucuauuuccgguggcagagcuccgcugugcucacuugcuuugcaucuuaaaggaggcaaaaauggcugcacuggugucggaacaaggggccacucaucaccacaucacauuugaacagaacagagagcaaaaggcagggaauccuggcucagcugcuuuuuaaauguucccuuucuuauucacaccuggaccaaaacccauccuacagcaccuuuccaaauaggcaggccauuuuggaaaguggaugcugucgggguucagcgagauuuccaaacuggaagcggcagcuaggaauuuccuuucguccuuaaccugagcccaugguguucugcucuucauguuuaagucuugcugucuuccuaacuaaaccacaaugaccuacauccucaacucccaagguucucuucacgguccuguuucucugccccuggcuucuguuuucucauccugccuccucagccuacuccagagagcuuuucuaagaaggaagggccgggcaccauugucccaucccugggcugagcucuuuaacuuaagaaggguaucccauaugcuugcuuuaugaaaaagcuggaaaucugcaguuaggaaaguuuuuguuggaggauguauuccuuuuaauguugcaauugaaugcauuguagauaagagaugcuaguagauaaccuaucacaugugcaacugugggggggauguacauguguauauuuuuaugugacaagcauguuagugacuuauguuuacacagagaccugccaaugcaugcagguaaccgucugugaaugauugacagcaauggaaauggcuuccuggccaucaauccguuugcccguguggguguuccuuuccauuccacaccuugugaaucagacacucaagggggcucacagcuuucuugcagaucugagggauuccaugguguuucccacugacugacaauccuauucuauccagacugcagagagauccugcuccccaugaugacagaccagcucaaguaccaccuggagaggcaggaggagcuggaggcuuguugccagcugcuuagcaacauccuggaggugcuauaccggaaggauguggugagucaugaugucaugccauggacagcgucaccugccauugacuaagccggacauaugcuacaaauguguugaaaaagcaauggucuucacuuucagccuuucucucuguagacuuuuaccuuugaguuacuuguaccauauuuacaucguagcauucacccuucugaacugaagucaguucuuuguuuuccaauguuuucuugcuaagauguuucccuaggccaaaguucucauucuucaggcgaaggcuuagcagggugguuucccuucguuuuuauagugcuugcaucuauuaagugauacaugaaggaagccaacugugccaccugaagcucccugcucuguuccccacagguagaagcgccuggugcuucuugagcuucuaaaucuuguuuuuauuccaguggcauuuuauuucucuacuuugaaucuggugcaggcaggcauaugaaugucccacccauucuuucccaucaccagcacaccaugucuguuugugcaaauguaaaguagacacauagguaacgccacugaucauucugcugucuggcaucaggacagaaacaccuuuguauguuacuaauaaacggagacugaacccaugagcaagauugggggugggcuccagugugcccaagggucuccagugugcccaagguuccucaguaugccuaggguuccccugccuguuggugcucucaguucuagucagaauuuuaaguaaaaaggguuuguucugagcucuuuccugcauggucaggaugccuuccugguacacacacucucacacucacucacacacacacauacacacacuccuguuuguuccuuccuuucaggaguaagucauccacucugaauuucuuacuuuuuuucuugcuuucacuaaagaccugauaagagucaacuaaaggaggagaaguuaauuguggcucacaguucagaggcucuaggacauugaggcagggacagggggaacaggaaggcugggccagggucuaucugcagcuacaggaagcugcuugcuuccauuugggcaaaucuagaagcaaaucuagaagaagggggauggguggguguugguguugaugugacuuucuucuuccccccuuuuauucaguccuggaggacuccaccucgugaacuacugccacccauacuagagugcgucuuacccucucagcuaauccucuguggaaagcuaaucaaagcuuuagcuuacuaaugcccuagguguuccuuaauccaguaaagucgacagugaugauuagcugucccauucugccugguuugugcucaaaggaucagauacaaccucugcuagauauugaggcaccuuccucagaggaagcccaaggcucggaugucuuccccaggcccagccccagugcucccaggacaggcccuuugcauuucucagaggaaagccagggccaagagguuguagggcaacuucaagaaagagcguuugacuaugcacagauugcucaggugccugccuacucaagccauaugcaugggagagaaucacaucccauuucacauuaaacaagggaauaaauucuccccauggcacugugaauuuuagauaauuugcugccccgauacuaaaacauucuguuucgugcggcaguuaaguuaucgggaugugacacgcagagcagucggcguuguuaucugccugccuuccacuuacagauggccaagcgucucuggaagacuaauuggcggucucaccagggaucauaaacauuauauuguuuaaauggauuugcucuuaguuuuaaagguuugcuuaaauuaauuugccacgauuauguaacaaauuaucauuaaugggcuauaauuaauaaaaggccucgaguuuucuucaggaaggcauuugccuuugacaaagaccauuuuucaucucguuaaggcuucuaauugauugacuccguacagagcaacugguuuccgugacaaguguuugggcuugggggaccaugauggucugugcucuuggcuuuuaucggcgucucuucccuccagggaccgacucagaggcacguccagaucaucauggagacgcugcuuaggacugugaacaggacggucauuuccauggggcgggacuccgagcucauuguaagugcccagagacacacgcuguaucuucccaaguguuccccacacaccgggcgcacugcuccucuccuguccacugggacaugaacuuucuuucuuaaagggggcaugagguugagaagcagucuguucugaauuccauuacuucuagaagcaucuguugggggaaaagguuuccauugugucagagacagaaacacucggugcugggauucuugucagucccacuguugugucaaaggugugugcuuucuucuaagacuucacucuucuggugggaucucucuuuguauuuauguugaaaguacuuuugguaacauuuuaugaagcaccuuaaaaaauuauugagguaaucuacuuuagcaauuuuauugucugcuaaauguauccuaguuguuucucucccaaugggucauucauuacguguggaaaaugauucuaucggauuccaauagucacugucauuuuaacucucaugguggcuggugugcagaaugugucaucucuagcccccaaaaugguuucaucugguuacauuuggccugaggcccacaugugcuuucucauuaccacuucauuuuaucaaaugcauaucaguuuagcuauccuugcaggauggccugucaggagagagaaaaacaaaaacaaaaacaaacaaacaaacaaagcgcuuccuuaauugaaagaacaaaagcuuuuguagucuuccacccaccagcaggaaaggcauauugguccucauuggugugugacccugauccuuuccacauguucaguuagagaaccaauggggagaagcugacuguugguuguauaaccacccucgccugggcucugugucccugucuacaggcuucacaacuggggguaucaugugggugaaguagguagguggguaacucagaauguggaucguagccccgagacagacuggguuucuuccugucuagugcaacugugcacuugucucugaccugcagaccaugccauguucagauuuuccuuggcuagggauauaucauuuaaguuuggcuaucauagguaugaauuaggaaauaacaggcuuccaugugaauuggcugucauuugaguuggcuuuuccagcauugaacucuugauaucuucuuaaugugacuuucucaggagcugggaacauccuguguauuagcagucagugaagacugaaccccauaaacaagauuggggguuggcuccagcguaccugagggcuccccugcaaucaggcucuagugcacuuuguauauacuugcaugggaacuuggaaaaugcuuccguauagaauggauagagugcggcucgcagccaaagcaagcaucaugcuguucuauuguaacccuuccuagaauaaguuagguugaaggcuggugcugacauggcggugcucaggggcuuucagauccugcugaagcuucaccaucugaauaggguccaacugguggguugguguaaauccaaggagucugauaaaguagccuuaccucugucuaagguggaggguuaucgucccguuugggagggagccuguuuuccguuucugguuagggagacaguacuguugugucugguuaagggaacaacaguucuguuucuguuuagcgaacaugguccuaccuuuaguuaaggauauauagccuuggcuaguuggacgcuaacugagcuucauuuuuguagcaagcuggaaucucuuggugcauggucccugacuagcagccaaaccugggcaaggagggcagagaggaaucuuauacaaguucacacauguuuuggaugugagugauuguguagagugcacaaaacuugauaaaggcaagaguguggugagugucucuuagaguuugggguccuggacucuuuggaagguuuucccugaguccuaaugacaaccacagcaaguucuuaguggcugccugagcuggauacuuacuaaugucuuggaagauucuuguuuauggcuccuuccaccccacccccacugccuaaacaacuauagaacauuggaaccccauauguuugugguucuugguucuagugccaguuugucuuggccucugcugugagaccaagguggaaugcugagugccguggccuaugucagcuaguaucaauguacgaaagcacccuucugguuucugcucuacauguaggcagcagccuuguaaaauaagaccucuucuauaccuaccuugcuucauuuucauaagacagaugcuacagucuucugcaggcaaaauccagauguuguguugaugcugaguuuugugauggguuaguguccaagguuggagaagcccuuguguucuaaggaccacauagcaguucccuuuaaauaaacucguuaauauucuuaagguggguaugaagggccuccacuaggccuucucaucuguaccacauucacaugaaguagguaucagagguucacaccacugucugggcaugaguaagcuugggaaacugucauaucuaggcccacuucccauauucuugacuguagcagaggucuccagaagucaaagggggauugagaucuuaagccagcuucccccauuucugaacaacugggauauuuacaaaaaaagaaucaaagacuuucuguugaauuugcuuuauaaaagcaagcugucauggaaaaaaaaaucacaaauggaaaugugaaugagcuguaauuauuuaaugagcaaugacaguguggagauggaucaggaaggauaucggccauuuaagaugugaauuguugacacaugugucugucagucaucugccauccucagguccccucucugcuguuugcagaacagugggaccacaggacuccugagugugugucaccuuggcaucacagucuguuccagcuggggacgcauacauuaauguaaugcuacccuguugcucugugaauuuagauuagcgggggaucuucacaaaagcaucccugacaagggggacaaaagccucaucagcggguccucuaggguggaaacagagcagaaaaugguuuagagagcgguuguacucaagcugcaccacuccauugugccccagcgcuuuccaucuucuugggcuacucauuuugcauaacuguagucgaaauuguauaacuaugaaucagcugggaagguauaacugauggcucaaaauggauuuuuuuuuuaaaaauagaaguuauuaaaagaaaacaucccgaguagauguguuucauuagaagucuuauuccaugacaucguccaaguuaguacugggaauggguuugcuuuuuccauggguuuauuagguauucagucucugucugguuuauacagaguuaggagugggcaaccucacacagaaguggccaagcugccacagacaaugcacagccacuuuuauccaccucugcaguguuuuuauguaagugcugcuuugcacucugccauguggcauuuguuuaaguagauuguauuugaagugaccacgggaaugcauuucauacgcgagaaaauauuucuugauccuaagugucaucauuaagaucaaucuguaacuuaacuaauaaaauauaaacaaagcacuuggcaguuguagaauggagaacauauagaugcugaaaacaggcuaugcuauauaacccuaauacugaauuaaaaugacuuuuuaaccucugcuccacguagaaguuaagacaaacccuuaaccaucaagaaagcaaguaugaagaauggaucuguccuuagacaucuguggccacaaccacaugaaacagguggcaggaguacaagucaccaucagagacucuuguguggcacauucaguuuugcacagggccugacguuacauucacuguauuugucucuuccucuuggaagccugucuagacucccaggauuauagcauuccuauccaggaugugugauauuagucagggacagugauuuuguaaagagguggccagaucagccguuuggugugaccuggagcuacucacaagcaucuuccaugggacaaggcagagaacagugauuaacaagcagggauguuccuucuccugcugcauuacuggguugcuucuuucaaaugauuggacuuccauucugauaaugaguccuuuacaaauguaauugggugaggacaaugucuaaagcguuuucuuuggccuggguacacacgagaagacugaaaauuaccaacucacuuaggcagagaugugagccuccccuaaggaaagaguccccugggcaguucucagggacggggaaugucugucuggauugucccugucugugaccuugagagccucugccucacuggacucagucuuggacaaaguucaguacuuguuguagggcauggauaagagcagaguguuugacgggggaguggcugucuuggcaagggaucacuaugagagccuguggugcuucugcaggagacgaagacacuacuuacaaauguuaccucggggaggagugccauuucacuaaguuuuaacauaauuuuaucaccaauauauuacuucccuuuccaugcgcuuugguguugaaauugguguuuucuugaagugaaaguaucaaugugcuuuuaaaauuccuuacuguaaaaagaucaaaucuucauuucuagaaauaauauauuauagauauuucaaauggaaggaacuugacuuuugaauacaggcaucacuccagcuggacaacuauauugguggccuucagauuuucauucucuugucugcacagugugagcacugacuucacaaggucauuuauacuuagugcuggcaggaugauccuuccugcuuuuuuauauugcuggguccuaagguuuuguuuuuuacuuccaccaaaguugcucacuaccagugggcuuacagcagaggaaauaaaaaucacgccaucauccgagugaaauucuugcauguggaagugcuuuauauuaaaauuacuaagguguuuaaaagcuaaugaggagcuuucccaugaccugugaccuuccauaacacaugcuacccauuauggcuuaauuaguuuacauuaauucacaaaacugaaugacauuuuuggcauuuguguuauauagcuauuugucuuccaauaagugaauuggcuucauacuuaucugaggccaaagauaugaaaggucuuuuuuauuuuuuuuuuauuuuuuuaagauaggagauaugggugaaggaaccuguugcuguagucuugagcuaacagcacacccaugaaacugccuccauugguggccacugugucagauaaaagcagccuauaaaaucagcccaccaguguguggggaguuauacccuggcgaguggcuaaucgaugcuguggugagguucacgauccuugguugcuucuccuucuagcuuacuucuaugcaaggcaacaagccaaacguucaucugggucaggggugggcauauagugaucacugaguacacuugauagucuuaucuguuugaaccucaccagagugccuucuaggucaaguaucuauccauuauuauuuucuuagauuccuccucuccccgcaccccucccacccccaaauacagaggcggagaaagaaauuugguagccacacaaaucauuaccuuuguuuuuuuuauuuaaaaauuaauaaauauuuaaugacaaguauaauaauuuacucucuauacguaaugccauguguacaucuacauaggaggggacacugaauuuuuuacuuaguuuuguaugaaacuuuugagcucaaucuuuccaggagaagggucauccucugucugucacuggcaggucgugauucagcuaugaaaugagcuugccaauauauuuuguuuccaguuuggggagaugcuuuucuuuugaggaagaauugcuucaucuucagaguuucauuucugguccucacauguccaaucuuuuuauuuggggcccuagccugguuggaaacauugacgucacagguaaucacauaugcucccauggagacagaugugcagcacagauguguagcacuggacagaaagcugcugaacccuuccauucacuuguugagaacaugggauucuucaaacacaggaagagaaaacugugaacauuuuuauaacaucaguuaaaaacaguauaaaaacaugaaacacguguuuuaaaguuuaguaugcaugaaacaauugcacuuccuucaagguaccggaucagcuuggucagggcucuucucccacaggccuguuuacugcucuucuacagauucguauuccuguaggguacuuccacauaggcauguuccacguuugugugcaugugugugugugugcgcaaguguguuuugcauguguguguguaugugugucuugugcgugcaugcacgcacgcaccugcccuugcauuucaaauuaagcacgccucuaguguggugugagcaguucccaaagagucuucacacaaaauauucuuuuagcuuuuuuucuguuaaagcuuguuguguaacucaaauguuuagaacuaaaugaaacucuucaguccagaggacaagcauguggugagccuuagcucuuacccaucagaaggacaggacucucucccgaaauugagcagcugcagguuugcagucugaucugccaucagcaucaguuccagcugaaagugcuggaccaacacuagguuuuucugguaugcuuacaaacuauucaaaacguuaaguuauacgaaaaggggggaaaaaaggcaaaggaagaccccuacuuccuacgugaaaagcagaacacagagagacgucauuaaugcacaugaggaguuugguuucuguuaaaaagguacuuguauaggugcaaagaaaugagcggaaaaacgggggguggagguucgcguugucacgugaaaucaagagagaacucuugauuauacggcagauuuuuaaaaaugccuaaaaccaccugauucacagcuucucccuaaguaugccauuuaauacaauuuucugauaggcuaaauggaggcaaugguaaguuuggccauugguagcagcuaagggaaacaggcaguuucucucugcgauggucagaucucacacaguagugacaaagcauaaagaacuauauaaaacaccuggcugcacucgcuuggggauaaagaacaucccuggggauugagcuacaaaaagaaaaaaaaaaaaaaaaaaagaaccagggcuuucugccgcagccuaggcacccgugauuuauagguaacuauauuacccauuguguaucucugucuguuucccaauucuugccagauucaucacuuggccuuuggguacccaaagaauaaaaacaaguucuaagaaagcuuaguguccaggagcucugacccugucagcuugcaaugauugaaggcauaucaugacucggggugggggugggagugguuccuggcugcuggccauuugggaaaugaacaguaaacaugucguccaucuggagaugaagaggggucuaaaucuguggugucaauuugacacugagauguggucacuuggcuuagcgcuacagcacacaaaggcagauauacauagagucacauuuuucgagauuauucauggucuccgaccacuugaaaaaaaauugugcuuucuccggaauugaaugugcugaaaacugcacucgccccugcuuauuucauaaugaaagguaaaaaugaaguccuuugccaacacaaggcuugcuuucucuucucauuuaaaaaaaaauaauaaagagccaaaaauaaugagaaguucuacugucuacaaagacagccugccguauggaacacuggcaucucgauacaaauucuuagguaagggggcgcugucggggguuagaguuuuuccuuaucuuugacuacguaaguuuuauuucagacuuuauaccccauaccagugaacugcaaaggacagcuggcaaggggcgacagucacucccuugcugcugauuaucuguuggugcgaaggccuuuuugguacgcagggcgagaagcagggagcacgcguuggcaccgcaguuuccuugauccuauccgauucggaaaaggacucacuuaaaucccaguggguuuaaaagacggucugggucuucccgagcccacgagucuuaaagaaaccagaguuuccaccugccaugcuuuuuggacucaguuuuggauuuuugcuugggcguggaggagugagucuccugaggguaaggcgaagggaugaccugaguuuccucgacagggugcaguuuucucagcacaggcugcaguuugucuucuuguugcuuaaaauccagcuccacacuagaaagauagaacacaggguuaauguguggcccaagagaucccgggacugccuaucauggcuauguucauucagaguagaauuauaguauaacugcacuguucaguaauacacagguaaccaugauagcuuuacuaucaagcacugugaucuauuccagauugacucauuuucuuuggaaaaauaaguuacuuucucaggcaagccucagugaagaaggggcuugccaggcaagcaugaagaugugaguuccacccacagcucccacuuaagagccacguguggugguguaugucuguaauuccagggcuggguacggggcagagucugggcaguucccuggagcucaucagccagccaaccugccaaucaaugagcucuggguucagagagaaacccugccucaaacaguaagaugccgauuaaacaggggcuccucucacagcugauugucucucuucuggcagcugacauuugccaauagcucuucaguuaggggaaggacuuuguagccacgucucuuguucaugcugggauuuuguguggcuuaaguuuacacaaagacuguacauguugucucaguggcugugaauucauaugugcagcugcccuguugagcaaagaggauguuucuuuguauucccugccucuggcucuuagacucuucauggugccucagugacuccugagccuugggagguaguccacacauccaagaagaaaugggcagcaccaacuggucuugauguguagggggcgggguaguggugguggugguggaaggugagcuuugaaaguagaagugagaggaguuagaguagggggugauuaugauaaaauacauuauucagaauucucaaguuauuaauaaaaaugaaauuuaaaauaaaauugagagcuauggaggcagaugugugacuucuggccuccacaugcacacacguguguacgugaccagaagaccauguauaugcaccauacacaaagaauuuaaaucaaaguccauuauguaucuguugccucgacacaugugugcacaugaccagaagaccaugugcaugcaaaaugcacaaagaacuuaaagcaaaguccauuauguaucuguugccucagaaaaugcgaaagucagauugaacacacuaucuauccggaauuguccacauggauaucaugcaaauuaguuagccacacacauggggagaggcagaagucaucacaugcacacacaugacacacacaugugcagugcaucaggcuguguguucccauguaaccaccuccaagcagagaaaccugccggcuggcaccaccaugaauccuugacuugggcuugccuuccugcaaaguuguacuugucugaaacauucuuguggaccacagcuaggugaggacccuggggaggacuccuguguguaucgcuucagcucuacugaaaggcuucuguuguuaucaaacacagcuucccacgaagcagcauagauaguguuuggucaaaacaauacaagauuguaauuacacccugggagcaagagugugcaaggauguuuguguuagaaagauaagauuggagauguguuucaaaauauacacugcuacuuaggaagaugcuggaaggagugcuguccgugugcugcaguuguuauucgugucuuugggaaggaugauggucugcuagacucugcuccuaauggauccucuggcccacuguguuucugugaugguguggcacuggagagccucucuucccaucaccugcuuuuuagaucauaugguuuggacuaggucucuggagucuuccacucuguccucucauuuuauucagaugcuagacuaaaugucaguagaguucagugacuguucauaacauucuguagccagggggaccguccgugaaccaucaucuauaagcacaaaauccuauccauuuagagaaccauuaaucccagccaaauucugacauuuucaaaacacaaaacagcaaagccguauuaucuggagucuuaaaaauaaguucaagccuauugaaugggccaguuuaugauuucuaacuuccauacagcauuuuccuuauugucaaaagcugugauaucacugagguuuuuuuuuuuuuauuuuuaauuucaagaaaaguuaauggcuauucuccuuuuuuuuucccauaagaagcuuuauguucacuuacuuuaagaacagugagcguuaucugugucuguguguacacgcguguauacaugcacacaugcauguguauggacggcacagcagguguggaagcagaagacaguauucaggaaucuguugaaauccucucugagacagauucuaguuccaggaaggagaguugaagcucaugugccaccuaucuagaaugugugacagugacaguagaggcaaggcccuccuaugggcagcugugcaaagugcaaaccuuaggagauaaugaaccugugacaacccagccugucugggcugugguaccugagaaagcaguagauccugucuugguucaggagucuggggagcugggcugaguuaauucccacaucaucagugagcuuccauugacuccaguucaaggaaugauaauugcuguuuuaccaaauucuagaaagaacacauucucagaccuacaagucugugaaagaccauuucacuauuagugaauaguuuccuuauuacuuuguucuuacuguuggguguugacugcacauuuugccauugagucugguacugauuagaaaaaaaagcauuagagaauucucagucuggaugcuuaggcaaaagagccuuucaggagucugugagaugugacaguuagcuaagcuaauacugaaacacgccuuccaugucaaggccauuucggcugucccagguagcuuuucauuuguuacaacggagcauguggcuagcacuugcuagacuaccgucuaauccugggcaccugcaauuauugaauucccauuaagcaacuacauugggaauccugucauuaaccaauuuaucacaccguggaaccauguaaucacagaguaaucuaaucugaguucuuguuaacgaaaugacucgacuuuaucuguugagcacgguccuguuugcgaucauucaggauacugcaguccgcagcaggcuugguagaagaagauggccaccaagccugggaguuccugcugggacaugccugcagugggguucagggacacagugauugugagcccugccucuccucacugcuggcucugugccuuccaggucgcaguguaucugucuugggaugguauggauguauuauuacccagccucaaucuggauaggugaacucuggcuguuaaguagcaaagauguauauucuucugcgcauagcugccugcuagcaguuucuucuuguccaagugcacuccggguuauuuggggucugcaguagauggcggagugcacagagcagcauuacaagguuaagagguaucugguuaucucuggcugccuuagagcaaagguuucuuugaucuucauggccaaacggccccugcuaggaacugagguccugucuacugcagagcugcagagcuguucugucuccaguccgccaucuccgaggacagccacauagaguuuagggaggccugccuggcagagggccgguaggcccaggcuuuggucuuucucuuaacucugagaugaugaaccuucauccacuucuauguguaaugugauggcugucaucaccuccuuuccuugccugcucccuguggccauucuuuugcccaccugggguacuuucucuggcucauuacaugggaugccacauuccaaccuccuaucaccaccccgguuaaacacagucucugcaacuugacuacaaauccucaucuucuaucuuugaguuacuucuuuggcuugcauuaaguuuggggaauuuugcauuggcuuugguacugggaacuggccaguguuuucuggguaagugggcccugguggcaucagauaauaggauguaccuuguacugaauggaagagaaagauccagagacucugucaauagcuauugugccggguauauuauugaacuccucuaaagauuuccuuuucuugccugcaccuccauucucuuucgagaaaucuaaaacaauaccucccauuagggcugcccagugagcaaaagcccucuucgcaaguguugcaaagccuuagcuacacucuucuguagcuccuggugguucguggccaaaggaugggaagucauuccauuucuuuaguuaaucauuuugucuuaaagauaaguuuuaguuaugagaguuuauaauaaucacuguucuguauauuucuuguguauguguacaugcauugaugcauacauacacauguuccuguacaugucugcauguauauauaaaggccugagauuaaccuaccauuucucaugugccauaugccuuuuguuguugcuguuuggugagccuuuguuuuguuuuguuuguuaaacaaucucuugcuggucugggacuugccaaguaaggcuaggcuggcuggccugcuagcuccaagaauuugccuaucuccucagcacugggauuuucaguauuugcaggaugccuguggguuuuuuguuuguauguguauguguguguguauguguguguguguauguguguguguguguuuguguguguguguuuguucugagguuaggcucaguuuuguucccuugcuugcaagguaaacacuucaucaacugagcuaucucuccagcacagucuguauauuucuaaagaagugaaauuugccauugucuacaucucaggcuguucuuccagcccguaucuaagcuucuguuuuccuuccugggaaagaugcuaaguuucuuaugaacacuucuccugggcacuucaugggaggcagcaggauaguauuccagugccuccuuucgcucgugugaaccuccugcaaaacuuagguucugccaacuauuguccauaccuccgcuuaaaugaaugccucaggugaugucuuucuccgcuucucagucuaaagcaggaaagagcuaaaagcaggugagugugguccccaagcucuugcuuguuuucugaaguggaagaccccaaaucuuucauuucuccugccugucgaugccccguggaccugcgagauucagaucccaagccucugucuuuaauucucuuugaguuagaucacagagucucuggugcuaacugugacucugcacaucuugcucugccacuguggauaaaucaucucaccuuggggaccccaacucccuuggcugugaaguggugauugagagucuucugcucagagggcaauucccaagagcggaugcacugugagcacggggagcucucaucccaggucuuuggcuaugauaaguaauguuucugcguaaagcaccuagugggggugcaggcgacgacugucuggacauguccuguaugggaaaacaccagcaugguccagaggaagcuugugguagggacugucccaggcugggcucucuugugugcuugaggaaucugggcaaccacuuuucuuucucucugcucuguuuaucuacaucuucagccacuucuccgggcaguagaagacacaaaauccaaagucgccaucuuuuuucuccgaacauuuucccauagagcaucugaggggcagccuuguccauguuccuagacacacgcagacucuuccuuucucuucgcugauccaguggcucucacgcugcuccccuccccacuguccacacguucuaccaccccacugcagaaccguggcauuugcccuuugcccuugaaauagcugggucuuggucuugccacuuccaaagcuuccauggccaauaugacaaacaccuugucuacauccugcugcugugucuaaauugagguugcucgucucccuuuccuucaauggguuuucuagaggaguuuagucugccuacucauaggucauacacaauacccuggugugccaugaucuggccaaguguucuccaugucuaucugggaauccacugaggcacacacaugccacauugauuccaucuuucacugugguuuagccagugcuggccucccagagcggacccucuggauuuacugagucacaauaaacugaacugaacugaaucuccucccuuccaaacucacagagcugcacuacccagccuguguugucuuacauuuaauguguguucaauuuguuggauucuguuuauuguguauuauauaauauguacauagcauauggcuguauuuuuaucucuuaucucuauauaauauguauugaccuauaugaagauauggaucucacucccacugaguguugaugguuuauaauuacuagcuuuuuaauuuuuauacguagauuugcuauccuuccccagcacuguuccauguauucuauaucuauuuauagcaguccuauaaggcuucaaaacaccagacauaguuuaguugccuauccaguaauauucaguuauugagacuauaaagauauuugcuaugacaaaggcauuaugaguauaguuuuuaaauacccauagguuguagcuacaaaucaacauacaucguauacaaagcugguuaaaaagagugaucuuccagaauguauccucucacuuuucccuggccuuugggaauaugcuugucugaggccccaaccuguccgucuuaccugccacaccaggucuuaugcaagugcccauguaagagggaaggucaggccagucacagcccucagggagcccugcucuggccacagggccgcagaaguaaacucaagacauuuugguaagcucugccuguuaucgcuucccccaggcaggcaggaauguggccagccgacuaugagauuaucauaugaguacuuagcaugucucaugucauccuaggagaacuugccaagaucaugcauuguaauuagaagggaucaaucauuuauuaaguguagacagucacacauugccauucuauccucagugacaagcauggcuuuuucucucuuugggguguaacugcagugaauuccagagaaugcccaacuuuuauccuaucugaaaucuacucuagcaugccucaagccccaggucgcaggacuugguuauaaucggaaccccccccccccccccccguccuuauucuggaugcuccucugcugcucugcucagacagggacacugcuuccuggauacuucugggcgugaguuaagcagccugcuuccgaauccucggcaggcucuguuccuuuggccuuggcugagagggccuggggaccacgggacucaaaaaucacugaaaccucccagagaauguuuucugacccagcucaggaauuaggggcaaaucugaauccuguauuuuaagcccuagaaaauccccauauucaucuaaaaccacagggcauccgucuccuuaugaaauugacagacuuuucuuuuuuuggugcuaauuuggacuucaggaaaaaggaucucuaaccuucaccccuugauuuaaccaaaggccagggcuguggaugcucuggggucuucugcccugaauaaaauauaagucauugcuuugccagcaagauguggggaugugggcagcuuuuacucugugccauuguuagcuucacagugucuccagaagggaagcaagguguuucugaagguuugaaaaauccuuacauucugggggcggggggcaagagauagauaguguauuuuuagauucuaaaagaauacugagagagauuggauuauuagcguugggaauuuucaagaggaauuuugaggccugucaaagcuauucuucuccccugacuuaauuuauuuuauuaaaaaaaauaguuccuuuaugcuggaauaacauugugugagguauugucuaaggguuccuuuccaucaccaucaccguccccacccccacuuaaacaaugugaauuagaauacagcuauguauguuaguuagauggaaggcacauuucccccaucucgguucagacugcuaaagaacucaauaugcacaagaggaguaauugaagcggcgcuggaaaggguauuuccacuaagagauaaucgucgggugacaugggcugcagcgacacugcugcuccaaguggcuauggagauagccucagacuggcacuggcuccgcauacaaaugcaauuaccucucucuacaacaagacuucauuagcuaugcugugcccugcucccucaccccgacgagcuccuuucugcgcaacacugggcaccagugaagaauccuccuucgucgcauaucuucaugucuuuccaaccauauauuuugugugcucaucaguggugugugguaauuuaaucgggaaugauauaagaaagggcagucauggucuuuuuguauaccuuacucugucuaaucauuugaguguguuuccuucaucuuuccuaaaaccugaucaucauuuuggguaagaacauguaucguuaaggcguuuccuucuugggagucacauacuguccucaaguugcuuccauggagccaucuuuauuggagaugcucugguaccugccaguuccuaacucuccagcagagggagcucuagaaaacauagcuaagccaccuucucacaccuaccccccucauugucuggcaucccuccaugguguccugccucucccuuaccucucugugucacaugaugagauuaugacaccuuauaggacaacuuacaaguucucccgcaccccggaguuacaguaaggcuggguaggcugggcuuccuccugcuacccuguccauugacugccagagugauugauuacuggggucacuugaagccacuuuuaugguggccuugauacuauaaaaaaugaagcaggaguaggcaguucuuccugaagucuguccuaacccugcucaagaagaacuuccugucuggaaacaauacuccuuaguuaaucagugucaacauuauuacuaucucuuaccucucggugcuaucccccaaagccuuugaaucaagccuggcucacuguuguuuucauuaaaagucacacaugagaauucacccccuuuccuuucucuguuauugcaccauuacuuuaugaauuaaccaguucagaaaaagagggaacgggcggaucugcuaauggucucuuucauuguucccuuugaaaccaaaucugagcacaaggugagucacuggaggugacaucagauuagucugacagcagcacugcugggauaggcugcaggcaaagacugccauuuauccuuaaaacaucucuaaacuaauuaaagcauauuuugacaggaaguagggaugauauggcagaaaaguuuuacuuaaaggaaaguccaacucaaaucucuuuuaaucuuucuuuaugcagaaccucuccuucauuugaauaucuuaguugguccagaucacaaucaaagaggugucauuuuaggggaaaaugugauuuuugucaacauuuuccauugugaagagcuagaacugucuggugcuuggcauugcagugagcuagugagcagugggggcagcggucaguugugggcagcauugcauaugcacuugcugauguggagacaggauuuuugauggagaggugugcuuuaaauggccacauauuccccgccaugcacaggcccugucugaguccccaggcccuuucuuguuuuguauuuguaaauaaucagcuucuuggauuucagaguuggaaaggauuucuuuguaauucuguaggacuuaaaaggggaaugaauaccagcccacaagaaaagggaacacaagcccugaaccccaggcacccaaaucugagagccuggguuugacauagcagugcuucuaaucuuugccuggugccacuuuccccugaagccuuuauuuccugaaagcgcuucaugaccuuuuguccuuuggguauuuuucucaagcccuguauauuuccauggcaaaaucuuauuucauagugaaguauguauuuucuacccgugacaaaggcacacauguauuacaagaccagauccauccaaaaguagguagcuuggucuugaacacaaugcccuuccugccucccuaagccaacugcuccuagaagcacaggguuuuuucugcuuuguggagaagacagcuggguuuccaguguuuaaaugugagacagauggggucaaguucauuguccuacagggcucucagucugccaacaagcagguaugacaaauugcaauuuggggacauuggcagcuuucauggaccccuguguccuucagcuucuaagauaaccacagacacguggcauuuaaaaaaucucccaauuuggaaccugcuuuaaucuuucccaaucccacacaugcuucuagcagaggagaggcucaaauuaugauauagggcuauagauccucaacuuaagaauacggucccuucuccuuaguaaaaacaucagagauugcaaagacucugaccuugaguuaagcuuuuacccuuugcucagauuguugucauagagacagucauuucuaucucccaugugaaucggguuuugguguucagaugggacccugagcugcuguaccucauuaaccauccuugcccuuccuugggugaugcugccaguaccuacccaaggccucugcucuugaguggacgaacaggcuucccucucuuucuuuuugacucagaccuuuaguuguucugcaacaaaaugcuugccaaaaaaauauguuuuuacuuguuccuugacuuguuuaugcucuuuauauucaucguugauaugaugugauuugaauauuguaacauccaguaaguuauucuuguguuuggaaagaggggcacugucacaauauaugcacaaaaagaauaggggcagcuccaggauacagccaggcugcucuguagucugguucaguugcauggcauggcuccauuuucaauacagaaaagcagccaugacuccuggaagguaacuugaaacucuuuuuggagauaucuacguuuagugaaaauucucaggucuuacugcuaaagacugaccacaccuuaaaucauacaggugugagauuucaaugcuuauaauuuaaauugagaugacauacuuauaccagguagauaagaguugcuauggauucccccaaggcagaggguuuucaguuaacaaaaauguuuacauuuuccuuggcuuuaaggucuauuccugugaaccucaagaaacucuuguggcauuucagacauugugagagucacuguugcguuuuaucucuaguaaagguucacaggcguuggguguagcggcacacacccuuaaucucagcuuuuaggaagcagaagcaccuggauccggguuaguucaaggucagccuagcacaucaugaguuccaggacagccagggcuagggagugagacccugucucaaaagccaaaccgaacacaggacgacagcaacaucaaggugcgaguuggcugaguuuuguccguccuaccugaugggaccuuccaugccuuauugagcaagugaugaagacuugcgagacucaguggaagaaggacuuacgggacgguggaagcgugagcuggccuggaguuaacaugcagaauguucuacaacuugcucacuaagccagaguagcuucagugugcaacucagagucuguggaguugaaauguguuuucguuucguauuacucugaacgguauaauuuuccacuauuuuuucuggaagaaagaagggaaacuccacucuuccucccaccccauccucugcuaaugcuuuggcauugguucagggucugauggagucugugaggcacuaacaagcuucuucucuauccuguuugugaaaaugcauccugccaaauccuguuguuaaugcaaaggucuccaggaguugacugguuuaugcagugggacgagggggaucaaucaucaggacucagacuuucuucuucaugagccuuccucugaagaugaggaggacucucaucuucuucuaaugucuggacacuuacugcuguuuuccaugagaaaccuuugguugauguauuuggguuccuguagagugcuggucgagccaauucaauacucuaggcuaauuucccccaaagacaaauucuuauccuucucugacucauuaaaaucaccuuuaauaucacuuuuuauacaaguuaccccuggauuuagagcuaaauuuauuuaaauuauuuucaguuaccuuggacagugugcuaauaaauucuuuuuccagucacccacaaaauguuaaauaguuuuagccugaacaugcucaccccaugaacuuucucuagaaaucuuuuccauuucagacuucucacauuaggugacuggaugaacucuggcccuggaaguguguuacuccccagggaggaauugccuaauaaacuugcaggcccuaacuguauucaugucauucguuaaaacuggaauguccugacuaaagccaccucacucuugaaucaaagcucuuauccacaguguucauggugugccaacguccuacucggugugcucaucgggcagcugcucccucugagucggaacaaggaguucucgacugagaagcuuuuguguggugcuugauguuuuaccuucacauggacagcaaccaagaacaaucaagagcuucgugcccuggcugugguugcccggggcguccuggcuccuucccuguugcccaugccuuaggcuuuaacuuaugucucuacagaaccauggcauaggauguuugcaacaugguggccuucuucaccccaccucuacugaugcuuuggacccagugacuuuauucucaugggcuuuucuaugcauuacaggacaucaacagcauaccugguaccugccuccucaucagaugcccgucaugcauaccuagcuaugaccaauguaucccuucagacucuacucacccaccauccugugggagucagaaucacuggggucauucagagucuaugucuagcugugauuucuucugcuagcucccucacaaaauuuccacgggacccagcuccucuuuuagagaaccggggcccuaucugggaugcucagcuuggguuacagccauaucuauguugcuugucagcacggaccugauggguaugagcccacguggccugaagccuucccacacuguccagguuugaccuuuuuauacagugcuagugauguuugguucacuuaaaaaaaaaaaaaaaacauaggggagcaaggaggacccucucuagauuuuuaggcauauuuagcuacuaaguuacuacuaacuuuuuugauaauuuuauaucuuacugaaacuuuuuuuuucuaaaagaagauacccagauaaccauuaguguaagauaaaaugauaaccaucaguagauacaaaucaaaaccccaaugagacauugccucaauucauaaagacaacacuauuguuaaauguugaccaggauauaggaaaaggcugugugcaaccaugaucacuguggagaugcuguuggugggaauguacauggucagucacaccucuguggagaugcuguuggugggaauguacauggucggucacaccucuguggagaugcuguuggugggaauguacaugguuggucacaccucuguggagaugcuguuggugggaauguacauggucggucacaccuguggagaugcuguuggugggaaugugcaugacaacaaccacuauggagaacccuacuaggugcacucaggaagccagaauugccaccauaagggcuacaccauuagaaaugacaucaguauaucccagaaauaucuacacucaccacugccgcacaguucaugccaggaaggcaugagaucccucuuggcucuugacuuaagucauauuuaaaaugaacuaaaccauaacaccugucacuguggccacaauuuauaaaacuuucacgacccccccccccauuaguuuugaccaugccuuaaaaaucuuaaaauuacugucaaggaccuaaaaauaacuuuuaccuauugaagauuucugaucuauucuagugggugucaauuauuacaauguuuaaaucauaaccaaaaccacauggcaaacaguuguaguuuccuaagagaggaucaugucaugagaccauggaccuuguaagcuccuugaaaaauaccuguacaugcuguguccagagcuggaccuaucccauacaguguggacucaggccuuugaucuauaccauccaaagggcuuauguuuuacuguuuugccagaccgcaguucuguacucaagacuauagauuccaagggagcaagccaucaaaaugauacuuguuccugagcccacaaaggugcauuuacaagauaaacguguguaugcucuccuucauccugggguuguauaccugggguugaggguugggaguuggauggaaggauggcuguuuagacauaaccuagaauuauggucaaggaaggaauuuuuuuuuuuuuuggucugauggaaucuucccagcauggcccccaaugauucuugcaauugcaguuguggguaaacagcauuugucacucagaauaacaaagugggaagagaauguuaacauaccuauagauaauacaugcacuguuccugcacgugucacaauuagcugugucuugccccguccgauaugaaagccuacaagauaagaacaggagaguguuacaaucgguggcugagggugggggggucagucgcuggccucacagagcagaagccucaauucagacgccuucccgguaugagaugcuugugaucagaggaacugacgccuguguguuuaccacucugcuucugucucugccuuuauggucccagccaguacacgucuacagccaagaugucacugaaauuaaauguagaaugugaacauacgcuucuggauggagugugcaaucugauugcguuauaagcacggggaguggaauguuucaaaguaacuuuauguuuauuguacuuaaaaaaggaaaucuuccaggagaaaaccauggguuuagaggcugacaacugccugguuuuaugaccuucuuccccuguucugcuagagcagggggugacaugcauggacucugggucaaauccuaaccccauccuacauuugucuagcaugcccaggauggauuuuacauuguuaaaugcuugaagaaguauccaaagaaugcagucuauaacaugauuaaacuauguaugucuccaaagguuucauucugaccauaaauauugugaucuuauacauaaauuaauaugcauauaauuuccuuggguuuguuuuuggucuauaaauccuagacuauuuccuccauggauguguagagaaaacagcugcuguuaucugugaauguaucuuucccauugucaagaugucugaugcauucucuggcuguguugccugaaaguaaugaccuaguaaggacagaacauggcagaccucugcucacccuagagaccaagcagguuuuugagggguaggggugugugugugugugugugugugugugugugugagagagagagagagagagagagagagagagagagagagauucugacucucauaauaaaauaacuaaacuguauuuuucuguaguauuauauugaaacaugcuuugcuuugaugggggaggcucuucauuuucuuaaccaggucaggguugccuagaauacauagcucgaaccauuccaccucccaaauuguuuuauauggugcuuuauacuccuucccaaugaccuuaguuggacuuucugaucauucuaagacacacacauacuuuauucuaaauaucauucgcaccaggagucaaacacgaacaacugaaucuguccgguugauggugagagaagcuuugccaucuggauugauuucugaccaccucagggacagauuugcauggauagcaucucccagcaaggcaaccauguguacacuggcugugucaacaccagucucuguuugugucaccuuuuucugcuguguacacuguguguguaugcauugugaguuucaaauugaaaauaacauuuguuuccucauuuauauuuuguguucuguaaacaucugacagaagcauuggccgcucagugcugacauugucuuugugaacucaguaaauacaggcaugacuuugagaucaguucaguuuauuugaguuugguggaguuuauuuguuaaucaagagaccauauucugcucccaaguguugccaaacauuuccugugaugaguugcauugaaagagaguuacaaucacaauaucacuguguucagauugucucucugcuauacuggguaccuuuggacacccauauccgggcuucccaccugagccucauaugcuaccuuggcucuuccucauguaugacuauuuccuggucuuagcucuuuuucccaagugguaaaccccaaggauauaccugucuccuuguuccauccuagccagagcccccuccauccuuuuagguauguacagugcccuucuccauccuccugaguaugcacagagccacucuguuuucaguauccucauuugagcgugguccucagcuuguccuugaccauagcccccauacagcaagaagcccacauccgugcuuugacauccuaacaaugucuguccauucugauguccucucaaucugcuaggcuggguuucccagaagugcugcuauccuaauggguaugagcaauagaccaaccagugagccuuuuguguuagucacauccaaacucuagguucuuagagaaggcuucuguggucccaaaaccaucguuugagaccaucauugguauacuucaagcuucuagaaucuuccugccauagaucacuacaaccucuaccacaccugaucagccucacuucucaucucugcucagucaccuccaagccucaagagccuuacucguacuagugccuggagucuuccaauuaauuauucuccucucauuuauggacaggaucuagccacacuccaggaccaggaucucauuauucuuagaccccaggcuucugaugcucugugcugccuugccucuagucagggaccuguguuuuucacgacauguaauuggcagcuugggauauagucggugaaucaaaaaaugacaggacaaaggcuucaggcaccaagagagucacaagaggacccucugucaggauggugggaggcuuuagaaagacacuguccuuuccuaagcucuucugagcgcacuaugcuaaucacuuguaaaaagcacacaccuucauccccaucaguuagcaaguaccuacugagucaggcauggcuguggcuauccagaugaugguaagugcuugugaaaugcuuacaagagguagaguucaccagggaggguuggauggucucccaaugguggccaguuacauuucuguuuuucucagugguauuuuccaccagcuuucccuaucagagacuuacaauccgggcuucauuaccuaccaggaccucucucggagagacccuucucaauguuuccaacaguuucuuucauauccuuucugugguugucauuuaaaagaaucaaacaagucagagagggauuagcuugugguaaacuguaaaaugcugaccuuugcuguguggcuaacucaccccaggguuccugccagcagcucuugucaaucauugucccuacugaaauuuuauccaucaaaagagugcucuccaggagacuucucaguacaguacucuugacuuaagacucuguugugcucagugcuaauucaucuuggaccucccaagcucuaggauuugguuucacugaucauauuaaggccacauuaauaacugggaauaugugaauugggucugugcugcaaauacagaaauagcagacucacucacuugagggcagcgaacacuaagugccgaucagaaaugcccuugcuuuucccucccuccuuuccauaagaccaggaggugaaaggacugucacucugugucacuauuguaacugagaagagcaaugccaagccucagacuacuacagcaagagcuuccucaggggcaaugagucccugaucucuggugaaucagaaguucacagacguaagugcuuaaggcacugaccuacaaacaaaccagggaggcugagaaggcgcugaccuuguaaaguuuucuuccugaccgcauucaggaauccacgcuuuauacuggguuguaaguucauucgugauucaaaaccuggucccauuggauuguuuggauaauaagacucuggcuccuacagucagaagugagugccacaacgaaguggaaggauaaauucugaauaguuuuagucacacaaguugaacccucuggaguccaguggcaaacauauuuguccuauguaauaaagauaggguaacugucccacuguagugaccuguaaguuuauagccuuaacaauaacacaucauuagacuugagaaaauaggcucuagcaccaaggacagcacccgggccggggggguguguguggcggggggggggucccuuagggaacaggcuaaagcccaucucucuaccuuuuugcccauccucauuccugagugagcgcauguuaucugggcauaaguaagcaagccugcgcaaagugccugcaucuggaauagcucugaguuucaagccucaggcaccuuucucuguuuguuuagaacaggaccucuuguuugccuggaacaaguagacugggccauuugugagcacccagggaucugccugucuuaacuugccaucucaugaucacugggauuauaagagcaugcagauaaaacccugccuuucacacggcuuuuggugacugaccucucaugcuugcaaggcaagugcuuggaugacugaucuccauccccagaccuguguacccuuuaaucuuggcucuagcauaccagucuaacucagaucaguccaaaucagccacccagaacuugcuuaucuuugaugaugcucuuuagcuacaucuuugucuuagaaugggcuuuauggaaagguccggguaacuagacauaauugaguacaguagaauuuggacaagaacuugguguucuagguaaacagaauuuagacaagcucaggccauaggggaccaguuaggcggucauuucugcucugauaugaaaccuuauuucaucaaggguuuacaucauuuauaaaagcauagugaguacagucugcagaguacagccugcaucuaagggugucccuguucagagaaucagcuggauacuucacuguaggggccagccagcacucacugaguugaguucaguucucuagucuagcuacugaaugcuuugauaguaauuugcuucaguucuucaguuguuguaaguaaaagucccugaacauauaaauauaaauguguguuuuucuacaaguguauccccuuucauauguacaaguguauauuugugggaaagcauugguaauaguuccugugcgggauucuccaauguuuccuuuuaccggagcuacauugugaaagaaacaaagaagggagacacagagcugaauugcugcagugguuuuuauagcaucccauagugaugcugaaggaagaaggcuggcugccaaccucagcugagguauaccaaggugcuguccuggcuccagagaugccauaggccaggaaaugggagagagagagagacaaagacagagacagagacagagagagagagagagacagagagagagacagagagagagacagacagagagagagagagagagagagagagagagagagagagagacagacuaccugcaucucccaaagcuacuggggaaagcuaggugguaugaaggguaaaggggugucagggaaggguggcugggagcucccuuuaaauccccauccaagcugcuugcucccuuugacagccugaaggauucaaaagagacaggacgcacaguucuugaguaaaaacaagauaaagcaaaagccaagcacuauuuguuuggguagaaggaauaaagacugaggaggaagaagaggaggaggaggaggaggaggaagaggagagucuggauaaaauguggaggaagaggggcagggaagaaggaaaaggagagguaugaagaagggcaagggguggagaggaggaggaggaaaagggagaaagaggaagagggaagaaaggaggggcagagaggaguaggagaggacaggaaagagaaggaggaguacauaaaagaggagcaggaaggaggaggcagggagggggacguccaucaugaggucaccucuccccaugcuuuuaugaggagcagugucggacaaaguucuaagaucucauagaaaaaaaugucugggaaggggaaguuggcuuucuaguauuaacaguaauguugacuuugucuuuugaccgaguucuguuguuccuguagucacagugaugccuacauacuuugcuccauaaaaccuuuuuacuuucaugguacugagaaucaaacucauggccuugcacgugugacaacaaccuuggcugcacuaugagggauuauugcagucaaacaugguagaaugauuagaacucccgcuaccagggcagcagagauugaugggggagggggaaagggggggguauuccaccaaagucuaggaguucaaaaggaaugggagaugcaguucaacuguucaaagaaguagcgguggggguuugggcagggagaauaggaaaaagguagggacaagaaaggaaaaugggaggaagagaagaggagggcuggagaaauggcucagagauuaugaacacuugauguucuuggagaggacccagguuagguuucuaacucccauacuacagcuuacaaaccauccaacucuaguuccaggggauccagcacccguuucugauguccacaggcaccaggcacuguacacagugcacguacauacaugcaggcaaaacacccauccauguaaaauaaaaccaagcagaucagaauaaaagaggggaaauguagagaaagcagagugaucuuaagcucucaaccucaaccucccuggcucaccugccuugguggcuacgucggucucuguauuaagucuguuuugccugcagcacuugggagaaagguuucucuuggcauugccuguaaugcuguguguuguggguccuucccccaaaauucuacacaucccaagagacagcagugaccuuguagcuuauucacugucuucuaaauggugcauucauuuucagcaaggucacauuucuaguaccaaacaaaagcauuuggcaugaugcuaacuuugggggugacccuccaagugugguuuuucaaaacacuaguuacacagaguguuggaacugucauacugaaucaacacaaaggcuguguccuaauccuguggguauggcccucagcaagagauggcauuucuugcaaauaugcaaagaccaucucuguucucugugauaauguauguucuuaucuaauuuauccucuuaauuuugaucucuuuuuucuuuucaccuggugccaauuuuuuuucuuuuucuuuugcauuccugcccagcuguccccuucuugauagcuaagccaucguuugugucagcaucuuaaugggcuuuuccacauaacagucucaaagugacauuaauuagagguacaccauaccucugcuacuggcaagaaauuaaauuucgaaagucgucggaguugaauguuguaaggaaccucacagguucugaaacuuccccagaagcaaacccagcuuguuucugcaucugaaaccucacuaggaauuugccagaucauguacuggaaguguaccuaguuuauauaucagcucuuccguugcuaaagugaauuuagacuuucccaauauauccacagaaacaucuacaucuguuguaagcccacauagauguaagcuaucauaugccaggauuuagggagcaucuauugaaagcuuugugauguauacauacguggggcggggcacuugggguaguagauauauaugugcauguguggcggacagagguuaacacgagaugucuuccuccaucaccaccaaccuuauauuuugagacaggucccucacugaaacuguagcucaguggcuggcuagggaggagggauguccccuuucucuguacuucagcaccgguguuaacacaggcacgccagugcccaauguaugugcugggaacuugaccucaugucuucauuccugugcagcaagcacuuugcccaauguuuuaagcuucuuaaaaagaauaucaaguugcuuuucauggccaacuccagagucaucuauuguugggccuuuuuaguuaaugguccaacucgguuuccuucccaguagcugccucucagcugagucaggaguuacaguugugacccuugcugcaccugggugucuaauaaaaguagacauagcacagucaucuccacuauuggcaaaacaauuugagguacuccuucccacccccuugaugauuuggaaguggggugacaguugguaccuaugcgguugccugucuggugccuuccaagagcucuggagggccacccuggagcugcuuguugggagcucuuugcuugccucuugucugcccuccacuugcuuucucugucagggccuccagcauucaguaucgacauggugacuucuauccuuccuuuguccaagugaugucuagcacgugcucuccucugaucagaagaauuuggauguagccucugccugucuuuuuccuaauaggaaguuaauaucuguuuccuucccccauguuaaaacuuaccacaccaauccucacagaggauggccuccaggccaauggacgguuugccuuaucuguugacacuauuauauaggcaaggaucuggugaacuugcagugugcagcauaugucaguaguauaguggauggccaagagguauguuuugaacacuuacuggacgaacggauggaugccugagcaaauggggaauauacauauauauucuuucggggucuaggaagaaaauacccuucugcuccuggaaaugguaauagacuggccaauuuggugauguuccagcuggggaaaggaugccugccuaagggcuauuagcauuauccccucucaaauguuuccagucaaguggggauaagggucagucaugguuuucuccucacacccaguuaugaagaugaauggcucagcacuugcacccuacgcugcccuccucacacacccgagaaaggucagucauuuagcauacacacaaucuggguaaagcaucccuccauaagacucacccucaugaacuccauggauuucugucgacaguguagacaaacaaacugucacuagacgaccaucuccccagauguggcggugacccucucguucuggugaggcucuuugugaacuucuaacuucuacuauaaauguacauggcuugcauuuucuuuaauguacuuaugcaauugaggagauacccaguugcgaaauaaugacaauaaugauacaaacaagccacuugccccagaaggcacuagaaauaucuauuaauaauaagaaagauggcuuuuuagggcugagcggaggcaggcuugauuaauuugugucccgaaagcagagcuaaugcuuaagcuauaguuuauugaaaauuaaugaaaaugaauuuuuuuggugguaccagcuccacaaagggaauaaaaauuaggaugugaguuuaugguacuaagauggaguuucccuucuggcugccauuucucuccaguugagcccuaucagucaagcauguuguaaugaauggagguuucaauuugaaagugugacuaugcauuugcgggucuugaugauaaauacucacaagggcuuuuaucuuuuauuuauagauucuuuugauguauuuagauuagcuuaguuaacaguuuuaacugaggcuuugugcuucuugaagcuugggugcuuuuucaaagcugaucuugcauucguuugagaaacaaauguaccugaacucuccuuggugaagauucaggucuaaucugaggccggagagauggcucagugauuaagaauccuugaugcccuugcaggggacccgaguucaauucccagcauccauauggcagcucucucacaacucucuguaaguccaguuccaggggaccugacacucuucuagacaugauauguacugcauauucaucuacacaaaguaaaacacaagacuuuuaagaaauuuuuuauaucuugggaaaaugauuuguagaaauccuuauuguccauuuugagacucaucugggaauacaaccuauuguauaacucaugagauguugaucuaaaagauuuuacuccagccagaguggaggugcacacagcuuuaaugauagcacucaagaggcaaagggagguggcucugucugcuuggucuaugaaaaagguuccaggccagccaagcuccacaaugagaccccucugggcuuuggaauauguucaguguucauuuuauauuguauuagagccuucugccuuauuguuguucaaccugcuucuguuuguuguuuuuauguugcacugaaaaguuuguuuugauauauuguucacacauugcucuaauuugaaucagugugaggaaguaagagccuggcugguggguagguaugccaugagucgcugcucaucucaucgggggagcucuuuuccucgggcagauucagcuuugcgcucuuuccgaggucccuggacuuucaagauaaaugaucuugauuuuucugcagugaucacaccaagggaauugcucuuggucaagaugaaucccuaagaauauacgcugugugggaaaugguggucugugcugccucucgcccuggcaguguucuuuccccuagagauugaauuucauuuugugugaggcaaggguagaaggagacaggagcagaguuucuggagccccuucaauccuagcggaaccuggagcugcaguagccugagaaaugccuccuuuucuccuuccauguacagaccugcugaguccccaguuucagggaacugcaaagucucauacaaccgaccugggaacucagugaacccccucucucuugaccuuggggagccucugaagcacacccaagccucagcucucugcuggagaucauuuaccucagauugcucugggaaggcucagaaaugcugcguggauuguagguugccccacguagcugcaugaucggaugugcugagcucugaggggcuccaccugggugcccucccucccaugugacuuugccucagacccaguggaaaguagaguguagagcauuuuugcauugcuuagcagaaauugcaugagguuugaaaaaguauuugaaaaccagaacucacauuucuucuuccuuuuuuuaaucugaauucuggaacacaaauccauaaauuucauaaauguucaugucaugccuugaauugcucauuuuaucugcaaacuggguuucagaguugccuaguggcucaguggugagguuucuauucaguggccaacuugaaaggcuggggagauauuugaaagcuauuuuggcauucugcucaggaaguuuauuuaaauuccauuuucagguauauaugauaccuacacgaagcccagagcaagaaugacaaauguguuuuauacaccuacaaauauauuuagcuuuauuuuuuauauauauuaagaagggaagaacuuauaaguuccgagaacuucaaacuaguauuuacagagcuauccucacgcgaguguuaaaggcggcggcuccccgugaccccgugaguuagauaaaagugcaugcgcuggggaggcccuggcauacacuuccaccucaaaagucacaaaacuaagaaaugcacucgaaugugggaaugugacuacuuuaucacaaaucaaugaaagcuuuguacuuguaauagaaaaacaguacguuuuccugaaaucuucuaagagaaugccacccucaccugcagccuccuggggagcaaaggcaccggggaggugucaggaugagugaagggaaggcaagauuguucucugugucugccaagcaguaaacagggcuuucccucaguaacauuuuaugaguauuuuaagauggcugcugaaguuguacuacuucuagauguuucugcagaacaugcucuuagggcagaaaggaaccuucuuccagacagaaaaauguaugucagaaagccaagccuaggugagcuggaagcaaguccaaguucccugacucaucgcaacuccugguggcucugagcgagggcagcgguucucccagaagcagaguuugaaguacagugccucgauuccguaaucuucagccuccagaauaaucuaacccauguaccaaagccagaggagacauuccacacguucuagccuacccgccuugacucguggcuuacuccugcaagguuauuugacagagaaacuaacuuuacaggaaagccggggcugcagguccacauccucuguguaugggauucccaucuucuauaguuucuguguuucagaaacuguagacuggacuuguagcauagacuggacuugaacucaaccucauccuacuucagccucugccgugccgagauuccaagugugaaccgccacaccugucuuucgaguccccuugcaggcagguacgcaggcugcaagguauuuagaggucucaguuacaaaggcagagucagagguccagcagguuggagacucugcugaauggcaagaggaggccaugucagugcucaggaccugcugacugcagagccguggucauucugcuuugcugucucgccgaagcccauuuccugagggggugggguaaguacaauggcugcugaccucucucugcuggcuauacugcuuuaaaauguuuuggguuacaauaacuguacagagagccaccacgacacauucaucaagaacacuagaaaacggagugcugacauuuccauccccugcaaauagaguaugugaagagacgggagagcauuuggcagaauuaaggaccuuucugccucugguuggucgcucagcacagccucucucgcugcucacagugcccugcuugccuguggaacaucuugcccgagcugaggagaauacuguucggacuuguagaaccccuaagaguagcucuuggggucauggucacugggggaggcugucaaacacugucuccuccacccucucaccucuguuugggacguuucccagcuaauccgguucaagaccuugaucuuaaugcaguggguugguucuggcaggagcaccucuucauccaguaggcaguauguagccugggugggaggggaucucuuuacuggaccuggauuugcccaaacuccugaagaggggccugggagccagaaacuuagaugcaauagaaaagcuuuaugaugcaucagggcucugccacugcugccaccaggguauacagaucccauggguauacuaauccccugccauccucuuggucuguaaccugagugaguaaacuggcuccuuccauuuguuuucuacuauugugacacagcacuuauucccuuugggccuggguaaucagagaaaauuccagguuucucaucucacagguucugaaaugucgguucugucaauaugagaaagagccaguauacaguucuauccaucuggccucaacauaucaaugaaaaaaaagcccuuuauuccccaaaaaguugggaaccuuucuuaugucuauaaggaugcugccauacaauuuacaguuuuguguuacacacuuacacacacacacaauuucaaagucagggauugggugagggucauacaugcuggaggaagguaaagcauauacguaaccaaacugaauguagccaauagugucauuguacuccucaaaggcugggccugaauucagucugcucacugccuaacuuggcauccaccacugaggcucaggagaagcccuccgagugggagugaacuacacgucuccuguaugguagucacacacaaacuacccguacccaaauuuuagccugacaacugagcugauguagucccaacacguauccaucuacuaggcaaccccauggucucuggucucacucucucuguguaaaugcucauugcaauauaaccaugacugcucauauuuggagcgccuguggcugcuuugaggauaaagauagaaugagaaucaucuggaugugggucccaaagcugaucaucggcccccgaaccucccaacgauugcuggcucugcuccgugggaagggauucugagguccuccggugacacagguccgaggacugcaguguucaucucucaccaguuugucugcacagaaucuuucuuacauggcugauauugccauuguuuuaugguaacgugguaaaucaacuucaggaaacuuuacuacaggucacuguaugagguuugcuaacucuauuauuuaaucucccaaguccugaaagcacuauaaugcuauccucaccaagucccugaacuuggaggcauucccaugaguggauuuguguguguguguuuaauuuuuaaguaaaauaaauuguuaguuaagccacuaugugccccaaauagguugaacugaaucucaaaccaccaagaagccaccuuuuaccuggcugaaggauauuccacugacaggcaacuguucccuugccuaggaauuggaauuuaugggcuggcgagaugauucagugguuaagagcacugacugcucuuccaaaggucaugaguucaaauuccagcaaccacaugguagcucacaacuaucuguaaugagaaacaaauaaaaaaaagaaagaaagaaaaaagaaaaaaaaaaagaaagaaaaccuaugggcuggagcgagcaggugcuggaacaaguagccagagcaagagggagaagggaaaagcggggggacugguuugggggggggugacuggaacuuauaagcugucagucaccuuagcuuaagucuucuuuuaaucuguggucucacauguuuucugacucaguauagacauagaggccccauacuucaugucugcuuccuacuauuauuucuauuauuaucucuggugcaaggccuggcaugcccugagugccccucacuuccuaagccuaagagagauucuuggaggggcugucagugaagaagcuauagucgggguucaucuugaccucgugguuaacaucuuugaauguaguuucucccguggguuucugguuuucucugccuuggaaggcauuguugggcuguuaggagugaauauauuaauuuucuggaucaaaugguccucaacccgcgaaucgggaccccuuggggagggugucagaugacccuuuuacagggguugcauuccagauauauucugccuaucugauauuuacauuagaguucaugacagcaguaaaauuacagaaauauaguagcaauggaaacagucuuaugguuggggaucagcccaacgugaggaacuauauuaagggccacaacauuaguaggcuugagaaccauuacuuuagagugucugggauggguuagcuuagaggcaggaggaguggucuccccacagggcgcugcuggugcugcagugcccugggcagugaggcccuucaggcagcuggucagugacugcccaacucaggaagcccagaguggcuacagggaauuuccacuguuucaagaacugguuggguuuuuaauuccauauccagcuugcccuguucucaaccuuuaacaaaagcaucagucaugcagguagccugugugaccuagcacuuccugagaagagaccagaauaauacugagaacacugaaauaggcaggguaauucuuggcauucacgccagccgugugagcaaaugccgccugugcugcauaaagcagagggaguugcgugaauugcccaaauguuuuacgggggacuaaaaagcaugauugugaggaaaucuuugugcaaccauuuccuuacagaaggcauccuuuccaacgcuguccauagguccuacccuuuuauccugucuccauugugagcucuuauagacgggggcuuccuacaaaccuuacuuaagucucugccacuccuacuuugaugaagacccaacugaagcucaguugccuaugaagagaccuuucucugcgcaagccuuucaggcacaccuaugagcaaaugagauaaaugggagagucucguaggaagaccaacuuggaagggucuuaaggcacacaugucuggcgaagcacacaucacuccauagagaaaaagccacuagauaaagaaaaaccccaucaaggauauuacauauuaaguacaguccacgauauguagaggcugcgggucaggcucaaagaucaucacuuuccccuuacacuguccaggcaucacaagagaagguccaugacucucaaaggcucauuuauaucccagaaagcacuaugggacuauggguauaagauaugucacauagaugcagucauggcugcagugggucuaccuccauuaggagcuccuucuuaauacuggugacuucuauccagaaccacucagugcuuuacugggcaagacaggcaagcagaagccuugacaccgggccaccacuucaucagccucuuucacagucaaugagccauugguuugagacuauuuccuagggacaacuuuggauauuuuagcuuaauggacucuuuaauaauuugucauuucacacaaagugaguauguaaugauacauauauggauggcaagauggcucagugggcaaaggcaccugccaccaagcccagggacuucuaucuccacgagccaugugggggaaagagaggugauggcugcagguuguacuuugugcccccaaacacacgcagagggaaauaaauaaaauauaauuuuuucauggacuaaaaaugaaugagcauagaggagaaugcaccuccugauguucuaacuugggaugcaaccgacacgauccucccuagccuccauaagauauacaaaucaggguuuggcuugggugaucagagaagcgggcaauguuuacucucaggauuugggagcugaugaaauugccccacaaggcaguauuuacaccagggaaacgggcagguacuacccuucuccgcagcuguuauaggugucauaguguggaacuggcuauggcuggcccuuuaaccuuuggagacgccuuggaaccuccaucucacagcuucugcuuugucucuuagaggcugcuucccucugugauauccccauauagacaagggaaguggaaaauuugaguauuaguuaaauuaaugaucuugguccuggagugggaauggccaccaucaaaguaaaguaaccuuagauuuugaaacuucuugauucccuguuauguuugccagucaguucccuaagguagaugcgaaugaguguucuagaaccugauaugagaaguugccacacuguggaucugcauugagaaccugggcuuguucuguauggaugaagaacuaagcagagguuuuaaaggugagggaggggaccuuggccuugauucaaggugccaaguccuaagauggcuaggacucugggcaagcuuugggauacuggaguggaaggcuuucugugacaggagaccuuuucucugucuucugagugacacuaucaagcucuuaaauccuggucagugugaguagggaaaugaauggucaaguguaacuaacggcagucaacuugaguuuaugagauucauuaggcacagguggcuaucagccacucugcucagcaaagaguccccagggugcccagggcaguguugaguagcagccuuugugcucagcagaugagguugcauuuauaacacuguauucagauaagggacccuaaguguuccucaggcccucuuucuccuaugcaaaaccacuguuuagugagaccaacacuagacacucgcagacauuauccaguucaacauuuuccacccggcauuggugacauccaguuauuacaagcuauaucaaaguucaggacagguuccugcuguccucugugucuugcuaaugaaaccagugcauuggcuuuuccuccugcccuggaaggcagaggcuguuucuucuucacuacuugcaaaaagcaaacacugacuaauucacccacagcaauccucugaguccagugagcucugcuacagugacaauguauuacuugguuucuuuuugccacaccacucguagcucacuucacccacagaauaaagggggccagcuacguagacaagaaaacacagccucacauccaagcuccagagcauaggguggguuagaugguccaaagggcuguacaagagaaggcuuggccaaucagaaaaagguuggugagccgugagcacuguuugaagaugcacagaaccagcucugccagccucgccgacagugagggcugggggagauguguuuucuaacuuagaugaucagcagcuggucauguccaacaagcccuuguugauuucuggacuguuuaguaguccaaauggacacccagaacaacucaggggugcgggugccuccuaaucaccuacagaucgggcuugucuacagaggggcucugccucugugugcuccuggaaaagaaugaaaaccaaagacugucuauuccuugagacaugguccagaaugcccaucccagugacaucauuuaucagucgcuagcauuuccuuugcccgaugcugucugauuuguucuaaugcugucuucuauaaugggacuccgaaggggcaaguggccucuuauuuaaauaucuugagccagcgugcacauuacaauucagcaagacuagaaaacaucaaucugaaaagaucacaaggaagacccaucagcucccugaauagacagggagagauugaaacccaaggccagauggguaaaugcuaaccaacgaaugaguaucagaggcgagugugccaggaagccuggccuucaacacaccugugacccuugucagacugcagcccugacacaaaaaccaccggcauuagacuccuuagggcugggacaucggggcugcugaugggccugcaaguggugagcccacaggggguaagaugcaguggccauacauacccuucccgaugggcuucuccuuucuccagcuccugaauaacucccagcagcacuuugauggucuccuggcuagagcugauuaaguucuccaucaccugcagcugggccuugaggucuaccaccucugugugaggcacaauuuguugguguucuucauccccuaucccagcuguggggcuaggcugguucugcaggggcuguucgcuacauucuggggacagguacugcaccgggguugagcaggccacagcagagccuguggaugccuguagcccauugaggugggcggcucgccucugcuccucaucugcagggcagagagaccacuggcuggcagcagcagaguuugacaagccaggcucaggggcccugguacugauggcaggcggauacacaguggcgaccucgguuuuaaacacccuuccgugggugaguggagccggcuccucugaguccagggugccccugucaagcuuagcucuccccugcagcugguggaugggcuccucagagggaggccgagaguuuugcaaaacagccucuggguagccaagcacaucuggagacuuacagagcucugcacaguugaccccagaaggcugucccagugcguucacgugcucauuggaauggaaaaccaaugcgguggucuugugaauccuuccugcacugcaaggccgaggcuccuccaugggucccgccucgcucuucucuuuugaaucugcuagaaacccauuguucuggcuuuugaaggcaucugcagccggcaggccuuugagacugccuuucuugcgguccagcgggaaugucugguaacacuugcgaagaucuggugaggucugcacaccggugcucuuggugacauugggaauggaucggcgugcaggcacugucauauacuuacgauaggccacccugcaggacacagccuuggccucucgcuucucccccagaggucccgaagacagcugugugucucucugcucauucugggccucacagauauccuuaaaacgcaccugcagagcuuuguuucgcuuuuugaucugccgguuagggucgagggcauaucucaucuccagggccaggcaggcggcgggcuccacuucccgcucuggugucgugaguaugcaucugccagaguccuugcugaccauggugccugcaugcagagacagcaacagaggcaucagugggucagaagcacacaugcaaacgaggccgaauggacguccagccaaaucacagcugcuggcuuccuaauuauuuuuaaacaggugaggucggccuuuauguuaaggaaaaucagacaggcggggaguugcuggcaggcacagcgugaacugcuucucgauauuaaagccugcuuacuuuuuccaugugggauacacuugguuuucguuugauaguaaugcuuguuuccccauuagacaaaccuguguuacuauauucaucaagcagcccaacaacucugccgcgucagauuugcaaauuaucuuuuuacaugugugucucugcuccguaggcagaugguuuaccaaaugcaacuuauuuaguuuaggauuucuacuauuuuuuuuuuaaaggaugacgugauuaaucuauuacuggaaucuaacagauuuaaagacuuaaugaauauucuaggucccuguaugucugagcagacaaacagacauagagggaugcccuuguagguaguaacuagggucagucaacaaggacucuauggggagccaaccauacuccugcacagggauauaucucuggugauaagucaugguggggaguguggcuuccagaaaagucagucaugaacauuccguggguuucccugagucuacaaaaacagcaauaccaucucucuucuaugauuucauggagaugguauuuggaaauuacuuugaaaaaauaaauuauucauucuagaauaaaauuuuguguuuugaucacaaccccguggggguggggguggggguggggguggcggacaacaaugguauuuguucuagcauuuaaaagcugaaagaaaauaaaaucaggaggcuuuuuguuaaucaugaagauucaucuugggcugagcuauuaaaugcagcuaaagagaugcagguggccaaugauucucuggggaauaccaggaggguaagugccuucccuuuauuagauaagcagauucacagcugcuuaaugcauacggaagaacuuucuugggagcugcacuugaagcaaggggauacaaggaaacugguccuggcagugcaaacuucugacuccagcuauguaggaagcugaggcaggaagaucacaaguucaaggcucaguuggcuacugagugaguucaagagcagccaggacagcuuagggacccuuguuucaaaaugugguagaauguuuucauaauauauauggggccuucgguucaauucugggucuaacaaaacaaaagcaaacagaagacagagcuauggugaugcuguuugugaguagcuuuugccagacuccugacaguugaggauaaaguugucagcuugauggauguggguguauacgagagguucaguuguucaagcccaaguguccagggaugcaaagacacagagaugagccaaggucaguaaaaacugguuauccagcccagggucaacagaacucaagcucugcacugaugcagaagugcugucccaguagcgauggugacagggguaguaguguaggcaagagccuugaccagagaccugggggagacucuugggauauaccauggcaguggagauauuugcagagaggcaaaugcacaugaggacagaaguuggugucaccauuccuauggcacagaaguauggugugccacuuguucaagcuuacacagcaggugagaaagcccaggaaggcccugucccaccaaacacugagcucacaguguugccaacagaucuacauauccaacauacaggucuaaugccucuccuguuauuaauccuuagccaguauuccaagccaauaggcaucguggcuugccgagggagaagaagagagagaacccaagcccaugacuuagggucauuacaugaccuauucugcaguggcuuacaccuuggcuacacugaucuuugccaccuuacaagaacccacaguuguuuacagcauggaagacucagaggcaaguccaaugaccaauucuucauaauaaugcugaaaacuaauggguaguuauaucuggagauacccuaaagucaucucugcacucucugauuauagaccaggguuacucuguggcugcuccaggguuccaucaggcagaugaccugcuaaugguggaagggaaugcagaacucucagcagccucagccagcagcaguaguccuggcuucucccaaacagaagagaagcaugucuuccucugagugugucaaccagccauguugccaagugaguuucaccaccgugacaauccugcauuagccuuuccaaccauauauuuccaaggcagaugccacuggcccagaguuacguccucagaaucaaggauuucaaguaggugcuggggauaucugcaggccucuggaaucugaaacucagccuucgggacaguuuuagagaggaggaauaggaauagaauggaccagagacaugauaacaugaauuucaaagcucauauauuggaggaggggauuaugccuggaggguggggcagggaagccucccagcacagauaaccgcuaucuuucggagacgcuuaucccaauggguaaaaggcacauucucagaagaaguugaugugggcaagaguauuggaaacuggggacuuaauaagaaaauuaaaucccaacccucauuguuuucugcgucuguucuuuggcuuuguugccaucuaggugugucagaauguauugugccaucauucugaaggagaccuucagacuaggggaaauuugaaagagagagcauuuuuacaaaaagcaauuuacuaguaauuuuucagccuuuucccugccaguccugaaaaaugugugucugaguagguuuguccugccucacuauucaucaucaggauuugccaggaacugaacugaaauaauuuucuuacaucacuccacugguuugcugagugcuagacccaaccaucagacucauaaaacaaaucagagggauuaauugcuggugguaaaagcaaaauaguaaaaaaaaaacaaaacucuucaugcuuuacugaguuacuaaguauguaaaacacaauucuccuauuagugaaaacagugacaacgaauaaauaaauggggcuggcccuagagccuugugccugcugggcagcuuugaagauuuuauuuauauugucuuuuaaaauuacauguauauguacuugaguggagauacuuaaaaagguuaucggcaaugggagccccuggaacaggagugagaggacuuugggaguugccugucauagaggcugaucaagcuugggucaucugcaacaugaguacauacgcuuaacugcugagccaucucucuagagucuagagaccaugcauacaauucuuugugcuaacaaaugccagccugugccugugccuuucccucccaucuucucauuugucccucaggauacccuugccugcuggcaaugcuccauugcuagacugggacuauaugaagggcacagcugguggucugcacccugagucccuuugaauaacagucauggaagaaauacccugagcagaaaaaucugucuuuuggcauaguagacuucaaaaaguaucagcuaggccaggcacaguagcaugucccugcaacuccagaaugcaggagccaggggcacgaggaucacugcaaguuuaaggccagccuagucuacauaacaaguuuugggcuauccauugauacuugguaaggcccuuucuuaauaacaacagcaacaauaacaauaauaaagcaucgggcaucugaaacaugaauuagucacucuccugguauuccaauauucuuuaucaguuguggaucauggaagaccuccaguaguccuggaacaugccugacauugguauauaaacuaaggguugcucugaaguuugaaucgacugugacacuugaauaguguuuauaaaaugccguccugggguaaguuacgccauagagcuagagguuuugcuccuuugggugagucucuuaucuguagagcaguggaaguccauaacguauauuggauuucauggggcaaugcuuaggaaaguggcaagucaugguugggcuugccuagcucgggcagaucuagaugccggagagcuguauagaauacaaaugucuuaauuacucucccaaauuaaguuucauaaucaaauaugaguuguaaauauauaaacccuguaguuuuagauuagcaaugcccugucaucugucucuguacuguuuuaaaugaauagcauagacuuaaaaaaaaauguucaguucaauuugaaggagugagaaagggaaguuacuaacagucuaacaauagguaaacaaucaaguaaaugaugguguaugcucacucgcugugaccauuaaaauaguaauuauaaggacgguuuaauaucuccacaaaacaggagcuaauguuaagggaaagaaaauggccuaccaaguuuuccuggguagaaacaaagcaaaguggucgcuauuguaccaaaacauugccuuuagggagagugucuuucccauguugauuugagggugacagucaagagggacacaguugauuugagggugacaguggagaggaggggcccaaugcugccaccacacuuuuccacuuaagcauccuaucagcagguuuuuguaaguguaaacccccucucagagaaacccccccgaaaggaucacguuggggaccagcaguccccaaaggccuucuuugaucacguugauggagagcugaauuuuaaaguuauaauugugugugugugugugugugugugugugugugugugugugcgcacgugcgcuuguauguccagguguaugcucaccacauaaguacuuguauguacagacaugcucacagggcucgggagaauuaacagaucaugccaguauucauuaccacgaagaagaaaauugccacugguuugaauuuauaauccaaucgauuugcccugagcucugugauuagaguguccaggaagucugggguuucaucagcugaugggaaagacuugcuucuauucugccaccgccaaaugucucauacuucccaggauucauaugugucccugugguaugguaugugugccuugguccucugacaggugggacuguggggaaacuaccugccuuagcgucuuccaucacuguguauagccuaaaagccagcaagccaucccacgaguguagagaggaacuacaggacagcgcuggcuucccaguggcuuuccugcggucgaggcaccuuggagccagagaugcuggcugcaguucaagauuaauugggucaacauuuuauuccauaugcuaugggaacgccugugcauuaggcuccuaggagugggggaaagagggaagaggauaagcuguucuugaacauggauccucccaguggggaagggagguagacuagcucucacuccagggacuccucugcagggaaagcuuuaauguggaaacccaguuugcaguccugaaccagucuuauuccccugaggcagagguagcuguugagagauagagaugcuagacugugucccagaacaugggcuaguuuaguguaacacauggagacgcucuuuuugcccagacagucguucacucuucagaggccgcagcuuugacugaaaagggaugacucuaaguccauucagaugccuuuccaggguggacaguaagugagggggcugugucagggacagcaaccuggcuugugggaggaaggaaaucagggaagacacauacagcuucuuuucuuuugguucucucuccccuccucacucugucucucucugugugucucugugugucucugugugaugucucugucccucuuuccuuuccccccucccuccaucccuccccacuuacuaggcuggcuuugaauuugcuauauguauuguuggguaaccuugaauugcuucucuggugcuaggauuuuagguauaugucauugugccuaguucaugugaugcugggaaugguuuccaguguguugggcauacaugccagauaaaugcauucacuaccucucuugcugaauagaauauucaaagguaaccugggccauugugaacugauggcuuucuuguucaacgcugaggauaggguuuuguuuuguuuuugauaaaggcaggcuuugagcagaauaaagccugucuaaauugggacucugaccuguucuuaucugugucauuggaauauauagcucacuaagagaagccuuggaaaagucaacaccaacaguaugagccauugcuggcaugcucacacacuguccuguucacagugagugggcagaaaggcaugaguugugugccucauccaggcauggacacuuugcuuugguguggaggcuuuggagcagugguuuucaaccuaugggucacaaccccuuuggggggucaaaugaccuuuccacaggggucaccuaagaccaugagaaaacaugauucauaacagaagcaaaauuagaguuaugaagcagcaacaaaaauacuuuuauguuuggggcacaucaccacaugaggaacuguauuaaagggucacagcauuagagagauugagaaccagguuaaagaacaguuuagcugggcagugguggcgcaugccuuuaaucccagcauuugggaugcagaggcaggcggauuucugaguucgaaaccagccuggucuacagagugaguuccaggacagccagggcuacacagagaaacccugucuuggggaaaaaaacaaaaaacaaacaaacaaaacaagagaaagaaagaaacaaagaaagaaacaaagaaagaaagaaagaaagaaagaaagaacaguuuauccacuucccccuuuccuucacucuuuagaagaagcucucucuuugcuuaaguucuaucaaaaacauuaccuuugcuuacccaugauccaaaccgaaucugacuuaguauuaaggucagcagaauuguaggauguuugugaaaagucagcugggaacccugccuucuccaaaugggguguuauguugaucaacaaacaacaccccacccccacccugcucccacugcauuuacaccaccagcuuggcaaucaauaguucccaaagaguuagguagaccagguucugacucugcaacccagguucaaccagcuuuguaaaaggaacccaucuuucuaucucugcaccucccccaugggcauacgugccagucccagcgaagucgagagguugggugguuguucagaaugcugcucgugggcaaaaguuugcugcuauagcaggcgcccuacuugcccuguguagguuccagauaaugaagagcucaucagauagccaccuggagcuccucagagauuggaguuuguaaaaacuggugcaccaggaaagagguaacuuccccuucuuacaucauauuauggacagcuucuucucauaaaaauagaugcacguguacugggauggacuuggagaguccauugccuuuaauuguauuaaauccaaacuuuuuugaaggugugugugugugugugcgcacgcgcaugcaugcgaaugagcaggcacacacaucaugccuguguugucaucucaugggccuguguggaaggcagagguugauguucggaugucuucuaaguuucucuucuaccuuacuuuucccuagacagaguuucucauugagucuggauuggcuggccagcaagacccagaucugccugccucaucuuaaacagggcucgacuuacagacauguacugccacaccuaaaauaaaccccacagguguaggggaucaaaacucagaucuuccauguugugcuacacacgcgugcuuuaccuaucaaacccucuucccugugcaccuuuuaacugguuuaacauguuuucacucaugguugauuugaacucccaagcagaauacagacuuuuccuuccuuuccuucaaagugcaucuugcaagcaaaagcuuuccugcuccaugucacugucaccccagaacagcacacggggacaugcagggcaggacuuccuugcagaaguaaccaucccauacaagagaagucauuuagaauuggagauacaaucugucuuucuggcaaguccacacaggccccuaucucuuagccucuauaggaucuccaccucuccacggcuguauucuccuugguuuggccaggggguugaauaggucucgguucacagcagcggcagcuuagccaagaagaaagagccgugaguucuucuuauaaucggcuucuauuuauaagcugauugcuggaugcagagaaaauguccugccccaggaaugcguguggaugguccauuggcuguacagagccaguaguaugugugagaccuagucagccuucauaguuuuuguuggccaaagucuaauguggaaagauacccugauuugaauucugaaggccuucuggcuuguaggcuacaaaugauagggggugcuuuaaucuggcauaauucacaauauaaagcaggggagccgucucccuuccucugaagcugauggcacagaagggugaccucagaaauuacucacugcccuggggauuguuuugucaguuuaaacaagacuuaagggcuggggagauggcucagcugguaaagugcuuucaagggccugaguuugauccuuacaacaaauguaaaaucccagaagugguguguggguuucuaaucccagcacugcagaaguguagacaagugggcacagggacggccuauccuaauagaugagcuucaggccaguuagaaaccacaucucagaaaacaaaguggauagucccaaggaugaccccuugcguucacaugcacacauuugggugcuugcuuacacuuguauguauagcugaccccagaaacacacauguaugugcaugcucacacucacucacucauagauacacucucacucucucucucucucucucucacacacacacacacacaaccacauuuuaaguguacacaguuaauugcuuggaauaugcaaaacugaaggaauacucugaccagaaugacggacacugcaggugugcaaagggcaaaguuucaguguuaagaauauuagugcaagcuuggcauggugucacuggggagucagaggcagguggaucucuugcagccuagguuacaaagagaaacccucucucaaacaaacaaacaaacaaggaaaguauugugucuggcagugggaaagagagagaauagagaaacugaaaguagagaauacuuuuuagacugugucaccucaauaguugucauaguuuuuguuuuauuauuauuauuauuauuauuauuauuauuauuauuauuaaaacaaaucucaucugucaugaauccugguguuacuugcucuucuauucuauacaggcuuguugaaucuucauuuccuuucuugaccagcaaugaccuuuaacgucaucuuuuuuauucauauuaaaaacccagcggcuacuuuacacccugagacuguagacaucccucucacauucugucuuccacauugaagguauaucccuugugcgcaucagccuucucagugccuccgccacacugcgaaggcccuguggugcuucuugucagguggugagugugguccaucuucaaccuagaaacccaacugccaugcuugccucagcugaacuuagacuaaggcaacuggucuucaaggcagccucuggaccuagcacgcagggguucaaagcccccccuccuacugggauugcuguaccaucuuccagcaaucugugcugcuaacaguaugaucacuucaacuccaugcugccuauugaaaaauugccacccacuaauaucuauguuucuuugcuauugcuucuccaguugacuuccuuuccauacuauuccccuccucaucuuagucuuugagccuuccccaaagccuaccuuccguuucuacuucccaucucuguccuuggaggcucuaagcaaaguccagucgagcagcaagucuuguuuucuuuaaagccgucuuuacucuuuccuacccuguuccucuuccaucuugucaagaauccccaacacugaaauucacacauuccuacaccauccugcgaacacacuguggucaucccuccugugcaacuuuccuucccuuagcucacuuuccagggcuguaacucagccaccacucaagguuccuggcucuuagauggcauagaccucgucuugcuuuuggcaguuucagguaucugcauguccaagguaagcagguacccugcugugugcuucuugguacuugugaaacaaugagacauaauccucagugaugugucauccuggaguuacaagggaccaguugcugagagagucccuuguaacuccaggauugugggcaauugcacuugaaagcaugcaggaggcagccuaaugugcuuucuccuaagccuaaguuuuugggcaaagccccaguaaaggaugugugauaucccugcccugugcccugccauccuucaauacuugcugacugauuugaauauacauauacgucaucucuggagcaguggcccuuuccaugaucuggucaaggagcuguaggaugagugugcaauaugagugauuuccaaggauucugucugcauucccaggggaaucuuggcuguauaauaaagcucgggcaggaauaagagaaagaacacguuuucauuaaguuugaagaaaccacuaccuggaguuaugcaacaucccuccgcccccacugaugcaagagaaagugauggcauguaugcucacaagaauaaggagaugaccuacuaauggggcaaguuuuguguuuaauugugaugcauaauggggacuugaugacauauuccuugcagacauuugacuugcuaacaguauauuccccccccccccccccgccaugauaucugugauguaguaguugccaaauaaauuauaauuuuaauucacacauuucaauggcuccaacucauauacaaauuuaagagcauagcaucuuucauaauccugggcuuuaaccagcuauagaggagauacugcuggccuuugaggggcaaacaacauuguaggguccaaaucacaacaguggaccuuagugcccagaggcacaucaaggacuggauaaaaucacauucauuuuucauacccuggaaaugacccguggauauacguuuuuacucacuaaguaccaugguuccuuaggacuauauaauuucccucuucuuuuauauacuaagaugaauauggggauggcagaccuaaaaaggacaaagaguaaggaguggaaagacacacugguggacagagacagggacauacugacaggaaggaacacucaguaaugaugggcaguugaacuacgauauaucuugguugcuuugcacuugagggagauauagagagcuuggguagccuugagccccacugucagguuuuuggcagcuugauuagaguuguaccaacccuuugcccacccagaauagaacuugacacuuuauucuggggcagaacagaggccaggcaggcaacugggauauacagcucuucacauacagacaucugaagugucagucuagugggcagaccaaggugauaguccugaguuugccuccauuucagaccuccaugguauuuuuuauaaagaucauggcaagaagagagagaacaacagaguaaaugguugaguggucccugagcacaaggcagcgagugagcaggacugauggugacaggagucugugaggucuccuugcagacgaagggauacaguagaaauagagaucucacucaguccuucggggacccuuucccuguugccuuucuugaaacuuuggaagagaccugaguauugaugaaauguguaucugugugugucuaugugugucugugugugucuguguguuuaaagcaaguugucuggcuuggcaggagaggaaaagaugaugaagguuguccuacugcagaaggaaaaaagcgugccuuuuccuugagggcugaagccugggcuugcaagcucucagcaauggcacacuguggguuaggagguaaggaaaaaaaaaugagaccauauauucaguucccaccuaaccugguacaucaguguauagaggguggagacuuggagggauuauguauuuuuaaacucuucugaccauuauauauagguuggauuuuguuuugcuuuuuguuuuuugaggcaagaucucauuauagcuuuggcuuuccuggaauuugcuuugauuaacccggcuagucuugaacucacagagauccacuugccugaaaauucucagugcaccaccauucuuggcuuccucagaucauucugauagugcaguuaugaagguacaccgcuagcuugugccuucuguuauuuuucuucccuaaugccuugauuucuucuacuucacuuuuuauuuuaauuuauuauuaaugugugugucuguguuagcacuggaucacaccucaugaggcgucaacccugcugaggaagccugggucacauuugcacagaugucauuacuuugccuaaccuuggauaaauuugccacaucagugauucugauagacacaguaaguggagaugcacucagaggcgagcuaauggacuaccugugaaggggcacacaaaugccagaacuaaaaugaguuaaaugaaggcacaaauuauuuuagugaagucauugaaccaacaaccacuauucaaacagccacauacgacaacuggcugggagaacucacaacaccaugcuccuaaauggucucgcaaagugaauggaagcaagggcuuaaauaagaaguuaguagccuugaaguucccaacucuccaugcuuccaccugcaacaugccagcaacucucugggucacuaaauccuggaugugggguucuagcucugggccucuccaguucaucuucagaggaauguagccguuuguguugagugguuucaaggcagaagauaggggagagaggaagggaccuguauggaccaccuucuacagacuuuuaaaaccacagugauaaauccaugggucugacacagagaacgaggacguuggugucacaaugucaaacugagaugcgagguuccagguaugaaggcagacacugggugucucagccuggccuggugaacucuccaagcugguagaacucuaacaaaaauucccuuggguuaggaaugucagcucuugggugugggagcuuucauggacauaaaggcagggaguguugugcucucucuuccccugguuuguuucucaagguuagucaguucaaaggcauucuuccuuuaaaaacucagucucuacccaagugaauuucuuaacaaagaagauccggguugugagcugggcagaggaaacccagccccuuggcuccucuauuucuuucuuuucuaaauaaggcaugauuagacuuaaggacaauugucuuuccuuuuaucaccuuuuaucaugauguuuccguccuccuucucuuagggggguaaaaaaaaggcaagaagaguugcuuccagccaggauucccuggauuuccagcaaaguuacugacuagguuuacaguuaauggccuuauuaaauauucauagagcaccuguuacuugguaguacaguguuucuuccuuuaaggaucucuuugaguugugagucaccagguccaucccuccuuucuucccucuuugaaagcauucuugaugcuuuagguuagaagugacuuaaaacaaacaaacaaacaaacaucccuccucucccuuucaaguaguauuuccagcugaauacucagacucuuauuccaggugaucaucaugguuucccccugcugucucccuguucauuagaaccacaccacccccaccccgacccacaccccaggcugaauguuaaucuguccucuaccgggugccauguugcauggauucuacuguugaugauuuuugucauggcugccugccucuggauccagccucaguacuaccagccaccauuugcccuagucaauucucaccuaucauaccuucucaguugggcucugguuccuucucucuggcuucugucuggauaucaacacuucaucuucucauaacauauauucuuguuacaggcgucccaugaggcccaccuuggccuucuggcucuuucucaaaguggcuucaaccugugauucugaaacccaaagcuuucccaaauaccacuucucauucuugccugucauucuuggugucuuuuccauucccugcaacaccacuuggcucgagcccuggguauguacauguuggacccagcauccucucacacccugacccuugaagucagccaaggugucacucacucacguugcagccucccacccugauucucuuguuugccacgucuuagucaccucuucucuuucugcuggacccaauuuccuuguacaccuuugcuucggucuuguaaaucuccuccuccuugguccugucugccaucugcuuaucugucuaccuugccuauguccaccucuuucuaagagccuggucuuuauaguuccagucaguuuccaaaauuucuaaaaucacuggaaaaauaagcaagcagauccuaggaagcaagcugccgauucuacgagcugucuagaaucuaacugcugcaaacaggugaaagagauuuucaaaagggacagcugaacauuguagaauacuccccaagaacaauguagaagcuauccaugucacuuggugacguagacuagaaacacaaaguuggcaaugggucugcuguuccucaaagacuuuccucugccuagcaacugacagacagaccucagcaucagccugcccuguugcuucuauggguuccugaaguggagagaaaucaaccuucauuugcaaagcuguuugugauguggucagcauucggcagcuccccccacccccuuagucugaaguuugcugcuuuucauuuuugauaauccuauccuagauuaucaaagcucgaacuggaauuuuccauaguaauuccaauguaaacuuuaaggagccuucugacauacuguuaauaucgcugucucuuguuucuucaaugguuaaaacaguggaacuucucuaacuguccauucugcauggaugugcuucucucuccucauuucucucuccggcuuccuaaucccagggugacguggccaccggacagaucuaugaguaugcagugcguuaaacuauuagcuccauacucugcaaaagcaauauccaaaugauuacugcagagagaauccuccccacaucccugugaagccgcauuaucuccaagagauuuacagagugauuuagaaacacaacucuuucuuugucuccuaauucuacuuucucuauauucaaguucauuuugucucccaugccuggcuugaacugagucuccaauucauacugaauaucccaaugacuuaggauccagguugagguccacaaggagaugacucugaaguucugcuguuucuuucuuuuuuguucccccccccccccccccccggggaacaggguuucucuguguagucccggcuguccuggaacucacucuguagaccaggcugcccuugaacucagaaauucgccugccucugccucccaagugcuaggauuaaaggcgugcggcaguucugcuguuucuuaaccugaggccaggaucuugguugucuggacacaccucccugucuucugccuucagggacugaaacaguuaccuccccagacaugguugagagggucaaaccuaaacccucuaugccuuaguaugcaacaucauccagacaacuuguuugugugaauuugccagagccauccaaaucuguagcucacacaaaucuguauucuguccucaagguauaagauaaacuccuuaagugaauugauuaaaggucgugauauuuuacaguauuuacauaaagauagauuaauuuaaguuuggauaagggcuucuccagacaucuuggaaguucauggagauagguguguugucaugucauaccaaucauauuaaauuuugcuuugaaauauugaagccacuccauaaugccaugaaauauuaaaaucaaauaugaagguuccacaucauaaauuaugucagcuaauuuugggcuggagaacucagaucucuggaguuacaaaggguccaggggugaugaacgcagcugucacguuuccgaaggagcuguggaaaacaguccuucuuguguccaggaguccucguggccuuuuauccccuggaggacgugagccaccuccauucuguauaauuggugcggugccccagcugaucuguuaacagccucucugcuacacaucugcuuagguauccgguggguugggccagaguguuagcauuaaggcccuuagcaacuccauuccugcccuucuacagcaaggccugcccugagaacugcuucacagcgcuaugccuccaaucauuucucaaccuuauugccugagaaguagccuggccaacgcaaggacucugcuucuacaagggagcucaguagcugucucucucagugaggcggccaugcaguggagcaaaccggaggauacaaauaucuagcaauguggauaaguaccuagucucucacaggauagccugguaucuguauuuucugugaacucacuccacuguguacgguuucuccuuggagaugcaugccugucuugcacaggccuuucuuuuauuuauguagcucuuaaauuuuuaucuccaaagggaaagacaaaagucaaaaaaugccucuuccuggggcaaaauaacugugacagcauagaagcucucugugguaaacugagguagcaggaugacuggaucuucagugagccuccugaaggcucacuuggagcuuuuuggugcuugccuuauuagccugcuucuuaaccacuaguuauguuucucaguggaauaauggaccugauuuaugucaaaaccccaaugucuuaaucacgauaauaaaacagaaagucacagcaacuauugucaccuuaagaccugcuucgcuucucaaggacauccugucuuuaaagagaggucuuugcuucagauuaauaaaaaaauaaauugaaucagcaccuuuuaaaggaaaagaggaauuuaaugaagaaaacagaacuccauugcucccauaauugaugccaaauccugcuaugcuaggcuaggcuucuucccuaccaaauucaaaucugauaaacccauccuggaacgcaguacccucucacguagagaguaaacacggacaguaaauuaauaucuggaaagguaugcagauggcaagacuuccuuuuuuuccccccucuuugagcuguuuugugcacguuugcuaaucaugcuugcaaaaaauugcaaagauaaauaugaacuuugaaaaguagcauucaacaggaugugaguguaagaaauagcacaccaugaauaguaaaacccagcauguuccgccucugcggagugcaaugauuacggucuguucagccuuuaccgucagcuucauaaaggcaguagccuucuuauuuaugaacuacucauggggggcgauccagcuuuuaugaucugaaugguauuuuuuaaucaggucccuagcucuguaaccuugaucaagcccugaucgggcugugaaaaaguaccccccgcaagucauuuucuaagagaaagacuucaagcuacugaccucaacccugugcuagcccuugacuuggugcucugaaaugaucucauggguucuuagccaaggcagggcuugcccaaaguuccuucccacucuugccaguuucaccucgggaugcuucggcagaauuucagcacccaagcagacaaggucaaauuaaacugcuucuccugcugccucuagcucaugaguccaacagggcagccagucccccagccccaggccugcaugcaccaagagaggggaagggaccugagcccugaucugcagagaguagaaggcacccauuuuucuuccuuauuuacuccaggggugccucuccucccccacucuggcaucccuuuaucacuggcuccaucuccuuguggcauauuuucaggguaguagaauguugaggucacagggagaggcuccuuuucuuuuucaagcagcagagacgccagccuggaacccugagcaugaacaagcaagaugccgagucuuguucuugacuuugggcucuagucucugccccugcuuggggcuggccccuguucguuccucuuuccugcccucacuagcucccuaggauccgcagcaucgguugguuucccacgauugugcaggucaggcaugugcacucggaagcucagcggggugcagaccccagcucagagaaggugccuauacccguaaccaagagaagagaccaacauuucacgugggcauuuuuugccuucucuccugcuucggucuuugcucaacagcaggcggcagggccccucugcucagacuuauuccccccaucucccugaaguuaaucagcuguacuguacuuggcaguucgcuuuaguuuggauaauacuuucaaaaccucgaacguuccagggagauggucguccccagagcccccaacccccucccgcccaguucugccuggccaaggauguccugugcucacaaggcuguggcguuugucuagaauagacaucauauucccgcuccuccaagacuguagccaaaguugccagaugccccugggcgacuagguccugccagaugcaguugcguaaccucgccccccaccuucgccgcugcccgccaccgggucuacacugggcuacacccgccgucccggaccuaggcgaagccaguuuaggggcuauugcgugcgcaagagccagggucugcgcccaucugccagcggucaaguacagagggcuuggggugcaggaggagggcaugcugggcucugcuuaccuuuggcugcuuacugauaaguggaggucggugcagcgccuggcucgggcaugucuugccgcggacccuggcaagccuggcgcggcacggagcacucggggcagagcauccacggcaaggaucuccgggcucgcgcugaaggaggcucggcuccggagacuuggccagcugcgugcccgccgcccgcccccuccacugccacgggcccggcccgcccggcccggccggcccccgcgccgcagcucgagucccuucggcuccugcucagcgacgcgcacggggaggcagugguucggccggcuccggggacgcccgcgcgcucgcccgaucgcggcgcggcggagccagccacagccacccggcuccgugcuccucagauguccucauuuacugcaauugucuucggcgagauccgggagccggggccgggaggagggggcggagacggggagggagcgggaggggaguccuggccgaggcaccaggucccggcuacucuaugcagccgagcggccagaggacugaagagagggcaccgggagcugcgcgccagucgccugugcgcucgccugccaccgaggcgggcggagccccggggcccguggggcggggguggggcgggggcgggccaggccgcgugcguggggcgggggccgggcgcgugaaggagccccuccagccagagacggaucgcgggcaagaggaggaggaggagaaggaggaggugcuggaagcagccgcuggcugcugccugugcgcggagcuccucagccacauuccuaggguuucugagcugcaggcggcgcugcggggccccuggaacuuguugagucuaccuaggagccaccucaggcaggcacggggacccuauugauuucuucuucaggaguggggcugucuauaggaaacccugcuugauggcuuucuguggugucaaccagccuaccccugcuggguaguuaauacccuagaugggaguggacaucugggcaaggcgcccgcccccucaccugcagaugugucuuuggagagacuagggaugaagguuucucuugcauuuuuuuacguuuguaaccaaccaggagucugucccucaaauaaggauuugaaacgcagaccuguuuauuggccuagggacaaaguagagagugucugccugccuaucagcucuguugcauccugauaauuuguggacaugucagagcaggcaucuccacuguuccucaucuggaccuccuagucccucugccccucaccccccuagagaggcagugggagauuguguuuguuuugaucagaguuaaauaaacucggaaaagagauuucuuuagcaugaacagaggacaauucccagcauauaccccaaacuccaccagagucuugugagcucucugaugcagguucagggucuuccccgaugccuagcagggcugaggagcagacacugggacuaaguauucuugcauacaggucucccagcccuaccugagacauacuggaaaguagcccccaccgauaacauggugguaagcuuuggccaaugaacugggauucagaugggaaaugcucuuaaucacccaccccuacaagcacaccuuucagacagaagacaggcucugguuuguuucuauguauccuuuuaucccuguaucccaucuuaguauuccaggccacuccauugcucuauccucauacagugggcugauagagcccagcucucuguuuuauauauacuuucagcucuuucaaagggcuuucuguaagauacugcauugucuauguaggaugauguguccacacguuucaggaggaggucauucuaaaauaucuucccuuugcauggagagagcaccaagccugaggaacccagacucugucccucccacucuuuaaaaugccccuuaggacccagauucucccaauucugauugccagcccauuuaugucuuuaggccuggaggcggcugggaucuggcuggggaaagggccugugugccggcugcuuuuaugucaacuugauucaaauuggaguuaucugagaggaaggaaccucaauugagaaaaugcacccauaagacccagcugaaaggcauuuucuuaauuagcaauugaugggggagggcccagcccaucgugggugcugccaucccugggcuggcgguccuggguucuguaagaaaguagguugaguaagccaugaggagcaagccaguaaggaggacccugcauggucucuguauuagcuccugccuccaggcuccugcccugcuuagguuccugcccucacugcuuugaaugaugaagagugauuuggaacuaugauugaauuaaacccuuuacucuucaaguugccuuugcucauggcacuucgucacagcaacaguaacucugacuaggacagucugcaagggugaauagacucugcuacccagcuagaagccagagggcuguguaggaugggacuguguaacagcagauggcaagacuuccugccugacaugccucccgcugcccccuuccccaggugugcucuuacaucuuugggaauucuguccagaaaacuuucuguaaaucuuaccuuauuguaaauccauaagauuagaaaccccuuuuccuauuucuuaaguaugucacugcacaucugccaggcaaugugggaguggcaccauugagaauagaagguuuggcuuugggauccaugaguaaaaucagauagacagaaaagugugcagaggaggccagagcucagccacaagcggcgcugugagcugguuaggugucucuagagacagugucagugaugauccccgcaauggcuaccuagaggaggcaaugauggcaugcuauggccggcagguuggaagauguucuagcugagccgugguugcucugaguucuccagcugcccaguaacuucagcuguugcuaggucuauuguuauccugcuuuggauuuaagaugccucuguacaggcucacuugggccccaucugaugaugaugcuugaagaaguugugggagcuuuggaaaguggagcuuaucuggaggaaguagguugcaggggucaggguaucagguuaguccuugaggguucuaguuggaucccacaucccauucccuaccagagguucgagaagucccagcugaguacaucuacugucaugucgcuccuaccuucccuaccuugaugaacuaauaccucuaggccacaccccaacaauccuuccucuuuaaguugcuuaaagaagucucaugaauucuguugcaguaauaagcgagccauugguguaccuccugcuauuguaaaauguaugacugcauuuaccuacugcaucacuaagucugccaucacaaauugagauauugcugagagugugugucauuugacuagggaggacuguuccaugagcaucagcgugcucagaaccgucaagcaagccuuguguucggggcuguguggggggaggaguuguggccuucuugcugcccacagaugcucuuugcaucauaguuucuguguggacagaacagauguauauauuaaggguuuauaaugaguccuuauguucagcuuccccagaaaaaaagaaaguagacucauuuuaggaaucaauuagguauaaauugguuucuuagguuuugcuucagaauuuugccacaaaagguagucuugcaaaggagaaaauagccauuuuaaaaagagauuucccacaggcagaggcagccagagaauaaaacuacacagcaauuccugcugccuaacccacacagagucugcuccuuugacuuccuggaaguccugaaauucuaaaccagugaauuggucagaugucgcugggucauuaggguacuaggcuagcaacgcacagaccuggguucccuccucagccugcagaaggcagaccuugugguguaugcaugcaaacucaguccuugaguggucaauacagaaggaugauaaauucaaggucauccuuggcuauauagcaaguuggaagcaaaccuggacuaccaaagacccugucucaaaaccaaaacaaaaccaguaguaugauaaacugcagugugugugugucuguguuccagaauguucugagcaguuuuaauuccaaacugaaaguaaccuaaguauccuaagaagcaaauagguaagaauuucuuggucuuaucaaaguguggaggauuaucuagaaacaaccaccaacaaauuauuaccuucugaggccagaagacuuuugggaacaucaugcagaacgagaguguaugucaccaauuugcuggagagaugcucagugguuaagagcacugacugcucuuaacaaaggaccaggcuuugauucccagcucucucaagucucacauugucuguaacuccaaucccagagaagcugacgcccucuucuggccuccgagggcacugcauacauucaauguacaagacauauaugcagucauacacuucacauacauacauacauacaaagagagcauguaucacuggauucauucacggggauguuugugguguuugguaugacgcugguggcuacuguuggauguuaauuacacagagccugcggauguccuuguacauccauuagaacuagguguccugucaccuccuugcauuuugucugucuauauugucacugcguccucaccaugccuuauaauacgucucuguaaaugaaggggcuuauugacagugauaugagcuuucaucgcugaagcccaaacccaagggaaagagcaaagaagggcuccgcagccucucugcucauguagccaugggugagaacguucucaaggaagcugcugcagaaaccuggcccuccugacucucagaugccccugugacacagcgcacuuggggaugauuucccaccuccuacuuuaaugcucucaagugacucaaggugggacugucuauggugagugguuucccuccuccagcucagaggccgcagcugcagccauggucgacccauagugcaggagagggagcuugcauugaugagccccuguugggugggagcagugcagaugcaaagcucugcuuucucuucaagaacaagaccgacacaaugcucaaaaugcauggccaccaguccuccccuuagcccaggagacccgugaggcacccucuucagacauuccauuugucaccuaccuucugccuccuggaccuguaucuccuugcaucuccaucucugucaugcucccuacccacaauugccuacugcucuggacccugggucuuacccucuuggaggcgagccacuuguucacccucugaugcuacucucccuaguuuuuuccauuccaauaugagagaccagagaugguuuaucagccgcuaaucuaauuaguuugggagaggcugagcaucuagaagaccggugaaaaucccagguuuccuaaaccaaucacugcaaauagaacuuaaggaaaugagauguuuucccuuuuaaagaggaugcuggugguucuagccucccuuuaacaacugcagcagcugugcuuggugaggaaggauggagugggcauguccuccuggcacucucccagacauacacgugccgggcucucaucaaacccucaggcagcugggcacagugguucaugacuguaauccuggcuaugggggggggggggcgcugaggcaggaguucaaggcaugcggggcuacagagugagacuuugccucaaaacaaaacaaccccagcuuuccuuuucuagguuggccacccuuccccucacaccccaggacucacugaggaagcaagccugcaguagccauuuggcuagcuucacucuuuucagccuggguuucucaccauccgugucuaauccaaggaguaagccuuuugcuacagagguagcuggcuccagagccauucucaguguuugcugccaucucucugagccugcugcagcucagcuucuguaaagcagcucaucugcccaggccaaagaugacaccuuuaaccagaacugggucaaaaagggauaaaaauugcucucaaauuucagggcaugucuuccaguccacucuguguaacgcuguccucuguucuuccaucugaagucugcccuuggacagaggcuggguggcagcguggggcauugcagggaggccugaagucagaguagggcaggguggcacuugucuugcaacauccagcauaggaguugccugguuuguccuuguuuugucccuagccuuccuaggcaugcaggagggggcaggagcgugggaagaagacaauggaauucuccuguacccuaggcucuucacacaagaugcguaugauguucggcucuugugacgagccugcagcauguugugccccggcacuuuguguauugucugcuucuguccucaugggaaggcugugaaauauauugagacaaacuuuccacagauguuaaucagcaguuucuccaaggucacacagccaggaagugcuggagcuuaggcucacacacggguccugcacauugccaggcugcuagcugcuucguucaguuccuuauuuuuaucugcccuugacauugcuguagaauauauaugguaaguugaguguggcuugacuugggcugagcaaucuugcaggaguggggacugucucuauccacuguaauccccuucaugguuuuuaugggucuuaagugauaggagagaccucugucuccagcuuacuauaaugccccagaucaucaugggaacagcucaaagggaaacucucuggccccagucaaguccuuugccucugcugagcucccugcugcaagcuggcaagccucuggccaaguuuucuuucacuuccuuagccagacacccuccucuugguguaccugccauuggaacuuccaggagagaccaggcauguggucagccaccgagcaggaggcuuuuguauuggguaguguucuguuucacccaugugauuucagugacauuaucacacauugucuccaucaaacgacaguuauuaaaaugauccaucacaacauacauguucuguauacaccacagagcucuucaaaaaauuuuaugccaugaguaauaaaguuauauuacuguggccuuuacugaugauacaaaaucccugccugcuuucauuccugagccccagcuaauuuggacagcacuuucuccuccuucuccucccccucuuccugcuucuccuccuuuuccuccuccuccugcuccuccugcuccuccugcuccuccuccucuugcuccuccuucuccugcugcuucuccuguuccucuuccuccaguagcuugcugugcauauaauucuaauuacccgcccuugacauuuuuauacucaguguaauaaauuauuuugcuaauuugggucuaggaauugauuaccugacguugaauguuguguuuacuggggaguguggauccugagggugggaagacaugguuuuuguuuuuaagugcccagguccacauuggaacaguacgaaugucuuuguaaauaucuguuuauauuuggugacccccuaaguccacacacagauuuucaguugcauuuuuacuccuaauacguuuuucuuccauacugaaaauucuuggggauuagaugagcagguuguucccaguauugcaggccaggguucucuucauucagcauaaaccaugccaugguaccuuaugggcaugauacacucuaaggagcgugugucuuuagagcuuacuucuuggugccuuucugcuaguuccacugugccuuuaagcuaaaguaacauucaaacauuucuaugaacauauuuuaugugcaauuuuacucccaggauuuaaagaauagcaugggaauguguaaaugcugccuacaauucuucauuuguaaauagcuugugucgguaauuucaagugcaguggguauaguuggaacacaauucugaaccccuugguugcagcugugacagccccuucugcaaggaaacuucaauggggucccccaagcccccgcagaaccugaaguagggaagagccaugagguguuggcaucuccuucuuggugauggaggccuuuucuucuuggcacccauuggcucaguauuucagcauauuaagcaaagaaagucacuguacuuuauacaguaugauauauacauguauauaggaguguguauguguguguguauguguguuuggguguguguguuuauguguauguguguguguuuauuuauacagcuuuugcucaguacaaagacaacaggaaauccaaauucauucugaguguguuuucagugugaaucccaagcuuuuguuuuagaauguauugacuaccugaaaaggauuccguaaagcuaagcagcuuauaaauaaaaggcaggaggcgagucaggagacugcauggauguuauccucaguggccacugggggcucccuucaucucuucucauuugcaaauggagaaaccugggcaguacugagcucaguucucuccaugacaagcaggagaagccaaaacaaaacaacaauaacaaaacaaaccaaacaaaaaaccaucucuuuauuagauaucuugggcuaugguguuaagcucugauguucuaguaaaagaucaaauuuauugagauuuauuuuguucccugcacucaaguaugaaaacaauguaauuaauuucaaugacaccuuuucuucuucuccguggaguaaauauuaucacaugaaauuguuggugacgcuuccaaaucccuuaaaauuagacuucugacucauucacacugugaaaauagugaagaagcaaccuccucgcuugccgguuccugauacugccgcuuucuuuuuuggucucuggguguuaaugaagaguuuuugguucuggaacuuuuucuucugcuaacugcaucaugggcagaagagugaggcuccacuugccuaguuaagcuccaggguucaagcuuguggcuuccaugcugcccugccuuugcuguaggcaaauugcuuaaauucaguuugauauuguagagcauagcuaauaagaacagcgggugagcagauuaggguugaacuuagcugugcuguguuggcuccgggcuucaucugguggaguaagugucagagguugacuggauguguccaacuugagugcugaguaucagcuuuuagccaaagauagcaacagaugcuacuccacucaaaauugaaaaugugcuuuaaauguugugaaauuucuaauaauaauggugauggggauggggaugguagugaugauggugaugguggggaugguaauaaugagauaauguguaguuuguaugaacuuuguaauggcaacaugguuuuccaguuuaagaugcuaggcacaugacuucuagaggaagugcucuuccuccuccagacaucuggggagagccucgucuucagcaguauccugagccaggaacuguuacuagggcccgaagacucaagaacaggaugcuuaaggcaaggaagauuccuugucuguaccgcuuuccaauguuuuucgaagcgggagcuuguuaacgcaugguaccgaaaggacauggugcugccuuuuggauaagugacaaggugggaaucuaaggugcuguucucagaggaguuuaggcaaguuugggaagcaucacuccuccacuccuucauuguaagcgaagucuggacucccagucuuccuuaugcuauuccuagauaugccauggugucuuugcacacgguacuuuugguaaucgaugacgucagcacuuuccuucuccuuaccugugaaguuagguuaagaguuaccagcaccaagugccaguuggagaagcaagcucaggugggacagugcacaagaugaaguccagaaucuuacauaaacaccccucccaggagcaggaaggauucagaacugucuacagccauaucagauaaagcaaucugccuugaggacaggcaaagcauggcugaagcuguccacguuuagugucuagaucuaccagaugaaccaauggcacucugagaugacaucaucauauacugugccuccucucauucuagaaacagggcaucuugcauucuugaacauuaccaaauacuuggauguauuuugagaugaaugugaacaucaucgaagcguugcucaaaagaauccuuuguaaaaaaaagguguugcaagcuuuccuuuaaaaaguuaauuaaaauauccuaagacuuuaugggccauaacaucuuguuaugaaaacuggucucugcugacaaagcagaacagcuauagaaaacaccuuuuaaaaacgaaacaaaaauaaggggacaggggugggcuuuaaucacagaacucaggagacagguagaugaucucugugaguuccaagccacccugguuuauauagugaguuccaggauagcuaagacuacauagaaagauucugucucgaaagaauguguuaaagagugaguuguguuugaauuccaaugaaagguuguuuguggggcuggugcuauggcucaugguuaagaauacuugcugcucuugcagaggacccagguuugguucccagcacuuacacuaggcaguucacaaccaucuguaacuccagcugggagggaugcggcaccugcuucgggccuucaugagaaguaagaucucuuaccugcugagccaucucuccagucucugaagucuuucagugagaaccagagcauugugcagaggagaucugugugugccgaggcuguuugccccuccagaacacuagacagugcuguuagcauuggcuuuucuucuccagcugauuuauuuaaauguuucacacagccaaauguacugucuuugcuguaggcuuuuaauaugggagcuguuaggaugacggauaugauauauggauuuuuuuguuuugauagugucuuagucaggguuucuauuccugcacaaacaucaugaccaagaagcaaguuggggaggaaagggucuauucggcuuacacuuccauacugcuguucaucaccaaggaagucaggacuggaacucaagcaggucagaaagcaggagccgaugcagaggccauggagggauguucuuuacuggcuugccuccccuggcuugcucagccugcucucuuauagaaccaagauuaccagcccagagauggucccacccacaaggggccuuucccccuugaucacuaauugagaaaaugccuuacaguuggaucucauggaggcauuuccucaacugaagcuccuuucucugugauaaccccagcugugucaaguugacacaaaacuagccaguacaauugaccccuugucaacuugacacacaaacacaucacuaguaagccucaacccuuacauucuuauucauccccaagaucuaaauaacuuuagaagucccacagucuuuacauauucuuaaaauuucaauuucuuuaaaauauccaucucuuuuaaaauccaaagucuuuuuacaauuaaaagucucuuaacugugggcuccacuaaaacaguuucuuccuucaagagggaaaauaucagggcacagcuacaaucaaaagcaaaagucaaucuccaaccauucaaugucugggauccaacuuacgaucuucugggcuccuccaagggcuugggucacuucuccggccaugccguuuguagcacacgcgucauccucuaggcuccagaugccuguacuccacugcugcugaugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaagguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaaccacagaaucuucacaaucaaaacagcaauggcccugaaaagagucuuuaauuuucccucugaaauuucacaagccagcccuccaucuucugcacuguucucaacauuaucuuccaggcuccuacaaaacaucugacagagcucuuaacaacgaauggaucuucaagaccaaaguuccaaaguccuuccacagaccuccccaaaacauggucagguugucacaggaauaccccacucugcugguaccaauuugucuuagucaggguuucuauuccugcacaaacaucaugaccaagaagcaaguuggggaggaaagggucuauucggcuuacacuuccauacugcuguucaucaccaaggaagucaggacuggaacucaagcaggucagaaagcaggagccgaugcagaggccauggagggauguucuuuacuggcuugccuccccuggcuugcucagccugcucucuuauagaaccaagauuaccagcccagagauggucccacccacaaggggccuuucccccuugaucacuaacugagaaaaugccuuacaguuggaucucauggaggcauuuccucaacugaagcuccuuucucugugauaaccccagcugugucaaguugacacaaaacuagccaguacagauaguuuccaaacaauugagauaaauaguuaaguuucuauaauuguuucuuguaaccauaugaaaaauuauuaagcauaagcuuccuauuuuuuuuuuacuagaguaagaaucaauaaucaaauguauguuuuaagguuauguuuaguacuauagauuuuuauuccaggaagcugagauacccuaucccugcaucauuuuguguguguguguguguguaggcaugcuuaugccacaacuugguuguagagaucauagaacagccuuggguaucaguuuugacuuucugccuuauuuaagacagggucuccuguucuuuuauugcuaugugcacuaggauagcagccccauggguuucuguggaugcuccucucuuucccaucuucuccaucagagauuggaguuacagaucuagguuuuggugccugucuuuacaugggcucuguggacucaaacucagauccucacaguuguguggcaaguaccuuuuacccacugagguagccgccgaaccuuccauuuauguuuaaaacaugcccccaaagugacaugaugcucuguuaauuccccaagcaucuuugaggguuuccaucccgcuuuggaauuuguccacacccugucaucuauuagugcuuuguaguguccccuagagauauaagauaaacuuaauucauguggcguuauuucugaguugcuaccauuaauucuacuuaacaucaccauucauuaaaaucaguucacucuccaaggagcacuguaaguaccaacgguugccagcacaggcugucuuggugacagcuuucuguuuaccuggccuugaggacuuaccuauacugaccuuucccaagccugucuaauccaggugucauuuaucucaucccaaauccauuuggauucucaggacuacucuuucccaucauccucuccuucagccugugagugguccuuuugaauggugguuucauggucuauagagagagagagagagauguugaggaugacucugaaugcuucacucauacaggcuagagacugagcuugcuuucgggguuuuagagugacaauuaagggucauuugggaguaccuaaguuggauuuuccugaaagagagcaaacucuggcauuguacaggggccagucguuuucagggaugaagauagaacagagggcugggcugagggcacauaccugagggcagguauuugacagugucgaauauauaccuguccuugcauggagguuuccauaacaugugcuugacuuugaagguccaccucuccucuacggucagaaucaaaugcuaagucaugguggcauggcacuaccuggcagaugggugcuuaaagggcaggaaaaucaucaaaccccuucuuccugccucccucaaaccuuaagaugauggauugggaaaguagauaaggcauaaaacugagaaacaacaacaauaacagcaacaaaaaugacauaacaucaauaagagcuccauccaaaaugguguaaaauaaacgguuuuccagaaggaagaacucaaaagugucccagggaugcuuagagauaguuuagagguaugggcauacugccucccagguugacuccccaccccccagauaucuagaccuuuugaacuggcagauucagcuaagagccuccccaacaccuuagcaggccugccacagucugcuguaagacugauccuccaaggaugcugagcccuggcuagggaaaccccauccucaguuguggugucccuagauucaguuauaaaucucuccuuaucaccagucugugccauuaugauucacugccugccugccuuccugccucucucucucucucucucucucucucucucucucucucucucucucucuucuuucuuucuuucuuucuuucuuucuuucuuucuuucuuucuuucuuucuuucuuucuuuuguuccaaaccaaaaaaaaaagaaagaaagaaaaagaaaaagauuucuucucucagguucuugguuuccuugcugacagaaugaaauuuuuuaugucaucuuaaauuuggcgguuauuacccuauuaccuauggaaacuacuguaaagaccucacucagcugucaucagauccagccguaggcaucauuugugccacgaaagguggccccagugcucagcuuggaaaaaaauggccccugcuuggcucugcaaaugacucccacugaagccuuggagagcugaggacgugacacgagacguuaaggagcuguaaagggaauggugacugagaauuucuuguggaaaugugguacugcuucugauuugauggugauggagucagcagggccuucucugugaauggcgggaguagcccaggcacccagggucugucugucuacagggagucugagcaaggcugugccuuuucccugcagcuucugguuuauagauuuucaguucuuucgucuagcccuuucucugcaucuaaacugcauccugguugccaccgaccacggcugugcuauguacugaggccaggccaagccggcaguugccuccuggcugauuguuuggcuaguugagguuacaauagugcggcuuugaaaguuuaucccuccccuucuccucucuuccccucuuuuccucucuuccucuuucucaucuucucccuacuuuccaagauccuauagccucgagguuuccugccuaguacauagucccaaucuaggcauuacuaauuucuuuacacuacuacaauuaaagcuugggauaguguucucagaauacaugacaagugaccuaaugacauaagacuauuuauucugucauccauucgauuuuugucuuauuuucuuuuaaucuauuguuugcuuuuauugcauuuauaggggaggggaccuguaagagccuccccaugugucuggagggcagaagugguuaaagguuaagaaguuaaggggccuggaucucuccuuucaccaaacagagucuggugauugaccucagauccucaggcauggcaacaggugcuuguacccgcagagccaucuugacgggccuuucuguuuuauuuuaucuaggacacuucacaggagauguauccucuuugcaguaagugugcauuggaguauugcugaccuguaaggauuagcuggaaaggcagacuuccaaaagcaugggaauggacagcucucuguccuuuaagaucccaguuaggcugggaaggcccuagacugugggaagggcaggagagccaguguagcuugcuagguaguuggugguucuguguuuuguguaucucuucgcauagcauucucccaagugcuucccaaaugaaaguucuaggguuuggggguugaugcacuuagggauauggagagaauucuccuuuccgugcauauacugaccuugguaguccugcuaggcacccuguuuucugauuuaacagacagcaucaccaagugugagaauuuggggucuggacuuaagucucucccucugagcucuggguucucccaagaggaaauagugucugugcuuuuaauucuugucaaauuugccucugacauuuaacagccuuuauaguauugaauuuugaaggcauugauuuuucuauaguagaaauuauggauuagauaauuggugaaauaagaaaaauccugauuccauaauuuucuuuuaaaaacacgcugccaggaaugggcuuauuugguaaagaggaaagguaguggggugggccuuccugcuguccaucugucccuggggugggccuucccgcuguccgucugucucuugggugggccuuccugcuguccaucuguccauggaugagaaccugcacccuuccuugaguacuugcugagagcaaaugccugucgauccccaccccuuucuuaccccgucuucugcucuuuguaugugaaaccuauuccugucuguaccaaaugagcugucuguccugacacacugcccaggggcucuugcuauuugaaucugcaaguaaaauuaaguucacuuugacuaacccaauuuuaccacauaaaagggggugugucugguagaggcauuagugcuuguucaccuguuaugaugguuggccuaaugagcccuggcuauuuccauguuaggaaagucauacacaauuuaguagaauguagaacucacauuuugaauuuugaacauugcccaagguauaaacauauauaacacagucgucuuuuguagcaagcccuguuuucagucagccccuggcuccccaaggaagccacggacaccacacugcauuguguggcuaaacugggagcugguagucuguguguauggaauauauuccaguuuaugcuaauuuguaguaaccacacucuaaguauugaaaaguguguguauuuccauaaugcucaaaacuaguuucugaagccaguuuaaugucacuuagcuuuuaaagcuagcuauuauaauugcuuguacaaguuugugucugcauucauuuuuuuuuucaaagacucugaaagaaauaccucaaggaaguaaaagucuucaggucuggcucacugauucuguccaugaguugucugugagauaucagucaguaaugacaauaacauaaaggguuaaauuauuucaagaaugaugucacucucaaaucuuaaaaaagcaaaaaaagaaaaaaagaaaaaaaaaagcauguuuuuagaagcaaaccaauaccaauccaccaugugacaaugcaguugccuguccuuuacauguuagucugcacuacaugugcuugggcuaaugucuuuagaaagcagugcagccuuugcuccugcaugcagcuguuugcucuggagaaccaggauucucccucugguuccucaccccauccccucagcaccagccacacuuucccuucaccucugcccggccuuccucagcuccuagcaguugagaagcaauugucuguuuuaggaauauucuauaucugucuucagacaauucucagugaaggaugaauuugccaaauucacacuucugcccuuccaugacggaggaggccuucucuuaaggacugaguuggcguguuugguggacgcuauuucauauccauucccuauuccucucuuagucacaaaagauguguaguaucuugcuugcuugcaugcugacuuccugccucucucacagugaugguucccugcuucuuagagucacuucucuucacauggaaagaaaauuccucccuaauuaaaaauagugagcaguagugcauacucucuuaaugaguaaacagaucacagcaaguggauguaauguaagacaucaaaucauuucuguccccugcucccaccccuaccuccccauccccauccuuucagguucacacacaguguugacagcugacuuccagcaccuuucgucaugcuguggugugaacauguggugugaacacauguggcccagacugagcuucuggcuccugauccuccugccucugccuccaaagugugaggagugugggugugcacuaccacacauagcuaucacugguguuuugucacagcaauggaaagugggcuggcucauauaccaugguuuguguucuggggaacacgcuuuggggaaugcugcuucuuuggcuaugcuaaucauguagggucaugcgcuuuccuuguguagagauuuguaccuuauucuaacugaucauucccguucauaugcaucauuuucuaauuuucccauuuguaaaccaaaguagaccacacacacaagaaacugagcacagagaauguuuuuaugguuuggaaauuauugagacagucccaugugguacuucugggucccuggauacucugcucccucaauugugcuucucuccaucuuucugcaugugucuccccagacuuggaguucacuaccucuugacuuugcuucuaguauacauaguugagaguaaguuauuuugugguguauuauuacccuuucugugcgcugagcuuuuucagugacacacauuuuacugugcgucuaugcuuguugauaguacagcuacagauuguucauccucuuuagcaaauaaaauaccagugugagaugggucacagcaaauguaucauuucuucauggauggaugccugacgucuaucggugcuugcaaugagagccauguugggggucuuucaucugccaucucccaguaauuccaggaugagaccuccgggauagcuucuccucaagguuaaugcuuuccccagacuagggcagccucagcccuucuuaggcucaggggucuggucuuugcaugaauaacaguguuuagacuugaccagccugauuccuugcagacugcccacacuucacuuguccuaauccagcauuuuaugguguuaaguuuuucauuguaugcugacaguuucuguguuauagcacuguaguggugguaaugugaggucuagccuggaccccugcuccuccucacccaaaaggacaugcauacuguucuaguuuacaauucugcugcugggauaaacacugcgauccaaagcaacuuaggggaggacaugguuuauaucaccuugugcuucugggucaagauuugcuauugagugaauucgggggaagaacugacgucaaaacuugggagcuucugagcuuacauagccaaagccugucugccuagggauggugcugcccaagaaaagucuccacagacaugguuuuugauggauagaguuuuuuuaacucccaggauugcaagcucucguccacucucugucaucauauucuguccccauauucagaucucucaggcacacugaccucugcaccacaucuaagaagccuuccucauauuucccauuugcucuuugccuccuccacagcuuccccuauguguguuauacugaagcuuugguaagacuccccagcccucucagcauacgcaggucgcugugcccuguggaacccaggaggacaacuugcaaaguuccagaagccaccccugcuaggagucuuucuuaucuuucucccccuacccugugauaucugacugggcauucccguagaugcaaggcaaacaaagccauguacauuccugcccauuauccacacuggcugugcuucagaguacagaacuguggagugugccaugagcacaauaggcuccagguccugcagagacccagugcacauagccaugaauuuaugaauuuagaacagaauccacagcugggcucuagcccugcuugucuugagccucugugaaccaagaagugcucacacauaggucacaaguaagacucgcaccuaagucugccuuguuuuucagaccuugacaccaacaagauacccuagauaaugcuuggugaacaauggccacuuucaguccccgaaucccacuuaaagacuuaacaccugauuccucaaguguccaaauccccugauaauuuaaaugaagguaaaagaaagaagagggaugaccuugcuuggaugauagauggguuccagaauagaccuacucgaccuccucucuaucagaaacagacaggcaaagaacccagaagagaauaguaaacagcaucaaaaugcccagugugaguuagguuuccuccuucuuucucacugccccuugacccaaaggccucuuugauuggcacagaguauuggagugugccucugguacuaagccaucuggucacugcuuuugccuaaaaugaacugauggggugccacucccccaggaacuacaucuuagcuucuuuaguagaguuuauucucugggauuuagaaugauggaagccuugacacucuagggugaaaggagggggcuugcugggaaauuuaugaauugaaauuguuuucuagaagcuaugccaucugcuguguuuugguuuuauuagagaccccagggaaggcaaaaccugugagcuuuaagaguccuguuugggggcugaagagauggcccagcaguuaagagcacugacugcucuuccagggguucugaguucaauucccagcaaccacaugguggcucacaaccaucuauaaugagaucugauguccucuucuggugugucugaagacaaauacuguguacucauauaaauaaaauaaauauaucuuuuuaaaaaagaaaaaaggaaggagggaaggaagaaagggagggagggagggagucauuugggaagguuucaugacuuccaaaaacugcuccagguaagacacagcccugagggagcuugccucccagcaucaugcagaagugaagugacaauucaguaugaggaggcauaaacucuuaaacacagccucagugugcuugcuauagacacucacugaaugaagagaaagauuccugcauauuucuagaaauauugccagcuccaggaaggaagaacugccuaggaaggucuucagagggaaauugugguucuagaaaagaggacagggaacuucccagguagcugugugcugaggcuucuaagugggcaagcuuuucuacccaucagccggagacggaacuggaaaagcacccuucccacguggagacagauguucaguuucuguagaagaaccauuauaaagcaccugggccaacuggcccugaaacaguauaaucaaaguugccuuuccuauucacuuuucaagguaccacuuuucucaggacuuuucaggguacaagaaguuuugaagccuuaagucaaaucaccaauuuagaaaaauuguagucuguauaggaagcuguuuauaauugcuuuuugagauagacacaauauuccagggcaguguggagucugccagcucugacagacguugauaucauugguccaaaaucgcagcuucuucacccugcugccagucuagggcagagcgccaaaggugcagaaguuugcacggugguucugccugcuuaggucacauugcagggggugggugcucucagaauaggacuguggugccuuaauuuaauuuaauuuauauuugucuuuauuauuuuuugaucaccaaaggacaacuuucggcagucaguucucuucucccaccaugugcgcuccaggaguuggacccuauucuucaggcugacuugggucucuguuguguccuguuaucuauauucauacuggaauaccaucuaagugaugcuuagcacaggacccucuauggaauuugaucuuagggauacacucacucccaguugcugucccugcuuccuagacaccccaggagcacaccuguuucuguggcuccccucugacaucugugggguagaggugggaauauauuucacugcuuccuccacuucuguccagacccaggcugcauccucuccuauccccauguguuuuuaugcccaugcccuguugcaccccugucucugccuguccucuccauguuacccgcugcgaucuagaaugcaaugccgaagcucaaccguguacucucccagucucccuuuagugcauccucuuaucuggguuuccccuuaacccuuccuucucccuaccagccgccccuucuuccagguuaaccggcugcuccacauagccuugcucagcggucucauacucccaugguuuuuggggacuucuuccuuuucagugaugaccagacagaagaacauguuugucacugacaccaucaguaaagaauagaaauaaucaccuucaacugagugugucaaugccauuagugucucuuccuucuugccccuugguuuaaagaguucaacagaaagucaagauaagucuagcaaacaacauuucuuaaauugagaggagacacucccauaaacacaagcauuugguucaaggaagugugggccauagggucugggguucugcugucuaaucucugccuggucuugucuaagucacguuucucagguucucuauuggugggcuuaaaauauuccccccgucauguuacuuagaauacauuugaccagaguugauuacuccuuuuuaugacugcuccaaguuuccugguugauagcugucuccuauguucucucuaacaauggagcaugcuuauaaucucagcacuugggaagcugagccaggaggauuacagugaguucaaggucuggugaggguguauaguaaauaucagacuauucagggcuaucucaguaacuuaaaacaggaacaacugcgaagaaagagaaucacacagauuagucgguaaucguguugagcgacaccccaguguuaaccuaucacugucagacugccguguagcuccuaagcccugguuagaagacuaucuuacaccccugcaguuuccccugugcucuaugagccuuauuuauaaccccaaaucuuucuucccuuugucucucucuucacuugcucucaccgcagccccuuucugggcuguggguguugaauccguguauggcauacccaggcugagcuuagagcuucauguccucucuccuuaaacccccccucccccaacaccgauguacuagagauacaggugugaaacaucucauugucuuuggguggcaucccaccaucuccuugacuccuguuaucaccuuuccucuguaccuuccugaaacacuuacuuuguuuuuaauuaugucuaccuguuuguguccaaauagguuugugagugugagugcagguaccccuggaggccagaagagggcgacagaucccaugaucuggaguuacagguggucaugagcugucuccucaugggagcaagugaccuuuuguguuagaaguguauucugcuucucagcugagguccauaucugaggucccacguugugacaggagcaugaucccacacugucgcuuuaucuuccaagcaucuguuuucaguuauuaaguccuaucagccaaaaguguguucuucauuuuuaagcucuuuaaaaacguaauuaugagauaguuagcauuauacugccagguaucaguaaggcugaaugaauccaggccccucccccccaucccccccaucccccccauccccccauccccccaccuccccaccccccccccccccccccccccgcacgguucucuguuuggguuuauuuccuggggugauugacucucaccagcagugcagcagagucaaaggcauuuaaaaaggggcuuuuuagucuugucugcuugagaggguggaugggggaagcuaaaaaaaaauuaaauuuacacugugaguuuaaaagcuaaagaggaaauggcauuuagaaaucagaaagaagaaaaaaaaccuuaaaugccuacuuacauagcuaguguuuuuauucauucuguuuguaagcaauguguugacuugacuugaagccauuaggggggucucaguuagcagucuugaccuugcgcucugugaguguguuugaguuccaguuguuccuuccuggugacacuccacagucccaucccuucuguuuacauuccaaaugcauaugcaggcuggguuguaugcuaaagaaggcgucaacuggugauggcuucuggcucauuaauuucuuaaauguucuuucucagggcuguaagggacuggccucagaacccuguguuccuaacugucuucagacagaaguguucauggaaggcuugaguugucagaugaaagagcucaucuagaaauggcugcacucagacaucaugagcagaauuuucaaggagaaggggcucuggucaccaggagugcagugugcucgugguagcuggcuguguccaguacuuuccaaccucaguguaggcaugagcaucagaacuaggaaccagguaucugucaggccauagcucugauuggugcuccuccgaagacaugugcacaucagccaucccucaggugcaggcugugcaggcuggaaaaagaagucaccuguccauaugugcccauauucaaagugccaguggugaggucuauaaucuacgacuugcucaccgucuucacugaaucuguaucccagcagagaagaugaggaagaggggagggccaugaccaguuaagaaugggggcaucccaaaugcacccugagaugucaggcaucucagagcaucacagcagguucagcuaacuucagugccaaggagccaccugcgaacaaacaccuucuucuccagcuauccuugaagggcuguuuagcagaugaaaacuggcuuuuuuaauugguuuucugcccguugcgucuuugaaacuguccagcguaagugcuuuaaguuguuucacacagggcuuuaugucauuaguguuucuguaugugguucuaauucucacugacugauaauauacugcucugcuggaaaccaguguagcaagaaaccuacuguguguguguuggcaggugggaaggggggugaaggggacagcgcugugaugugcuaccaaacucugagcgccuggauauucuucuuccucccaagaccucagacagcaaaggcauggcuuuaaaguguucccugguuauuaaaguuugaguucacucaacaguuucuuaucuguuuugagaacccuguggaaauaaagccaaguaaugcuuuagacaugaaaugcuaacaugcuggcagucuuagcaugcucaaaagauccauuucauauuuaaaaaauagucuccuuaaacacuggugacauugauuugagaaaauaucaccucauggaaaacauuuuuaugaguuauaaaaacuaugagccacacuggcuuucauugauuaagagaguuucuuaguaaaauauuugaauggagggaacagggagaguaacucucaauagcuaaagugccuauugaccuaggcuugcaaccuuuuuugaucccaguacccaaggaaaggugacaggagaaagcugacuccaccaggcuguccuccaaccuccacacagaugcuguggucucugcaauccacacacacaucuuacugauauaaugaaaucccugagacuugguaauuaauaaagaaaagaggaguuagguguugggggauagcccagucuguaaagggcugcuuugcaagcaggacgaccugacuugugccuucagagcucuucaccccuuaugcuuuguuuguguggguuuuuaaacgccaagugugucugcauccaccuacaguccagcaugaggaagguagagcuaggguguuccucauagcucccuggccagccagccuaucuaacuuggcaaguuccaugccauuaaaagaccccauuucauaaagcaaguuggaggauaccugaguaaugaaugacaucuaagguuguccuuugaacugugcauacacaugcagcccuacgccuacaugugcaugcugacaugaacacaggcugcaagguaaucacacaauuaacccacuagaucacgcuuuucuuguugaccuuuccuaucucugaaggccaccccaccggccaucacuauucaccaucccugacgauaagccuggaguugcugcacaacugcauacucuacuugcuuucaacaucucuuuaagugucggcuucuuuaucgaaucugggucuuuagaggaugccacaaaugaugucaaccucucaugauaaacaaauauuuccucaagagcuuaguuuuauaguuuuguuauauauacuuuccccuuccucucucccucccucccucccucccucccucccucccucccucccucaauauuaccucuucuccuaagucuuccuccucucccaccuccacccucccucaacccugucuuugaaacaaggucucacauauaacccaggcuaaccuccaacucacugacccuaccccuaccaccuuugcgguacuggauuuacaggugucuacuaccacgugcaauacaauucuucugcuuucaaaagcauuuuguaggguaugaugauugguuuuggcucucaacuugagacaaucuagaaucgagaauaggagagucuuaaugaagaguugacuauacgagguugacacuaggacaugccuguggaugauuauuguggugguuugaauagguauggcccacauagucuugugcucaagcucugcccaguguggaacugucuccucuguuaucuuuggaucaaguuguagaucucucagcuccauccccagcaccauguuugccuggaugcuaccaugcuucccaccaugguaagcgacuaaacuucuggaacuguaauuuguccccaauggaauguuuucuuuuaugagaguuaccuuggucauggcaucucuucacagcaaaaagccccaaacuaagacgauuaucuugauuaucaguugaugugggaagauucagcccauuguuggcagcaccauucccuaggcuggaggucguaaauaguauaagcugagaagguuaggggaaaacaaaaugauuagagaaacgucuauuccaugucugcucuuggcucuggaugccaugggacaagcugcuugagaucccaucuucacugaccugaaaugcuagacagcagcuacccagcauuauaagccaaggaaacccuuuccucccuguguugauuuuugucaacauguuuuucauagcaacaaaaaugaugcuagaacguaggcucauagagaggauggaaagaugcugcugccgguucccaugcaccuccccuucguuccuccuccucucggcauucugagguacauuggucacagcuuagaagucacugcugagaaccucacguuugugaaaauguuugauuauauaauuuaaugaucuguaaaauuuaaagccacacacauuagcaucuuucaaggauauuuggagagagagagagagaguaguuuggaaauguauacaaaagcaaauuaagugguaaauugugugugcuuauuguuuagaaaguuaaaaaucaauuaguaucauuaaaauuaucuuuuaacuuaauaauaugguaaugcuugacuuggguuuuucuugagcuuaauaauucuaaucuggugaugcauuuuuaaucucuccucauggaguagaagacugcuacacuucuugggcaaggauauccaguaggaagaggguagcauugggccucaggcccaugggcauugucugcuuccacagugaugcuuugcuuaccugggaaagacaguggcuucucuuugguugguuuuagcuuuauugggacaaggcccugcuccaucaccaagcugacauggaucuuacucuguauuucuugaacuugugguaaucaccuaucucugccucccgaguacgucuauuauaagcaugaaccuucuuaccugcuuucuucuuucagaagugccuuuaaaaaaacaaaaaacaaacaaacaaaaacaacaacaacaacccuggguguuauggcacauacccauaaucccggcauuugagaguuugaggcaggaggauuagacauucagagccagcuuuggcuauauagcaaauucaaggccuauugccugugcccuggacuacucgcugcuggacucuaccugcccucaggguuuggggccgagguggugcagagccaaugacacagccuccuggagcaggugagaaaugccucaggaagcacucugaacacuuuaauacccuccuuuaauacccuccaccugggcccugauuggucccaagaaaguaucucuucuaaauagcagaucccaauugucugcaccagcaauccuuggucucucaggcagucucuuaauuggguccuccugcaggagauguuuugggggccacuaguccccuggcauuuacauagagguggccaggucauuccuguugcagaggccagccuggauaugugaggcccuucucaacaaaugaaucuauaacuauccagaacuuugaauggcacuggcugcugucuucucaauuuucagucugcuucucucuugucgugucggagugaccaugccaucuucucuggcacugugagucuuaucauccagcugaagggaugagugggaaauguacagggggcugaccuggcacugagagcaggguuuaccuugcagguugauuucugauauucagucuaccaauuuaaguuaaauacucauagcaucuuagacuuguguuuguggccaugguuggggcuaaccugggcauggcucuuuaaaaaucuguuuauuuagguuuuuuguuuguuuguguauaaaacaaauauaaaacucauuuauacacuuguuguguauaaaacucgguuuucugccgaguuauuucuuagcaagaaaaauaugcuguuuuaauuaucuccagaggugauuugaagccaugucacuuaaaguaaugaaaggcuguuuagaaauaaagguguuuaaauauacauaacugcaggagccaugccaggagcaaugugaagcaggaauugaaaguaggaauauguuauugaguucuuagaagagaaggaggcggacacucugcuuagccauagaccuauaaguggauaucauguaggaauccugcuguacacuuacacucuauauguugucuguugcuguccuuaauauguggucuaauauagcccaggcugguguuaaauccugauucuccugccucgccucccaugaguaugguuacacucuguuuugucuacuucuugguaagguuuuugcaugucccaaaugucacauuuucuaccaauuaacacuuuuuuauacuagaaaucugagcuagaaagguuagaacauuaucuauccuuacauuuccaaaauacagaaaauuacccauguaaaagagaagaggaauaggagguuguuuugugggcccagcagaauugcaaucaccguguucugauagcuuuucauaauuguccgcuuuacugguaaagagaaaaugagcaguuuuaguuuguuaaguaggauccuacacuuacccaucaaaguuguuggcauaggagguguccacaggggucccccaacaaaagcagggacagggacuuuaccuuuuacauggccccucacuugagagcucugacauuuuacccuagagcuuacuacccuccuuuuagcgccaagaagauucccacucgucuugguguguccccuuuacccagucuuccugccuaagacugcagcccucacaaugcccagugaucaucauguuuaacugggagacuuccauauguaccaauggcuuuucuuuuucagcgacaaaaaugcuggacgaaggcaacucgaggggggaggggaugauuuguuuuugcuccugaucuguggcucugugaccacagaggugaggaaggaccagaugucagcagaaugagguggcugcucacacugcauuccaccagggaggggcaggcagcuggggcaaagcuugcuggagaagcaggcuaaugguggaggcccacauuugagguacccucuucucaucagucagaguucucucagacacagaaagggguucuaaauccugaugaguaucaggcugggcaaacccucauacuccacagacguaaaggguugcuuaggaauaauuaguagaaguuacccuuuugaguaccagugguuggacguacagcuuaggaaaaacugaucacauccuuuauauccuuucccuugcuaacugacaggcauggagcuuguguuuaacucugauauccccggcaguuacuguguagcgugugcucaucccaagaugcuggaguuacccggauguugccuccuuccccucacacugaaugcuguggacuacagaaguauauaauaccagauggaggucgucaaauaaaaucgcauaaugcucuucccaucccagcccuacuuugugugauuucacaucuuugggcacgcugagccaugguccucuucucugcuauugugucgucacuuccugccucuccagacugagcauccuccccucuuggcacuguuggguaccggcucucaggcucuuggcguugugauuccauagcagcucuucugugggacugacccucuccucuuccacacccaucuccacccugagagguccccaucauguucccucuuagcucacaacucugcccaguauggcccugccacaccuuuaaaggacacuuauuagauguaggagcgaggaccauguagcacauuuccguaccucagcacagcacuuagccugcagcaagugcccaggaacauacugggcauaaauacauuggguccugagaccccaguuuaagguaaaguccucagguggucaccuuuggcucauuuagccuaccccacagcuuugggucuuauucuggauggcauacuugugugugguauccucuccagccaauccucacuugguuuuuggcgugccugcuccagagcauccauccugaaugccuucuuuucugauccuccauagugcaaauucccuugauaggugagccaccacugaggacuccugugacaacgccgucgaugcggauuguaguggcuaggucuggcauuguuuggccauaccaucuguacacaauguaucuguauacuaguguaccguguguuuccauuacaaaacuucucugugucacaagcucugucuggccaggcaggagacaaggcaagaugagagcugugucuccuuguguuaccccccauccccagauuaaaguaccuucaggaagaaagguguaauguuggcucauggguuaagguuauaguuaauacuggcagggaagucagugcaggaaccuacacaguuuuucacacuguaucugcagucaggaagcagagagaaaggaacucuggugcucaauuccuugucuucuuuuuauucagccugguaccccagccugugagcaggugcuaucuacaugggcguugggucuuuugucuuccauuaaaccucuccagagacauccccacaguuacaccugacguguuucuucuagguguuuccaaacccaaguuaacagcgaagauuaacuuuagccaucacacucuucuugccuucuuuuugaagcaauuucuaguagccucucccagcaacaucuggccacaauggaugauggaccaaacacuacacagucuauaucaaaauaacccacuauuuccauaccuggagugcuggagaaaaauucuucaaccuggugcaggauuaagcuucauugcagugagacugaccagacauuugacaaagcgauacaaacuugaaaacacuagggcugaggagauggcucagucaucagcaugcuugccucaugagucugagggcuugacuuuguaucccagcaucuacauaauaguuggcuguagcagccaaugggaagaccuuagagaaacagaugaauccuuggagcuaaucuuccagccauguuagcugaucaauagguuccaaguucagugagauacccugucucaaaaaauaaggugcaggguuggagcaagggcucagugagugaacggugaguggagggucucuaggucauauguaaagccaggccugguggcaugguaauccuaguacuuugaaaacacaacugaaggcagcaacaggaauucugggagcucacaggugagccagccagguauauccuaaucuugucuucuuuuaguaaguaucuaauagugaacucuuuguccaugggcuucauuuuuuuuuuuuuuugagaguacacaguuuuccauaauggcuguacuaauguauauucucccuacuggugugccggguuccucucuccuuccuuuagccugcguuccuccucuucccuccuuuaacuaauaagccaaccaaaccaauguaguccaucuuucucugcuuuugauuuguaucaucccauucacuagugagcagaacaucgucucccaccccugcaucucugccuacaugucugcucacacccuuuaccaagauauaaucaggccaguagggguuuuuguuugguuuuuuguuuguuuguuauuuuugguuuugaguugaguuucuuacacauuuuggauaguaacauuuauccaaaugaugccucuaaacauuucuugcuuaacaaaugguuucauuauggaaaugguucauuuugcagugcagccuguuaguuuaaugcaauucuauuuguuuguuuuugcuuggauucacugcccauagccauucuguguuuucuuuuaguauaguacauauguacacguguauucacacacacauaggcacacauuuuauguguauguuauacauauuuauuguauguaacacauauguuguauaccauauacacacauauccacaugccaaaaaaauuuggauuuuugagacagacacucuauugcuauguaggcuggaguggcccaguacuuacagugauccuccuguuuaucauuugaguuuuuuugaucagauuacacacaugugccauucagccagccaggguuuuuaauauacuucaaguugacuuuugccuuugguaugagggucuaauuuaauuuaccugugagucuccuauucccucaacgucacuguaaaauugccagcaccuuugccuucuagccaucuugaucaaaacuugcaugccaaacgaacuggaugguaaaaagcccauaagccucaacccuacacaaggaacuacaggcaacuguagaaagcugacaguaggagaaugcagcaauugguuguucagggccaacuggucaaccuugacaacauaugaacaaguaacauggauucacuaaguuacauuuaggauuagaaauguauauaaaaauacauguguguauacaauagcaauucaugaaaagagaggcugugcauuugaaggaaaguguggagcuaaauuggagaguuuagagggaggaaaggaaagagaggaaacauaauuagauuacaaucucaaaaacaaacagaaaaugucacuugaauggucuuccagaaucuauuccuugagggaugugcuugauuuugugccuugccaugcuguuuugauuacuguagcuuugcuuuguauuuugaacucuaguaguauguugccugccugccugccugccugccugccugccugccugccucccucccucccucccucccucccucccucccucccucccucccucccucccucccucucucucucucucuuucuuucuuucuuucuuucuuucuuucuuucuuucuucagacaggguuucucuguauaacccuggcugucauggaacucacuuuguagaccaggcuggccuugaacucagaaauccuccugccucugccucccaagugcugugauuaaagguaugccaugcugguuggccaguauauugccuuuaauauugcucauuuuguugaagauuucauugucaguucaagaucuuuugugguuuccuacagaugcuuaauuuucauugcuguuuguuuuucuuuuucugaugguuuuuuuuuuuuucugugacuacugcccuugugauuucauggucuugcauuuugacaagauuaauacuuuugggcuuuaagcaugguguuuaauucacuguaucugugccuuguaugguaccuuccagggguguuucugucuucaguguuuggaucugccuuaucuuaguuaaacucuacgugauuuaguaguuuguucucuggugcauugcauuguucauauuaauuaaucacucacaaauauuauguuuccaaguuuucagguaguguugcucagggaagacuggaaguuuacaucaagcaggaucugggaagagagaucuuuagagacgggguagagcaaauuugaagugauauucuaauauuuaaacaucuuccccauauccccuucucagagauauuuuaaagauguguauucaguauaguuaguuuuaaauucauggugaaaagucuucaguguaggacuuagcacaguccauucgcuacaggcuuaagaucuuuaaaggaccuagacaugaagcuguguuccuucuaaucauugacaggcuuguuccuugcugugagucauuccauucuagcuaugcacaccaggccgucuuucuuucuguagguacauuuagaauagugggaucacagcccaucccuaggccuggagcagugucccuucagcgauggcuguguucugggcccucuaguguagucuguaaacaaagggaagguaccuguccuggaaaauuaaacauucuuguaaggaggaacaaugggugguguacuagauagagagcuauguagcuugcaugggauugacccauacauggagaucagaucagggauagggagguggucaaguugccaggaccagacauaucucccacuuugagugggaggcaaaaggcaaaguucuugcaaaggagguuuugguaccuaguucugcaggcaguggggagguuagccuaauggugccuugggcaucaaccuccaacagagacacagauagcaggauccuaaagagggcaggugauaaggauaagaacaaugugguuugucaaugucauuggaauaauguccagaaggagguugaguuggggagguaacauagagggcuggaacaacuccuggggaacuucauucgucuacacauggcuucaaauuaauacagccugcaccucguguguguguguguguguguguguguguguguguucauguuuguaucuuugccaguuuugagacagggucucuuauuucucucuuucccuguuauucaccggugauccuccuguugaugugccaucaugcccugauuuuuuuuuuuuuuuaagauggguuuaaaggauugaacucggguccucagcaagcacuuuagcaaaugagccaucucccagacccuguuuuucuuucugacuuaugauaaucauuucaccuaaauaacagagauucucccugggcaguguuuaggguauguaaucucucuaaagaaauaccaccuaauaaugguguuucucucugacugaucacccuagaugucugggcuuuuugcuucuucuggacacugaagcagcccauugaaauucaaugcaagugggcuucaucccauuauccugcagcuucuugguagacagggauggugaauauuccauuuugcaaacucuuaacuauguagcuagauaauuagcuugugagaaacauagucaguuuugcaaacaaguagagauucuggaaaguaauuaaaauuagucauuauugggccgcuuugggguuuaccuuccacugcgugccguuaaggucuugucggaaaaaaauuaauaaggaauaaaaaaaucuccaacaagcaucugguccacagugacuucuaguuuacaucugucuguguaacuuccagcugaagucugagauucaugcuaggggauaaucaauguuuuguguucuuguuauuaugauaacuucauuguuuuuuggguuuuuuuuuuuuuuuuuuuuuuuuuuuuuugcuuuuuugguuuguuuugguuuugguuuuuugagacagggcuucucuguauuagcccuggcuguccuguaacucacucuguagaccaggcuggccuugaacucagaagucugccugccucugccucccgagugcugggauuaaaggugugcaccgccacgccuggcuuaacuucauuguuuuauguguggagcaaaugaucugagugccugguguuuuauaacuaaaauuuuuuauaaaauauagggauuuuuguucaaggagaauaaucuaauaaagcguuguuuuuauuuuauaacuaaaauuaugauggucagcaucaugauugacccuggucaugcaacugucgcaggagcagcugugaaguuugaugagaugagugcauguguucuucugacaucuucuugugaaaaauuaguaagguagaaauuggaaauauaaauagugguuauggaccacuacuaccaugacugugcauuuugacugauaccaagagcauucaaggaugucacuaaagcugauugucuuuuaagagauuagaaguuauuaguaccauagacagacagcggugcugguccucugaggacaauucaggaccguguagcagaauuggggucccuuuuuacagguuucugaggaguggaggaggucccuugccaugugguugauggguugauggaugcuuauagcuggggugucucugaauuagccacgcaggugaggagggcaaggcucuaaaaaaauaagucacauuggcuauagggaccaaauuccuuucauuuuaagaacuguccuuguuuuaucaaaauggaggaaccauacaaauauauaguaaggcuguggcuaacauauauacccuggagaauuuuccuccaugucuggacaucugaaagaucuucuuucuacauaaaauauaacacgagccaucuacagacuuuacucagcaagcacauggugugcacuuacugcagguaccagaugguccucuuaugauacugauuaaugucagcccugacaaguuaaagugaugcuuauauucagcugccaauaggauucccacccuacacccugcaccauuccacccccacccaagugucugaaccuucagagaagagugugagguuuucaugacacugcaggccggguguggcuaacaaaugaauccccaucuccuagguuuuuggccuuauacaauucugccuuuuuggcuuuaccuuuacucucuuagugagaacucagaagcaucuuuacaccgugugucauuugguuuuugagacauggucuagcugugcagccaagguguggccuugaacuagauauucuccuuccucgucuucuggaaugccggggauccagguguguaccauuguacuggaaugacuguaugucuugaugcacacuuuucuuguuaauuaguuauucuuauuuuguaguaauauccauggccauauuuguuuagcuugugguguuuaauuauggcuggucccuaguugauaaauacuugcuuaucaugauaaauuaguuauuuccuauacuacuguucagaguaguaguuaaaaauuagccccaaaggcaugaccauuaaacucaccgagguagugggaagaugacucugaguagagcacauagcacucuuucauaggaccuguguucaguucccagcacccacaucauggggcucaggagcugccugggacucuagcacaagaggcuccaguacucuucucuggccauagcaggcacauacacaugcaugacacacauuucuacauaaucacaaauaaaauaaaucuuacaaacuauaaggaaauaaaaucacggggaacacaaaggcccugccauuaugacugggacuugagguuguccuggccuagagcaagggguagaaacagccugagaugaggaaagacaccaccaaaguguuuaccgucaacaccuugauuuauuuagaaacgccuuccagagcaaaaacaaaaaccuuuaaagucacaaguuuuuuuaaguuguaucauaaaauaugccaauaugcccaccaaauauauagaaagaaugaaauuuacugaaaaacaaaacaaaacagaaaaaagcccucacucuacccguuacauaugaaaauagcaagaucuuuuaaagaucuuuacaauagcauccgugaaauauuccccaaugauauaaaaauagucugggacagucugguuuguguguuuaaaugggagagcuauuuuguaagccuccucaauucauguaacaauuugauggaaguccaauuugaauccaaauggaacuuguuucaaacuaaaauaugugauucuggaguuuguuuacaaaaugaaauuggcuugggguggcugcggagaaggcuuaggggauaacaggcuugcuaugcacucagggggacaugguucaaaucuccaggacccaagcagacgcuuaguggguucaugaguagcuggcugucaucgcagcacagagggugaaggcaggauccauguagcaagcuagcuacauuagaacuaagaagcucugcuucaaggagagaugcagccucaauauaaguaaauaaauacaugggggggggagagagagagagagagagagagagagagagagagagagagagagagaauaugaaugaaugaauaugaauuagucagggucaggguuuucuagagucccagaacuuauggguagucucuauauaguaagagaauugguugaugucuauaguccaagaauggucagcagcagcugugaaugaaaauccaaggauuaguccuacaaggcaaguuggcaaaaaagagagugaaucuuccuucuuucaguauccuuauguaggucuucagcagaagguguggcccagauuaaaggugugugccaccacgccuagauuugagacuugcuuugucccaguugaccuugaacucauagaucuuucugucuuaaucuucagggauucauagccacuaugccucaagaucuccaugacaagauccaggucagaaaccuguaucucccugccuccaaauuaggaucacaagugagccuuccaguucuggauuguaguucauuacagauauagucaaguugacaaccaggaauaaacacuauagauagauagauagauagauagauagauagauagauagauagauagauagauagauacauagagagauagagagauagacaauauagauauagauccaccaccaauauaaauaaauauuuagaauauagaugauagauagauaaacagacaucuagccuaaauauauauauauguagagagagagagauguguaucuagugagauaccaaaugucaaccucuauccuccacauagacccacacacauagacacacauauacuugcacccacacaaugaguacaugcaugugcaaaaaaaacuuuuauccuuuuuaaaauuggaguuaaacaugccccugugcuuccucaaggacgucuccuuuucuuucauuguuuucuaucugucuaucugucugccagucugucuuucuuucuucccuucucuuccugucuuuccaucugucugucuuccuuuucuuccccuuccccuuccccuucuuccuucuuuuacaaaaaagguaaauagagaaacuggagaaaaguguguaaaacaagcuucaaguuaagauuggcaacagagagcaacaguccacuggaguguaauguacaagguauuaauuaagacucgucugccggggcgcacgccuuuaaucccagcacuugggagucagaggcagguggauuucugagaccaggccagccuagucuacaaagugaguuccaggacagccagggcuauacagagaaacccugucucggguugggggggugggggagacucgucuguuucuguauggauauaggcugaaggaaugcguauugccauagcugauagggaauuggaaaucaaucccucaccccacccccacuucucccuacuccccccacccccgccuccaguuaaauacagucuaccaauguaaguucugaacuuuaaacaguauguacacuucuacagcuaaauauaagauauaccauauuuaaacacccguuguaccguguuucucugucuucucccuuuucacuauuuucccuucugaagaaagacacacagucagccuucaagucucccaccugugacucaguguaguguuuucaguucaucuguuuguugucauuagcucucauuacuuuuuuacugcugauucguguuucauuguacagaugugccacaguuggauagguaaagggagacaggcacucggagugucucugaggauuagugugugacucugucuuaggcagcggcccguuguacugcuuggcuggccuccuccagggucucagugcugucuacgcugcacuguaaccgagucacuauugagaauugcacuugagucugcucugccaccaugaacuuguccugcagccuucccuccucccuuugcuuacugcacagcacagcuaaguccuagccucagaaucucagagaaauggaguuucuuggagcucagcaaagaguaaaauggcagaugggaaugcuaaggcuggagugugugucugcuuuuuauguuaucuuuuacauacuugcuacccaaacacauuguucuuagauccccgcagucacacucugccacauuggaguuuuguuuuuuuuuaauuaauuuauuuuuuacacucuauauuuuauucccccacccccuugauccacccuucuacuacuccacaucccauaccuccuccccaaacccugucuccacaaggaugucccuacucuaacccacaccccaccugaccucuaaacucccuggggccuccagucucucgaggguuaggugcaucaucucugaauggacacagacccggaaguccucuacuguaaguguguugggggccucauaucagcugauguaugcugacuguuuggugguucaguguuugaaagaucugagggguccagauuaauugagacugcugguucuccuacaggaucgcccuucuccucagcuucuuucaaccuucccuaguucaacaacaggggucagcugcuucuguccauuuuuuggguguaaauaucugcaucugacucuuucagcugcuuguugggucuuuuggagggcagucaugcuaggucccuuuuugugagcgcuccuuagccuuaguaauagugucaggccuuggggccuccccuugaucuggaucccacuuuggguacugagagguuuuuuguuguuguuguuguuuuugguuuguuugggcuuuuugucuguguuacaugcuauauuacauggcuucaaucaaucugcuguaaucgacugaucugcuguauaacauuugcacauaaagccacuugcaucugguucugcauaaugauauauuaauaagaauuccauaagcauugcccuaugacgucugcauuuuauuauguaaaagaugaaauucaaaauaucuacccacuacuaaggaccagucccacaaaucuccccaaccuuuuaugaaacuuuuacccaaaucuuuucucucuuccacccaguuuuaaaaaaaaaaaguugucuauaaaaagguuucucugcauucuuggaauuugaugacucaaaguagcugacccuuuuccccuuugcuuaauugcuuuuaagcuuauacuaaaucaacugaccacaucugguugagaguucaaacuuccaccaggguugaaccugaguuaccacuugaguuaagauaaaaacuaagugaaguuuccaugauaguauguuuacuaacccugcuugggucaugguacaaaaacaaaagaaaacaauaacaacaauaacaacaacaggggguguggcgauugcuuugguuuuuuuuuuuaucuaaaacgaauggacuugccugguuacuuugacuucucucaggguguccucgugugacaaugagaauguucuuuccaaaacuccuggugaugccuucauuguuccuucugcuuucgcucuguacgccaugcugaccuggaugguguugaguucaugguccuuuugcuuuagcaucccaagcucugagauuaaaguuggaaccaaucaaaucuagcuguugauuuaugcucuuuuaaagaaauacuauuuauuugacugugugugugugugugugugugugguguguguguguguguggugugugugugcguguaugugugugugugugugugugugcguguacaugugugugugugugguguggugugugugugugugguguguuuguggugugugugugaguaaauauguguguggugugugugugcguguauguguguguguguguguguggugugugugguaugugugugugagugaguaugugugugguaugugugugcauguauguguguguguguguguguguguauccagaggaugacuugcucuccucaguccuuuccacccaucgugugaguccugugggucacacucagguagucaagcauugcagcaugugccuuugccuucggauccccuuugcuggccuucaguuugcuuguuuguuuguuuuuaacuuaguaugugauauccuucucuuucuguauuauccagccaaugugaguaaaaccaaagacaauguauuuuuaugaucuaugcaucuguuuugccuguuuccaauuuaauauauacccaugauggcaauugagcccuuuauggacagaaaucaguuauagaaauguguggacauugacuccccuauuagcuagcaggguugauugcagcuccauuccucucauuuuugucacuuccuguucacugauucugucuaucaugucauaagacuugggaaauccugaguucucuaagguucuaauauugccugauuuauugaguuuauaaaaauaagauauaaaaucucugcuuuacuaucuuucuaguguugacaucaaaugaacuuuauuaagaaguugcauacauaguauauaaucuucauugcacuguguaucacuugcuuuuuauugcugugauaaaacaccaugaacaaaagcaaauuauggaagaaagagacuguuugggcuuacagugccagagggagaagccaugagagaucaugucagucuacaggaaggaagcagagaggauaaacuagaaguggggugaggucauaaacucaaagcccaccccuaguuacauacuuccuccagggaggcucaauuuccuacagauuccauaacugucccuaguggccccaccuccuggggacuaagugcucaaauacaugagccuuugagggacauuucucacucaaaccacacuucacaaaguauaauuuuuguacuuuuuaauccuuuauuaucuauaacaaaugugaacugggguuuaaauuauuucaugcaauaaguagcaaauaauuguuauagguaaguuuauauccaaauuuuccccuuuggcauguguccuuuaaacaucuuuccauaauuauggcuucuauaaaauugaaauugauuuuguuuugaaaauuagauuuccugccuuggugugucuggcaugaaaugagauacuaguacuuuaugaauucaaccaagcacacuauuuaaauuuaauauuuaauuuuguugcuaguaguuuaaaaucccuaauagauggcauuaauguaguuuaucagccaugcugccuucaguuuuauuuugugccuuuuuauagucuucccuuugguuccucauaaaauaaggaaauuaugauauuuuguaaauuaaaugagugaaaauuaagcauauguugaauaaagacaucaaguuauugaauuuaucccuccccuuuccgugcuuguguguguguguucacacucaugagugcucgcaugcgugccuguguguguacuuccuucucuucccucccccuccaaaccacccccuuccuccuucuccugacaugguuuccuuuucuguggccuucuaauucaugccuuagugucugaguuccugguauuccugguuucugcauuuuucugggauucagagaagucaacgggcuuguugcuagaucaucaccaucucccugcuuccauauccacuggccaccacugcuuguucccuuuucaguuuccaaaauucucuuguccuucguucauccucacuaucuuggcccccaugacucugaguuguugaugcucuuugaggcagagucacucucuacauagcccuggcuguccuggaacucacucugugaaccaguccaaccugggacuuauggagacagccugucuuugcuucucaagugcugggauuaaaggcaugugguaccacaccuggcugggcucugcuucuggggcaugcuccuuaaugucagcauguugagaggacccagagacagacccaggcuuugccugugcuguaugugauucccccauggguguuuggucaagcaucauccccaugaagacucuagggaggcuuugaaaaguuuaugacaucuugagauuuucuuuguauucguaacguucucaucucucauuuuguaauuuuuuuuucuuuuuuaguuuuuuuauuagguauuuuccucauuuacauuuccaaugcuaucccaaaagucccccaucccccccccacucccacuuuuugguccuggcguuccccuguacuggggcauauaaaguuugcaaguccaaugggccucucuuuccagugauggccgacuaggccaucuuuugauacaaaugcagcuagagacaugagcucugggguacgguuaguucauaauguuguuccaccuauaggguugcagaucccuuuaguuccuuggguauuuucucuagcugcuccauuggggguccugugauccaucuaauagcugacugugagcauucacuuauguguuugguaggccccgguguagucucacuagagacagcuauaucaggguccuaucagcaaacgcuugcuaguguaugcaauggugucagcguuuggaggcugauuaugggauggaucccuggauauggcagucucuagaugguccauccuuuugucucagcucuaaacuuugucucuguaacuccuuccauggguguuuuguucccaauucuaagaaagggcaaagugucuuacacgcguucgcgaccggccaggaaagacgcaacaaacuggaaucuucugcggcaaaagcuuuauugcuuacaucuucaggagcaagagagagaauggcgaaaccccgucccuuuuaaggagaauuauccuccgccuaggacgugucgcucccugauuggcugcagcccauuggccguguugucgucacggggaaggcagagcacauggaguggagaacuacccuuggcacaugcgcagauuauuuguuuaccacuuagaacacaggaugucagcgccaucuuguaacggcgaaugugagggcggcuccccacaaaaguguccacaauuuggucuucauucuucuuaaguuucauguguuuugaaaauuguaaauuauauauuggauauucuaaguuucugggcuaauauccacuuaucaguggguacauaucauuugaguucuuuugugauuggguuaccucacucaggauaaugcccuccagguccaaccauuugccuaggaauuucauaaauucauucuuuuuaauagcugaguaguacuccauuguguaaauguaccacauuuuuuuguauccauuccucuguuguggggcaucuggguucuuuccagcuucuggcuauuauaaauaaggcugcuaugaacauaguggagcauguuucuuucuuacuaguuggaacaucuucuggauauaugcccaggagagguauugcaggauccuccaguaguaccauguccaauuuuaugagaaacccccagacugauuuccagagugguuacaagcuugcaaucccaccaacaauggaggaguguuccucuuucuccacauucucaacagcaucugcugucagcugaguuuuugaucuuagccauucugacugguaugagauggaaucucaggguuguuuuaauuugcauuucccugaugauuaaggaugcugagcauuuuuucaggugcuucucagccauuugguauuccucaggugagaauucuuuguuuaucucugagccccauauuuuaaggggguuauuugauuuucucgaguccaccuucuugaguucuuuauauauauuggauauuaguucucuaucugauuuaggguagguaaagauccuuucccaaucuguugguggccuuuuugucuuauugauggugucuuuugccuuacagaagcuuugcaguuucaugaggucccauuugucaauucuugaucuuacagcacaagccauugcuguucuauucaggaauuuuuucccugugccaauaucuucgaggcuuuuccccacuuucuccucuauaacuuucagugucucugguuuuauguggagcuccuugauccacuuagauuugaccuuaguacaaggagauaggaauggaucaauucacauucuucuacaugauaaccaccaguugugccagcaccauuuguugaaaaugcugucuuuuuugcacugggugguuuuagcucccuugucaaagaucaagugaccauagguguguggguucauuucugggucuucaauucuguuccauuggucuaguuuucugucguuauaccaguaucaugccguuuuuaucacaauugcucuguaguaaagcuuugggucaggcauggugauuccaccagagguucuuuuauccuugagaagaguuuuugcuauccuagguuuuuuguuauuccagaugaauuugcagauuguucuuucuaauucguugaagaauugaguuggaggggauacaaauuagaaaagaagucaaaauaucaauuuuugcagaugauaugauaguauauauauaagugacccuaaaaauuccaccagagaacuccuaaaccugauaaacagcuucauugaaguagcuggauauaagauuaacucaaacaagucaauggccuuucucuacacaaagaauaaacaggcugagaaagaaauuagggaaacaacacccuucucaauagucacaaauaauauaaacuacuuuggcaugacucuaacuaaggaagugaaagaucuguacgauaagaacuucaagucucugaagaaagaaauuaaagaagaucucagaagauggaaagaucucccaugcucauggauuggcaggaucaacauuguaaaaauggcuaucuugccaaaaucaaucuacagauucaaugcaauccccaucaaaauuccauuuuguaauuucuugauagaaaccggagcauagaugugugucaccucuggcuauucaucucaaaacagaaagcguuuguguaccauauuuccuuggugugucaguacccagacuuuccucgucuggacuuauucugagaugccuuugauuucucaguggacggcauggcucccagccacauacacccccuuuccugcacuguguucucacacgucugcuugcuuuuugauucuucaguuugacucuuccucaaaaugccagucaucaccaaccccucgguuaugcaucuucccgccuggccugcaguuccuucccaggguuggcucaaaacagauuuuuuuuucuuuuucaauaucaaaauuuuacucguagacaauugaaaauaacauucucggcauacucuuuuugacacaaagaaauuaagggacagguuuuuaaaguuuuuauuuagaagcgucuuuuuuucauucacaaacaacuauuauucauuaucuugaaacugagcucaugagcagauuauugauacacagugagcuuuugagaauauaugagaaaauggauuguuuacauuuuccuuaagggaaaggcugacuuaaaacaacaacaacaacaacaacaacaacaacaaacuguuuuauccauaaagccaaacuuaaaugccacugcugacugcugucucuucaacuuuguucaacauguggccauucuugguaucccgugagauuuaaguaucuaaaagggaucuccuuucucaaaucacugucuuggagaacacauuucauugauucccaagacccuacuagaagucaccaaguagccugggugucaaguuacccgcacuagccggucuucacucccaguguugacccuccguguaccucguugucauguguucugggugugcguucgcugcuuuccaggagcuuccaagagcuggagcugcucaaacaccucauggagcuuuuggaacuuagagaaguguucacacuuccgcccgggugccacacaccccagccagcagacacucugcacgugugaagugcgagcuguagggcagaugagucagcucacacccagcugacagaaucaccaaacuaaguucaccagucauguggcugcaaccauuugucucccgccuucauagcucccccaaaccagggauaaauauagcuggggguuuuucuucuaauccguguacuuguccccaacccuuaaucuuuacaugggcacagcugacagagacacuagggcaagacuggcuuuguuucugcaguaccuagucucuaccaccaccaccaucaccaccaccaccacccccaccucaccaccaugcuguucuaccuugcaucagcaucuuauaaugaauuuaccuggugcagacuauccccugcuccucuaccaggcuccugucuacagguucuucuuucugccuaucuucccuccuacccaucuuuagauccccugucauugguuuugacccugcucucaggcucagcuggccccugguucucuugucuuugguccuccugugcccccuucuccauccugccugugugccccaccccuccuuguaccauccaccuugcuaaugcacugaggacacaaagggauuuaaaacuggucacugaagccaguucaaggaguucuaagguguauguggagugggagaccacaggaucaggaagugauaggaggcucugucuucccagacaauagauccuugauagaugugaagauaagaagguaggaaauaaaggacuuaggcagagagguugcgccuccucacggaugacaucuuuuguuccucaugggugauauuucugucuuucaagaccaccuuugaaaguccuaauacaugcugcuuauaaaaauaacaugugcucacccuuucuuccagaugauagccuggaaucuuuuucuucuaguccucucucucuuucucucuuucuuucucucaccuuguccuacagauuccuuuuauugugaauuuaugcauuuaaaauagcucuauuuuugcucuucaacucuuuuucuuguguuacuagagcacuucaugguucugagguugauauccagggauuguacagccuaacacugagauaugagugcuugaauuaacagacgccaacaagacaguccacugcauguggacguuagauaaacacuguucuuccuagccucuguaaggccugcguaguauuucuaaggcggugcuuggaggguuucuuuuguuguuugccugagauucaaauagaaguggcauucugcauuuaucuuucaacccuacaaaauauauaaccuacccaauuucuugcuuugaaugcuuagauauuuuucagaaaugcaauggacacuguuggacguaaaauucccucuccugaauuaccuuuucagguggguuguuagaaggagaauuaccgagaagaugaguauuuucuuuccaagacuuuucaaaccucuugccaaauugcuuuuuaaaaagguuauagcaauuuacgcucacacgggccgcguguaagagcccucguccuccauaccuucaccacucagcacuuaaauccugccuugcuguucuggcagcaaauaucgcuguaucauuuucuucuugauuacuaaugagguucgcauuuuuuuguuuaugaggcaguugauguccugguuuuuaaguacaguugaccucucugcccuuacucugcauugcuuugaaaccauaggaauaacucuucuuuuuauuuccuuaauuauuuuuagccuguggcuagagcuggaacccacuccccaaacucaaguuccaaggaccagcucuguacaauggcuuaccaccagccuacccacuguuuaaaaauaaaagccccaguugacuccuaaaaugcauuuaaaauaauuaaaccaaaaagugguauaauuuucuugagucuauagaauuagaagucucccccccaccccaaugguucucucuaguuuuguuccuggaauacaacugauuucaaauaucauuuucacgaaagcuacuucauccauucuugcagacaaauacauaugcugaguuacacuggguccaggugggaucugcagcucacugaugugagcaguacuugucugauaaauguauuagugucccaaggaugggucuccguugccccaagggccuggaggaagagggugauaugucuguggguuguagcacauagguuuccccucagcuaguggagucccauccaacuuaaaauagugcugagcuagugaaacuugcuuccuuugagaaaagaguggcugagugguacaaauuacauuuggcccauuuccuuagguuaaguaaagggggcgcacagucugccagacaacacucugcuauuccauggugguggcucucucucugccccugcauggucugcuuuaauuagcccccaguaucauuaaauaaggggcuguuuggcuacauuccugaagauguucucauucagauaaaagauuccaggcugggcauuuaugucuuuccgggacucacuuuaaggauaccacuguauucauggguuuuggccucuuuccccaccauuuccuuugcuuaguguggacuuuccgcauuaccuggaaaucaguucuugggugaaugagucuaugucacuucuucugcccucaggccugacccaagugugcuggaucuucuuauggaugugacuuugaacagagccucgggucuucccuagcucccacaguggucuuucuuuucuuucuucuggcagcuugaccuuucaugaggggcaugguaauguuccacugcugaaucuaacucguugacucaauggcuccaucgcugaacugucuugaccugccccauucaucuaagcaugugcuaggagcaucugcauggaugcuuuuucuagaaagccccucuucucaaggaauagauagcaggcuccagacagcugcaugcaaguagaauuugaggcaugauaaguauuauagaaguccuuccuuccccuccaccagcuuucucugauaacuacaagaauaggacacaguuaaucuuuaacucagguugguugucagcaaccaaguacguguauucuagccuuggaguuuugacuucacacguggcuuuaccacccacuccuuugaggguccaguuucugaaucucacaucaacugccugagaaauggaacaaucaacaaguggacuggugaaugagugcgagacuggcuucagagcuuggcuagugggcaaccugacaaggaugcguguucaaggcacgacaucucuugaggagaagaugaagugcacaggcagcuucccuggaacccacuggggugccaaauaguuaugccuuucaaauuucccauucauaaauaaauauccuucccaugcaaaccaacuauuauucugcucuuucccagaacaccaccgacuugggaucuaaaucucaacaauuaccauuauucacaaauaauuuacauuucugggcaaauggaagauaccauaucaucauuauuguauuuguucaauuugcaaaauggguccuucgaggacucauuuggaagccuguguguauacuacagauagaaaauguauuggacucuaacauucacggaggagugcauguuccaaauuaauauaaaagacauuuaggcauucaaauauauuguuggaaaaaguggaauuacugaaaagaaagcaauuugggagcucauuuacuaaagaaaaaauagggaugugucucaaacuauaucccucuuauuacucuacuagacucauacaauguaauggaaguucguauagguccuauguggcuuucagaugucuuuaacuuacggguacauauuuaaaaacaagaaaggcucugugauguuagcuccccagccugccaguaagaaauuguauuuauagcugcucagcccugcacacuguccagacuccuuguccaguugcuuuguuuccuuacccucuccgucauuagguuuuguuuuuugguuuguuuucuuccuccacuuccuuucucccaagcuccauaugguauggagaauucccaucccucccacuggacagugcaccgagacugccuuucucccccccagcucuucccgagaagcagaucucacagugggauuggcccauagugauugccucugaauuggccaaggaagacauggguagauuuugagaaauaaaauuccccucucuuugccacagcccaagaagagggacugugcacacaucugccugauaauaaagacaacugaauuccaagaaugcuacagaagugauuggcauuucauucuugucuuuaauuuuugugaacuuaauuaaggaaaaagcauuuaaagcuugguuucuuuuauucugggaaaccuuuugucaagauguacuuaaucauuuaauauaguuaaagaagaaaacaaucuacugugucccuuaaaacaaacaaauucugaggucagaagugacccaggcacacucugauuggccuugagcacuauggagcagaauugggacuucugcccaaauaucaugccuuucccugaugguugcagagcuagcuccguaguuaaugucaguucuuuccaagaagauugccccuucccuaccuaauucuaccuuucuauccaccuacaggggaacuuuguggcuugcaugacagccauuuuacggcagauggaagacuaccauuaugcacaccugaucaagaccuuugggaaaaugaggacagaugucguggugagugucuuuuccauccugucacaaggccaacauuggaagcagucagugacaucuguauuuccauuuaaaauagauuucugcauaagaaauucucuauuugauaucagaagccacucaagacacuguguggaugcuuuugacuagcacuaaccuggagaauaacuugggucugagccuggagaaaucccaucuguuauggucacagcagccuuucacuugcuacugggucaauaacaaucaugugccccacagucauuagcuccugucauuucuugguugacuuucuauaacaguagcuugugagcuacccuccuggaccuuaagcuaucuucugcuauuaauuagugcuaaccauagacccucaucagcauuucuccuaauaacuccuuaguccuccucacacaaacaaugaugcaacuuaauugggagaguguaauagggaaauuuauugcuuaggagcuaccucccuaauggccugaaauuacacugccauauggcgaauauccuuugcaaagcugcaccaaaccugcuggcaggcuuucuagugagaagcugaugcaaauucuuggauuccacuuuuaaggagccacugcuccuguugaauguucauaggucccuguguggcacagcuaacucacaucauauuuccagagcaaggccuauugcacuuggucucgaccuuacuaaaggaaggaagcagcaagauuuucaugauuuuuuuucaaagagcuacaucaaagaccagguuuucuuuuguguggccauaguaggagggcagauagucaauagacaaacagacaauagguaaauacugacagcucauacauacauauguagaugauagguaaguaaaucuuuaagaguuaaaugaauuuauacaucaaaauuauaacgaauuuccuuauacguagauaaaugauagauugauagaagauagauugauaaaugauaauuacuugguauaugguagauugauagauuuauugauaauacaagaugauggacauugauaguuagcuaguugauuaauagauauaauuauagagaagaauauagguuaauagauaaauuauggauaaauauauacagauaauuucuaagaaaaaauaaaucuauacuuuaaauuauagcaguuuuccuuaaauaaaaggguauaaaaaucaaaucaguagucuucuacucaaaggauaagcaggcugagaaagaaauuagggaaaugacacccuucacaauagucacaaagaauauaaaauaccuugaagagacucuaaccaagcaagugaaagaucuauaugacaagaaauugaaguuucugaagaaagaaauugaagaagaucucagaagauggaaagacugcccaugcucauggaucggcagguuuaauauagugaaaaugacuauccugcugaaagcaaucuacagauucaaugcaauucccaucaaaauuucaauucaauucuucauagacuuagaaaaagcaauuugcaaauucauuuaaaauaacaaaaacccaggauagcaaaaacuacucucaacaauaaaagaacuucuggagauaugaccaucccugaccucaagcuguaugacagagcaauaaugaaaaaaaaaaaaaaaaaaaaaaaacuaugguauugguacagagacagucugguagaucaauggaauagaacugaagacccagaaaugaacccacacaccuauggucacuugaucuuugacaaaggagcuaaaaccauccaguggaaaaacgacaguauuuucaacaaauggugcugguucaacuggugguuagcauguagaagaaugcaaauugauccauucauaucuccuuguauaaagcucaaguccaaguggaucaaggaccuccacauaaaaccagauacacuaaaacuaauaaaagaaaaaguagggaagacccucguacucauggacacagggaaaauuuuccugaacagaacaccaguggcuuaugcucuaagaucuacaguagacaaaugggaccucauaaaguugcaacacuucuguaaggcaaaggacacugucaauagggcaaaacagcaaccaacagacugggaaaagauccuuaccaauccuaaauccaaagagagggcuaauagccaauauauacaaagaacuccagaaguuagacuccagagaaccaaauaacccuauuaaaaaugggguacagagcuaaacaaagaauucucaacugaggaauauugugaggacacuuagguccuuuuuagaaaugggaacaauauacucauaggagcaaauauggauacaaaguauggugcagagucugaaggaaaggccauccagagacugccccaccugaggauccaucccauauacagucaccaaacccacacacuauuguagaagccaagaagugcuugcugucaggagccugauauagcugucuccugagagacucugccagauccugacaaauauagaggugcaugcucacagccaacuauuggacugggcgugggguccgcauuggaguagucagagaaagaacugaaggagcuguauggguuugcaaccccauaggaagaacaacaguaucaaccagccagaccacccagagcucccagggacuaaaccacuaaccaaagaguacauaugaagggacccauggcuccagccacauaugcagcagaggauggccuugucaggcaucagugggaagagagacccuugguccuaugaaggcucaaugcccaaguguaggggaaugccagggugggaggcaggagugggugggugguugggagaacauccucagaagcagggggaggggagauggcauagggggguugggcgugguacugggaaagguaauaacauuugagauguaaaugaagaaaauauccaauaaaaauguaaauauagaaaauauccaauaaaagaaaagaaggguauaaaauguguacaauuuuaugugccccuguguuuuaguuuucuaugaauaucaagaagaaguuuacaguagggacauagucaaauaaauaaauaucacgcaaugucauaagauuaguuugaaaucauaguauagugaaaucucuuugaauauucauaauauuuaauuucauccuuaaaucuucagugugccucuauggccugcuuuagucagugaaaauaauagaguugagagacuucagagaugauauucuuggaugaaugcuaaaguuuccaggaugagaguaacuacuucuacugaaaaaugaguaccacgguaacaauugauacauuaucagaacacauguguucucaaaagguauacauggcauuaacaaaugucccauaugaauuuagcuacagcgugggaugaaacacaguuagacaacauggcuuccaagggugagucugaguuacuuuucugucgcuguuauaaaacaccaugaacaaagucaacuuaagggagggaaacuucauucuggcuuauaguuucagagggucaggaguccuuccuggugcuggggagucacugguaggucuggcaacaggaacagagagcagagaaaucauacguuuagcagcaagcaugaaacagagaggaaacuggaagugaggcagggcuguuccuugugacauacuuccuccagcaaggcugugccauguaaacauucccuaagagugcuaccagcaagagaucagguauuuaaaugccuaagaugauggaggacauuucucacacaaagcaccacaggauggcagugccuuguuggcuuggaguauaccuucuccuuucccagaauagaggaucaaguauccggaggcuacauguuguggaccaaauuucccaagggguuuuucuuuuuuucuuuuuccucuuagacacaggcauccagaaaagucaauuauuugcauacaauuugauuucuauuauaaaauggcauuuguuauuuguaugucucaaauucccacggcaagauuuuuuauuguuguuaguucaucaaaaccuucaugaaaauauguuccuacccacucacuguaugcggagaguauuuuauuuuucuacucucccaauuaccaugaaaaugaaaagaucauuuccugugaaauaauuggaaguuaauuaguauuccaauaugaaaauggccuaaaaccguuuuccagagucuugcuugcuucuaacaagcacagcucuggauucucagauucagcccccccccccccccauacccagacacccccucccaucucccucugccuccuaccccaaaugcugccacuggguaaaucauucucacauagauucacagucauuaucacuccaauaaccccacagggcuacugcugucaccuuccaaaugguccuuuguucccaggguagccagagaaucucaacuaggggggaagaccagacaggugacacucaagcaucccucccaggacagggaagcugcuuucucaagcugcagagaaccucucuugcuucugccuagugcugggugcugcccucugucuaagucucagcaucaguagaagcaggaagcuuggccaaagccuccccgcucccuaagauuguucuaacagugucccagcccuccacuggguggcucuggaagagccuauacuuugcuucacacugauucccucaugugccaguucucugacaccagcugaauguccugccguucagcacgaucccugcacugucaacguggaugucaucauggauuccacagaugacagggcucaccuagauccagcuguaagucuaggcccccguacuuuugacuaagcagcuauuaauaagcguuccuuuagccaggcaguggugacgcauaccuuuaauuucagcauuugggaggcagaggcaggcugguuucugaguucaaggccagccuggucuacagagugaguuccaggacagccagggcuauacagagaaacccugucuggaaaaaccagaaaaaaaaaaaaaaaaaaaaaaaaaaaaagaguuccuuuaacccugaccuugagguccauaauuugcccaucuagcucacagcccucugggagaugcuugcauauucuguccuguuuacuauaaaggauauaacucuaggaaaaucaagaggaacugcugcacaggacagaguaagagggguggacauucagacuucugacuucugcuuccuucucagaagauuauccauagcccagucccuccagucuugucugcaaguucuuuuggcacaaucucccccuaguuggaguauauaggguuggaaguucuagccucacaucuuuucuucugucuggagaccagccccacccugacaccuccuuaagauaaacucauguauaagacucauuauguagauaggaagaauaaugacacucaggaacccaagguuccugggaccuuugugccauuagaccauagcaaauguguguugggugaagagugaggggugcagggacagagcugguggagacaguguugaggggaggcguauguuaaaggcuaggagagagaauggcgcacauggacucaguacugcccgacuucucacgugcuaccugguucuuggguaauccuuguggaguccuccaggccuaaucugcugucagacaaguccagguauccuaggcccucuugcuagaauccuuccucaccuucuugcugcuuugguaguaaccuuguaggagccucuuucugacaccugucagcguuucuauagaugggauuaggccccuucccuucauagcacuuuaccuugucuguuccauuggcccaucagccuguucuggaauguaccaggcuggcauaguguauguagaaagugguaaggaagaacauuaguggguauagagggagcagaauugccagcagcaaggaugcacgugcuucagacacgugcugcacuugagacucucaaggucuucaagguauugcuguccgcgggacacugucagccgagguguugcccaguuuccauggagcgugcauccuagacggaaagaugagacaggcuccacacaccugccugcucugcuucugagccacuccccuggcaaugcagccucaggagagcuacacgggacuaugagucuagggguacagauuucuuucccagugacuuuuuauccgcauuguggaaggcaagcagaacaaacuggcaugccucauaguuagucuuuucagggcucccuuaucaucugagcucuuguggguagggggaacaaaugaggcuaagucagugguaagguggcuucccuggcagagugggccaugguggagggaaagggguugcaggugaaaggagggguuucugauccuaugcuggggaguuuccugugggaggcacuaaugggccacugaggaaaauaccaaccaggaacucuugggccgugcuagccaaccuucaauccuuuggugcaucuuuguuuucagagccauuauguuuugugugaacuuuauucugagcccauuauggagucacacacagcucucaauuuauaaugaauucuguacgccuuguauuguaccaccccucagacucagaguucuaucuagauggcucuguauggcuugcuuauagcucagguuagccuuaaacuuacugugauucuccaggcuuagucugcugagugcugggauugccaucauagaccaccacacugagcuuuagugugucucuauuuuauucuuuucaccuugcucucuuucuuccaucugugacguuagugugugugugucugucagaaagaacaugucagauuggauuacagaagcccuaagagggcauuguaucuucuggaacgagaguugugagcucuuacaggcaguugaaagcugcccaacacaggugcuaggaacugccuuuggauccucugugagaugauccugauccugugggcuguccagcugaaggugaccuuuucaucaaauuaaugguguuagagauugagagaagcuguuguuugccuccagagcaccccugcagcuuuuguuagagcugaccacucacuacauuggacacccugugaauacucaaaugcacauagcaagaggacuggcuguagggugaaugaugaagcucucuuucauuacuccugaauuccaggcuuccaaggaggucuuuguaaaccucaucagcucugcuggaccacccugacuacugaguuacucagcccuacaaauaagccucacaggaggucagcucccacugcacagacugcauucuguuugauuuagccaaguuccaucauauaucaacugagcaauacuaauuaagugcuggccugugaaucauagaaagaaaagacccugggaaaagauggcuuaucuacuaagcauguaaacccaucccuaucucucaguuauugggcuuaggugaaggauggacaggaauccuagcaaucucaugcaagccgagaugcagcucacaaaguauacaacccagccauccgaggaaguuccaaacuaagggcuaaaugggaagcuaaguagaauaacugaguuguuuugagauaagcccauuccuccccuauauugcuuuugcucagaguguuucuucagcaguagaaugaggcuagaguaagccccaaaagaaugugaaccuugccuauaaucugaugcuugucuucaagauuaaccugugcuucuuugcaagcgaugccgucuugagcauuucccacuagggaauuaccuucuuggaugcuuagauucuauuuucccccuugcccuucuuagccaacacuuccuuaugauuuaauagauuccaauaugagaaagguccacucauuuagccaacucuaacuuuuucuaaaccaagucccuguugccuuuuuccucguccugggucccgagcacacaugggggcuucccagaagaccuugauagggcucagguuaacagcccagagcaaaacaaacuugcccucacaaauaggaacuaagcuuaauuccaaccagggagcugcuacaggcuuaccaacuugccacguccagaggcuuccuugccuguguauaauuggcauaaaacagcaggcaaccccuugaauccugcugcccuauguugaucugggagcuccccacaaagagcaugagauuccagcagcaucccugaauggcuuaacuauggagcgguugggcaaaaugucuccuuacucacguggucagcugcacacugcgugugugcagagggucaaggcaagcuuuaaauuacaaaaagaaaggcuggggaucacaauauaccaaucucugggaguuuugauguagugaaaaauggauuuaggauaaacaugagagaaugccacagccugccugauagguuuauaaaauccauguuuuccuguaagcagaagaggcacaaauguauauuuauaacccuuggggaucuuuuuuuaacugccauagagacauucccagggacuauuucaacaucuauccuugaaaaagcuaucucaagcaggaggugcccagguaaacagacagaagcaguauagagcaccagagaaauacaucuucauuugcuucuagaauguuuuccuucagcuaaaaauaaugggaucuuuuauaaucucaucaucagggagaggguucacccugcuccuggugggcuuccugaccgccguguugucucauugcaggauuuucugauggagacauucaucauguuuaagaaccucaucgggaagaacgucuaccccuucgacugggugauaaugaacacgaugcagaacaaguaaguccagccugaagccugcaucuugccuccaucgcaucugguggccguggugcugcggcuggguucucaggugucugcugaggucgucuaugccuucuauggugcccgugguuauauggaacugugaacauguagcucaugggaguguccuaaugccagcauggaacucugccgcuagaucaggcuguaugucccugcagggggagaaccagggcugcucucagaugcugcugauacaaucugagacaaggauucaaugguggcuguggauuaagguuguuguuuggcuauaaaugagaagaaggggccuggguguacuuuagccuuucuaauagguccaugucucuccuugcaguguuagcuuauagcucccuguggcuuugacuuuuucuuugguuuugguuuguuuuccuuagagccccauguauuucgaacugcccucaaacucacaauguaguuaagucuagccuuauacucccaguucuccugcuuccagcuuccagucacugggagaacaggguuaaggguaccaagccugccuggcuggcuuugccuuucuggccaucuguggaguagagcaaucuguggcagcagagaccuuuccuggcuucugcuccucuuauaacaguagagacgguuuuggggccuuguguuccucagauggcuggauucccagcagaccucugacaagggucuacugagggaaugcuguaccugaagucacaugagggaaugcuguacuucugaagucacaugacacuguuguggccaagcucucucuugguggggcaggaugacgaagagaguccuggcccucaggcuugggucugcugcagucaccccugacugguugaaauaggggucuuggccucugcuuccauccuuccaccuaucacaucaucuagcccucugccugucucuugacauccccauccuacuguggaggcugagauccaacccaacaguguacuauuccuuucuugcccuuaggguuuauuuuuguggcuggaaauuccacauccuccuggaacuguauacagugccuuuaaugggucuauuucucauccaucacaacaaacaaaucaacaucagaaucugaaacaaauuccccacugucuuugaaccauguacaaaaccauuguacagacuuagggauagcauggcaacauugcuuagaauaggcaacugaacacuggggugggguggggauagcagguguggauugcuugccaugaucccaagggugggcuuggcuucugcucucuccagaagggcagccacgugcccgucagugcccagguugugaauuccauacccugagugaugacuccucuaauaaagcucagauaugacuuuuucccuguaguugaaucgcccuuccaugguccaccaauguguuggugggggugggggacauaaaauauacucacacguuuauuuuugugaugcuuuuaagaucaacagguuguuuuuaguuuucaaagcacccuuguaucacuucuucuugcuacuccgucaacuccccccucccuccaacuuugccuuagagggagccucagcugccccagaacuaaaggagucaccauggucugugguuccauccauacagcgcugcagaucuggagacaccaagguucuuuggggccaugcugcuuugaucuguggucgccagcgcuguggacugacuaagcaguaucaaccuccuccuggucccuggaugcucccugcggguuuagccacgugaugggcuacaguaggugggcagcaucgaguguccacuguauugucagcuucagcagaaagacuuuuucaguuuugaauuggugugcccaaggcuuuugcauugaggaagaugaccugagaaggcagagguuccucccugcuccuguugcugagccauugauacuucugagaauaagugacacuaaguauagcuugugacauuguccuagucucugauacacugugcauagaggcugcaguccuaaggaaaucaugauaaaggguguguguguguguguguguguguguguguguguauccccgucuguccagucugccuguuuuguuaucugucuuacacagaguacugcaccagagugucuaguaacaaaaacucuugagucaccaggcccaccuguccaucuuuccucccuuggugcuuucuguagacaugcaaggguguguguguucuuaccaaugugugacugaguuaggagcucauauaaaggcucuucuauugaggagaaccuaacccuuaaaaaucacagcaaagccacaguuaauauuuuucagagggacaaguuucaaggcaagguaaccuguggaagagccacccuuucuugaugcacaucacgugggggcacagagaacuggcaaaguuguucccauaccccaggggaugcagauaccacaaugcacagcacugauguguagaagcugagucagucauguguaagggagccucgucccagacuggggaugcagcucacccauguuugcccauugugcacuaaguacugggcuugauccccagcccccugcaccgcugugugaacccagauguggaagcgugugucuguaaucccagcgcuugggagguggaggcagacugaucacaaguucaaagagaaacugaaacagaagcaucuugaccccuuaccuccaccaggcgagaggugagguacuuagagcucuuuggagacugcagguugguuuaugguccacaccuucccuuaaaugccgguauuagaaccuccuucuuuggaaaugcaacguggacuguaaaugauagcuuucuaggaccucucugggacucuaucaucagacucggacuucugagauagucagucuuguggacugaacaacuaccacucacacacauucauacaugcauacauacauacaugcauacauacauacauacauacauuuuuuuuucuuguugcuaugagaaaaugcugggcaaaagcaacuuaagggaggacauuucuguucuagcucgugguucaaaggugcaguccauccuggcagggaaggccuggcagcagaaagccaugugugugaggcacuggucacacugugcccauagccaagaaucugcacaggaucagugcugcucugcaguuccuuucuccuuuugcuugagucugggaccccagcccacucacucacauccacagguggccuucccaccucugucucccugucuagaaagugucucagagauguccccagggguuuaucuccauggugauucuaaaucccauccaggugacaguccagauuaagcaccacauauguuuucuacaugauuucugcccuuuuugcuguguguauguauguauguauguauuauguauguggguggguggggggugucugucuaucugucugucaucugucuguggugacuaugucccccauugccagcauugcucaugccacucuccuuguagcucacgccagccuuccuucccucuguacaguacuaaacuguggcucccaggagcuuccugagucuguauuuaaguuuuaauggcacagcuggacaugcaguuuuaccacccacggcuuagaaaucgacccaaucggccucucuggucucuuaaauaucccugugcucguuuggcuuugucugugaacaaacugcuccuugauguucagggcucguaaaauauaauuaaagacagcacccauuugauguggcgcaacaagcuugcacaccaaggauguugggacugcaugaggagcccaaggacagccacggcuugguuuccauguuacgauagugacagacuagcaauggccugacauuauggcccugagcuccaguaugauagugccagguggcaagaugacauuuaagauaagcacgguucagaagcagucagaugguaucugugugcuggcuuccagagugcuucauagucuacccagaauucaugggugcuauuuucuuggaagcccccagggugccuuccauucagcaacugagcauuacagcugcccuggcucucacaugacuaucuuuucuuuauuggugcuuugaguguauguggcacaucccacagcugcacacucauucaugaagucacgacuguguuagcugcuacuggaaauguaaccacuugccgugucgccucugguccugggcuugggcucacucaccccaguggcacuggguuugugugcccauuaugcacacuaggauuuuaccauggcugggcucuggugggaggucugucuguggacacaauucuucuacaccucagagaaauguuauagauugcuuucuuuuggccugugagacacaucucugccucacgcaucgggugagagaaaggacagugcuccggaugauuugacagcuucauagaagucagguuccucuucauccugacuccagagaaggaggcagaacuguuucugcauuugccagugaugagcacuuggugacagaauuuuugaaacuuuaaccacucccucugaaauuccccugugggccuugcuaggagcaggcccuccucucucagguggaaacugagcaaaaucaacacucuguccugcucagaaccaucacuguugacagcugugauugucagugguuucaaguaucccucaugucaguguggaucuuguacuugaggcuggcuggucucuuugaggcugaguuggggccuaaaggagacugauuauaaaggauggugcgcauccugcacacucgcauagaggacuuuugaaaauccaugguuauaaaauuauggaguggacuuggaacuucguaguagucaggaagggaaguguacuggcaaguaaggguauggaggaaggcacagugguuaccaaauucucgcuggaugguggacaaggaaacagcccuguuauucuccagagaaccccgacuguucaucaugagggucauucccagagagauguugagcaagaaagucucagagggcaaacaucugcugagaacuaaugaugccucucagaaacaaauagacacuucuuagcagucaguacagggcccuaacaaggcuuggcugugauucgaguuguugagaaaguaagcuuaacaaaugcgaaacuuuuuugguuguguguaugcuugucuauauguguacagaugccuguggagaccaagggacauccuagguguccauuucaugugccauucccguugaucuuugagacaggaucucuuacuggccugaaacucggcccuuaggucagcaaaaugcagacaucucccugucccugucuccccagggcugggauuacaauuaugugccaucacaucugccucuucauuuuggaguuuggaggaucagaacucaggacuuuaagcuugcaaggcaaacccuuuacugucagacgaucucccuggcccacaguguggaguuggcugaucugcuuuauuccuuucuuuauuucuuuauuccaagccacacccuucuaccucucaaaauucccuuccucuuuauuauguucuuuugacuauuuuuaauuauuuugcucuuugcauaauugaaacaagccauuuucugauuuuuuuuuaaccugguuguuuauaacuaauuuauugcacguagcauagauauuuucuaccagugagguugauucgaauugccucuuuauuuaauuccaagaugagaaaucaaaccgcucuucaagagcugccagugaugaagggcucucaggucucuuacuuagggacacucacuucagagggaguuugaaaggcagcaucugccggaggaugcugagcauacugugcauaccucugcgcccugugagcucccagccacugucuaucuccgucccauuggcccuuggcagugaaggaugcccugcacuucaugagagcagaagccaagcguucucucuguccagugcaugggggcaucucuaggaggcaaacaaacugaagggaaaccauuucuucauagccaucuguugccaccccaccccagccaccaccaccaccaccaccaccucccagguuagaccuguccuaaauucucauucauuacagucuugggaccuagaaaaaucuauaccguuuaagggccugcacuggcugaggacuaagaaagaccaagugagggaacauugauuguggcagaggcaggaagaacaaaguuucgggccaguucagucuggauuauggaguagaugagagaaaguguggauuguacaguaggacuuccuccgaagcagaugaacaaauaaacccacaaaaaaacuugaagggaaucaaagcaacaaacuugcugaguugccuggcaaugccuucgguauccuuuugguggcuaaaugaauugagauuccaccccccacccccaccccccacagaggccaaggggcuguguccauauagacuuuggcugcuguauuuagggacagaggguuucuggcaucuacugagcagaccucagggauguuccugacccaccugguagaauaaauaguggcuuuaaaguggucuuguucaugguucuauuacagcaauagaaacauaacuuagaugaggaggaucuaggagaaauugggcgaagggaaaacaugaccaaaaagaacuugccugagguuuaauguaggagacagccacucuggguagaacccuucucuaugcaaguggggcuggacugcugcguaagaaagauggcucagagugaaccagagcagguccgggcaagcagugcucuuucuugguuucugcuucagauccugccucuggucucugccuugacugcccuccaagacggagugcuauucagcagugugagcugaaauaaauccuuuccuccccucccuaagcuguuuuugcccccgugcucuaucccagcaacaaagagggaacuccagcaccauguccauccagacuccuccgcuggccagcuucaaggaggcugguaaauuuaccuuaggcugaaacuuuaauuaagaguuggaccaaaaauggaaggaguguuaggaacaugaaugagcuaagaggaacggagugugucacugaaaccugaucugcugugucugccuggguccugccccagcagucagguagugagguggaacccagauaggcagaccagaggcugaugaccucugaugcuuaacucucuguuacugaucaggggccgacagcugauugcugcuggcaaugaacuccugcugguaguucagggaaauuagaaaagaaacuuaguuacuugggaucucuacacauugacucaggcuucucccugucuguaugagaagucaaguuccuuaaaucuuugugagccaaagagaaaagaaaagagaaaaggaaaggaagaaagucagguccacucagagacacacacauaacuggauggagcaaaaaagggcuacagugccacuuuauuauuguucuuaauuuccauacuuuccuaggagaauugaucagaugguuuuuaaagcauuuuuacauuccauaaguucauaguaagcugaaggcaauaguucaugucacaguuccauuaaacuuaaggaguuaccgaagaauuguuuacaugucuuuccauugagacuaguaccugacuaaacagucauuaucugcuuucuagaccuauaauuucauuuuaaguuuaaagcaauaaucuuuaugucauaaguuaacaugguuuugucaagacacaaaucaucugccuugugucuuaauuuuucagucuuauauagacaaacuaguucaucauuuauuuuccuguccuugcaccuacaauaaauugcccauuuccaguuuaugaucuuuaguuaccagauaguggccucauucuuaaccuagaaggaauguuuuuaucuauuguaaauuugcucaaagccuguuuucuuuuccuagagcaauuaaucccaugacacacaaagguuuacagagcucuauuugcgguuuuuauucuauaggggguuugagaguacuuauuucaguuuaagaauucuauaagaucauuaucaggaauuaugaaaccaucaauucaccuaagcagcauuauuccuugaaaguacaucuucauauugauucuguaagaaaucugaccaauauggugggcugaugcccaugaggcuauguaauuguggcaggaaaggcaucucagcagcaagaaggaauccugggaugaagucucugaggacccugcaucucagagcguaccuaucacagccaugcaaaacaguggaccaugucuagaaaacucacuugcuagccauagcuuuuccuagguggcuucuaacaagugaccauaggagcuauuaccuuggccaucucuauggauguagaaaaaaauaugucuuuguuccuccauauccaagaaauuggucauagguauuagaaauuugaauguuuccauggagaugaaaaauacuucauucaugcauugaagguguauuaugaagaaugaaacucuuuuuucccauaaacauacuuuuuuaaaaauuuuuuuauuuuuuauuuuuuuuguuuuuuucgacacaggguuaggguuucucuguauaguacuggcuguccuggaacucacucuguagaccaggcuggccucgaacucaaaaaucccccugccucugccucccaagugcugggauuaaaggcaugugccaccacguccggcuacauauuauuucuaugacauuugaauauauuaaauuuacagacuaacuugauuuauaauuaagucagccagcauuguugucugucuucauuaaaguaguuauaugugguuggcugggacuugggaagcucauuggcuuaugcaguugcccuuuguucccaaacauggucuauggaacuguggaacuaccucaacacgauagcaugucagagcuacaggcuguaaggacgaccccacucuggcuucagaugaggcucugagauguggcagguuacacugguuaccagaaauguaugcaguggagcaggcuggagccagucuugcuccuaggcugggagcagugagcuaugacuccuucugcccucaaagcuccuugggaagaucacuggaauagugaaaggcaaaggcuuggucauagauggguccuuccugaggacuggaaacaggagucacuguugugcuacugagguaguaguauagacgaugcuuagauuuggugauaguauaaucacuauguagacucuuuauuccuguccucccucccuccuccucuuccuuccuuccucccuccuacccuuccuuccuuucuuccucccucccacccuuccuuccuuuuuuccuuccuuccuuccucccucccuuccuuccuguuuuccuuccuucugcgcuaacaguucuuuauacacacauacucacacaaacacauacacccagagccuuguggaagugugugugugagagugugugugugugugugugugugugugagagagagagagagagagagagagagagagagagagagagggagaguguguguguauaugugagugugugagugugugugugugagagagcaugugugugugagugugugugugagugugugugggugugagagugugagugugugugugagugugugggugugaguaugugugugagugggugugagugugugcaugagugugugagagugugaguguguuugugaguaugagugugcgugggugugagugugugugugugugugugugugugugugcucugcagauacuuuucucagcucaguaacugcagcgcuuccucucaucauaauguuucuguugguugacauuuaaauuuuguccugaagacuugcagaaagacacugacuagagucaccucugguaacuguccagguagcgaggcuucacauuucuccaaugcagugucaccaaaaacacuguucuuacagugagcuuggccucaguacuaagugugaaaguccauaguuagcugccugccggucagaagguuaaaaauaagguugaauaagauguugucuccaucuucaauccaacccgacccuuguucucagaugcuaaaaauuuaaaugugggaugugugcccaaaucuaugaaggaauuguaaccaugcccacuacaauuccuucagcgaaucaaagugugaacaaggaaggcaacauccuccauccuugcuccacauaggagccccuuucacaggguggucacugugcuuuaucugaaaagcucagcgcggcgggggggggggggggggugguacugcgaggcugcggauacugcgcggcggggaggggguacugcgcggcugggggaacugcguggcuguggguacugcaucgagauauugagaaucuccccaacacccucagaggcuugcacgguaccuuguccgccacacaguagguauuuaacagugcucaucuaacugccaaucuaaaaucaugagugucaguagaaaucgugcuaauguggcuauggaugaccuugaccuugacagccucccgccucugccuuccaaguguuggguugauuggcaugcagcagcacaccugcuucacgcugugcugagacuugaacucagggcuuugugcaagcaaagcaagcauucugccugcucaaauacaucccccugccccugugagagaucaagaagucaacugguaaggacaugaaacucuguugcagaugcucuacaggaaugccgugcgcaugcucucuuauguuuggguccacaaagaaauuauuguagaugccaauaggcaaugagcaaagacuccuccuuauacgccugacaaucugguaacgaaugaauuuccuuagcugaacguugucccaaguuuaccugcggcaccuucuugcagaucucagucuguaaaccuggcucagauaagcauuucugcugcaggccugggagcugcagggagcugcuggcugccggagcuggcugcuucaugguuaaccuuuccaauaaggcaucaaagaagggguuuuacuuaauauuguaccugucaaauucccagagcugugaguaaauugaagauacaaauuauguuguaaagugaaauauuuuguguuauucuacaguuugguugauuuaggaagaaaaugaacucugacagcuugaucuuuucaguucaguggauucuaaugguccaaaacaaaagcccacacuacaggcucuuccucccuuccuguuuaugagcaguguggcugcaagcucuacccauacuguaccuccaggacaaccggcuccaugcuggggaugcacaggcccuugggaacagcaggauagugcugguugcuuuuuuauauauauacaaauauucagcauccccgugaguggaaggaggccucucugugucuggcccacuugccucaguguuuuuuuuuuuuuuacaggaaagggaccugugcuccuaguuugucuaacucaauggcugcuguugccaugacuuccaugccuacauagaagugauuaccuugauggcuaugggagcugcucacuggaguguacagggaaaggucugucagagagcccuucacuuuuccaucaugaagcucauagccucccuggaccaacaauucuguguguucacaaaaagcauuuuguaacauuaccaccuugcacuucugaugcauuggggagggucgugggguuuagaaagaugauagacagaguguuuuguaggccuagguuccuucggugggggcuaaacugcuagugcuguucacuuuuguuuugccuugccuaagguucuuuggccuucauaccuuugauaggaauccccuuugcccuaaagaaaaggaccaggcugccagcagcaguggguagcaguuuagacucuuccuccaaaaguccccaagcacagcccuugccaccuacagcugguuccuugccacucucccuaggguucaugggauuaagggaucgggaaucugcuuuauuucuucagacugauuuugcugacucaccaauauuaguaaucacugggaggaagggguaccaaucagcuaccagccugcaggugauauggagguggaggauuccgaguaaauggauaaguggguagguaucuuuaccuuugguauuaaaccuaugacauuagguaggugcagagaauauaguguugaucuucuaggagcugcucuuauguaguuugcucauauguuacagucuggcaugucuuccugguacugugaaguggauugaaaccugccagaaaccauagugaaagggauugcucuauuucucacagaugucucucagucuaaagaaaccauaucuauacagaugucuacaggaguccuugacugcuaggugcaggagcuugggguugccuccuggggcagagagcuauccucuaaguauagguaguuccuggauuuguuuugaaagccaggcuuuagaacaccaaagugacaucaacauuaggcucccuagggccagggcaucagagcaaggagcauggacaaggguuuggcuggagagcugaccgggagggagccucuggauuaauccagaccauagaugguuuugucccagaaugaaguggucauggagaggagaaaauggggcauuugaaguauuuuccagguaggaccaaauggagcuacgacuuggcuacaaggaguuuaaaugguacagguaaaaaggcagccuauugucaagguuagccaagggugauuggcagcucacccuugauguggggaagcaguuuaacagagugggaauauucacaagcacucuuucccaucaugcucaguguguguguccccccccccccccacacacacacugucucccuccuacagagaggaauuacauuguguuuacccuuaaguaugaagagaauuaaggacugagaaaugagacaaugugcagaguguccuauggagggccacaugcaggauugugucugaaaccucuuagcuucuccaccaagaacugguguucauccuuugcuuuucgaucaggaaugcauggucugcugcugcagaagggcucagcuagcaaguaggccuuaacacucaaguuagaugucacuauuuagggugccaauaauaauggcaugaugccacuaagaugcccgggaggaaaaaacaauguugcuagagacagggaguagagguagacagaagucccugaggcugaacagaugcaaagguccacacagcacagggaacugggagggggagccaaaguaggaggaaaaccagcagagaaaagacaauguuaagcuccuaagagaaggugugccaauuaacagagaggugaccuaaggaagaggccacugucgaggucaccgcugaugucaacugugucuauccccaugcaguuagcaugugugugcauugaccuugggcagcccucucugagcuucauggugcuuacauucauagaaaggguaugcuuagggaucugggauaccauggugguuuuccuguauuucuuguuucuuugaugguggggcagugguugagaauacucugaugggggaaggaaaaggugauauggaggugcauuugauggaaguugggaugacugcagcaucaggggcguggccuugaugggaagagaguugauuuacugagacaguuggggaaacagagucaaaauguacauggauguaggaaauccuuauauggcuucuauuucccaagacuaaaguuuggucaauagcaguaaagagucaaggaaaugggcggggaaggggggauguugggucuaucugcauguguguaguacccauaucaacucuaccuagagcauuuaccaugugucccucacugugaaugucuccauauguguggcccugagacacauguuguguuacauaaagucugggagagacucaugaguacaggagucuaaaaagauauaucacuuuaaauaacugcuacuaagucacccucccgugaacauuucuagauggauuuuugucuuuuaagcuucaacaaacccuauuagccaucaaaacccacuggucucucaaaauagcccucucaggcuccuccucugcagguguauauggcagccuggcccugggacugggagggaaugcaggagccagaugucccugaagaagugacuugugucugaagccccucuggcuucucuuaauugucucuuuuggagaguagggcugcuuuaaaaguccuguugcugguuuuucuacacuaaaagccaguuccauaauguucagguaucuuuccaaaccagcuacccugcugguccuccacugccccugccuccuguuucuuuucuugacuugaauuccucuugucuucucaaaugacuaagaagugacucugaaugccugguggcucauggacaaucccaggaccuagcuaugguguccuugaagcaggugacuugcaacucucaguccccuuuccguuuucauuagagguagacaugucuucucauaccuucuucaucugggcugauaagucuuggaggcagcaaagugaaacuugauucauccaaucacuccuuagagagaccauugcauuuccacuuucuugcugcagaaugcaggaagagaaugcagaacucacauaauggugaaucugacagaccacucccuguggcugacuucaucuugcuaguuccucagagacauaagaugcacaucccuagagauagcgagcagcuggcuagugcacacagugcuagggaauccaguggaguagaugcauucuccugaucuuguucauacaguauuacugucagcucuagcagccaugacugagagacucuggucucagcugccucuggguggggggccuaacucacaaggcauacacuuaauuucccucucugaaaaggaucacaguccuggauaacuuuggagcaucugccuuugaugcuguuucugcaauuacaauauuguaaaaucaugccacccaaugcaaucauauuccgucccaguuguuaagcaaaaaguugcuaagacgguugagcuuugaaaacuauaaugcauaccgagcuggggacauagcugagugguagagucuucccuagaaugcaggagacucuauguucaauccccaggauugcaaacaauaaauacuuacacaucaggcaggcuuuauucugauucucagucuauauaaacaugcacccauuucccgaaggucaucaauaggucuucuuuguuggguuguuaguacagauguccuggcauacggcucacagugccuuccuagaacuggaugcccucaacaagccaacuuuuauuccuuagaagccgaauaagaacugaaagaaacuggcaaaggacuuuauaccuugugcagauuuucaccaauuccuuauuuguguccuacauaguauuucuguaaauaacuaauuuaugauaacagacuuaauugcauccauuagaucgggaacugugcauguauagggcuuguaagcuuuguuucaccugugccauuccauguucuugucacucagggcuacuuaucugaacccuauugguucauuaucauauagguuaaagggaagugcccauuaagauaaaauuaguauuuaugauucuuaacuuuaauugccaacuagacacaaccugggaaagagucucucugaggguuuaccugcacggauuggccuuugaacuugccuugugaguuuaucuugauuaaguuaauugaugugggaaccagcccacugugggcgauaccauuccacaggcagauggaucugcucuauguaagaguagagaaauugagcuuaauacaaacaaaugagcaugcauguauucauuccgcucuuugcucuaguguguguauauuaguagcuacaacuuucugccuugguuuaccccaaaagauagacugcaacuuggcauuuuaaguaaaauaaacccuuccuccucuaaguggcuuuuuaccccagaucauuugucaccacagcagaaaugacaccaggacagcaccucauugguuagugcugagugugagcaaguuugcauguagguaguccuuaaugguaugcguuugccuugcccacguaaaccauugaauguuuaaaugaggaaaccucuauaguucugcagcugcugggucugcaguuauucacgaacccuugaaaagugauaaccacgcuucuagguccucaggaaaauaagaguaaaguauuuauuuuuuccucucagauccaagcaaauggaguuagagaaaugggucagcaguuaagagcugcuguugcaaaagaccuguguuccacucacuuaggguggcucgcagccaucuguaauucagcaccagacaguggaucugaugccucugagagagcaucuuuguucaucuugaugcauccccagacagacucauauguauacacauaacaacaggaagaaaucuugagauauuuuuaaaguuuuaggaaaauauuguccaggaagcaagcaagggaugaguucaguggaccagaaguucagcugucuguuucuaccuugcaucuccugcccagucugagggaauuaaacaagggugaaggagcacuggguaacuaaauucagaaacucaaggaggacgucaacauaacuacgcaggcuucuagucaucucuaaucccagggcacugcuccugagugcgcccugacaagguaaaguacuuuccugcuugacaggagaggggacuggguagaggggucaaaauauuuuguucuucuccacaggaugggcuccuuuuggucugaguguaaacacugaugaaaguccaggauacucugagcauucuuuaccauguagaguauuuccuaaaugguaacuaggaucagugacaggaaucaggcauugagcauccugaagggccccacgguagcugauaggugcccugaagaugccagguucccaggaaauacauggugaauugacagcugcuuuccuucccacuuugcaguugguaauuuuccagugucgcauuuuccauguauagguaugaaucuaaaugcaaguguuuuuucauaauaagucacauuugugguacugcgaacaugguuagacaucuguguaacuuuuacauagacugucaucaaagaucaugaaauucauaacaaagcauuuagcguuuauugagcuuuuagucuggaccucacacuuugcacuauuuauuuaaaauccucccaguagccacagaggucagguugugugguccuuauuucaguggugauggcgcugaccuugauaaucucuucugagcacagcaagaucuccaccuaaucaguaagacuggaacuauguuugccuggcuccagagcacaugcccucuuuuuuaaaaccccacucgaucuucacgcccccaccgcuucuccuuuauaauuccuuuggcacaguuuugugccauguggagaaaaggucaagaccucaggucaucaggccaugucaucauauaggcaagcauuguaucccccugcucugcaccgccacaaccuccccccugccugccgagcaaaugucugggcaugcauacauagcugaaauucugagaaaucuguuccugcucaccgaugcccguuccuggguguucaccuugcucaaugcgcuuuggauagggcauagaaggcaggcucccagcccggacuuccagaccauccccugccagacugcaguggugagaggaugcugcagcccuccuccugcucauggcucaggaagaacggacgugcccagcaauuuauaaaggauuaucgcacgcaaaggcaauauuugcuucucucccucauuucucauucgcccacagcaguggcucucccccaauaucuccuuauagcagaguuguaagaaagugaccuuaacauugaaucaaauaccacacacuuuuuuacccugagaaaauuucugugguuuuggaaauuuguuucacauacuuuuuuaaaagagaggaaccuuuguucuuuuguucuuugaguaaaaugugccgguagugaauaucuuuuauuuuccuguaaggauuuucuuuucaagucagacaaaaccgcuccauguuucaugcauccaguuccucuguccucaucaccuuccauugagacaacucugggcucuugggaaaaagaacagggaauuauggguauucacccaucccugagcugcuggggacgaagcagcagaucagcuaguggcucuugcaggcacucagcuuccucuagacaaguuuggcagcagagaauucagguagaucuucuguccgugacugcuugagaauuuugugccuguaggacaaggugugcaguguggauaugcagcucuguccuuccaauaugucugccaucugccuggugcugcuccagagcuggagagagggcucuccuucuccuaucucccuuccauucggguauuucacaggcuggagagacagcucaguugacaaagugaguucugucuccagaacccauguaaaaaugcucaguuuaguugagcaagcucauaaucacagggcuggauugugcugaauucagguagaaccuuggagcuggcagccagccaguuaagccuauuuacuggguaggccagugacaaccccucaccugcagaagauagacugugguuuugaggaugacaacucaaguuguccucugaccuccacauagagguguguauacacacacacaaacacaaacacacacacacacacacacauacacacacacacauuaaaacagaacauuuucagcucuuucauuucuaaaaagugcaaaaacaaugucucagccuggguccauguuucuuucuugaguuagcaguagccaauacuguuuaguuuagccagcucuuccuuugaaauuuacaguaaggccacauuuaauauauuuccauuuagcaaguauuuguucucaauaacugccuuggcucuuuauuugauuuggggaaagggggccugguccucuauauuuucaguguggcuagaaguaaagacuccagggcuuugccccugauguaauuuuauuuuuaaauugaaaagugaauuuauuuaauguccuccaagaagcaaauucacaaagcuuggccgcccuaaaaugcgcugccaaaguuguaauugguaagaaguuagcaagaaagagggauuagcuuguugagccauggcguagcaaauugucaugguccugaguaguuuuguggcuuguuaagaaaaugauccugaguuuaguaugcauccccaugcaguaacauuagaaagccccaacaugaagagacucuuugcagggagaauuuguaaauggauauuuuuuaacuuuccuagaggagcauaugaggacuuauuccagauugucuaggaagaaagucucccuguuggccaggaagcugugcuaccuauggcuccagguacugagcagguaugggauauccuggccaaacuuuuccauucaucauuuucugggcuccuuuccaucccgugacacacuccugcacaggcaucaaugaagaagggacccugagagccugugguuguuauaggucagcauaaaacaucagagcucuccuauguaucaugagcugggcugcacaccugacagggcaccccaagagcacauuggaacagcaaagauguuuguucagaaaaagcugcgcugaugcaaccuaaugagaccccuggagcuaccccaguugcaggucauagacucacuaugacuuugggacugguucgaagaagguguuacaacucucauggugguuggcuggcuguuccuugugugagccacccaugcccaccuccaaccccgcccuucuuaucacucuccccauaucgcuuucuccuuugcuucuaccuugcuggaagaaguucuguuucaggaaaacuauguuaaguacccaagucugacacauggugccaggaagggaugccuggcaacuggaggcuucccaagcagggauucagaaaggguguagaaguugcucuaggaucugggcuucaaaagaagugugugugugugugugugugugugugugugugugugugugugauguuagugaucaaccccaggguucugugcaugcugggcaaaugcucuaccacuggacugcauacuagcuucauuggggugguuugauagaugcaaguagauaggacaguucccaugucugaaaggaauagaacauacaagcaaccagggauaaucaguuguuaccccagaacagaagagcaugaagggcuuagcaggaugagauccgggagaggacuggggaguuuuggggugaugucucaggagagcugagugaccagcucacaauguaugguuuccauauuaacugggaagugaccuuuccugcugaaaggagcugguggaccagucucauaucacagaggaucccaucuuugugacuuacuuuaaauuguacacauguauucucuacagacugauuugugaaaguccgaaagugccucaugaguaaaguccaauuuucuugaguggcauuuguuccagaaggcugugggagaaucuuucuguugugucuccaguauccauaggcugccugauuuguuguuguuuguuguuuuggcuguggcuucuuccaucuucaaggccagaaagauauggaaagccuuucucuuacugagucugacuccugcuuacauauuuucucucuggaaacacgugugugauccaggauaaaaugccccucacacuguuggcugauuggcaucccugauucuuccugcugcucugaucucacacagcaucgugaggaaugaggacagcuuuggcuaucuuucugcucaccaaggcaggcauagcucaucuuguuacucugaaaauaguuguugccugacacucaguaggugcucaaagcugccacuggaaagcuugugguagguaaaccagagguguuucgcuucccuuuauucuucuaccacugaaacucucccuggaugcacuagcugaggggagcuuugguacaaggucuaugguuggacugaucuacucgccuccuuuccaacaaaugaaaccucacccacucugacagagguuggucucuuuuacucauuccucugccccagaaagguugagaugucuuucucugugaaaaugaguuaacccccuauuagcuuaaucaacucuagacuuucucacaccuauuaaaccucaccagauugcaacuuggaccaaagugaaucaaggaagcguccaucgcuuugguaguuacaagacuuaccagggacacccuguccuucuacacauagggucugcggauccugucagaguuucugugccugcaauucauccauggcccucggggugacugccugggcuauugucccacuguucuucuuuauggaagaggccacaggcccaggcugguuuagcuuacuccuuggugagaugaaggccuuccagugagccugagacagggcaggguuccucagaguucugcaagucaucagaaccuggcccaaugaagcagaguugcccccagagcacugagccuucacccuggcagacagcucaucuuggaaagaacuguggccagaauccugcugcaaggauuucuuugaagguggugugagcccacaaggagguccuaggaggaggccauuguuuuccuccuggaucucccuguucuuucaucgccucccuccuucuuucccguuguucucgcucacacucacuucuuucuuugcuuccuuagcagacacuagcauucagucagucucuuuaccacagcuuccuccugagagcuagcucuguucuggcgacagcuaugacucccgagcgguagauaggauuuuagaaaagggaagcacgaagucucugauugagggguucugccuggggacaacaaauaggguaacugguaggcaugcccagcucucuuucagucuuuucuccuccagcauauaaaaacaagcaaaugcacagcuucuagagccuucuugccagaggucuuugucccaaggauuuaacacagggcauaugggcagcauauucuuggggacuugaugacaaucuagguauuucugggucuaaguugggacaugucaugcuuugucuaacucuaugaagaggccucaagggcagcugaaguaucucugccuguguuccuuuucuucacuuuccuuucugggcugggcugccaggucucugcucuucaguuacaugggauugaugaugucuuaucugccaaggcagugauuaagggucccacagaacugcuaaauggggcuagcccugcuuugcaguuuugaucugcuuguuuacaaggaagaucagagaaaauucuagaaggccccuuaugaaguagaggagcacugaaggcuguuugcuuucagagggucuaggugaggacggugugugggucuuucagggcugcaggcaacucuuguaguuuccugcaguuugacuucccugugggcuuggcuuucuaagcaccucaguggaaugucaguaugcuguacuuuuuacauccccugcaccaagcauuugucauccucuaaagaaucuuggaucccugcucccugcaccccacccucagcuacacaggagucaguccaaugguuggaccauuugccagcccauccucgcugcguguacguugaauugcucucaaguugcaucuggugcagauaacguuguagugagcgcauccgugcguacuuuuucuauauuuuggauuguuuccuaggauucguucccagaagugggauuacuagggcucaauacacacugucaaauuccuuuccaaaaggacuuuacccacuuucuguacgcaugccagaauccaguauuaucuuaagcaagaaaaaaguucauuuaaugugaugauaaaaguucucuuauuuugauuaaauuagcauuucuucaauuguuugcaggauaaaauaacucuuacucacuuuccuuguaacuccugcuuuggaccucuguauuuauuggauuuuaaucuuuuuuuuuuccuuuaaaaaaagauuuauuuuuauuuuguauauaugugagugcugcuuuaugucugugcacugcagguguccaaugccugcagaguuaagaagaggauuuugagcccccuggaacuaggguuaugaaugguugccagccaccacgugaauacugggaacugaaccuggguccucugcaagagcaccuaguacuccucaacacugaaccaucacuccagcuuugaaccuuguucuuaagcaauuuaccagcacuuuauaugaugcccaucuuaaccuuuccauuuccauggguauauuuuauuguuuggguguauauguauauauacauguguguauguauguguguguauauaugugugcaugugugggcauauauguguauaugugugugggcuuacguguguauaugugugcauauauguauauguauguauguauauguuuauguguacauguauguguguggguauguguauguauauguggguguggauguguguuucucuuugcaaucucacgauauggcugucugaaaaaugugucugauguuucauguauaauguuuuacacacaucuccguuuuuuucugcacgcugucaccauguugccauccucccuucucacauuuacuauccaguuugggguuuuccuauuuuauuuuauugucuuaaauuuuaauuuuuaguuuuucuggaauuuaguauuuggugcuagguguguuacauugacuuuuuuaaauccccaugcuacugcauuaccuuucaugaaguaaucccucaccauaguuucaagugauccucugaacucaauuuuugaaacaacauuagaggaaauuuggggguugcuucagugaugcaacuaaccuccuacuuccggguuaggaccgcauugcucuucugggcuuuuccuuaauaaguaaaccucauuuauuuuuuaaccaaagaaaauauaauuuugagaaaucuguggaaagcauuuaguuucaaauucugcuuggauuuauguucaagcaucaugugagcgcggcucaguuuagagugcuguauuccaugagcaaugugucuuguucucaggcucgucaaguauccacgcuugcuauggauaauucagaagauggacgacaagaaucacagcuucuggcuuccuguagaaccuuacuauuuucucucagguuuuccccucacagacucacaaguggggcuauugcuuccacugcagugugcccugucccuuagcagauagcagggucuggaagguggcggguucaggcauugaccucuucauacaagagucagcacucgacugaccaaccauccaccagacagugagaggcuugauaguguugcugggaacaagacagaagggcaucgggaagacuuuacaccauccuagcucugaacuggccugaguacauugaucugaucaaugagcugaucagaccaggaaccucgcaugagccuggacuggcuuccuuccuacuucugaauaaucuuucagaagcuaaagccugaguuucccuucugcuggcucauggggcugugcuguguucaaggauccuaugagacuggguugcugcaacaugcccugugcucucacagaagacuucuagccugcaucuuaugcccuccuccuguaaaggaggugaagagucuuggugugaccuucgaugcccaucugccaucauuacauuucugcuugaaaaauaucaggagcauaugauuuuaaaaucugucuucauuugugaucugagaagaauuuugguuugaguucagauuuggaauuugagucaugcacauuuuuucucugcuucuuguagauaauuauguuauuuggggauuuauguuucucuguugacuuuauauuaagggagauuucauacauguagaagguugaguggaauaagaccuccuucuagaaccuucuguuaaccuuggcaccucuugagauggacuaagcugcucggaguuguucucccauguuacuuucucgccacaguuuuggagaauauucagauguugcucucuccauucccaaauauuucauuuguauuucauaaucaaaggagucuucacaccaccacacugugcuguugcccccacaaaaaugucgguuuaugaauacucucucuacuuaggucuacucagaaucuaaauaggcuacaagcaucgcacaagggagcaauauauagugugugucucacaguuguccaggucuuauguuguguuuacuguauuuagggugucacgugcggcauguuucucacaguuuuauguuguuuauguuucucuuagucuucaggauauuacuuacaguauguuucucacgaccauuagaauuuaccucagaguuaagggucuuauaugugguaugcgucuuacagucccugggacgugcuguggacuaugugcauugcacauaauguguucuauaaugcacagaguaaaggggauuguauaaaauauacaugucuugggugcagaauuauagaauccuuucuagaugacaggcaaaucuuucuuugccaugucugcuuuguuagcuguauccugccggcauacacagucaggcccgugcuuuucaggcacacaagaugaucccucccaugagugagucaucaccuugacauuuagaaugauuucauauugcuuuugacuuuuaaugauucugucuucaucauuuuuguuaugacuaugagggucagauucgguaaacagguguuugcauacuuucaucucugccuccuuuguuucuccaacaggacaccguuguuauuaaauuugcucuuuauguauacaucauuacugaacuuuaauagaaguaaugcacauauucucaaucucauucuucuucuggucggaugacugaauguuagugaugcuggggacucgguaggggguagagguguguuuuacaugagugugugugcgcauguauccauguguacacauucagaggucagagcauuacaucugcuccaccuuaucauguuuaagauaagaugucccagugaacaggaagcucacugcugggauguguuggcugggcagugagcccucaggauccaccuguuggcauugcuucucuguuucccucugccaugugaaugagcucucuggagacgggucugcaaccacacucugguguuucucguuggccuuuucucuguccugguggcuguuggguauucuuguuauauuccauucagacuucuaguguuuucugucugaauuuucuaggcaaagucuuuguaaagucuauuagacuugaucuaauagcuguguguauuagucuugucgcgggguuuccagugugucuuuaugguagguucuuugcaguacauuggcuggauuggacaagucagguugccauucuacaguguuauuauccaguuaggcuguucacuagaaauaucugagcacauuuaaguuuucaguagcaugcaugccaacauacaauuuuauaaaugggcguggucuugcauggcuugcuguaugaccauuccaguguuuguuccugugcuaccauuguucagacuuggaagaaugcuuagugccucuguuauugcuucacaucacucuuucucuucuucuucugggacuccuguacuuccaugguagaccuugacagccuacuacuugccuuucuaagugccauaauauguacaugucugagggcaaccauugucuucgccuuccaccuuguuugaaacagucucuuguuuaucacuguguacacucggccagaugcccaucagcuuacaagaauucuccccucucucucauccugccuuggagcccuuggguugcagacauacguuacaaagguccuagggguucaaacucagguucucauacauacaugguuuguguuuuauguuuucucccuagccuuuccuuuucuuuacuguuauuaaacauucuuuuucugugucugaguuuaucuauuggauauauauuugaguuuugacuuucuuuuuccuguucugugauaugcuaggaaacucauucauugugguuguggaauucucauucgguuauuuucacacuauuaaucaaaugcuaaacuucccuguuuggucucucagucucuuaaauaggcuugguucuugguugcucuguucuguaggucuguuuuuaugagggcguguggcuuaucaucaugucuugauugccuguuugcuuggauuuuucagaaauagaugauugagauccuauuuaaaacaaacaaugaauucauuagaaagaugcuguugccuuccuuuguaucaaauuuacccuuuuuucuaguuuccugugauuuuuauguuguguauaucuauaugagauaaaacagcccuuucuguacuucucaaagaagaugacagguguuuuggguagaaaagguauuuuuuuuauauuuuuagagcuaguuguauguuuccaaaccacgguaagaaauaauguagauggauuccacaagcucuuugcuccguuccauccagagcuaacguaacuugaauuugguggggaccaagaaauagaguucuccuuuuguguucaggaccacaucccucuccuccuccccccccccuccuccucccccuccuccucuuccuccuccuccuccucuuccuccuuaccuugcugcauuucuaacaaccacugucucauccucagggcuguaauuuuuucauuauuacacuagaaaguagaugggauugcacaguuggucaccuuuucaagacuggugcuuuuuuuuuuucaccucucauacuucaucugaaaucugucuaaaguggauauaaaaacucaaucuccuuuugguguuuuugaguaauaauccauaauguggaauaaugauguuuaugacaacugaaggucauuuuuuauagauauagguguuaugaguauuugugaauaguuucugugagggaagaaaagcuuucauuucucuagcauaaauacccaggaucccaugucaagguagagaucugggacacucguacucagucaucugagcuaucuuuggggauucagacuauaccuggcacuucccuucccucacuguauucccuguagcaugccagacccccagggcuccugucucaggauaacauagauucacuagcugagggcucuuuaguucuguuuugauaaaaaucacggguaggcaagaagcuauggaaacacugguccugcacagccuucaccucucaguguuuggcagccaugaggagggccgugcgcagggagaucgguggaaacuagcaccagcuagcacagugguuccaaccuaucugauuccugcauaucagauauuuacguuauaauucaugacaguagcaaauuuacacuuaugaaguaguaaugaaguagcuuuaugguugggaucaguacaacauguauuagggucacacagcacuagggagguugagaaucgcugcucuagaguuucaguuucugcauagacuugggguaucuggacucucaggucugagacccuuggcucuuaugauuugacagaucucuagaacccuucuagugcuugccuucuuuggcucugucuuagucaggauuucauugcuaugaagggacaugaacacgcuaugaacaugaccaagguaacucugauaaaggaaaagaugucacuggggauggcuuaccgcuucagaaguucaguccauuaugaucaugcuggcaaucauggcagcauccaggcagacaugguguuggaagagcagagaaugccacaucaugaucugaaggcagccaggaugagacugucuucugcagguagccaagaggggacucccuugagcacuaggaaacuucaaagccugccuacacaguggcaucuuucuccaacaaggccaugccuguuccaacaaggccacaccuccuaauagugucauuucccuugggccaagcagacuccaaccauguaggcuaugauuucuccuacacccccuacuguuccacugaagguucucaaacccugcaacugcucuuucagguaagcauccuccaaggaagacuuagccaugaucacucaggauagacauucucgccacguagggcauggcuuccugggcaugaauccaugaagcauggcucuaggccuuucuuugcuccagguuggcaaggcuuagcucuggauaggugagggccgcuccuuagccucugccucgcugcuuccucugcugccaagcaguguuguaugcuccaugcacugaggagguagggcccagaguuuaggaaccuagaggcuaguaucagaaccuggacaccaaccacuguaauuguccccgggggaggaggggggggaaggcggaucauuuuaguuguucaagaguuguacagcuuucucaguagggagcuuagggucuaggaauuaucagcuaggcugcuuggagcucagcacaggggaucagaagcaguauugauugcagggaugcugacaccagacugggcuguguccuauuaguugaacuacucagcugacaaacugcugagguucagagugucuggaccagugagaucugguacgcauggcacccauacaaccaagccaccccuuuagacagacaccuuuagaguaucagugguacugguaggauuuagcugccaccugagaaggcacaugcagucaccugaggcagacaucuguucagcaguugagcagguaacagugugccuguuccucccugugaugggcuuucauugaaucugcuggaggaggcugcagccagguacaguugcccuugcccaggacagugcuugcccaggacaucugccagcuaauuccauugccaauguggcugaaggugcuugugccacuaucuucauccuguuuucagcucagugaggacuccuggaaggagacaaagaacgguaauucaagagaacucgucacugagccugauauugcaguaucagagugggcaguagaggaaagugucccucagucaacucugagugagcugagggucugcuuauauagaccaaacuagaguauuuggaccagucccuauuggaccaaucacagcuauuuauuuuggaccaaucacaguuauuaagguuuguguuguagaccagucacagccuugccacaagaauuacuaucuuuccaccaggagauguacuuccacucugaccaaaguggaaaugauccauccgggcugugauugauugcacaaagccugguacaaacuguucaaacaguccuggcuccagcuccucgugcaggagccaaggcagacggcugcagucuuuugcaucauuuucuugaggcaucauggaacauuuaagaagccugguguaggggcauugagaguggucuggcuggcuauguggcuggcagugcuguugcucaaggcaccuuagacauccaauggcucaagaauucaaggcugcuaauuagcgaguguugguuugcccuguccccacgucuuagcuuccuuacaggaaaaugguugucauaaaguauuuacaauuacaaacaaaacaaaacaaaaaaacaccaccaccacuaaaaaaaacuugucauuaauacgaguagugauuuuaaacauuuaaaccacucuuuugcaauguuuagcaccuguccggugcccaggcgagggaggucccccuuggucucucgaaagugugagauggagaagacauuaucugcccuaucuccucugaagcacauggucucagcguagaauugcuagacggaacucuuaggcacagguaaggccaccugccacaugaucacugggggacagucagaauuagggacuuaaauguuggcaguuggugcaugccagcuucacucuuccuuauuguugaccccuuucuucuugauggcugacggagaaugugacacccagccuucagccucaggguugucugaccugcuacuuaguuagaaauuccgaaauccuggaggcaagucugaacgucccauaggucagaagccuaugccuguagguaaagccuggucuacagucccgaggacuuguccugagcucuuguggcuuccuuuccugagcuguuguguccuccauaguagccauggaggcagggacagcucaagucuuccagagugcagcacugacccagacucccucuguguuugcuucuucuccucuugguguuagaugcuugguguuuggaguaagcuguacucuugagauggcaugguagguguguacugcucaggguaguaguaccuuuguuccuggauagacaaccuuucucaugacagaccagguugugaggaaaaguagcccauuaauaucacucagaccaggcucaguuugccagagaaaguacuggggagaugaaaagcuuucuccgacuauuacaaagaguguacccaaccuacagggcaggacagcaaggcaccaagcuaggcauccauuuagaaccaaaagcccugguuugagaaaaacaucacaggcuugggaaaucuguacauccaaagcaucuuuaggaggggaugaguauguagcucaguugguaaaaugcuugccuagcaugcucaaaguccuggauucaguccuuagcauauauauauaugcuuaaacuguguuaugagcauaaauaaaauagaauaaauaaauaaaaauuuuaaagguuaaaacuggugguccauccucaucaccaagagucuacccacacccacccaccccccaaaagagaagaaaacgcgcuuaguucuucuuucuaaugcacccugaacaaacuaaaagacagagccaccaaaguuuaccgugucuccagagcucaucugggggaccagagaauuuaugaggcucacucagagcaugagggaguggcugaacccuaggcagcaggacugaccacaacaucucaccucauagcacagaugauggcuuccccucagagguuggauggaguugcuccuugguuaacuuugucugguccauauacuuuaacaugucgcaaaacccagcgguuauauauaauuagggcagaauugugugcugguagcucagagggacggcuggaaucucacgugacccuuccauccuucucucggaacaccaggagugagcaaguaccacugagaauccccugaacaaaggcauagcugaucugaugaagaggccagcuguuuugcucagaagacaaauguagaggcaggggcaucagaagcucaaaguuaucuucagcucuguagugaguuagaggacagccuggacuacaugagauucuggcucaaaacaaagcagaacaaacaaaaaggaagggcaucgagagaguucucuguggcuugagcugugucacaggcggcuguugacagcacuucuuuuagaccacucgaaugugggacaguuuuuaaugaugucugcuucccaguauggccguuccacuggcugcuuugcuguucuagugcuguuccaauccucuguggaaugguugcugcggauucuguguguacuuagaaauacucucaggaguaggugggugcuguccacucaugaggcaaaguccaggaaagagcucagcauuuugccugggcccaagaugcuggagacuuaggcagugcacaggguccacugcccccugcugcugcugcugcuccaaagcucuccugucggcuucacuaggcacagcacuguggaacaaugaacagggucuuuuauauguuuuuaacaaggaaaugggacccuaguguuugucauggggccuuuggggcaccaugcccaggacagcaucaggcacagcccuaaagcaaugagaggcaggcugagaagaaaggaugguuggcagccaacaaaauacaggugugcagucguucucucuguccugcuuguucuugggaguguggcggugugcaucauuguaaacuuugcauuccucuugauugauuaaaggugcagcaagccuucuugucagcagcgcuauugaucacauuuauuuacaaagaaauaaagucauucaugcagcuugccuggagccacgggcuuuaaguuucccguuucucuaggcagagcugcuggugaugugaagugacacuugaccugcugagaguugauaucggcagacagauuucaugcccugucuccuggccacccguuugcugccuuugaguuguuaaggauauuaaaaacagagaugagaggcccccucuugacagguucaauuuguaauguguaagccuccaauaaccaagcugggaagcuaccagcccugcugcccccaaaccccagcaagacagagaggggucugugaguuccacaaauauuggagagggaugugggagcugggaacaggggacagaagccuugagugcauggcaugaagaagaugacagccagggacaccuaagugccaggccuuugaugauacaggauucucuuuuggaggcucuuaaaccuuucaugaagccugugacaaaugggagugacugacccuucacugcauaggagaccaguagauaagaagccagugccuaccuuuuccuagaggccacugaaguuggcuaugucccucccuaaacuguuuuggaccugugaaggaaaacagcuaucauuggacacuaaaaaugccaccccaguuuuccugcagcacuaccaucuucucuugcuaauacccaaccuggauggguuccuggucuuucucugggaacauaaugacauuggcuuguccuuuguguagacaugugcccuugacugaaacaugcuacucuaugccccucaccuugcuaugauauagcauguccucuucagucugcucucagagggaugauggguuguggggagugaaggaaaaagacucaugaugggaagggcucaggucuaggaaggaaaggacuagagcauagccugcaguuaccuguuagcucagaacugggauccaugccuucugccuagauauggggcuggaucuccguaguacacauagcuccuucuguucuuggggggaaaaaaaaccuguuagaugugcagcuaaaguguugacaacaugaagaagcuagagucagaauugugauaaauauuuacaucucuucccuuggaugcugaucguuauaguuuuaaauaaaucucggugauauaacaggaacuuuuuuuuaggggagcagguggugacuuucuuacagccaaauacaugcuuuggggacaguuucuuaauuucucugcgaucuucuuuucuuaaucugcuaaaggaguggccauguauauucugcaugauucucaugaccucgucccuuuuagaaacucgacuuuugccucaguuuacaucauccuacgauaguagaaacacauacacaccaaggacuugucaccauuaugcaccaaggcagacaaaagagcagcugcauguggugugugaggccaguuuuuucccccaccccccagaaugaagcugccccugcuuuuccugggaggccucaagccuaggccucugucuugcuuaccacugcccagugaguagauccaaacacuggucugauuugcaagagagaugauucucagucacaucuguuguucuguuguuaaaucaaugucaagaugcuuggccagauguucugucaagacuccaucuugaaugaugaggaagggacauagucugaguccggagccucugggaaaggcacugacuccuuugcccaauucagugcugaguuuuuauaugucuggcccagagaaaggcuaacucuguauaguucuagagcaaagccugagggucagcagcggacaugcaugccuugggugacaggcauggagaaagggagacgcucuuucuuucgcuggaugguggacgagccagaagagcugagacucuagagcaugaggaaggagaagagcuucuaugugcucugaugggcucaucaguggcuaguagugggaccgagugguuuucucuacaagaaaaacuagaccaaagauccuugaccauacccugugaccuugagucaggaauucaauuucgguuguggcuucuuugcagcauaguaggauacacugagcaguggggaccuggaaggacaccuguaauucagaacaagcaguaccagaagaucuagcugcugccugagagacaguggauggaugggucagcagaguaaggaccucuaguuccagaggugagaugugugguaggagaaguuaagguuaagcugagguuaaaaggagaggagaaaugguuuaggucuucgccagugacaauggagaaggaauauggcgucaggaguucucaucaggucuucagaauuaacuaacaacuguuaacuccucagccacccagagcuccucccagucacccucugucccuuugccuaugugacaguaauaaauuuuguuucucugcaagcuaugugugagcauuucagaacacugaaagcaaaaaccaaguccuccuggcauuaacuugagaagcccuugugguggaaauccauuuagugagagaggagaagaggggaggaagugagccauagaauccuucccacuguugugcaugaugcaggcaggcuggagccagagcaggcaagccuaccuucugcggccuacagcggugccuucuccucugcuuccuccuuggaauauuacucauuuccagguuuugcuuguauuaucuugagaggaaacaaacaggacuuaauuaaucccaccaaacauuauacuggaaaagcaauuauucccaccauguguaauaacccaucuguagggaaaauaauccauuaagcaugaaucaacgugaauuuaaaaacuauuaugaagaucaacucgguucuugguuaugagcacuguaauuugagaguuugcucaugcauaccuuguucuagcauauucugugaccuuggcaccuaaaaucccaaacaaugaacaccucuaugguaaugagugaccagauuugcagguuaaccauugaaauacuuugaaguugaaucccuuugggggugggggagggucaguuugaaucugauuaaugagauagagaguccccuguuuugaaaugcgacuguagcuacagcagagcucugcauuuguuugcauuuuccauaaaucauucauuaacugaaaugaaaucuuuuccuuaaauuaccucucaugguucgguuauuagcgagcuuucuuuucuuucuaaauuuacugggcuacccuucagaucuccuugagccaaccaagcuauugcuuugaccauugucaucgggaaaucauuuucccaggcauuccucucaucccaacugggcuguaaauccucucccaacuuagauugcuguccacuccugcggagcccggaggcugcugaugcucugucugggucuuguugagcugccuaugaaaauguguaaaaaacacucugugguuaguuuccaaagaaacaccuagcaaacucgucuggacuuacaaagcccagagccugcaguuaggggaccaucccuauugaacagcaguugaucacauuuugcuaaacccuccugcauuugggcuguggaaggccucuaauguagcaaaaaguucuauccuauaauguaacuccuaagauccuggggugguuggguagguguaugcugcuaguccauugacugugggaugguguugagagagagagagagagagagagaugaaauccugaccccuggagucuaacaacaugguagguugucaucaucugucuccugcauccccucccccuuccccaagugguuaaaugagguccuacugcugcugugcaaggccaggccacgugauaugaggacugggcauguccucucucuuugaucuaucacagcuaccugcucuccugaccuuucaggcuuuucagaucugaaagcuguuugaaagaggucgaagucauagcacucccaggaagugggguugacaucugugccacuugaucuucaugaaagccaccaaagccuacaaagggaaggacuaggacuuugaggcucugucucaugugagugggagacuggagucuaucuacuucugagcuggcaucagaccccgcuuucugugcuucuugugugcaagucccaagugcagccuguaccgccgugcugacgauuugccugcuccgcagccgcuucccaugcugcuucuguucuucgggaauucagaaaaaggaaaccuugcuuguauuguucgagcugcuagcccucuagccguguguauccacccuagcagaaggaucccaaauguucacccgauggaacaaaugagggcaaagcuaacuuucaugaacauggguuaggagugguuuuguguauggaggaaugcaggcugucugcaaaccggcuucacuuugcugucuguaucaguguagaggaagaacuugucaagacugcauggucauccgugaauauguugcugugguuuuagauaagugucucccaaauggucauauauaaagacuuggucuccagagugguggugacgggugcuauagacauuuaggaacuuuuaggacauggugccuuauaggaaggagugccuugggucaguagagguacccccagaagggaucgggcuugcucucccuguucucgcucccucccucccauccuucuucccucccucucuuguuugaggcaugagggucccaacacauguucccauggugauacccuguucuugucagaugcccaaaccaagggaagaaucggaucuuagaacagagucuccaucaguuugagcuacaagaaaccacggugcuugcuaagaugccugcgucagcuuuuuuggugacacgagaucguuacacaugcgcaucgugguuuuaauauuugugagaaaauaaaagaacgccugugugucaagaacaaguaccuauaaugagcuaccacuuaaagacacaaagaaagaaaaaggccaggcuuuugcacaagcaugggagccagcuuguggccuuuaguccugucuuugcugauagucucacgggcuuuuccugugccagaguuccuguaggcuccucguugcaagccucugucucuucccugggucucuacaguacuguuuccagcugguucacccuccuuucuggccuagcucauuuccauggacuguuuggacuaccccuguggaauuugaauuauagguggcuacagggaucuagccgucauuuggcaaaccugagaugucuuacauuugaaucggaaggugucugccucucuacaucauguccagggacaaaaccaagagcugcuuauaagggcucuaagagggggagcugcugguaaggacuggggcuagcuuauacuucucuguuacaucugucuacuugccuccaggugaaugcugggccugcuauccguacuuaaaggcaauuugaggacagaaaagauacuuuccuccaaaggaauccaucauucucuggugaucugcagacugaggcggaguucggggauuggggauuggaaaccaaacacggaaggagcauuugagacagcuuaguuuucugaaugcauuacuucaggugacagcuucaugauuagugguuuugguuuagggugcgcuauucccuccacugauacagcuuuuucuaaccgagucugaguauguguguaugcaugggcuuguguaugugcacaggcaugugcaugagagugaguucuuaaaacugcuagaaaagaaccauugccaagcgagccgcuucagaacaauuugcaguauggaugucucugcaauaaauaggcaggcauggaacuuucagagaagcugcacuggacuuugaguuugucacgccuuagaacaccuuugugguauuaaaauucucaccaaaauauagaaugacuaaaucguguguguuaaaaacaaacacauucacuauuaaacauuugcuuaaaagauggagaagccuuuacuccaucuacugccguagggguugagauguuugcaauagggugagaucgggcucuccucugaacaguggagauuugugaccaaggagcaggcuagguugcagaggggggugaaggaugacaaauuacuaaugagaugucaagggucagguaauucauguaaacgaaaaucacggauucuuauggaaaagggcacggacagagauggucaagaugaggauaggaagacugaacaaacacaaggaaaggagaauucgcucucuuugaggucgacagucaggaaccagguggagaccugacaaagagaaagucuccagaggagcucagcuguacugaagucaaggagacauuccuugucagacucuugacuuaaccuuguuacuuacaguuaauaaauaucgccuggguucagcaccgcaccgacucaaguguauuuguaaauguacaguggaaugugagagagaaaauacauacggcuuuaauguuuuaagucauaugaggaugugugccuguggcuaugugcagagcacaguaguguuuggcccacugaaagaauccacucuggcccucuggggaaaguugggcaagcagcuccacugguuuguuccuaggaggguucucagcuacuaggaugagagcacaguagcgaugccucccauuucucuuuuguuugucuugcugcugcggauuaaacucaagacuucuuauaugcuuggccagucugauguuaugaagcuacguucugugaccuauggucaaccaugggcccaaagguaguaaguggaaaauuucagaaacaaacaauuuauaguuucaaauaacuguugcuguaaccaguuguuaccguuguucuauuuuaugagaaguuauuguugagcucgaguugugccuaauguaaaaauuaaacuuuaucgugugaguacauggagaaaaacacaguaucaaguucaggccucacaguguucuuggcauccacugaggguuucaagcuccuugccccaggauaaaggacagaacuccuuugaaagcagaaaggcccuuaguaguggggauggucuguaugaagcugacauggcuuccauuucugucacucacaacaaggucucauccuagacugcaguagagagcaggugcagagacugagacagugagaaaaaugucugccagcagugacagauaugcucuucuaggaggcguucccaaggccaccaguuauucagcucacugucacuacagaugaguuuaguggccaauaauuucucccuguaugacaugcaaaauucugcuauauuuuuauaucuucacuaguuauaccaaaucaaaaaaugucagccccugccccagaguuucuuauaugcacaugugacuuucaauuaaauuguaaagccuuuuguaagaguuuuuguuguuguuguuuuguguguugguuuauacucugugacuaaggugggaaguuagcugagcuaacaggagcuguuucuaugcccaccacacaccuuaagcauuuacuuacuacauacgcaccucuuaugccuuucgucuucguuggguuuugauaaucgcaggccuguuugaacuugcuucuaccuacuaacuuuuaaaguguggagucagucaauuucaugaguauugcugaguuucuauuuacaacgcaauguaagaaaacuaauucuccuucuuuuucauccucuucacccauuguucccaguuguaucccagcaucaacccaguaucaugaagaacagcugaaaguaggcuuugggugaaaucuuuugaacuugguuggcauuugugcucuggugaacggguacaauagaaccugggcaucccaaggcuaugaggugggcuggggucagcguguuacuaaugcagcacuggguuuggguuaaaucagggacucauuuuccucuaagucauuuuagaagaucccugcugcacaugacugccagcaaaccuugcugggccucaggggacaaugggaaggcauucugggaacagugugacagaugagcuguaucuucagguagauaaagcaaagagcaaacagagaucaugaccaagcugucagcagcauccucaagagcagaagugugcuugacugacugacugucuguaagcagaaaaccgugcaaagagauugcaagugugaucagcuuugacacuccuguaccuacgcugaaacuuauugguuuguuucuuccuuaaggaguuuggcuuuguuguccuggguggaccaagugguuuggaccuaggauugugacacucaccauggaaacaggguaguuaaaggcugauauuuuaaguaguuaguacaugcgcgcgcgcgcacacacacacacacacacacacacacacacacacacacgguguguuauuauuuucacacaggguccccuauaucccaggcuagccucaaaccccaugcauagcaguggaugccuucuaaucuucuggcuucuaccucuugaguucugggauuguaggccugcacuaucacacccagucuguaguauuagggaucaaaccuagugauucauacgugcuaagcaagcauucuaccaacuacaucuccagcuccagauauuugauucugaauugguagauggacaugacaggcuuagguaauaugguuuaagugugaagcguucucauaagcuuguguuugacauuuggacccugccuagcaggcagugcuaucuuggaagguuguggaaccuuuagaagguaaaacuaguuacaggaaacaagucgcuagaagauuggcuacagguugguaguccuuugcccaggucccccgauuccuucccauuacuguguuacaagaagaugcauauucugugaugccuuucccaccaggauggauuugagucuuuuucaacugagucucaaaauaaguccuuucuccuuuaaguugcuucucuuagguguuuguuggaagaacagucauaguacguaaucagaaguacuacuccuguguucacacaggccaggaaucagaucagugucuugcucagccaguaucagagaagcuucuuccuacaggaaggagaucagaaaugauucagagacccacaacuggacaauguucagagagugagagacuuuggaacacucggucccgagugggagggcuccaucaaauuccuccccucagggcucagggaacccuguggaaaaggaggcagagagucuaagagccagagggaggggaggaugccaaguaagcaaagccuucucuauacagcagcgcagacgcauauaugaacccacagcgacuguggcagcacacgcaggggcaagccagauagggucccuaugcaaagaggagacguggacacaagaucccaucccuagcccagagcuaucacuggcuaauuacuacuugcaggucaaaaauuaauuuucuccaauggagucucgcuggguauauauauaaaccacacuugaggaggcccuauuucuaacaguagauggccaacacaaaaccaaacucaauagcucaaucguauuuuuagagacauuuugucacugaaugcuuuggggguggggguggagggcagggaaggcgcaugcaugugcacauauguacgugauuuuuguggguuuuuuuuuuuuuaauuuguuuucucuuuuucucuguuugcuuuguuuucuucugguuuguuuguuuguuauuugccuguuuguucucuaaauugagagagaaaaguguggagucggaugggugggaagugggaggaucuggaaagaucuagcagggaaaacaugaucaaaaauaugcuguaugaaagauauauuuucaaugaaaaaaauaccacuucuuaggcacacacauccuggcgcacugauguuguccaaaugggcuuuugguguuuuguacugugugaccccagacugaauguccaacuuacugccaguucaaaacugccugugaaagggcgagagagagugcuuagcuguuaacacugccugcugcuugcacagaagacccaaauucagggauuguauggccucugcaggagcuuccacucauuugcauguguacacacacacacacucacacacacauauacacacacacacacacccauacacaguauucaaagaaucuuuuuuuuuuaaagaccuauuugucaaagugugacuuuucuguuuuccucugaggggcuguugguggcaccuaggagagccacuucccagaaguaucuuucuucucacaaugaugauaacuuuguuuugucacacagaaguuuguccccaggccaacauucaaucagcuuccccugacuuuaguguggucuuaggaacuuaucagggaaauauguuuuguuuguacugauuguauuaugggaaaccuggauaugugcuuggggggcuuuuagcuuuaugcuacaugauagauauucagcuguuaugaaacuaaacccccgaugaagugacagggaugugaaaauggaaaucugaaagucugguuuucuuaagagaaaaaucucucucuggaugagaauuaagaaaaauauuuacauguauuaugugcaaaguguugccguuagauuagccauaauugaaaacaggagcaccgagacuagcuggggaauuguuuuaggauuaaaagaagauucauuuauaaggcgauguuuuccuuuugguaaugcuaauuugauaucuucaguauauuacuuugaaagugggcacagagaaccuacccguuucucuggagcugugcuaaucagauuggcaagagucugucuuuuccaagccguucaccaauucgcuugaauauauaaauugucugcauuggcuacuuugccgugcugugaaggacagaugagaauccuuuugcucucagauuuggccaguugugucucugcuuuggcacagccuuguaacaggagacgcucugcucucuuguuuugcucuuauccucaaagcauguacuuuguccauaguuccagccucucgucccugucagccugagauuguguuuucagucuguucccuaaaccuggacaccagaccccuaaaggaaaugauggugcuccauccacccgccuguccaacagugcccccacugagaaggaaacauuacggucagcaggcucuauggacaucuuucugaaaugcaaggagguagcuuaucagugacuucccuguccugacacagaagcagauggccagcauuugugcuacccucauggagcauccuacccuccagggucugguccugccucagugguccuacagugaggaguaacaaaagcucacgcuguauuucuuggucccuucuacugacuuugugcguucuggacauacaaagagguauuugccuuucucugucaguaagacaaccuuguaaucucucccucuccuguagucuccugaguaugaagguuccaggucagggcuucaugcuuugugugcugggcaauuagccacugccuccuccuucucuuuccucaccguggguggcaguaaccugggauguugggcucacucucaauuuagaauugccuccuucuacccccaggugcacagccaugauugagucucucuggccauuuccaaugacuuucauaucaguaaaaaaugauuuuaaucaaagagaugagucagaacauuaaaaaaaaaaaucuucuucuacccagguaaauccccuaagguuauggaaauaccacaucuugcauguuuuuuauuaagacccuagugacaauuguaauuaaacuugggguuuucuguggaugggagccaguugccuguugaaucccacagcaucccauuuccccuuccuaauacgaggagggugugaagccgcuugcccagccuaaguagguuacucuggagaagcagcgaguguaaaauucucccucuguagacauguaccaaaccagcuagaauagccaggcacagaguaaauagccgagcuuugcugcugccugauuauggauuuauugauaggaaacaacuuuuugacuguuuacaucaugaaaauuugauaacccauuuguauuacuuaaaccgcauauuucgugagcguugucaaagcgagggaguaauuuguaacagaggcagcggauguagaaacggaccucguggaagcgcucucuaaauugcuuugcuugcagcuaugugggucugccaugaagaauaauuucucguauuggauuuccaaagccacaggaguggccacagagcaggcgagggacagcccagugauuuaagaccauuuaaugccccaguugucaugaaauacuaggaaauaaacuccaguggccugcuagaacacauugcuacaaucucuuaaugccccaaacuaggaggcugauuuaucuuuuguuaugucuuauuagauggcauugaggaaaagaggguuggcaaaguuaaaacauccaaacccacaacagggaaauggguccuaaaugcaccugauaccggcagcuuugaccuucacccuggcuuggaccauguccuauaucaauaauuuucauccuuggaacacaaauauuuuugaaugugguagucaauaagaaagggcuguggggcucacuaccucaugcugcucagaucucaucaugugcucugguccccagggauccuaucagaauucagguuccaguccaguggaucacaaggaaccugagacuaucuguuuuuaugucuccaguguagcugcgccagggcuguuugaagagggagguugugagaccuguaaacuugccuagucauccuuccuagauacuccuaucuauuuacaguagaugcugagccagcauugggguuugaacccagacagguggccccucuguccagaaaacuaaguugugccuccugcucuauggggagaaagaggguccagcuuaggaguuuaggguacauguuaaucaugcuaugaauugguaucaugaugauuugggguuaaaaacuggccccuauaggcucauauguuaggaaguggcacuauuugagaaggauuggaagaagggaggggcuugaaguuucaaaagcccauaccagacccagugucugucucugagccuguggauuuccucugagcucucaguuacugcuguagcccuacgaauaccucccugcuccccaccaugaugauaauggacuaaguuugaaacuguaggcaagccuccauuuaaaagcuuucuuucauaagaguugccuguccaugacgucucuucacagcaguagaacaguggcuaagauagugcucuuuaagccacacccuuugaauugacacagacccuuuacagcccccaacccccauucuucagccucugcaugucacccugucuuauugcaacuuugcucagugccccugguauguagaguggcggaggcucccccaguuugcccugaaagaagagaccugcucucucuucuuuagugaggagaggagugaagaugcccaguaaaaauggccuuacuggcccacaugcugcugcugacagcauaggugccauuuacaacgcucuuugccacaggcaggcuaacuaauuccuuuuuaauaauuugucguaauaaaauaugcaaaacaaguuugccaucuuaauaaugccaagcauauaguuuagugguguugaauuguugaacaaccucguguguguguguauggggggguggugugcaugugcuagaaccuuuuuaacucacacuuuaccccuugagcgcuagacccugucccuuccacacccuccuuccuuccuccuucuuuggcccuucuauaccacagggauguggaaucauacuguucccagcuuguuugacuugcuacaaugacaucaagguccauccauguuguacccugugucaucccuucccgcuuuugaaggcuaacuaauauuucaccgugugaguuaucacguugugguuccccaugcaucuaccacauagcccuaggguugccccuaucuuuuggguuuuugugaacagcccugcucugaguauggcuguauggaacucuuagauguugcuucugguucuuucugacauauaauaaaacuggaaauggagauucucgaucauacagcaguucuacuuuugaauuuuugaaaacccauacuuguguuuuccacagcagcugcaguuucacagccccgggcagcacaaggcucccaacuucucuguguccuccucaguguuccuauuuccaauguuuucuacaguagcuacuucaaugguugggaggugucauuuauucucacuaaaauaccugcuguccugagggcugaagagguagcuaaaggguugauaagaguugcuauucugucaugaguaccagaguccagaucccagcacccaaguccucacucccuagauccccucuccccuuucccaugugacaguauggauacucagcccugaccccuggagugugucacuuaggcaguguagccacauuccguucccugcugcacaagcagggcaguaugcucaguagcugugcagcccaaggcaagcccugguucuaacuggcagaguggaaagugugcauaugaaauggcuaccauggguccacuugcuaccaccuagcacugggcuuugggacaugguauguaagaaugacaugaaaaucacugauauuuccaauucuguaucugucauuacuaaagauuuuguucggugaaagaaauaguugcuccuuggaucaguaagcuugugucuuguuuucuguuauuuuugucacuuugcuuaccacgcccuucucaaucuuuagaagagaagagccuuugguggggaaaguggcagugcuggugcaccugugugcaugggaaacggcagugcucgugcacccaugcacaugggggggggggcagugcuggugcaccugugugcaugggugggggggggacagugcucgugcaccaaugugcauggggaggggcagugcucguucaccugugugcaugggaaauggcagugcucgugcacccaugugcauaggggguggggggcagugcuggugcaccugugugcaugggggggggcagugcucgugcaccagugugcauggggaggggcagugcucguucaccugugugcaugggaaacggcagugcucgugcaccugugugcacgcuucguaaaggugagagguuguucaugguuaucauuccuaagaugccuuuaccuugcuucugagaugcucucucaccguccugaaacgugcuguuugagcuaggcuggcuggccagcuagccucagggaugucccuggcucuacuucccccaugcuaggauuacaaguauccaccaugccaugcuuuuccacauauguucuggggauuaaacccaguuccucacacauauauuucgagcauauuaccaacuagcuaucuuccuagccuggaagggaggaguugagagaagggccccaaucuaucagcacacaccaugaucuacccuugccauauuccguugccccuagaagauacuuccaaggguccuuuuccaugcuuuccuuucugguucucuuaggagaaaagcuuaggguugucugccuaagucccugcaggacuuaaugcagcacuacagucaccccagugcccuuggcucucacaugcugaccgcauccauauuuguguuuaauacuggacugugugugagguuuuucaacuggccuuuuucagucuauccauugacuaguucuccucugugguuuuauguggaguagauuuuuaugcagugguuuggggagcucuguacccuucaaagaaagggacuucuccugucuacaaauauugaaaugaaauauuucucuuaacucagaaggccaguguguaccuguuuucacacuugagcugauaaguuugcucaugacaugacauucccccagagaaccaagcuacccuagugcuaucuauuuuuagugaauccuaaaaacaagaaagggcagccaugugaaugcuuucuuuuggaguaggaguauuuagaguugggcaggauuguguggaugacggugauucuuucuccaccauaaguuaaaggggaaaauggauaacaggggagccauaguuccugagcuggguccugggugagcugcagacaagcuaugcuugcugauaucugagagagaugagaccuguggcuuggaggaggucuguaguggcucagcacccuugugcacauacucgcccggguucugaccuguuccuugugcuugcgaccugagcacugcaaggggcauggaguguaugguguucuuaccuguucccagguguaacuggcugauguuacaagguagggagucugagguuugcuuggcauacaguucugaaggcugggaaauuaaagaucagcccacugcaccugguaagguucuugccggcagggacucugcagucagaagguggcacagagccacacccaugauauccuacuucaggacucuggcucuuuuuuuaaaugccauaguguccuagaguuugguguccacuuccaauauccuuccgggugcuguuagauuucaacaguguguuuuauuugguaagggcauucagacuuggugccaugcauaagucugcagaucaaguuuuucucuguuggaaaagucacacuuguaguaugacaaaauuuccaugaugucgagucaggacuuguuucccuugccagggacauccauuuaaaggagaccaguauucacagucauuguauucaccuguuugcccaaagguggcuguggaaaaggaacuugucuguuggcauccagaugcacucugcccuagagcccucauaggacuagcaaggggcuaggugucuggugaccagagcucaccagcauugugaacaaacacaaaaacaugucuccaguccuuauguggugucuuuacuugggagauaaaguucuuggcucugcuuucaagguaccaaguguucacagcaacugauugacauaagggguggugauguaguuauaacacuuagcaguguacaugagguccacacacaauguuuugauacccacuuaaacaaagugguuacugcaggaaaaaauaagaauagauacccagcugacucaauugcauaucuuauuguaugugauaaacacuucuaaauuuucuaacagaaacccagugcacaacccauaccauuagcuccugcccucaaacugugucggaucuuuaacuuacuacuacacggcuccaccucugcaccacuaacucaagcuucucccccagcccccagcccugaaccucuggcaggaaggaggcuguuggccuucucauccaguggugaagcucugggacgccgcugugagcguuggcucuacaaggccaagaccaugugcagaggguuagaaaggggcacugcauugucucacuucuucucguuccucuugagcagagccuuaaaaacaacagcuuuacuuguuuuguuuuguuuuguuuuguuuuuucuuccauuguucuguuuaaaggcauaccgcuugggauuuuauauuuguggcaucuuuuuguggacagcccgggugauuucagaaagcuauuugguuauacucagaacaaaagugggcuuaauaugagaccugacugugaaccuacauaucaucccgaagagaugggggaauccgcagauaggggucugagagcaccagcaagccucucacagcucacaagcuggccccacaaguccaagaacacuuguauccugcaugugggcagacuuguuaauaaauaauugcccuucacagaugugcuuacuagucuuaugucaacuugacacauaaaccagagguuucugaaagaagauaacaucaauugagaagaugcuuccauaagcuccagcuguagggcauuuucuuagugauugaugggagagggcccagcccauuguggguggagccaucccugggcuggugguuguggauucuauaaguaggcugaauaagccaugcaggcaagccaguaagcagcaucccuccauggccucugcaucagcuccuaccuccagguuccugcccugcuugacuucuuguccugacuuccuuugaugguaaucagugauaaggaaguguaagucagauaagcccuuuccuccccaacuugcuuuuuggucaugaugcuucgucacagccauagaaacccuaauuucuccaagaccaagaaaaauaucaacuuggagcauagacuccuuccaaacaaugaacuguuucaccccaaaccucaacccugggcuuguagaaguuagaaugagcugacucuucuguguacauucuuguaucauuuucuuggauuauuucccaaaacuugacagaccuuaguaaaguuauuuugagacuuugcugacaguuuuuuuuuucuaggcucacaccauguauuuuaggcauuucaguauuagucccaugaccucauuaaaugcguauuuuuguuuaagccugugggcauggguggaauggcagguuuugucauauucagaaagcccaaguuaaaaacaacccacucuugguggucauuuccaugcaccagaguuuggaucaagagacaaggacaugcuccaagacaaccuuuucauaaaacauugagacaacgauuuugcuaaguguuaguaccguguagaauuugcuuguuacaagcauacagcuuuuuauaauuuucauguguuuaccacauaugaaccucauaccucccgccuggaauguaggugucuuaagccucaugcagcgucugcuccuaaucgcagagcucacugugacucaggagaauagacugcauuugagccagaugcucaggauuccaacucacggcaacucacuaguccuauagaacagcugguucaccgaugccaaucggcagcagcuucuugcacauccauuuagccucuguguuaaaaccagcucaguuggguuagcacauuauaucuuucugcuuauaaauacucuggugugcucugggcgugccacucacaggcugcuagagauagccgcccuuuccuguacauuacugagaacaccuaaguucuuagcaaaacccacccccuccagauguuuaaucaauagcuaccaucuugcaucuagacagagucagcugauacuaguagaaucugcacccagaggcucugacuccucuauguccaaggauagggaagucccagcuaagaaucauaaauucuugccugaagggaaguggaaucuuuaaugcugagggcagccuuucuuagggcuaucccaugcucauuagccacuccccgucucuuccguucaaaguagacaagugcauaaggaugcagugaacaccgacuugcugguucuacagcauccauauugauaugacaauagcagcacugacauccauagcaccaugacaaauguuaagcuagucagauggcucagugcaagcaagagcacgugaguaggaaucuggguaauggugggugugggagugugccugcaauccccgugcaucuauggugggacuggugaaagcugagacuggaaaauccccaggagaccguaucucagauaggauaggagaagacugacacccacaguuguucucugaccuccacacaugcacagugcggcaugccacacucucggguguuacccagcaugugcacacauggaagaugauuaaggagcugccucaucucauuagccucaccuucauucugucuuccccagcucaaauggguguggaaugccuccuaagggucaggaugcaggcuaaguagcagcuaagcaaacacccacagaaguggauguggagccucucccaucgcugagagucauugggggauacccuggacauuauucaaacaagcaagcaagugaccguguaauagcaaaugugaccuggguccucugaaguagaaacacaugguucuuugggagcaugggagaaggagauagauaugggaaggcuaggagcugagaaguugucagaccacauguacaagaaucaggugacaccuagaagaagcagcccaggcaauugccagugcauggaaaaaauggaagaguuagugggaggcacucauccuuccaguucauauguccagccccuauggcaaccucugaggaagaguuuugucugucuaacaagaaugaugcgcccuuggcuguugugauuucaucucauuuuacaaggcauuuucccuauucauggacaugagugucaggcccugguugcaaugcuaacaagacugaccaaaccugugucuucauggagcuugccuccuacacggauggagguucagagagaugguuucucggacauacagauugcucauauaacaucuaggacuauugucaugcaaauaagugaagcaucucaggugugaagcagguaucucacauuggggccugugacuacuucugcagaggacuagguauggggucuucccuggaccaggggacugacauuaugaagccagucucaguaggaccgcucagaggcuugcuuuggcacucugaccggcaggcagcuaccuaccugccuucucuaucacagaaagcuaaaaccuucgucaauaacagcacugggaaagaaaagaggcgagcuacuuagaucgccaaaggcaggagguagugcacugaucgcaucaguuagaaaauugucuccauuccccgguuugcuuuuccuuuaaauaggacauucagucauagcuucacuauaaaauugauuuauuguguggaaauaauuuccguagcaggggaacuaauuugauuguguagcauaaagaaaauguaugugggacaauggggaagaauagagccaaaaugaauccaauauauuuuaaucuccacaauacagauuauauuuucaauuaagaagcuuaacgugccuguguucagcgggaagggcccuucccggagcacauucccacguguuuguggguaauaagucacuuagcauuaagaagguacauggugauuagcccugaucaccuaguuaccucccucuaauagcagagucgacgacguucacagucacuguggcuuuauuugugugguaaaaggcacaguaaugagaaagaugggccuauuauacugguaauaugauguucaucagaacaaggaaguccuccgggcugaaaugauaguacagugguuaaggacacuugcugcucuuacagaagacgcaaugugguucccagcauccacacuggacagcucuggggggaucacugccucuucuggcgucuauggacaccugcacucauguaugcauauucacucacccaccucgcacaaauacacacaaauuuuaaaaauaauagauaaaagcaaggcuuuugaagacugaacaagaaacugcugccugcuuccccaccaucaugguccggucuugguuuuuggacuuugucucuggagcagagcugggcagaaggcugggucccagcaguucugcuuugcugauugugucuaccagggccuuggcagcagaugggcuggucuuugcucugugcccgcucuuggcugaccuuggaguugcccacucauggcucuacgagcucagaugcuagccacucccccuuguucuggaucaaguuugaucguaagccaacccaucagaugacaccauaugagucacauuuugcaaucagugggauuugucaccugggcuugucauguaacaagagugaacaagacagaggcacguuuccacacguuugucugcacugucacaucagcccucaggaguuuuugauacuaggccacgcucacagagccccacucacccugcguuggucaauuucucauccuaaggaggauggguguuuauucugacuuaugguuugagguuugaguguauguaugcucugucagggaaagaaaagaacugucaacuuugagagagagagagagagagagagagagagagagagagagagagagagagagagagagagauuuguccuaggaugaaaugugagcagccauguucuagggacgcagauuuagguuaccccagauuccauguucuaauauguuaauaguuugaugaccuuuuauagcaacaagaaaauuuaauuuaaaaaaaaucuagaugauuuuucagguauauuggcagaaacaucaugaauaucuuuucccaaaagaggcagagaagucugagcuaaaggcuuauuaacaccugaggccuucuuagccucuuggaugguggacucuggugaucuguauguuuccacggguuugcuacaauagucacagagauguucuaucacauugccaaggagaucaagcaaauauacuuuggcccuggacuugcagcaccccaacuucuccaauagccacuggaguuuuaaucacuuacccugaagccuagauggaagguccaguuuuuuucuaggaguuuuuucaaagcaaggaaccugugguggugggagcauagggcuccuugcuuacaccuugacagaccaggaagcagagcauuggcaaugcugguacucggcuggcuuucucccuuuucccuuuucuucaagccaacauaccacagcgucagaauucagagcaggucucauuuccucgguuacuccucccugaggaaggggcacacacacacccggaggugcaucucaucaaagacccagauauuuccugucaaucauguugacacuaaauaguaaccaucccguucaccccgcucccugucuuguuuccuucuagaagcuauguaaggugcagggcuuugagggugcuggcuuuccguaugaccuccuccuaucuucaguagaugucagguugacacuugaguuggguagagaaacagaggaagauaguagggaauggagagagggucagaaggagacgaagaacgugcagggaaagcagacgcagauguggcaugguuuaaagguuaaugugagccuuugcagagccaggcugggaagcacagucuagccaguacccaggagcuggugccagggaagagcuguuguguaaauggaacaggcgccuggggcucccucaugcacagccacauggcuagcaacaugucagguuugauagcaucaaaucaaacagugucgacuggaauagugaaccagacgggaaugaggucagagcuggguaagggaaguggggguaauccagagaggaagagacuaugggaacaaggacaaugggaagggaacaguccggaguuuaaaaccuagccaagacaucauucauuuggguguuuauuuguucuagaaauaucuacuaaguacuuaaaacaggucagcccaggcccggucuacagaacgagcaucugggacucugcuucugcagguaccgucuuuuguagauugccccuucccuucuaguaucuuuaaaauguguacaaccccaucuuucagauguagcccugaacuccccucagccuuugcccagcaccugcauuuccucuucagagaagacuuuccagagccuucccucuuuacaagaccccuaaccaccccauuccacaauuaacaucuguucuacugauaucaggaaugcucagucaauaagcccugucaucauguuaccaguccuggauucugcucuuauuucccacccucuccccucaccacaugaccccacguuacucuaguucucuugucuaugcuauaucucuucucccugccucucccugcacaugccccucucccaucucucucucugugucucccuuccuuccaccuguucucucugugugucuuucucugucucuggguguggagaucuuucucugucucugucucugucucugucugucugucucucucucucucucucucucucucucucucucuuguucucuuccacagaaggcuuccccgcucuauccagaagaaauacuagugucuucacaggcucuauguucuacccuuuucccgccucuucuagauaccucucuucuguuuccuccauccauuagcaaggauucauuuacaggcagauuaggucaauuuccagguucuaaugucccucccacucauuuuuguuuguuuguuugaaaguaucuuuuuuguguauuuguauuuguuuuuuauuagauauuuucuuuauuuacauuucaaaucucaugcccuuuccuaguuuccccucugaaaaugccguauccccuccccccauuccccuguucaccaacccacucacucccauucccaguccugguccuggcauuccccuauacuggggcauagaaccuucacaagaccaagggccucuccucccauugauguccaacuaggucauacauaugcagcuagucccaccauguguuuucuuugguuggugguuuaguccuggggagcaaaccccuucagcuccuuggguacuuucucuagcuccuccauuggugacccugugcuccguccaauggauggcugugagcauccacuucuauauuugucaggcacuggcagagccucucaggagacagcuuuaucugucuucugucagcaagauuuuguuggcauccacaauaaugucugguuuuggugguuauuuaugggauggauccccaaguggggcagucucuggauggucuuuccuucagucugugcuucauacuuugucucuauaacuacuuccauguguauuuuauucccccuucuaaaggauugaaguauccauacuuuggucuuccuucuuuuugaguuucaugcauuuugcgaauuguaucuuggguauuccaagcuucugggcuaauauccacuuaucagugaguacauaacauauguguucuuuuaugauuggauuaucucacucaggaugauauccuccagauccauccauuugucuaagaauuucauaaauucauuguuuuuaauagcuguguaguacuccauuguguaaauguaccacauuuucuguauccauuccucugcugagggacaucuggcuucuuuccagcuucuggcuauuauaaauaaggcugcuaugaacauaguggagcauguguccuuauuacaaguuggagcaucuucuguguauaugcugaggagugguauugcuggauccucaguacuacguacaauuuucugaggaaccaccagagugguuguacaagcuugcaaucccaccagcaauagaggaguguuccucuuucuccacauccucaccagcaucuguugucaccugauuuuuugaucuuagucacaauguuugugaggggugugggguggucaaaauaagaauguuuuacagcaccugaaaauuagaugaaauuaaagcuuccguguucauaaauaaagccgguuuggcucacuguccccucaucuauguguucacuguagccacuuuugcacaguaggugaggaguggcaacagagaccauauggccugggaggcuuaaucucuuuaugcucuggcucuuaauagagcaaggcugcugaucuaggggcugaacuccucgauagagaacacgcaucuagauagcaggcacguuauucucagccuaugaucugcuguaaauucacuguggagguuccacaaaugacuccugugugaaagccagucauaaugguuaguuuuaauugucaccuugacacacuguggggaaggcagucuccacgaggaacugucuguauuagguuggccuaugggcaugucuaugagagacugucucaauuguguuaauggauagcagcuuaaaaauccaugucaccauucccuagguuuagguccugggcuauguacauaagaguggguuguacacacaccagcaugcauuaauuuguugcccucuguucuugacaaugaaugugauaugacuaacuccuucaaauucuugcugccuucgcuuccucacaaugauagacuguaaccuugaacugugagccaaauaaacccuugcucccucaaguugcuuuggucagggcauuuuaucacagaaacaggaaagaagcuauggccuuccagaagacaagacacuaaccacagaaggauagcaagagauguagugauaggaaggaaggcccacagguggcugcagcuggcggggagacuccauauugguacuugggacucauaguggacuuuuaauccgcagugacuucucuuucaguacagcaagcagaauacaaguaccccaaaaauaugugcauucuaguucccaggucucucaaacaugcuguugugugucuuaagaguguuuagguuauagaugcagccugagaaccaacgggaaaagccaaggcaaaggacccucucugggagccgcuauauggaacacggcccuuccaguauuugggccuucuuuuaaacaucugauucuagagccacaagguuguaaauaugugaugugagggugccucaggacaucacaggauuuagcuuacguuucugcuuuguccuggcauuucuguggagguucccuuuguccaggugugaaaauaccauuacauucuucauggcuguacaguuugauccuguucaccauucuggcaauugaaggacuuagcccaagaagagacaacagguguaacuugucccuucaaagggaaccucccaaccugucucagugcuuccuucucuuugguucucugaccacucuuauggugaccuacucacuuucuggggcaggaugugaugagcacaaagcugucacccuuagaguacacaugagugccucagccuguaguuggucuagaccgucuuuccagcucugggugcugcagaugccaugcagugacccuacauuugauuccagggacccuguggaauagucuggucaauugaugacccucacagucauuuaucauggguugaaagucaaccuucuucacccaaaccuuccaacucugagacuguuauccuccuccugcuuuucgaucuugggauacagaacaaaggauaaaagcauuuggaaccauccuuaagucccauggccuaaacagcacagguugggauuggccagcucagcucucaagguuguaugcuuacaaugccuaggaaauucagccuugucucguuuggacugcuguaacaaaaucgcaaaggcuggaggguuaaaauuaacagaaguucauuucucguauuucuauagacuggaaaauccaagucaaguugagauagauucccaucugguaaugcuggcuuccucauucacaaauaacaucuugacaaguuuucaguacagcaaggguuaagagaaagguuucuuaggccacuuuuaccaggcccccaaucccagcccugguuauuccacccccagucaucugaucaccucccagagcuccacuuccuaaugcuauauagauuucacccuccgaauuugggagacacaaucauuuauaccagagugacuggggaugcugucuucccacggucucuuugccaagugaguuuaaagaugucauugucucagcaucuuucucucuuccaugccuuccaucuagccaccuggggcugugugggcugucccucccacgggcacuuccgguacuugaucaaaaugcucaaauuuccuuccagcuaaguguguugaagcaaaggcaaggcauuuaaauuauacugcaugaggaagggggaaguguugcuggaaauguugguggagugcuugccuagcaugcaggaagcccucaaauucuauccccagggccauauaaaccaggagugcuggguguaccuguaauccuaguguucugggaguggaggcagggggaucagaagcuuaaggucucccuugacuucaugaguuugaggauaaccuaggauacaaaaaaaaaaaacccugucucuaauuaauuaauuaauuaauuaauuaacugauucauuauaguuuugcugcuguguugucuaaaugccagacuucucuacaaggcacugcugugaugccaucaagcagcugauugagucucuaggguguucccugggaagggggcagggccaggaguucagcaccccuuucauaacugugagcagugauucaugaaguacagauaagggaggugggaggcuuggcuagcuuuugcugccuacuggcugauuggccuaaacggguaguggaccuuugcuuuccuccuuccacugauaauaaaagagagugaaugggagagugugugaacucugggcuuagcagguggcagagcgggguggccggcagcauugucuccucuacuucagaacagagucuacccccgucccaggucuaucucagcaacugagcauguguccagcauuccuccugcugguggauggagccaaagccagaugcacaccaagccaccgugccucagaauugggugcagucacuucagggugaggugugagcagaggcuguucauuucaagccauugaucucaagagguaggagcugugcacccuccaucgcuuagcugacagcugucaguugucuugggaucaagaaacagcugucucaugggagccucuguggaaagaaaaucuguuugaggugccuuccaccccugagcuucaaaugacagagcgaugggcugaacagaaaucagccacugcaaauucacuugacaaccaagcaccagccaugucuccugagaaacacgaaugagcuucacugucauccgccugucucauccucacauuaaucagccagucauuaaagcaguuugccaauaucagaacucagaaacaccuggaagguggauguccuacgggacagaaugagggcacucacucggguuccaaggcaggucaucucgggcagcauucucucuaaggccauugugugccacaaguaaugucaaugugggagaggccucauuguuggaccuaaaacuggucauugccaagguuuggguaggguacauccaccaaaaaaggcuugugcauauuagauuugaugcucaaguugcuggcacuaauugccgcauacugccacugacuucacccaggagcuaauucuuggaugcaauuacagcucugagcuaugaggaagugcagccgugggaagaaaguaggucacuggggaggugccuuucaagggucuagcuugcacuuggcccuuucccagcuuucuugcugcuuccugcccaccaugagaugagcagcuuuccuuuucuaccauguugugccugucauaccaggaugcuuuugcacuagggucuuuuaaucaauauuccuuuuaaauaguuucucuccguuauauguugucacauuaacaaagagccgaggcauaucggugguaucugcuaccauacugugagcuuccuaucuguguuuguguuugucugugugugucuguguguaugcauguuugaguauguaggugcacauguguauaugugcauguggaagcuugagguugauguugggugucuuccuggaucacuuuccacuuacauauuaaggcaggaccccuuguucaaccacaguuuaguucaucucacuaauugaguuguuccugaacugucaucucuaucuaccccaugcugggauuaccaccccagcuuuccuuuucuaccacccagcuuuuccaagggugcugggaucugaacucugguccuuacacuugcacaacaagcacuucacuugcuaaaccaucuccccagccuugagcugcccaucuccagaacugguguuacugagcuguguccucguuacuuggcuaccggacaugaagggugaucucugaccaaagucagccacauaugucuauccauaugcagugacccugggcuucccaaagccccuuaugucaugauggcugcucuuccccugugccuuauaaagaaaagcauuccaagcaggugagaaaguaugcuagauguaauugucaucaucaggccagcugaguccucuggacccauggcuugaugcuacaguauaugaugaggcuuuggguaccauccccggauacugagcuccggagauccucauagccuauucccacagaagccuggagaauucccaaaacaacuguggguguccauauauuuuacauaacacagauauuaauaaggaugacuauuuuuauaaucaguucugaucauguggaaauucaaaguucauaaaauaauuucuagcaacaugcuugcauucagcuuuuagucaaaaaaaaaaaaaaaaaaucaaaacacuugcccaggccacucauuuuagaauguacuuuucuaguugaaggcgaacugacuguauaugacauggcucuaaacuaguucuuucuguugaauuguuuggguguaagcgguucacccacuuucucacaguuuggugugugugcagugcauucucuuaaguacuaaacacccuuguagcucacuuuuucucccuaccugggacccauuugauagacaaggaagcugaaagaccauggucauuacauucauagcucacugguucaugaagacacuugggguugccacucgggcucuuugucuaacugucacacugacauuacuuccagcccuaagcaagacuuggauccauuuuccaaaucuuaggauugggcauucgugaguccaaaagucaaggucacuugguaacgcuguuccaaggacgggggacacuaugucugggauagaaggagcagguucagguggucuuaauaauaaaaugauagcaaauuuacaucggagguagggauggguucaugaguuuacuggggcaaauaaaucuuggggucaguauacuaugucuucucuccuugaacuucuuaagugaauuguuaaaugaauuuguuacaaugauaggccacaggucuaccugacgcuguaguucaguugcugcacaugcauaaagccucaaacuagagccacacugcauuguacaccucucaucccagcacucaggaaguuuaucagguauucaagaucaucuucugcuacauuaagaguuucaaaccagccuagacuacacauaagacccugucucaaaugauagaccacauuuucagcucugugcagguuuauucuaugccaguauaauuuucuugauauaagauggugggcuuagucugugggauguaguauggggacuucagagacaugauucuauccggcuuccugucagguuaggguuaugacauggcacagggugccuugacccaacuccuuagugugugagcucauacuauacucuggaagaagaaagcuugcccucccucuugugacucugagcaauuauguaaauauaagcaacuccuuugcugcuuuuucuuuucuucuuuucuggacugcaggggaagaaaaucauaauucaaugccugagcucuccuggucuaggcugcuaugcugaguccugccagcaaaugaacuuggaaugagauggccucccaggcucagacuaagguuaugcucgguaauaagaagugccacucagaggauggcuucuggaagggcagucccuucucuccagccugguacacauuaguauuucgugcuuucuuuuccuggccucuccuccacuuucucucaaacauucaugccagcauggggaccaccaaaggagaaccucucucugcaugaguucauggcugaaagacaaugccagcaggaccuguacaauacauuuggcuuugagcucuguggcuccauguauccaggaaaaaaauaaaagagcaaaucuaccgugguccaccgaguuccagcaugaccacaaggagccucacccuggggcaguucccacccaccaccccuguguauaggcagaaccauacgugaugcacccuauuaugccugggaugauccaagcauugaaagaggaggcacaguuaaaagucacuaauuagcagaccuuccgagcuggggagaugacucagugagugaacugucugaugcacaaacaugaggacuccaguuugaauccccagcaccuacauaaaagccagccauggaggcagagacagguagaucccaggagcccaggaaugagccauacuaccugaugcaguaagcucugcguucagugagagaaccccauucuccaaaacuaagaggaagaaaugguuaagggaaacaucguggcaucaauuccagggcucgugcaaucacacgggcuuggcaguuucuucugguuacuaucagaauaaagcccgaggauuccagaugcuggaggaugaugguggaggcuuugcuacacaccaagggcuccggcugcuguggggugauggaggggguuuuacaacagacugagaucucaugaacauuaaccugaauucuccuuugcucgcugaacucuuucacagaugucuucuaaaaccccugacaaagaagguaacaggggccuucaccccuuguguccugaccacagucccagcgggcucugccagcugucaagcaguucuuucauguagccuccuuagaagcuaugacuucugauccucuuuccccggugccccagaccucagcaaggagacuggaguucagagguguuaaugaacuugaccacggcugcacaggcuaccagugacagcucacacauaaggguccucuguaacuagaagaccagaguccaugcugguuagcacaaagaccagugagcauccaggaagagcaucuuuacccacacuguguuccgagggccagggcucugagauggcaguaagcuaacacccuacacugccucacagcuccucuccugcagcagauugcaugggagaagagcaaagagcaaaggccagccacuacagagucuggcccucacaagucaggugacaugauagcuacucuccauugucagcuagucuggauugaaaaucaccaugggaacagaccucuaguugugucuaugaggauguuuccagauugaguucauucauguuggaagacuuacccuaaauguaguggacaccauuucauguucuggaauccuggacuggagaaaaagaagaaagagagcaccaacauccaucucucuaucuuuaugacugugggugcaaagugacagucagucugucucaaacucuugauucugugaccucccccugugacagacugcaucuuauccucacugaguaagcccaagccaacccuucuaucugcuaauugccuugucaaacauuuuuguuaggcuaacaagagaagucacuuggguggucagccacuuuucagagaccugaggugucuaugucucugguuaccacccccucccucauucgcucauucucuaagaaucuggaaucuggcaguucuugaauucugggagcugguuaggguaggcugauguugaccuuguccuccuccaggccaucugagcugcgguaggaugggaagaacguggaacugaagcgcuaauaauaaaguauccuucaauuccuuucugcaauauggaguacagauacaucuuuaucauacuauggaguaugaaaguucuccuugcuuccucuccuaccuccuauauccucccuguuccccuguuccucucacacagagaccuagcaggaaaccugugcaugggaaucuaagcugguagcgagaagaauuagccacacuucagugcagaugagggaaauauagaaaaugccaagugccagguagcugcucacagaacacucucaggcaccuaggccccuggaguggccaaagaaucuugucccaguuuuuagccuguggcaacggagccuggagcaaguuacauuaguuugcuaaaugauuaaagugcccuuaagcaagucuugcagaugcaccaggaugaguacuaaacagagcugguccguccaagcgugagcugacuugaaagacacuuuguccuuuguucugcuagcuucucuuaagaauuucugccuugaacuuaccagcucaccccggggguccucacaaggugcauucaucugcacuaggcuuuauucuguacaaaauccccggaggccugcuagcugaaaaggcaccuccaggccuguggcugacccugcucccaagcuaggugacaggcacccuagggcccaaggcucugggcuagugguuguuauccuuguuagguuucugguuuugucuuuguuuaugccuauuuaucaaugccccucagacuccuggacccaaacagccuggggcuugcagagugaaaugcgcacauucguauucccagguuuguugguuugcuuuaguuuaguuuaguuuguugggguuuuuuguuuucuaaagcauggaacuaaagucacagugauagcaaaggaaaaucaugacucccacugcugcaguuucuagaaaaugcuguuuucuuucccucugugucuuucucauauauauauguguauguauauauauauauauauauauauauauauauauauauauauauauaucauaaaauucaccuuucucccauuuacaagugugcagaguuugagagcauuaauuacaucuguaauguugugcugccaacauugcuguuuauucccaacacaauucaucucugagcagaaauuccuagcucucuguuccaacccucccaccuuuguguguaacuggaaaucagaaaagacuccggugugggugaggcugauacucgcauucuauggagaucuguaugcuuguuccuaagccugaaagaugacugccccccacccccaccuccacuuuugccucugccuccagccaaaucaucuuccaucucacaccaucaaacaucacaguccuugaaccauccaggugagaggugaccacagaagcauccugagaacagcgggggaccacgccuugggauguuaauagacagacucuggggcaacuacgacccuuucucccuaccgugauuaauucuuagagucaagccauguacucuauucccugccuugcccucauuagagauugcccugcuuccuaggguuugcuggaucacuuucacugcacuguucugccucccacuaacccaacgcuuacuguggaguggccauguguuaucugcacaggggugggagguacaggagagugaggagaagguuggagagagggguagcuuguggccuuauuaagacguucauuauuuauuugaugaguaacaacccuuguuuuuuuccuguguaacacuguugucguggagugucuauggguucuggaauggcuguaaucuagcugguuaacaugugaugaggcauuuaacagccauguucuucacagugcuucaagaacacauuuauccauaggcaccuaccugguguccauagaucucucaaccucuauuccuucaaucuaagucuuuaugcauuccuuggccggcagcuuuccaucccaccccacccacacccauggcauagccuuucucuuuguagugggcagacagccauggaacaucucguaaugaguagguauggcuguguucuaaugagacuuuaugccacuucacaggugguaccuuaagauagcuucuaucaggauuccaaaagaaaaaauagcaagccuuggugaggacuuagagaaguuagaacucuuauguacuguuguuagagauauaaagugaugcagcccgccauguaaaauugcauagugguuucuuaaaagccuguaaugcuauuaccacuacugaagccagugcauuuccacguggacacccaaaggcaucgaaaucggauacuuacacaccaagcugcaugccuauacuuauacuagccaaaagcuggaaacaacucguguccagcuggcagaucagugaacaaacacaguaugacuuuuacaauaagguauuaugcggccuuaagaauaagggauugugacacagccacaaagacaaaccuuguggauauuuugcucaugaagcaaaccacacgcuggaagauaaauucuuuauuauuccacucauauuuggaacuaagaguuaucggacucauagacagugcaaagauaguuauaaaggacaggagacggguacauggggagucaccauuuaagggcugaggcuuuaugcuuguaagauaaacuccgcagauagacagcaauuauggcuuagauguuuguauguucaguacugaugaaauguaugccuuaaaauugcuaagaugaaauugggcagugguggugcacgccuuuaaucccagcacuugggaggcagaggcagaggcaggcaaauuucuaaguucaaggccagacuggucuacacagugaguuccaggacagccagggcuauacagagaaacucugccucaaaaaaaauaaaaaauaaaaaauggaaaaugcuacgaugaucaaacuuacguuauuuauguuggauuguuuuuaaaagagcaaacacaugcauacaccagaguaauaauuaguguuaauuaucaaauugauagaaucuauuuucacuuggaacuuggacuucugggcaugccuggggggagagggguguggaucaucuuguuaucuuuacugaugaaggugggaagagcuguccacuguggguagcaccaaucccugguuaaaucauggacaguguaagcagagaaggggagcugaggagcagcauguauucaucacgcucugauuccugacuguggaugugacaggguccacuccucagucuccugcugcccucacuuccccaccaugaugaacugcacccuugaacugugaugagauuaguggcugucagggaugagagaggagaaaucaguuagguggaucacagaauaucuauccuggggcagugagcaugcuuuuuauuauucugcaguacaggaucucugccauacauuugucuacuacagaccacacagcaugaggagucaacaggaauguaaaccacacacuccaggugauaacuggcauucagauguugaugaagguucauagaugguuggaaauguaucgcacucagcuaaggagguuacugaaggagacugggccaugucugggagagaagcaucacuuuccauccaucuuugcugaggaccuaaaacuacccgaaaauaucaaaaauaaugugagagaguuaagggacggaaggguaaaugacacagcuuuggacagaguauaauuaugagagccugagcuccgguugugcugucugcuuagguuucugauggaagcuauauccuuacugcagugugaaaggagaaaaagaucaggaauugacuugggccacgcugaccacccuguucagguuccuaaggaaagcaguugugaggucacaggaacucagcuccagaaggggccucaguuugcuuguguguauaguauugaauaaucuauaccccauaauuguugaccucauuccagagcaugguuuguaugaaggaacagcagcaguuccuauaacagagagauuuccuggaacagcagagcagcaggaagaagugugguuagccauugagaggaagccugagguccccgggcagccaccugagcagccccuucagcccuaaugauuccgugagugggaggaguggcuugguggaagugggguagagcgugaauccugcccugcuucuuuagcaagaacaagagggugagugcccagccaucucagcuggagaccuuguagugaggaccacacaaccuagaugcagggcaggcccucccagaaaauucucuguauuccugucugcaacucaagcucucuuaccagcccuggccaguaggaaaacaaaaccaaacaaaauucagaaggaaauuaggauuuuaguuaagagccugauggauauuuaagucuuuauugauuugaaaaagaaaugaggaaaucuugggaaacuguagcaagaccugugcaggugauggagucuugagauuugggagaaagcccagcuacaugugacccuuccccggguuagaguccucggaaucuaugcuaacucaacugucugccuccaaacaaggcucaaccccacaucguggucaaucauaauaucuacugagcuggcucucuagugacauucgucuuccuaccguguugcugaggcaauguuggaucaccaggcuuuugguuucucugcauccucauauguccauuccugggguucccccuuagaagucaccucgaguguguaugaguuuuccauuucccaguagagguuacacaacaggaagccgcugacccuaguuggucagaaaagcugcucugcuaagcuggggacuggacagccaaaccgauuugcugaaauaaagcauucauuacccacccccuucucaucuaauuggaaugguuugcuuugccucccccucgcuacuucuccuuaacuugccccuuucuuuccccagcauuccugaauucugcagaaauccuuugaaggcgcauuuccagcuccugcacuugacucauuguccugcugggaugggaucugucacuucuaauuuguuuguuucuuuuuuuuuuuuuuuuuuuuuuucccuaccuacuuugggcaaaacauuuucguaaaagaugcaguuuccccugcccccaaagcaacuuguuuuggugccagaacuguuuaaaugcccucauauugaacugugcaaucuaauuauguaaguuaaagugaguuuagggaaggaauuaggaaaagcccucagcuucacaguuugggaacuggcuuuucauuucccuggaggcuuugcgcaguucuccauauuuuccccuccuuagugacaggccaccucaucuugagucuuagcagcaccacugagugacagagaagacggagacauugggggcguaaaccacagucauuuuagagccuguccuugcagggcuuaaacuggcuucugaggacuuuccauuuguuaacugcccuccucagcugaguuggccuguguugcuuuuaggacucuauauaucaccugccuuaucccagcaggcagccuuucuggguggucuccugccagagcagaagcauccccagacccugcccauuuuguacaaggucauaauaggcacuggggcagaaaguccagagcacuggaaagcuccccauaaacuucauguugcucagaggcuuggaacucagcaaauaccuugguauauugguaaggguuuaccugcugugaagagaugccaugaccaaggcaacucucauaaaggacaauauuuaauuggggcuggcuuacaguuccagagguucgguccauuaucaucaugaagggaagcauggcagcauguaggcagacauagugcuagagaaggagcugagaguucuacagccuugaucagaaggcaggcaggaggggacuguccuccacaggcaaccaggaggaggcucucuuuccauaccggguggagcuuauacauaggagaccucaaagccugccuacacauuguuacacuuccuccaauaaggccacaccuacucuaauaaggccacgcugccuaauauugccauuucuuugccgaucacugaauuacaugaaucuauggggccaaaccuauucaaaccacccaucccucuuucaggcauaucuaccaggacaugcaaaacauagaaauaaucaagggcacaacuuccuuuagauaaaugcaacuuaagauuuuauaguuuuuccuauuacucaggauucucuagaagaacagaaccaaaggagugaauauauuacaaaguggauuuauuagguugauuuagacaagauaggcugguuaauucaacauuggcuaucuuauacccacuggaguugagaauccuguagcuauuuaguccaugaggcuaaaggccucuguagucccagucuggugcugaaggccuaaagaauaccuagagagcugcuggucuucaguccauauuaggacacuuuaaaaucugggcuccuaagucagcaaaggauggcaacagccucauuuuacccuaagaccccuuuguauaugggcugccucuggaaggugagagccagucugggguuaguguucaccuucaguuaacccuucuuagaaaugccuucacagaccaacccaaaagugagucucaguauaucccagagacaaccaaguuggaaacuaggucuaaccacccaucauagaaugcauaaagauggcagcauuugaugacagugggacauguagugaugugacuucuucauuuugaaaaucuugaacuagguaagccguguagauugagagauuucaaagaacucaguaguacucagcucaguauucucauaaacugcuccgaggcucgaacugcuucuucugcugauguaauaucuucuuuauaacucaauuguaauuggcaguuguauuauguauucacaagauguagcguguucugguggcauauguacaucuuguagagugguuaaaucauccuuauuaauuuaucugucaccuuacauccuuaucaugcccuugugauguugaaguacuugugcauaacuaaauguuuauaugcagaggaagccauugauugacagauauauagauacaauuagauuaagaauuuaacuauacaaaugugugaaugugucaucuacaauuaaauuuaguugagacugacagaauagaauugagcauuguuucuacuugaaagccacuagcagugacugccucuuauagaaggcguugucagagagacauccuguguuguuugauuaguugaauuauauuagcuuggggaugaauugucuuuauuuuuuccauugccccaauuuaaacaaaaaauuuuagggagguggcuccaucaguguauaccuucugucauaaguguguguaccuucuuauuggcccccaaaacccauacaagaagagcuguguguggcacccacguauauaaucccagcaguagagacaagcagauaucuuaagaucaugggcugguuagccuggcauacaugguaaaauuccagccaaugagagagucucugucucaaacaagaaguugaaagcacuuaaggacagacaccguacauucuccucugaccuccacacacaagcuauguacauauauacacaauguguacagaguauguuguaauagguuugagcaugcuacccggacuuuguggacauaugacuagguugcaaguacccagagauuacuuuauuuccacugguauuuuggaaauaaaacuugcagucucucgaccugaugacauuuuuuaaucuuuuuagggugacaugauuugccucugauucucucuguauuauuuaucucugugcaggguuuuuaucuucuaaaguuuuagauuauaaauaaauccuuccauagauuaaaaaugguugaaaagagcucuguucaaugcaggcuuacccuuuuucuuaagcauugagaucauuugggagagcguccaugaacacauuugaacuuuuauaccauuagcuggguguuuggaaguugccaccugauaucccaggcucugaacaagacaaagcuugauucaugugccuaaugauugaugguuuucaccuacugagacuuccgcucuucugcaugaauauaauaucuacaccccccuccccuuuugggaaccuucuuuucuuccuagcaagcauuucugauauucuaacauugcgccuggccucuacugagcuguccuggaggaagcugacggauagaguauuuugcuuugguugguaaaauuuccuaauguucaccuuggcuuaaagaucucuauuaccauccuuguaaacaugugguuccuugaaacagagccuugcagaaugugcacaucaacaagggaucugccagauagaugccuugaagguucuugaaguuaaaaaaaaaaaaaaaaaaaaaaaagcaagauucuuuccaucaagaaaugagccagagauaauggaaugagcuccuuagaccaagaaugggagaagggagcaaugccacugccaaaccauaucagaaaccuggauaacaaaacccugaaaauacuuaacccugccacagagaguccacuuaggaagcagggucuccagagacugagaacaccccgaauaccugagccucuguugggagucaguuugcucucuaggccaccguacucauuuauuugccaucuauccaccuguccauccacgauuucuccauccacccccuuacccacucauuuacuacuuacccacccaucauccacucaccuacuuaucuaccugccugcccauccauccauccacccacugcucaugcacucauuuauccauccaggcacucacuuaucuauccauuaccuaucauuuaccauucauucacucaucacacauccaccuacccauccauccauuuaucuauuggcccacccacucauacaucuuuccaccuuucuauuugucuacccauuacccaacuaaccacugcaagcagacaaagccaguguuuuugcaucccuaccauuugcccauuguuagagaggggacuguuucuuauucuguuuucuuuucucuuuccccuaagccuacuccaacaguguggaguagagacagacucaucaguauguaaagacaagccuaucuaucuauucaucuaccugccuuuccuaucgucacuuccuuucaaaaccaacugagauguagcugugugggacccacugggaggaaagcguuuguuuuccuauacucuauaucgucugauaaggcaucaugaaucagaaugggucuagucacaugacuuaggaucuucuucacagaccucuaugaccaaaaacaagugcugugcaaaagcuucugacuuucggcguguaugcuccguaguuugagacuuauuccaaacaacauaggauuacagugccuaacaggucauucugccgaaauagccgcagcuuuuguuuccuuuugccuacuuagcuaauugauugauuucaggaagacuugggguuagcagcuuuuucaucccauggcugugaacugugagggauuauuuccacgugucucugauggggcuguguaagucgcccuccucuccugcccugagcccauguuccauuugcucuuguuuacagcauuggcuguaguguuuccccuaguuuucuucgugugucuugcauucuguguuauuuggaguuuuguccugacuuuuuaaaaaauuuauagggauucuaaauuauagaaucuaucucucagcacugcucuuucucagcugacaguucauuuaaaaaaaaaaaaaagguuuuguucagcuuucauauuguuucagccugacaugguuucuuuuucuuuaaagggguggaagggcauuuugagaaauaacuuuauuuaacuagcugaaaauguuccagagcuuaauuagaaguagcauauugcaucuguuuggguguuaucuagaggccaaauaauuacccuguaauaauaaugcauguugugaugaacccaucauuauugccaucaggggcuggggagaaugacuuucagcucuuaaggacagcugggugcucucaggaauguccacaaaagaugaaggggaaaaauagaaaugaaaaguuuauuguggcuacauaagcuuggaguuuuuggaguucaugcaagcccauuccucugagaaagaaacugaguuaccuggaggcucugguuuuuggcccugcaacguguaccuuccgaagcucaagacucggcaauaugagaucaucuucuuuuguccucugcuguauuccugaggguuaacccugccaugacaggcaccaccccuagucuagagccuagcuagggcugcuauguuuccuccaugcaggaggcauggcccuauugugcuccauguaguaaucugucaggauguccuaacacccugcauucagcuuuaaagaaacaacuaacucaauugcagaguucaguauccagggcuauauuucaaacguaacugggcauccuaaauuugcaaaaucuggccaauggauacuguugcccagucuuggcuaacagucaaggcagugaccccaugguccuccauuaaaagacacuuaaaaacacccauuuuuccuaucugguuauaucuuuaugucuccagggaagaauacagauaacugucuguuucuccagugacugagauagcaaacuccaccacgggccauguggcacaacugugugggucguacaucccgauguuuggcuuucugauggaaugaugccuguagcucuggauugacagagcuuccuucaggagugagaaaguacgauggccucaagugcugugggaaaggcucugccacagaccucuuaaagccccaagucgagaguccuuuucuuacuccuaacaucacuagucuuuagugacucugaggugguaggaccuagggagcuccuauaagcauacuuaguuaaaaagauaaugccaucagagaacaaggaucucaaguaacccagauuucccucacauuguagcugcuuccugcugucuaaaugaggagagguaauuaaguuuauuaucugugaccuaaugcuaauucuucuugcauccuugcuuugugcgaagggagaaugccauuuacaaagaaauagcuggacuaugcuuuacuguugucaacacauucaaggguuauaaaacaagucuacugagugaacaagcuggggaaagacaguccuccagaguccucccugacagcccaaauugcacacuucaucauggaaaaguagaagucaggguguugagaaaugcugaaaauugcacauugucagggcugaggaaguggcucagugggauccagcccuugcugugcacauauuuacaccugaguucaaaucuccuucacccauguaaaacgcuaggguuggccacguacacuuguuaucccaggaguagguggccagaggcuacaggggcucacuagggcuugcuggcuacuauccuagcuccuuggucaaucaaaggcauauucuuuguuugaaagggguaagucaaagagugaucagguuaucugaugucuucaucuggccuccccguuccuacuacuacuacaacuacacacacacacacacaccaauuauacauaucggugaaucgacgaaucacaauaccucuaaaauucucgccgagucacuuucuaaucuacuaaagccuuuuuaauuuucuuuuauuaagugaacaaugauugaaauuagauaaaggacagaugguaccgauaauggcaauacauccaaguacaguaacauuguaccaaagcacgcugagccuaguagcuuacacaccgagagugcuuucagauccaaccaaaggauucgauuaugaugcagcaagacauuguaacuucaggaaaggauuuuuauuuucaccuuuucuuccuucuuuuuggaaagcgggguauuuuugugauacauuuuuaaauguuacuuuuaggggcuguuauuuuggucuguuucuuucauuccgcuugugcuaauuuucuugauuaauuuggagaacaucugcauauaaacgcugagugcuuuucacuggcaaaaccucccaacuucaugcaggacuuagaggcuucgccuucuccacagucuggaauccuaccuaauugaaaugccaaaccugcaaaggugccaaagccugaguguguaauuaugccauuuucucuuggucuuucagagucuuucugcgggcgauuaaucaguaugcagauaugcugaacaagagauuucuggaucaagccaacuuugagcugcagguaaaaggagaaggagacagcaccuuugugggagaaucuuguuaaaacaaacagcugcccggugucagucacuuauauuucuaauccugggauccugaucggagguguggagaugggacucagggagugagaaaugauguuuuuaguguauuugcuccauuuagcaaguuaggagauagaguuguuuccaggagaaaguacugaaucagaguggcaaggagggacucuucuggcaggaagcagcaggcaagcuaccgagugccacuaugccuggcugccagccuccucucacaucauccuaagacaggaugaaggguucaguacaggagaaucgggugugcuucacugagcuaauugcuucugaaacucuuuccccgucauauucgcuccuggcuuugugccacccguauuguccacauugaguccuccuguaucauaaauaccucuucuguauaugccugccuaaguagguguggaggaguccuggggagggaacccugaauccuugcgcaugcuaauuaauuaggccuucuaccaacagagccacauccccaccccuagcaaucuuauuuuuaaaauauuuuuuuguuuuuaacuuuuuauuguuuuucuccgcuugaugcuuguuuucaugugucauaaacaaagagucgcaugccguaaaugaguuguuaggaaauguuuccucuacucuuagcaacucccauucucucucugcaggagucacuuguaacuaagugcucugcacucuuccugacaccagacacauuuaugcggccccgugcaugacuucaucuuccuuuuaacacauguugguucacgccgaguguuuuacaggccugucauaccccacagcaugaauguaucugcugccccugcaagauggcccagcggcuucugcuucucacugcccugagccaagcuuccuugaguuuccaugaaugucagugcacgcacccccaagaaaaggcugauugcagacaaaacgggaugagugguuaagcucgaugggcagggucacaaugccguccuaaaaguguuccagcaguagcaccccacuagccacauagauguguguguguguguguguguguguguguguguguauguguguguguguguguguguguguauuuauaaaccuuuuuaauuuucucuuuggagauuuucguauauguauguaccacguucuccucagucucucccaccagccccaucuucuccaaguucccucccaccccugacagucucccuuccaaauuccaaguacccuucucauguuuuuguguuuugccuucugacccauugagcuauccagacauucucacuagccucuuuugcacaaagcagcuuugugcaggcuuucuugagaauuuaggauuccuguuucuaugaacccuuuucugaccacuacguuuuugaaugaccaguucugcugagagaauuuaucagcuauggggauuuuuuuuugcuaugcccugccugggccuuucuuuugcuuucauuggcucucaguguuuuuaauuaguugggacucuuauuauauccuauucauggcuuuaauuuuauuauauaaaaauauuuaacuuuuccuguagugaaaccugacauuucucuugugauuauauggucuuagguuuugcauagcgaaucccuaauugccuuaauguuguagauugaguuauccgcaaugaaguuaauaucagcaauuaucuacagaguucagcuuaaugguuccuuuuuuuuuuaacuuuucaguuauuuaauccaccuaagauuucuauaacuaguguuaggaucagggucuuacucuccgcucaccacguggaguucaugauuggauuccuccgucuccagugacuugacaugcugccgcuggccagauugcaaaccuacauguguauagacucuguuaucuguguugcgaccacagugacuuccuugguucaguucuauagccagauaguggaacccgcaccucccagugaauuuucugcaaggaauugcccuggcugcguuuguguguuacuucuugcacacguacuuuaaaaucagcuaguugagugucucuucugaaaaucaugcugcuugcauguuaacuggacuugcuggacugcugaacuuggaaaugggacagccuuugagggaguauuuucuagccuguuuucuuccauuccaugcuggucuucuugcucuagcuuucauugaacuccggcuugccuugugacuugcuggcuggauuccugucuguccugaauguggcugcugcuagggagggacccaucuccccacugaaggcauucucaaugugcccugcuacucaggagcuauuaugacugcugucuggguucucaccuugagacugaacaccuugaaggcucugugcucuccagauuucagagcugggaccaggcaagaguacugggugugggccaaaccacaauaaaccacaaguaguccgggccccauaagugaauagaaggaaugaggaguugguaaugucauucgacaagcucucggccuggugugguggugcacaccuguaaccucaguucccaggcagcuaaaauggaaggaucccagguuuuagguuugucugaaaugcaaagcuauagccugucaugagaaaacagauugccgaaaggaacauugucgcucaugaugggacaugccacuucaaaaaguuagagcagaaggauuuugaguucugguccuacuuuggcuacauagcaaguucaaggcuagccuagguaguucagcagguuccuuucuuaaaacuaaaauuaaaacgagcugguaucuggcucagcaauaccaugcuuuucccaccacgcuuaagcccuggauucaaacacacaaagaaagaaauagggagauaggaagggagggagagagggagggaggaaaggauuggauuggauucgugauuauuacauuauggcuuuuagagguacuaggucggcaggcaugguggcacauaccuacauaccuauaaucccagcacuuuggagguugaauagaagcaguaggaauugcaguucaucuuagcuacauaaccaggcaaagccaucuuaggcuauaaggcacugucuuaguuaggguuuuacugcugugaacagacaccaugacuaaggcaagucuuauaaaaaaaaaaaaaaaaaacauuuaauuggggcuggcuuacagguucagagguucaguccauuaucaucaaggugggagcauggcaguauccaggcaggcauggcacaagaggagcugagaguucuaugucuucauccaaaggcugcuaguggaagacugacuucuaggcaacuagggugaggaucuuauacccacacccacagugacacacccauuccaaccaggucacaccuauugcaacgaggccacaccuucugauggugccacucccugguccaaggauauacaaaccaucacaggcaccuugugucagaaaauaaaaagaaaacaaaaacagguaccaggugucugucuguauagguuccgguauguguuuuccugcccucuuugccucccucccaguccacuuuuccagccagccgugauucugugguucucagaacauacagaacauguguagcauuguccugugacugcugcaggaucaagaaggacacaggagggaaaugcuccuuucaaaaauaaaugaaaaagagcaacuaguaucucacggagugaagccaccccuuuugauugcagaaaaaggccaaagaaaaaugugcuuugugggcaguaacgaagcucucugaggucagggacaucugcucagcuucaauucuacuguagcugugagcauccuaauauggguggccauugcauccuugguuaguucuuugguggucagaagcccuguaggcaaugccauuuccuaggaagagccagauaaaagggagcgcacacacuguuauauucugaggauacucuuaaauucccaacuuuugcaggucauuaaacucagaguugguaaugugaaugccuuauccuccugugacucuuuguagcuaucauauuugaauauuuggauaccugguauguaaaugaggagaaaaaaaguaucuacaaugucuuccaaagaucacccuucaaaucacauauagcccauaaauccuugaaauggagguuugauccuuuuacauguuuucccuaauugucugguguaugcauaauuuugguguaguaaaaagucguaaauuaugcaaguguauacuguuccucagagaggggcuccaucuccugcugauaguuagagcugagacgguggagugcucguuaccugcucagcaccaccauaccauuagccacugcuucuucggguaguaauccuugaucccuuccuggaagccuacccagguagauacugcuaacaaccccgagaagcaacugaagcacaggcagagagguuagaggagcugcccugcugaauugagccucaugcucacccaugaaucacgcccugaagacuagcuugcagugcuguggauuuugaagcauuucaggaugauaauggcccagaacuuuccugagacccgacgguaagcuguuccauugcucagccuuaucuccugucuuuugguuuucagcuguggaacaacuacuuucaccuggccguggcuuuccucacucaagagucccugcaacuggagaauuuuucaagugcuaagagagcuaaaauccuuaacaaguaagucccccaccaccaccacagcccugccacugcaggcgggagccuucugcuuauuacccuaauuuccaugucuucucuaagccaacuggguacaaauugagauguaaucacagcguaaugaaagggugguuucaaaucacaaauccaguguugccuuuguaacccaugaaucaagaucuaaaauugcaggauucguccuggcagguucaaagucagugugauuggagaugguuagugcuaaacagcguuugaguuucuggagauaaugaccuuugcugagcaccuuucugaugucauuacgcucugguuuacuuuauugcuuaguuuuccaguucugcuucuacggaaagagaggugcugaugaaaguccugggcgggcacugcugggacuguccugacuggugaagcagagcuagccaugguuucuuuaguggcacaaaaguccccugucuuccucuggguaggaggucugaguggacuggaucagccugugucucaccagagaagcuucaugaaggccaaagugcuugggcagcucuauggcgccccugaauacccugaaugaucauguuccuguggcaagagagaagaccgugggcugagaagauggcucagugggucaggugcuugcugcucaagcauauguauccgaguucaaauccccagaguuccuauggugugaugagaaagagaaacaggacgguccccagaugcuuucaggcuugcauagcugcaaacaagaaaccuuuucucaaagcacguggaaccagagguccaaucccugugaucgccaugcgugugcacaugcacacucgcguucucucucucucucucucucucucucucucacacacacacacacacacacacacacacacaguuuacaaaggaaaagaaaaauaguugcucagcuauacugaggucuuugcucuucaccuuuggccuaagcuccacuaaugucauccagcuccagguguccuucuaacaggaacuccuaagaagauucugaaauggugcccauauugcuggguugucauauuuauaaugccucuguagcauuuugaccaucaaggcuuggccuggucccuauaaguugcugagguuagaggcugcagagggagucuuggaaugugguagcggcucuucuucucagagcccagcaguuucuaucaccguuacugggaaauugaaagcacuugaucucuaggauguaagauguguuucugcaucuaacacugggcuuaguucacaugacagcauccuucuagacacugugcauacauguguacaugucuauacauguaugcacuuauaugugugccuauguuuaggugugcaugugcauguuucacauauaaucauuaaaaagcaagacucuucauucaguauguccucuaauccauguugaacuaugaaugccuuauggauggcauccaucucuaugagcaggacccaucaugggccaccuuaucuaucuccugcugccagauuccagcccaggcaacucuguccaaggagaacuugacuuucagagagagaacccaucugcaagcccucuugcgacugaucagauccucuuuggcugaccccaagaggcaugaauguagacagugacuauuauuuagaagugacagauguaccugccagaccaaccacagugagcgcagaguagccccaccugugacugcuggcacauugccccucuuuggaaccuucucagggcuuaaucguuuaccaugacccccugugccaaggacagacuucugccggcuacacaugcuagagauggacacuauacaaaguuucccacuucgggcauucacggggcuugugagaagggagggauuccuguuguugcuccccgugcgguagaaaccauuacuuuagaagcagagcauccuuagcagcaaucagggcagcucaccgaggccaccucagcuucuugaaguacacacucccaccauuuguuacauguguucaugaguccguguggccggugcaugcugcagugagaugcuggacauccagcccuaaugguggcugacuuuagaagccacuuccugggaagcaccugcauuucgugcccuuagagauagaugcccacaggagaagagaggcuuuuaaaugaggugucgcuccuggaggcuuugcugcugagugcuguggagacugggugguagcucugagcugggguuuccucuugcugcugugucuacaguccuagcuagagcagcaccagcgauagcuuuaaucaggaaggauccuguucuccagagaaagucuuugcuucccuucuugcucuaucguuucaagagcuacagagccaaaggagauugaacacagccaucuggugucucccuucccagagcccacggggacucuagaucggguuuuccugucucucuuagacacagugacaagagacuugagcugugcgucuguguuuucucaaggauuucucaggcgaaaaaccugagcgcauugcaaguugucucuguaaacucugggcuauauuugggucucacuagacaagacuccauguggcagugacuggccaucaagggcuccugucuaugauaaacccaacaugaccucuaagccuaagagacaucagcuucaugcagcuugucaccagcauucacgagagaguugugccucuuuauagaccucagacgcuucauaguauauuugcaaacucuaauuuacuggguacacugaaugccuggauccuuuuggcuuaucuaauggaacaggauuaggccucuucugugcucaggcaaguaugguccuguugcuggagaaggagaagcggauccucaggugaagccauucauugucuaguagaaagcuaagcuggauccguauaggggaucaggagaagauaagguuaucgacagagcuuuggaaguggcuggggcacagccuagggaguggaggcuaccagguaguguggacgucagacaagggggaacuggcagcugagaugccugcccauuugacugacauugacagguauaucccaguccuauagcaaagagauacacgccuuggauaguauaaaggaguggcaguggcuggcaaggcucagaggacaucuccugcaagauuguacggaguuagucccaguggucuguggugguagcuggccuuacacacuuggggaaugcuguaugcaacauuuaacuacaaguaggagaaacccuugggucugagguagauucgggucugcccacucaugcccucaagacuauccauguguggcuugucagccucuauagggcacaucugaguggacaaccugggucuucucuuuucuugccuggucugccucaccauggcuuagaaaauuaaagauuucuggaauuagaauacuucuuguuuaugcccuaaguacuugggugcaaaacauauaacacucacacacacagacacagacacacacacacacacacacacacacacacacaccaagcuacaccauugccaagaacugaguauauuaaccuccaaauaaaaaaagauuuuccucuaaaacucaaaguuuaguuaagaaccucaagaacuccaggucccuacuaagaaaacgcugcugugcggccucaacuccucccuggugcuagcgacucccaccacagacaucaggcaacucggcuuuggaccaucagccacccuccccaaguuuuuugcaucauugggguucaggaaauauaaauaaaaugcagaagaguuaacucuaaacucauagccauuuggacaacauuacugugucacaugaccacaaaagcgcaccaugcucagggcccaacuuuguucugggagagaaaagauucauaaucgcuuuugcaugguuuuguuugguugguuuugguuuugguuguuuugguuguucuuuuuuuagggguggugggggaggcagaucucucuaucuggaggcccaggcuauccucauaggcacuuagauccagccggcuucugccucccaaaguacuggaauuaaagguagcacagcguuuuuccaaguguuugcaagagauucccgguuuggauggcaucacaggagggagaggagauguugacugagcacguccaacucuuucacucgcccauuuuuuuuuccccugugaaaucuauaaucuccugaggggacauguuuugcagcuggaccaaaacaucacacaaacaaacauauucccauuucaccagacacuggcuucugagaguccagacuguagaagggacuuugaaggaagcuaagaaggaauaaaugagaugugacaagucccguuuuacaaugugaccuagucagaaaguaggauucuguauugcagaguccgaucaauucaauccucaugcuaauuauuuuuuuuuccaaaagauucaagucguuccaaguaaauucacuuuaaggauuaguaagggaccuagggaaacacacuucauaagcaguagcccugugccaccuucauguuggcaaagcuaauuagauauauuggugaggcauugcucuagagagcauaauaaagcuuuaauguaggcagaaugcucacaucagcccuguguccaacaggguucauucccaauggccugauccccuucgaccuauuguaugcggguuuuuguuguuguuguuguuguuuuguuuugucucccauuaagacagaauugccucauccuauccaugagccuguuucuugguuaucuuuccuuucuuuuucuugccgaaccguccacccuuuggcacucugaccaagucacuaaggcacuaaauccacaucuggugcucuggauugcucuccccacguccuucaccacuguuucuuggccugggucauggcuacaaacccagaguuugaauguuuuguaaagaggcugucauuggcucaucauccuggaggcaagcucuuucaagggcaugaaacuagcauuuucccagcuucugcugagagucuugugcuguagaacauaugauagugaagccuggagggcgagcaaggagugcagacaggaaguguucguaagagagagagaaacagaggcagacuugcuguauaaacaccuacucuccccagaguccugugcuaaucuauucuugaagaccuagcucugaccugugcuaugucguucccaagagaucugacucgcucccugaagaccuaacccagucuugaaagaaccaacccaaucuguugaaagguauuuacccauuccugagggaagcaagcucagauagaaccaugucugcugggucucuuaaugucugccaucucucuguccuauuaccuuagagaccaaaguggcaggacauggaccucuggggacaggaguauccaaaucacagcacucuaucuccuugucccguggaacuucuuucuagguuugcuucugccucuucagccuguuuccuugucugguuuagacuccuacacggacacaucaacgugccagagcccccgcccccuccaaucucagccuuagaauucuuauuuuauucuuuccaugggaaagcauuuuucagauucuagauucucauuguuucauggacuauacuaaauaaauggauuguugcauauauucccugaguucaccugccauaacaguggguacaaaggaaguuacagucucuugucugguaauuauggaagccaugaguuugaagucaggauggugauggugcagaucucucuggggggacuguucuguuaccuuuaaguugccaucccagaccccagcauuccguagccuguguuuuucagucucugcuuuucucuagauuagguucuuuuuaagucuuccuguauaucugugacucuugauacgcccuccuuauagagacaucacuccuugaauuuaggccucucuccacuacaguguggcuucaucacaacuagguuacauuguacagacccuauuuccaaaugaggucgcacagacaggcgucauauguauaagauuugcagaugcccuguaugauuguggaauugaagucugccuccccugucauggugcauguguccuaaggcuugugaaucuuguuguaguucucuauuagugauggcuaaaugaaucagucuaauggccuuugccaacaugcugugcuuaaggccagcccuuuaaaguauagcaucuccuccuuagagugcuggcugagagagaguagaugcuaccuuguucucaacauucagaccagcaucaagguaagcaccaagaguuguuuccuuaaacugugaaagaaauaggggccaagaaguugcccagcugugcuuaaauaaggcugaaugguagauagaauuccucaucuuggguaaagaugcaagaauucaaguagugccauugagacuggauguaggagcauaggacuuccugcacuggggaaaggcucccuuucaagucaccuuuccuauguucacuugguggguggacacacagggugaggucacuccaguucuuaugaaguuccaggucccuuaugacuuagcagagcuaggcccaucugcucagcaccaugaguccuggacuccucacuggaagagcgacugugauaugagacagaagcauuuuggaagaagaugcaacagucggucccuggagugugcagugcagggagcaaugugggcuugcgaucuaaggacuuggacucucuucucuuugcccuguaaccuaagccaagucauccagcuuuccccuccaggcuugggccagcucccugacucugugcuaugagagagccacucaacugugaucucuagggcugccccuggcuccaaggucugucuccaggaaaugagcuccagccagacacucucaauuauccucauauuuuucuuuuaagggaagaagguagaaguguuccccgcaaacccucuugaggucuggugacagcugcuacucugcuugagaauugcuaggaagcuuguacagauucaucagaucugccuuccuauuaaaugcaaaggaaggaucaagcccagccugcugccagggaacuucaguccuucccuccaccgugcgucucccgccuuuucgucuggguuucuaggccucuaguucauucugcuguuagacaguauuuugucuccuugugcuguaggccuggcucucacaagaaucacccccucugaucauugccaaugcccugauucucaaauaccgucauguccaaucaucacccgaaccagaaaagcagaagugagugugugaacccaugguccucacccuccuucagcagcaacagcacuccuaauuuccacagcagcuggagagaggcagguccccacccagaaucacaaauguuagagucccagggcuuccuuuacacgauuagaacuguaaucaguagaggacccgagagaaagagcaaagaccuugagucaagggcaaaggaacagagacauccaugaagccuacuguuagguauuccuguguuuuaaggaggaauccuuccuguaaccuggaugcaagauguucaaagccagaguuaaugaugcuguuuuugauaccacuggcuucauugguggauugaggguaugaacacacaucauagagagcuagagaacugaggaugguuguguccuguagcccccugccacaaugcugugucucccagucuugucuguggccuuguagcugaaagugacucguccauuagccucaaagucagggcugauuccucucccccugauaaauaccagaaguugcaaguagccaggucgcugugcaugcuuccaacuccaucuugcccaggcccagguggcuuugacugcugagaaaccucaaaauaaugcacaucuuaauguguucaggucucggaacccuuaagcgauuugaagggagagucaagccugggagagugucucccuguuaccucauaccuacuagcugguaucaugucuucacugccuggaacaugccucccaccccuguggccuuggcagugaaucugcagcuggcuuagaucaccugauuuacagagaaucucugagucagcuuucacuggcuugcugggcagggucuuuaggacccagcuuguccugagaggaaauagcugacuucccgguucuguuucuccagcuacauaaaccuggauguucuacacuccauggcauccaacauauccauacaccauacauguauauauucauacauacauguauacauacacacauauguuagcauacaaaguaaugaguuucauuaugacauuuuauacacauauauuauuauaguuuauuguuauacacccucaauauccuuccccaagaccugcccuucauuucucucuuacccccaagaucaguccuccuauuuuaggccacaucuuccauuauucacucucauuuucccucccuuuagaccucuucccuuccuuauauccccuuucuauuuucuuuauauauguauauaauauggagaaaaguuuguauauacuugcacacacacauauauauggaaaagaacacauguauauacauacauacauacauacauacauacauacauacauaugccuauguauaugugcaugccagaucccacauagagaaagcaugcauguaccuuggauuacauauuuucucugguugagaugaacaugccacuguaaccuuccugcugugagugacagacaggugcuuaggugugagagacuuuaauaagguggcagccagcugaggguuguugauuuagcagccagggcugcuugccugaagagccaggacaccaucaucugugaucagcuuuccuuggcgccucagcugccacaaggaagaacggagcaagccugacgaugcagcugcucggcugcaaugcuguaugauaauuucgcaaauuauuauuuuuaauauaaucagcuuuuuccuuaggcacuaaaagaaaaaguuaaauugcucacaagcuaauaaagguuuaucuuccgaagcaucaaauucuguuuacucaugaaacgcgcaccuccucucuucgcccaccgggaggaaaauuagcauuuauuuucccagauaaacaaaaacugguggaauguuuguugacauauuuggguauuaagcucuugcuuacauuuaaaaugauauagaagaauggggaaauuuugggagcugccuuccccaacucuaggguuuuauuuuccugggggaacccucugcucugugguagaaugcucuugggugccugcaugugccaacagcagcaugcaugggagacaaacucccuuaggcccagggccacaagacugaaaaacacaagacuggcuguucuucacagcuucuccaugcucccauggagaugcucugucaucugggaugagccccauuccugccuggagcucuccuagaaauccugcugauggauguaguuggaacucuggcauagccuucaucuaacuaaguccaugauggaaggccggaguuugauuuccagaagcucuguaaacuggcauugcccucucuccuucguucuagguauggagacaugaggaggcagauuggcuuugagaucagagacaugugguacaaccugggugaguagcugggcaucaucuuggagauggggugagcaccuugaguucucucuguacugugacaucagccccauuuuuuaauguuggucucugguguguguguguguguguguguguguguguguguguguguguguguuagggucuauccaaugguuuuuagagcaggaucuaacuugucaaguugaccagcugucuggcucaucagggccuagggauccacuugucucugccuccccaucacuagggugacaaguaugagacccucagucagcuuuauauuauauggguucuggcuuugaacucagguccuccugguuacauggcagauacuagguccuauugcuaucuuuguaucaagugugcuggacuauggaggaguugguccuuggaccaugcacagguaucaguauagugcucuauaggugauauuacucuauaggagacauuguucuauggguaauauuacucuauaagugauguugcucuauaagcaauaucacucuaugggugacauuacucuauaggugauauuauucuguaggcaauacugauagcauaaacauuucaccugaggccccagcucagcuccugggcauagagcugcaggguaaaguuccauaguggaagugcagagcugucaaggaaauaugucugcuguagucauccagugcauguagaaccugcaccauccuaucauauuaggugucauaauuggagcagguugaggacccuucagggacauucucuauaggauuguaacaagaucacagcaagcuguuuauggaggaccugaguaaguccugguucuugggcguuucagccugcugaucucuguaacauggaccccacagaaaccauccugacuuucugcccacucugggaguucacaggaacccaaggguggacugaguaguuugcuaagucacacugaguuuucuuccuccacugccuugccuuuguaaccucuugucaugugacaugguccuucuccguuucccucacucagcaguccaguuuuuauguuauggagguugggcagaaguugucagaagacuuccaauccagacgccuaacaguccuaugacguggacauaggaugagcucagugcuaagagucugagucuguuggaacaaggaagggagcauccauggauaaucuuaaccaauuuuucugucuuucuucucaaaagcucaugcugaaagauccauuugucacuugaccuagacagcccaauagccaaacuaaugcccgacaggaaacaauguguuaccuaugagaaagagaguaaugagcagccaaggacccccgacauggacagcuuagagggacaccaugguucuccacuggaugacagguucucuagauccucucuagacccagcauucacaaaggagaugacaugaguucugucucauuugccagccugcacuguccuguuggcuccucuaggcauaggcuaccaugcaugaggcccugcacucagucugaaguacugcaaaagaagaggaaagaaaaggagagccugagggaccagugugcaauaggguggcucuuucuucccugauaaacucugggugcugucccaggcauccccagcaucucacuaugguccuguagugacagggucacugguuagaauagaaagaacugaucucuggccccagguauuauccagagauaauccacagauuauccuaacugauggauugaugagucuucuugccauuccaauauuuuuguuuuaauuuuuuuugagguuuuguuuuuuugguuuugguuuuuuguuuuguuuuguuuuguuuucaaugaccaugguuuauguuuuauaugcugaccuugaacuuuguacuucuuuuuuaauuuuuaucauacuauuuuaauuauauaauaauuuuuauuguuugggugugcuguuuuauacauguaugggauuuuugaaauauucauccccacuguuccuguugcccccucuuacuucugcuaacccccuucugccuccccccacuuucaugcccuuuuuucuuuuugggguuacaaagugaguuucauuaaggcucuuccugaagccugggugaggguuaugugcaccuugcccauaguuguaucccugaagauguuccuuccuccucuagcaaccaaacuacauguucauguuuaaguauagucagugacaccucugaagggacagagguugaccuugaaccugguccuaucucuuuccaugucauuugccaugacccccaggaaggaaggaaagaugagcuucaggaagagugagguucuccacagcaccuccucgagagcccccagucucaggugugugcccagacuuuucuguuccgucccagagcggugaacucucuugacagcgucugucauuauucucuaaacaagaugagcccagcaaugagauuucugauucaggauacugagaaggaagcuaacugagcaggaacaccccccccccccaaaaaaaaaucuucuuacucacuaaugugaacauauaacuaacacccaaguguuucaaagcuugcuugucagcaacaaacaucaauuugggcaugagaacaggcaggagaucaaacggaagccaugaccuuggccaugcuggacccuuccugcugugggucuucagguuucaggccugccugccaauggcacugugcaggcugccgcucuccaaacucacagcagccugucaugauuucccaggauauacacauccucuuuuccacauagcuuccuguuuucuuuucuuuuucuuuuuuuuuuccagugggcucagguuugggaauauguuggcaggcauaugcagccaguucugccaagaaaauaaaaauagaagucggaucagauguguuccucaccuuagaauuagucaccugucacuccaccagugcagucugugggcuuuggggagggaggggugucucacgcagagguacccagcagccccagggcacagaucggagucuccuugcucagugugguuacaaaugcagacccaggcgugcugggugggacagggcaacuaacccauuucuuugcagaacccagcaugucaaagagaaaaucagaaguguacucuuucaaaagagaaguggagaaaauguguucuuuuaccgaacccuccaguuauuuaugagugcagcuugguggcggccuacagggccaccucgucucccucucuccugguuccuucauccauuuuuguuuguuacguccaccucucaggaaccagcgcaugcucccugaugccuucugacugaaacaaaaagaugcucacggcgagaccuuucuuuggccuuauuuggcuugggcuauuuuucgugugaggaucucuuucccuguuauuuuuggggaugugcaaacugacugcuuuucauuagacccagacacuacgccauagcuggaggugaugaaagguucuccguccugugguccuucugugugcacaacuuuguuacauuaagacccugugcaguggucugauucuugaccaucagaagugucaaggcgaaagccugccuuucagaggaagccaggugcggcucucagaggacuuagugcuacauccugucacgagauuagacacuccagggaggucuugggggugcagggguuagagaauacaacuaggggaccuaagauacaaucuuucacuucgcaccaugguuauuagagucucaguuacuuuucuguugcugugauaaaagcaccauguccaaaaaaaaaaaaaaagcaacuuacagaagaaaggaucuaugucauccagagagagagagagagagagagagagagagagagagagagagagagagagagagagagagagagaucauacuguaaaggaggcaaggcagcaggcugcuggagcuggaagcagagaaaggagacuggaaguagagcaaggcuagagacucucaaggccugcccccagugauguacuuccgccaucaaggcuguaccucccggagguuccuuaacuuucccagacacagcugcugucuagggaccaagccuucaaaaagccgagcucugggaacacgucucauucaaaccaccacagucaucucgugcugccuuucucuucaaaggaaaagaaagccuugacgcucguugacccaccuccaguuccaucauuagacuucggccagaugugcgucaggagaagcccaaaaucuggaugucuaaaaauaauuaaauuaauaagagcaucugacagcccugcccagcuuacuaacucaaggacuguggacuugugacaguuccauccccagggguaucacagcucaaaggucucaggcuacuccagccaggugugcuuucuguacccaagggaagggugcugaugccugggguugcagcucuuauuuucuucuagcucaguuuuccaguagcugcuccagcacccucuugcucugcuuuguauguuccucccagcuuggaacaauaaaagccgagagugacagacagaacuuuaugacacugaaauuacaguugaugaacaacuugcugucacgaucuccugcuucucugaagcauuggcucugacaucuuuuaggcauaauacaaggaaaaugucaccugagaaauugaauauaauggcauuuucaggggaccacuuugcggcgcuugcacgccucucagaaguguuaagcauuaagggaaaugggcagaaucacaccauugucgcuucagacaagauaguaucuauuuagcaaagguugaaaauucggauucuaauuaaauucagguuccuuaucagagauuacauuuugguaccuguguccacucuauuaaaaacaucuuuuggcuuaugaggacacucuacuuucuuagguaugguuauuuauaauagacacauucacuuaaugauucucuugacagaaaucugcauuuguugagcuauaaagaaaaccagauucuguguuguguuucccgauugugucgaaguauuaguaagauuaauuaacuccagaucagcugcuaguguuaauaagaaaaugucacaaauaauucagucaggcguaucauuucucaugcacccuccuguuaugugcuggaaugagacagugcugguuagagugcagaggcuugaagagaaagggggcauucugcaaugaaggaugagagacagcugcccgggagcaccacucuugccucaucaugccccuucaggaggcuaguguauuagucaguguucuaagggaacagagcugagagagagagagagagagagagagagagagagagagagagagagagagagagagagagagagagagaauaugaaugaaugaaugaaugaaugaauguguuaguuaguuagaauggcuaacaggcugugguccagguaguccuacaauggcuaucucaugacauaaaggccaagaaucccauaguuuuucacucuaugaaacuaggugucuaaacagucccauagguugugcuggcaucccagggaggaccuagagagcuauuggucuucagucuauguuggaaucccaaagaaguagguucuaaucccagcagaggaaugccccagccacaggauggaugaacuugccagcaagagugagggcaggcaggcaaaggcaaaggcuuccuccuuaggcguccuuuuaucuaggcugccagaaugagguguagcccagacuuaggcugggucuuccuuccucuaauaauccaauuaaaaaaaaaauccauugcagauauucccaacugcuugaguuuguaguugauuccagauguuguugguugacaacagagauuaaucaucacagccugcuugccucuguguagaaaggcuccuagaagccucacuucugcacacgagcaggggcaugaacuaggucuugccacugcuuucuccccuugccuuccauggcucucaucaagcccuauguacacucaucugugccaucccccaaacauccugaacucagggaugggaaagucaaaguaggcuccguaggcucagccagucacugagcccuaggaaaccaccucccagugcagagaacacaaagggguuccaccgcaucuuugcuuuuuauuauuuuaaauucugaggaucgaaccaaggucuucaugcuugcaaggcagccccuuuaccuccugagcccgacaaagcucuucuuuacauaaaugccugccuaucgugcagcagcccgagauaguaggcucugcucuugcuguagucccauauuucagugggggcuuuuugugcucugacugcagucauucagaaguuacaggggugucaaguggaccacaccucuccaugccaccuuggaggcagggaaccuuggagacccacacucucccugucucagcuccugugagugucagauggggcuaucccagccccaguucccugcucugucugaguagcagacaaugaucaugucuuucauuuauguccuacaacuaccuucuugugaaaccacauuaucuggucaauauauagggagaucuuuucucaaaauaaacauccaaaugaccucucuauaggaacaauaguaaauauuauaguacguaguaucacgaaccaugcccacaggcgacaaguuuuuaaaauauugcuuuuuauuauuacugaaugugcgugcaugauaugggagaggagggacauggcauggcguguguguggagaugagggggucccuguaggacugguucuuucugccuaccuuuauguggguuccaggaucguauuuggagcuugguggcaaaugccuuuaccuacugugccaucuugcugccuggaaauacacguagagaauagugucucauugcuagaucaugauugaacucgaguucuauccacauuuucucccuuauguguauauauuggugugaugugcguauguguauggagaccagagguucacuuuaagugucaucucuucgugcccucuacuuuauuuacugaggcagggccucucacugaguucagagguuacuguguaggcuagccugacucuccauacugccccagucucugccucucauacauggccuccccagcuuuuauguggaugcugggguucugaacuccaguccacauccuuaccuggcagacauuuucucuacugaacuaucuccucagcccucaguccacacaugacuuaaagcacucaaaauccuuauaagcaagauugaguucacaaccauagaaacuccauucaguaucccagggucuguguugcuguguucuguguccucaacccccuuuugaaaauucuaccgcuucuuuuuaaaauaauagauguugcguuucuugauugaaaggucaacacaagauaaaauucaucccagaaaugguuggcccaauauuggaaaugacauugauuccugagacagagcuucgaaaagccacccuucccaucuucuucgacaugaugcagugugaauuccacuccacccggagcuuucaaaugguaagggcguaauguguaaagaaugugaagaccagcgggacagacagacaaacaaacaaacaaacagaagacacaggcgauuccagagcuaaaggugacacacgcaaaaacaguucuccacagcucaaagaaaacacggugaccauccuuacuugagaaucuguugucuucugucuuccugguugggaagggggugguugguuucuagcugucuucuauuguuuuuuuauaaggacuuuacaucaaauccuagacuaaagccccuugaggcuggaaagggagcuggauggguguagggcaucugcugugcaaacaugaagaucugaauuugaaucaccagcauccauguuuaaaaaaaaaaaaaucagagcauaggcaugcuuaccaguguugggggggaggucauagggcauaggucauaggucauaggacuguagcagugcaugggucauaggagcuugccagcuggccaaccuaacaaaaaagauaagcuuuggguucagugaaguguucggucucaggggauaaaguggagacugaaaacaugacacucagcauccuuuggcuucugcagauggggucugcacucucucucucucucucucucucucucucucucucucucucucacaaacacacacacacacacacacacacacacacacacacacgagugggugcacacauaaacuguaugugugugauuuuuuaaaucuuauuuuaauggggauauaacaguucagagagcacauugacccccuuccuugcccugggcugcuuaguuuccacuaccaaugaguguacugcgucccugcucauucacacagcuugaauucauauugaauguuuccucaguguacacacucagaaaugcaauuuuagaaucaaaacgcuuuuuguaccguuugacauuauugccaaauuguuugauauuauugcuauaagcuuugaccugccuccacugcagcugccucaaaagccuggcuccagugucacuccaggcuugccgaaacuauaaauuauaaucuaaaauacuuuuucccaggcauaaaauucaucacacuuuugaauuucguaugaaucaagcacaaagaaagacuugugaaaacugcuauuaaauuuaaaaccucagauaaauggagaaaagguauuuauauagaugagugucacaagcccagaaaacuaaaaucauaagccuugaaaaccauuaauaccguuucucauuuuuaaacguaaacuuugggucaaaguaaaggucaaggguagguuaaaugaagaugaaugggcuggggggagggugcgggggggggguuggcauuuccccucccuccucucugucuugguacccaguuguuguauuauggagguuucuaaauaucuuacaacaaccuucuaagccucugucacaugggacuuugagggcauacuagugaagcccacuguagccgggucucuucuguguuaggaucucccccagguuugauggaaaaugggaugaagucaaugggagccauaggagcaggugcccauguaaacacuccuuuugggcauucagacucuguccuuuguuuuuugcacagagcuaaaguuccugagucaucccacaaagaagcaaggcucccuauauccuagcucaugcucuauaagcauuucacugacuuaagacacaccucacucgcauuuaggcaaauaaaagcacagccccgaaccagcagauccacaaaagagacgguaccgguaccaggcuaagcacggcuucuucauccuccagcacguugcucaaaucucacuggcuguuccacuuguguagagacgcuggguugccuguguugacaacucucuaagugaagcaaaucagaagacagaaaaccguaaagcuuguagaagcagucuugugauuaccagcuuucccuccucgccagaacaaauaccccagauaaucuauuuauaaagagaagggguuugcucuggcuccguuugagagaguuucacugucaccagcugccccugucuggggucuuugguaaagcccuugaucacagcaggacuggagaaguagugcagcaaagccacccaucccaggaccaggaggagcugccaccaugcucucucucccucagaggugcaccuauuggucuacuuggccuagacaccucccaugcuaacgguuuccuggaaaccaggccucugucacaugggacuuugagagcauacuagugaagcccacuguagccggucucuucugugucagucuguuccucgggguugggaaaaaaaaauuaaugaccucugcuucucaggaagaugcccuauccaaaccuucccaucacucauuucucugcuaggauccuggccacuugguuuucugguauaagguaguuacuguggcuuugcuugccuucucugccuccugacuacagucauuugagaaaucucaccuugcccuuucugggcuacacccuucuccgugcucccccauaccaaggcucuccuggaccacagcacuuauccguugacuuccucugcccuucuagcacuuuccugcguucacucuggcaggucagcuuguucucuuaaagccgaagccaugaucccucuuccuuacuggcaaucucugcagauauauccugacugggugcaugcucagccaccaggacacagcuggcucagccugccucuccauccaggagcugcugggauggggaugcuuggcugcuguuuaacuaauccaccacaaaugcaauuaucuaaccugauuagucacaucagugagggcuuaaauugccuccacuuuuauagcagaugcacaaaccuaauggagugaggggaaggcauuagggcuuuuuguuuuucagcagcuuuaguguuuuggucacaggacgcagcaucuucuaaagauugcgcuuccacaguagagaaguugauauguugauguucccaaaauaugcauuguggccagguuaucuugaucacuuguaauuggaguuugggggcaaccucucggguucagggggaaaccucaacuuacucaagauuaaaugguaucuaaccaugacuagaguuuuagaagcaugugcuacaaauuguuuuuuccagaguugcccuugcauccccuaccccagccacgaugguaauguuuuauuagcauguucuuuucaaugccguuccugggagugcagaaaacuucgaaaaccgcuguguccuugcccuguccagccucuccaagguccuuccauuggcugggcuccuguggaaggaugacauagagguacccauucaaggaccacagccuccuguagccuaugucaugcuuucuagagcugcguuccuuaccucaguucacugagucaccgugauuucuucaguucuggacagaucucaccagaaccaugaaagucuauaggacccggggauguggcucaguagguagaguguuuaccuggcaugcacaaagccauggguuugguucccgagcacugaauaaacuagcauggugguacguguuuaaucuuuuggagguggaggcaggaggaucaaaauuucaaggucauccucaccugccuagcaaaauucaagcuagccuagaauacaugagagcauggcucaaaaaacagucuaggaaaagcgaaauaaggacaggaaggucuguagucucagugucucuaaugcuagcaaaugucaccaguuuauagcuaaguuguauagggacugggcccaaaugggugagucugugaucuaacaagaaggaucuuagacaaggcagaagcauaugaaauaagaggcagccucagguccuuucggaaaucccuccuggcuauagacauguuuguucuucugggccaggucagcagaucugcagcccauuggaaggaagacaucaugguggacagguugcuuucucccauccccaaaucucuacucucacucuuccucccugccucacaucaccuuugcagcauguccuucuccuccaugguugugggugcuccaaguagcagaggcaagagcacaugugagcgccucagcucagaggccuuucaugugucccugaggugaucccuccugucccuguagcggcugccauugacagagggacuccccugucaugucucugcccucucuacaugagucuccccucagcagaaauccuuuucuucugcaccuguuucaucucugacuguuaugaagcucugccuuuuugauccucucaguccuuuccaagacccucucacgaucagguuaucccacccaucugccuaagucauucacuccuaccccugcucuguggguuuccccuccaggaagucucuguccaccaccaugguaacauguuaccucaacucagcccuguuuucaugcuugugucugaauccuccuuccaccccauucugcgguaauauggaagaggugaggagacguccaggucuucuugccccauuugucacccuccuccacacacccggccuugguaaaaggaugguggaccaucucucagcauuacccugccuuuucugcuuucugacugagagccuuccagaggcacagccaucaccaucccagccuuaugcuguacuuuacuuccaaaacauaaaaaugaaagggggaaaaccccacccuuuuaauucuguccugacauauuuuuaaagaauuccguuuguuucggcuuuggaaaugcagcccucccagcugagagaaguguaagcaaauggccaugcagccugcauaccacugauaaaaaugaaugcaguggaaaaggcaaaaucauguucucaaucauggggucauuucaugucaucucugugagacucgguaaacagcuccaugaccuccagacacucccauuuaguagugacaauauaaacaggaguaaucuuggugucauccugaguuuccguuugaaucaucucccugugccaccccugcugcuuaccuuaagcaaauaguugaauagcccaagugagucaacuuguuggaacaauguuggaagcgucugccacuugguaaaaaagccaguacaauuuguagucuaguaugaaugugaguaagucuggugggaauuuuaucuuguuuauucuccaauucauuagggaguuguauuugcugacuuguuuauuuguguucuuuauuucaaaagaaaacauggccauaucgcgcucaaugcuucuagaggaaccauggcuuggggaguagauuugauuucauugaauucauuuccaaagguggucugcgagaucuugacagccaauaccuuugacuccaagaguucugauuagauugacuucuguucuuuaacgccuuccagcaaagacacacucaaccucccgugguccccuucaacuaaaucaaacuuggcucucucugccauuuccucagaguucacuggaacugugcucagaagauccucuucaggcuaaguugugagugucugcaaggcagcucagccagucggcagcugagccucccugcucugaggguacaguguuggggacucucaacucaugaaccggucacaggagcuucaaggucagggagcggccuccuugauagacaggaggaauaugaauguuguuuuuuuaauaugggaugaaauccuagagauuaauuaaguauguaauuaaguuuacgcagugguuagggaagauaaauguaaucuacauaaaaauauuagugugucagagcauggggauuaaaggccaagugacagacugaagaaucugucacuguuaggaucucaucaggagagcugggggacugaggcuucuaagcacccggcuugugucugcugaggcuucuucacagacguauuuuccaugcaggcucagucaaccaucuuccuauuucuaauggccucugguaaagcccgcgagugagguuguauggcuccagcagaacagccagcccuguguggagguggaggagacaaaagaggugaugccuuggugcucucugaaaccaggaaguugccaagcaccaggcuccuaccuuguagugucuuuucaacuuguuuucaugagaacaucagaggaaaguagagcacuuugggcaaagagaaauauucaccaggaaauucuuuugcuacuagaugcugcaggcuacacucauagguucacaaauuucaaccagauugcgaaaagcucuuagccuuuguuuguauuauuuacauccagaucucugugauuaaacaauccuggcuacauuacaggucugauuuuuauacauguauaaauauauuguaaugauagcaguaagacugguaagauagcucaguggguagagacauggcacaugcccaugauuuuuaauagcaguaaaccuaacccaaaauuauacauuucaaaugaauuaucauaggcuuuaagauuauccauggcugggaucccuauuucguagucucugaaauaguauucaguaacccauagcugacuuggguaguaauauugggaagcaguagcuuuuucuuaguuaauugaauucacaacaucagugccacuaaggacaguccaucguggccaguugcaaagcaccuuucugaaugccuuucccuggugaccucuuccauuugcuagucucgggaaaaugcugauaucagaggccugagaugcucuagucuguauuuuaaguuggcuacccuguggauguuuuuguagcaguauuugugauucagaaaagagaagaaaauauaaugauucugguugcuccaucagugagccuccaccaccauuugaguagcacaauaaacacacucuaauuuuaucccaaccacagagccccgcugccuguuaccauugcaggcugacaaggaacacaguaaacacagccuuuauaaaaaccagcccugcucuaucagcaaauggacugucuccaguuuaucgggauggggccauuuaauucugauuaugauaacaggucacaguacacuaacauauugauccucauauguucuguuaaaaaaaugaaugaaggcacagaagcgagaggcuagcugaagagcccugcugcuguagaccuugcugauauaggacagaguuaccagcuguuugugcaacuguucaaccucagccuggagguugguaaauguagagucagcuguacugcgaugcacuuacaauucagccauucuuucuggaaaacuuuaaauuccuuagucaacuucgauaagcagcauauugaauggcccaaggcuuccucaucuccuuguguguaacagcuaaguuuacacacggaagcgugugauuuucauaaaguagaagucacauuccaguaucuucugagugagaaaccauuuuaaauguuucuauguauguuugccaguguuagaauaagucuugcuucucugaauucucuauaccuucccaguuguaguccucuuauacauacauuugagcgcuaugucugaauucugggcucucuuuucugucucaacuacuugugaaucacacaugccugucacucccauaaucuuugacuucucagucuguuuucuccugaaagaugggauugccuugaaaugccgcuuaggggcuaauuacaagagaucucccuuguguuggaguccaaagugaauggccccacuugaaggaauccuuucuauaaagaagagaguugugagcuaguagcaaaagguggucauuucacagcaaauguauuuuccuuuuuugagacuccauguugaaagggaaaaaagcuaagucaaucucuuccuucaguggaaccaucucuguuucuaaaagccuugaacuucuuaagccugaccaucaaaaagugcuauuuaucuggaagaaaagugugagagggucagagagacugaggagaucauaaaggccaagguugcugggaggccgccaaguccuuaaugcugagcaaaaagcacccuccucccccacccuaauuuaugucugugcagcgggaugaaagugaggcucugagggcugugucaugauagggacaggagagccugugccagcccagaggcucuuccaugggcccugcuuucugcuucuccagagccuaccauuagcugccacugucacaguaacacuucccauacgccaugccaguguccuguagcuaguguuguggcucaaccaugucaccacuuggcuggacauggccuagagagccaguuguuucgguaccaaccagcccacucuuugcuggcauauugagcucuccugaguucugucuacuuaaggcucaauuacuugcaucccuagguauagaucacuguagagggcuugucagucauacaagaaacccuggguuccauccucaacacuccauaauacuccauaacacuccacuuauauagugacaccuaucuaaucccaacacucgggagguagaagcaggaggauuagaaguucuuccucgcuuauauacugacuugagauucuacuuuuauauacaugacagucaccaaacaaauuugccaugcccguggggcagcauauuuauuucaugaggucaacugucucaggcuuaucuccaagccucaauauggcagucacuaagagaggaggccuagucucaccuggcugucguucucauaagaaccuugccaccauaggggaccuggggauugcugcugagaacuggguguuuggacaucuuaaaagggauccucgagacccucacaucuaugcuauaguguucuugcuucuggucuuugaguucaguugcccauuucccucuugcucaccuccaauuguucagaguguggaugucuccaucuuuauaagaacccauacucuccuagccccuccugccuaccaauaccccagguuugguaaccuugagauucucugugaucugggugucaucuggcuaucagggaaggaaacggggagagauacuuauuauuaugaugguguuuuauuuccaaucuaauuguccccagaaacaugcugggaauuucucccuagaauuuagagauuuuuuuuuuuuuuuagaaauauaaucaguuaacucugacacuuaccauguccagcucuaggaugagccuggaaauggaccaucuaaagaugccugcuaaucucagcuucuggacucuucuguuuugcuuccacuaaucuuguuuggaguggagaucugucacggaguagcagugaaguggucccauggauguuuucagacugcccagaacacuaacuuagcaaaugaagugccaccuacuccuucccaggaaucgacacccucuuccacuuacugcuugucuguagagauaaaguuggguacaucacuccauuacgcuuugauucugucuccuacaauugacuugccuugacuuuccuuacguggcucuuauuccugcuacugaaauacaugcauucuggcuucauuaacugggagaagaagcaaagguucucucugaggcugugagucauuggaucucuguaagggcucagggacagcaucucugaaaugaaaucauguuucaaaggcagaggguaaccacccagcacugaccccaaagacguaaaugugacugagacccauguugucagauggaauaucugccaugcuaauuauuuacacuuccucuguuuaauuauaguuugaaaaugagaucaucacuaagcuggaucaugaaguggaaggaggcagaggagacgagcaauacaaaguguuauuugauaaaauguaaguguugauucacggugggauuuaugucaggagagagauggagagacuuguaauuagacuacaaugaacuuuguagcccagaaauaauuaaaauguguuaauaaugggaaauauuuuaaaccaugccucaaguuucuuucuuggagugugauuaacaagguguauguaauuauuuuuuucagccuccuggagcacugcaggaagcauaaauaccucgccaagacaggagaaacuuuugugaagcucguagugcgguugauggagaggcuccuggacuacaggaccaucaugcaugacgaaaacaaagacaaucggaugagcugcaccgucaacgugcuggugagcgaaaccuuaauuaaaccuucuaucuucacagcaugcugcaugcaaacagccagggcauuccagagcccagaggacaacugaccuuagaacacuccacagcacaucauagcuucccccugccaaaggugggggugggacguccucucuggugcugggaaggaagggcagagaauuaccuguauaucugagagcuugacucccuucugaauguuucacaaugucccugcugcggcugaggguggcaagccaucuaguuucauagccaaaguugcaccuugugaauuccagauaggaagacucuaccuuuauuugaucagagucauguucuauagugaguguucugaaugguagcauccaaaagauauauuucuccuucguccugagaauaugacucuuuuuggaaaaaggcaucucuccagaugagacccagauagcucaguugguaaagugcuugccuuacuaaucugaagcccugaguccaauccucuaaagcaugcauaaaaauaacccaagcauggugccucauaaccccagcacuggugcagcaaagacaguuggaaaguuggauuccugggucucagugggcaguuagcauagcccacugaguaagcuccaggccaaugagagacuccaucuccaaaaaaaaaaaaaaaaaaaaacaaagacagaaaacaagcugaggaaugaaugagagcuuugcucauccucuuacacucacacaugcaugcacaccccccgacacacacacacacacacacacacauaaguacacacacaugcacacugaagcuugagaugagauuagccugcgaugccuagguggauaggguuaaaucuauucaaaagaguucuuauaaaagagaaaagaagaaguuguguguggcaguguacuuagagaauggaggcaugaagaucaugaaaguucaaggcuagccucagcuauauagcuuaugugagaccaguguaggcugcauaagaccccugucucaguccaccaccggccaaaaggaaagcagacacagacaucgaagagaagcuaagugaauagggggcagcaauuagagugauaaauacagcauccacagaacucugggaaucucuagaagcuagaugggucaagaaacacgucuucccuagagccuucacagagaaugcaaggcgcuaacaggcaccuugacuuuagaacuuuaugacuaugaggaugucuuuguguuguuugaagccacccaguuuauggucauuugugagagcaccacagaacaauagugcaggauggcacagaugaaggguggcgagaugaauuugguuaugcuugaccuugcacuuccuucuuaaugugcaucugggaagagcaggaggaccagugugcuuuuaggaagcuugaugacgcgcaagcucaaguccaaggaguggcuaggcuggccaaccucaagccucucuauaugaauauacuucccaaucuggcuucagggcucucugcauuuucgugcacuuuugcuccuauaaggaaccauaauagcugacuauucucugcuucccagagcugucuguaggcagaaaugcaagacaauacuauuccuaccaugccuaacuuccuucacuauucuucccagucacuggccuugugauuucaggccaugacucagucauugaguagcauguaagcacuuggccuucacuuccauaucugccauuugugugacuugcaaguacuuugaggucaccagacuggaacuuuugugucaggaggaaugugauauagcauucauucuuuaugguguuaccaaagggguugaggagauggcccagugaguaaugucacuugcugagugaccaucagacccugaguuugcauccuagugucaacgaaaacucaggcagaguggcauauguggcuauaugcacagcacugugagggacagagacaggaggaucucugggccuuauugacuaccaacauaguucuagguucagugagaggugcugucacagugggauagagaacagcaaaccugacauucuucucuggccucugaacacauucaugggugcacacaccacacacuaacacacaguuacacagagagagagagagagggagagagagagagggagaacacacaugcacacucacauacacauguacacacucacauacauacacauacacuuucacacacacacuacacacucauacacacuaacucacacacaccacacauacucacauauaccacacacucauauaaucauacauauauuaaggaaaaucagaaagagcuagagaaauguuuaaagguuaagugugaauauugcucuuucaaaggaccugaguucaguucucagcacccauaucagaaaccuuugagcuuccuguaacuccagcacuaggggacccagugcccucuucuggccuuuaaggauacucauacauggguacaggcauacauacauucauauaaauaaauaauaaagaaaaucuuaaaaucagaaagaaaaaccugagauauuugaauaagaaaaauuaucagaagcagucauuuuacucucugcuucucugagcaucaauguugucucuguccugccaugaggaacgucuucuaaaaguccugguacagcacagccccugucugcugucuggacaagcuguuaaggcugaugacaaacauucugauaaugaguuuucccuuccauaagcauggggaccuaugaugucugucagugguggaaagagcaugagaaucaccuucccuugaacagcaaaggaagaaagugaauaaacuaaaaaagacaaacaguucuccuaacauccagcuucuuagacuaucaaguucuccuucagcuauggaggcaagaagaugcucaaagccacagcugcuggagcugacauccaggauaguagaaacccaggcuggacaucacuguccucucagcauaaaagaaccauccuaaaaacagagagcaaaauuugagggacagagaagccauccaucggagccagacauagacacgacagaggucucacagauauuggcccaggcaugucaaauaacugugggacuuagaagaugguucagucaguaaugaauuugaggaugugagcuggaauugaaaccguggguacaagagagggucaucguagugagaggugggaagaaagggcuuuucucacucugaaucuucuguugagucuccggcuguagcuggaaaugcccuuguuacugcuggccucaagggaaccugggcucauuugaaugucaggugcagcuccaggaagaaugggucuuucaauacagaacccugcuugcuguccggauagucuguuucagggagacuggcccucuugaucugugaggcugaagacucacugugugucugcuuuuacaguguuuguguuugccagcucccugggggcacucaugguagcguuuaaacaucauuccuagaugcuaaauuucaugaugaggagcucuucuggccccaucccuuacuggggaauuauuggcagaugauaacugugggggagggagaaucauucuuaaaaauaaguuaguuuaaaagaaaaagaaugacuaugucgguccuuguugaguuccugggcuccagcugauggcccuucucccaugcauaugugacagcauucauuagaucuaauggguucucuccaagaaacauaagacuuaauguuaagaggaggacauuuugggaagaauucaaaggggaaaauggucauuggauaugaucauguuucauuguaugcaaguaugaaauucucaagaaaaacaaaaaacugauauagaaaauaaagugacucucaugcuuccauccuacagacccauaugaguugacuccugcaccucuguaguguccuaugcauaacguaagguguagaaaguaguccacagggagacgaaacaucacuagguggaaaggguaaggcagggucucauggugucacucagacugauuugagaaucucuauauagccugugcugggccaaacucgugauucuucugccucagccucccaguacugccauauacguguacacugccgugcucacgagaagugugacuuugauguaaauauugagucagaugauauuuuaaaguaauguguagaaauagcccacuuaguggaaaucacaagcuaacuuuucuccaccaggguuuuuggacaaggggcuuuauucuuucagauugguuuccuuucuuccuuccuuccuuccuuccuuccuuccuuccuuccuuccuuccuuccucuauuucuucucuucuuccuucuuuuuuuuuuaagugggcauccauuuuucuuauacuguaguuuagagggccucucucuaacacaguggauucucuguggaauccauuauacauuauagguccauggaggugggauucggccuuaacagcagugacaguggccccuuguggaacagucaguguggcaguguuauguaacuaaugugucuuugccuuuaaauacacauggccagugguuugggaugugugaggacacgaauguccccaggcuucuccaucucuuacacaggccggccccaggaugugaagucauauugaugaugcuucuccuuccucccaauaguagacugcuuauucaaaugagacuggcuacagugguugagagcuuguguuuucaggcagaaccuuguccuuacugaagaugggugacuuucaaaugaccgauacagguuuaguccucaagugucuaaaguguuugagaugugauccuuacaaaagcaaaaagcaggacuaguguuagaugcucagagcucaggugaauugagagaucuacucuacauacacuagauccacugagugugccaaucauaacugaagcauggauuugcaaugaugaguuauuguaauuuugcuuuugcuuuguuguucuuuguacuguguuguauaauggagucagauuuuuuuuuuaaacaaugucaugguuuaauuuuuuucagaauuucuacaaagaaauugaaagagaagagauguauauaagguacguguaugucugugugugcauuguggucuccgagaugcauauaaaguaggugugugccuuauuggcuuacauccugugugugccacacuggacagcaccugugugugugcuauaaucgcugugcaguguauauaagguauguaugugccaagcugacucugcacccugugugugccuugcaaucacugugggauguauauaagauauguaauaugcugagcugaccaguacccugugugugagcuauaaucauguuacauguauacaagguauguauaugccaagcuggccggcacucucucuguauauguugguccccuaauaagucaugugaucaaaugagaaauauggugauaaauuuuccagaaguagacaguauaauuuugcagucuauucuuauuucccacgugccuaugucuuucucucacaaagaugaaaaauguuuuguguggccggcuggacuugauucuuuauuugcuuuuaagauacacuggggacauagcccacugguggaaaacuuaaccuagcuuggggaggaccuagguuugaaccuuaccaucauuggaugaucaaagcacuugauuagaauaacacacuauauuucucaaucacuuuucaggcuauguggccccuaauuagcaagguuacagaccaccuuauugaaugagguuagcuugucaccugugggacagaagguuugacugugugguagcuacacagaguguacuuugcaugguuuuggauuucuugguuuuuuuuucacuuuuuccuuuaaaacauaugauaugaauauaauaaacuuaggaaacaaccagccucuuugauccaaaaugugucuggcuguggaguaaagagcaucccuuucuuccugcggcacagacuuccuuuugaucaagucugcugucacugaugccuuuuuuuuuuugucuuguggauuuagaucuuuauggauuucuguacauaugcauuuugacuccagagaaaugcacaaucuagauugucuaaucucauuucaaauguuugaggaauguaacuggaaaagaugagagaaauaaggaacccugcaauaaaauucuuaccuuuauauauuauccacauuuuuuccuacaaagaugacuuaaaauuauauauuuguauauguauaugccaacauauacuuuuauuuauauaugcaugguauauaugucugucugcauauauauuauuauuauuacacuuauucguaucaguucuuucugugauuucuacaccaacaguuuuaaaggcauuaugaauuaugaacauaguaaaaagaaaguauagccaugaguuacuguugaaugucaaauuuaguaccuacagcccucaacacaaauuaccuugugaguccuuaagaaugcaguccuauuucaucaccagguacuuguauaagcucugugaccugcacaaagagugugacaacuacacagaggcggccuacacuuugcuucugcacgcgaaacuucuaaagguaagaaaaaucacuguacaugucuaugcagcucuucuuauaaauucugacuuuauuucaaauuuuccuuuuccaugacaaauuuuaguaaaccacuggcauaugguuuuauggguaugggcuacagucagugauagaaacaaaaauauccaagugcucugauugcagacucggcccagcuaaugccgaucuaacaaggugucagguuugcaaaccuucagugggcugugaagcgacugugacucagaacaacaucgauaauuaggaaugauccugguagagcagcugagaggaaggguacgucauccuccuccucacagagggcgcaagcagguccagacuuuucugcagagcaggucgugcugagcguuuccgugucggcuguuggagucuauaacguguguugcuaaugagcaauagcucgagaacuuucaacuucggugauuccuuuacuccucagcccacucuaagacguuggccuucugcuugugcugauggguuguguugucucugauguucaauuccagaauagguaguaauacaaaguagauccuuauaaaauagcuagaccagguggguggacagguagauggguggauuaguaaguaaauggauggaugugggaagagagagggauagaggcauggauggguggauguuggaugauggaugggggaaggauugauggauaguugaugauugacagauggauggauggauggauggauggauggauggauggauagauggauggcuagauggauagauggauggauggauggauagauggauggaugaaggcugugcggaugcaugaggaggugguggauauggauagacaggugaagagauggagaaacuucuaugcaacuucaaguuuuauauuuuagaaucuuagccagucuuugauuaucuuucucaugucaccuuuauuuaaaaaaaaaaaaucagaaaauucugcaugagauaaacaagaaccauuagaguguuuagucaaugacucuuguuugcaaauuaggauaaccucccaaacagcaaaaguagagugagagauaaugccacaagaaaaaaauuacauuaaaauguguguuaggagauguguuuuggaucaugggagucaaggaggaugguguuccagaguuaaacacacacacacacacacacacacacacacacacacacacacacacacacacacacauggcucugcagcauuugccuuugccugaagugagcaggguccuggcagauagaaggcaaagagcuggcuuacucuugcucccccuccacaauccuggagguuggaugccuaaggaccccuccugucuugcagccaucugaagcuuucccaaggaguaucagcuuugaagauagagauuucguggcaugccccuggaagcagccauuuccuuuguaaaguccgaugucuguauuuauuagaaauccaaaugucaggaacagaguauuuuugcaaaaugugaaggucuuguuauucacaccagggaaauuaaaacgguuuggcagacugcucacacucuuagaacauaaacuuuguaugucuguauagauguaaaauguguguguguguguguguguguguguguguguguguguguguguguguguguguguauaagcauuccauuugcuuaaucuuuggauauauugaggacagauggguuugucacugacugugugagagucuauuccacagccuagaucaauaggcucaauugcauuaucucuuccacugggcuccaaauuuuccaauuaaaugguaaaugaaacauaaucugccuccauauuucuuauacuguuacauuuugugauuuuuuuuuccuaaauauguuugauauuaucaaugugaauuugugcuggucaaucaacuuacuaaacaaaaugguuuguauuccuguaucuaugaauuaaaaagguucuuaaaugcaaucuuuucuacuauuuuuuuaucaaaaauaagaaugauuaaaaacaugaguguuuagcuuagcagugaauuuauucaucugcaggcuuacuauaggaaauaugaggaacuuccccauccagauucaaugugguacuuauaugaucugaaaucauacaauaagccuuaaccuuuugguccuugccaguuacccaaguuugguguuugcauccacaacuucuacaacuaccgauuguguuacacagacucagguucugcuugcagaugggaucuguaaggucaucuuuaauuugagcaucuuguagaccauauaaaggucucccagcuccuacccaacaaucguagggauagggagccuccagacugacagaguucuguuugagguagcccaaggcucuggacuuuaggaauguugugugccugggaguaaacaucugguuuguuaccaccaucaguggagccuaacuccccacuucuccaugccaguccguuuggcccuuuguucuaugucccagcaccaccaugauacccacugcuugcccagcucuccuugucugucaugcccuuaacaaaugucaucagagcugguccugugguuugacuaucccacagaguucacugggauaucccaugcucucacucgcauuuguuugggaaauaauggccuggaagucaguugcuucuuuguaagacccucccuguccugccguaacagagggucacauuacaccucacagauccaucugagaagcucauuccugcucuacccugagccucccaggccaccccaggcaaagucacaucucauacucuuagaagccuaugggaucuucuucagggauauuauaucccaugaugcacuugugugauagguggcucagagcuccagugggugagucuccugacacaucuugacccauaggcacauggaaagaccccaagaaacaucagcucauuguuacugaagcccauaacaacaaugguuuguuaacuuaauacugaggaguuucacaugcuuugccugucaaauggccuuagcuucuacucuucuaccucuucaguucacucaaaaauuggccagcacuaccacaaauacugacagaaccuaugcuagguagugggccuacugcugguagugcagagccaccuccuucuauaaagauagacuauggaguucccuucugaauggccugugauccacagacauugucuguuaagguuuugagugacuucugaccaaggagagagagcacucucauugcccacugagaacugucagcaaucacuugcuuauaguacacccuggcugccaggaagcuauuugcaagccuaggagcccgagcuuuucagggauuuucuauugggcaagucuggcucugccuucucauccauccuucuuguuaggcccuucagggacagguuguaccucuagcauuuccaggccugggcagucugauaacagcagcccuaggucccuggcaucagagucucauccccacacucaaugccugccuuagugcuuagugauauuauuuaacaugccccugccucaguauuguucauucauuguuuuuuuccacaguggucagaggacgugugugcagcucaccucacucagcgggacggguuccaggcgacaacacagggacagcugaaagagcagcucuaccaagaaaucauccacuacuuugacaaaggcaagguaagacacacacugucccuuggucucuuucauguauuucccccacagcacuagaaguacaauucuuuuuuuuuuuaauuagauauuuucuuuauuuacauuucaaauguuauccccuuuccuaguuuccucuccaaaaacccccuauccucuuuccccucccccugcccaccaacccacccacuucugcuuccugguccuggcauuccccuauacuggggcauagaaccuagaaguacaauucuuaacacacgauguucacagaacaagaaauacauuacauguugugucuggaaguauuuuauguauguuccucuggcucguacuuauaagaaaccccuuuauauaagaaaaaaacaauagcucuuuuaggaacucuaugaauaguaaggccugaagacaucugacuauuuugauagcucuuacuugaggaacuaggucuggaagagcagcuuagccaugucugugugcuuggagccuuuggcaucuuccauuuuccuauugucacugaaaaauuaacccugugacaagacgggcuuuguuccaccuuggcaguuuguagauuaauuggcuuaagcaaaaugauauauucaguugacuuuuucuaagggaaagcuggcaucauuuuaaucaaccgucuuacacuuugucacuuccuugugauuagauguguagucacuauaaaaucuagccacucuguuuaagaaauccuuaaaaccaaggugacuuccaagcuccuucugggguuccacugaauuuuuuaaucaugucaagguuguucugugucacucuagcaggaucucaaaaacagcugguguuuuauuuccgacuaucacuguugggacagaacgcuuugaacaguagaaacaucucacuuuucagugcugggacuccuagccuggggugcagguguaguggagcccagggucucuggaggccuuccaggaccacuuauggcagucauggugggcaauuguugguacuuguucccuugcagacccaucacccaacugucugggucuuccccaugcuuacagugugccugugucuauauuccuucuucuaugaggacaccaaaugcuggccugucagguugccccacccugcuccauagaaaugaacuuugucuaaagugccuauguccacacgaagcucucaaucacagauaccagggcuuaggacugcccaugucuuuguggaaaugcauuucuaccuacagcauccuguguuguacagaagaacccuuacccuuaguuguuauucacaggaacccaaccgucuuaaaagugaccauuuaguagauuccucugugagcacaagcucuggauucucuccacaucugaagucaucguauguuaucuuuuugcaugguguauguguggguugcugagaauugaaccuaagccuuacaugugcuaagcaagugcuuugcccuccaccguuccuucuguuaaccuguucauuucaaaacaccaggcugacuuugaacuugugauccuccuugccucagcauccuuggcagcuaggauagcaggccuaugccaccugucuucuucacacagggaaaaguccaaauucucuacucaggccacuuggaagguagguucuucgugacccuaugguagacuagcaggauguuuagaagcgaggcuuucaccauugggcuccccuuugcuuuguggcucugugguaugcuggggaaugauaaccaggcacugggaagcccaggcagagaucccaagcaggaagccuaaggaaaacaagggucuaccacgucugaggagcacauggcuccgugggcagccagacucaggcucuccaugaaaagcacagcucugaacggucuuagacccucaguuucucuggcuuugucucccucucuuuccccucaccuuacucuguguuucugccauacuuguuggagucuggaauauaccagucuuguucugcccaaaagcuaucuauuguucccccacacacagcucuuucuucuccaucucagccuaaaugucaccucuuccucgccccugagucacccucugucuuucuuuggaguccuuucuuuaauuugcuacaggaaguuuacauacaugcuucuguagccucaccgaagagacugugagcacuggaaacagaggcuucucuuauuucuucucccagcaugccuaaugcucagaacagugccugcugccugcugcaggcucacuggggggggggggggggggggggggcgggacacgacucacuuuccauaggaaugagacagaagacagugagguuuuguuuuuugguugguuguuguuguuuuuaaugaaagauaaucuguuaacuuucuguauacaauugcucaucuuaaaaaagaaucaacaugaaggggcaaaaaugaaugcagucaguuuggaauguugguauccgaucuuaaucagcaagaacaccuugcucucaugagugagaaccagugucacuagaagucucauggcuggggcugagcauguggggcugaguuucccauaaugcacaagguguccccagcacagagaacauccagcccagaaugucaauagugcugagguuggaaagccugcuuugagagagaaagagagagagagagagagagagagagagagagagagagagagauccaugugacaaaauaguauagacaaaaauggaaaaccagcagaggccuguccccagaugucccuauguuguggaaacagaaagaagaccauggugacgugguccauuggcugaccuugagucagagugagcuugggagggcugcguucccagcugccauuccaguuguauugauaaaacaacaagauuggaaagccauuucggagugccugcaacauuuccaccagaauguuaaaaaggauccaguccacccaucuacacgagucuacaacacagaugcuggagagaacgccagugcauagggcaagcagugccuguguaaugagcuggcagcaaagggcucaucuucauaucaccaagcaggauguguucuaggaagccauuaucuuuuaugcagccugggaugggccagaacauucuggaguuuugaccuggaacucuccagaguuccaaacaacagugcuccacuucugcucagacuaguggccaucucccugaacaaggcccaggaaggcugcccaucugcucagguagaugcagcccaggaacagauaggagggaguagcuucccugaacugcuucucuucuugucuucugcugaggcaaaccacauggccauacaggcccuccagggaugggcaagggccuaggagaacaggacagcaugaggggaaccuacucccaucaugcaccacggcacuugaucagggggaauucuagguaauuguguucucucagcacauaaggcaguuaaucucuccaucucucucugucugacucucugucucugucucucucucugucugugugugugugugugcgcgcgcgcaagugcgugcgugcgugcaucugggcccacauacaagcccccagggguguccucuguuucuauccacuuugagauggggugucuccaugaccuggagcucacugauuggcuaaacugaauggccagaaagccccuggacucccccugucuuugccucuccaggacuggaguuauagauacacagcacaacaccuaacauuuuaugcaggugguaggaguucaaacacagaucuuucugcuuguucagcaagcacuucacccacugagccaucuuguccauccuagaaugguuaaucuucacuucucccaagugauacauguguucuaagaaaacuacuacacaucuaauggugugacuccucacagcuagagauauaggaacugcuaucuaagagaacuugacucugguguucauccuggcuucucugugacugauuaccauucuuccauuugagugauccugaaaggcagaccuauauaggaaaaguguugcaaaaugggucccgguguccugugaggucacaggguagggguguagcauaguagguguagacaguuugacacaauguucaagauuuugacucacuuucauugagggaacaagcuagacuacauaguaauuggagaaccaauguucuucauacauuucacucucauugacuuuguuguauuguucucuuuuugucaacuugacaaaggcuagguucaucugaaaagaggguaccuuaguugagaaaaugucuccuuaagauuagacuauaggcaaaccugcagggacaagacagaagcuaaggaaaaaggagaggcugcugcaggccacugugguggugacuagcauccaaggaacucagcagcagggcuaggaagauggccugcauguuauaugaaaacauuucauaucggaccugccuugcaucccacaacacacagaugaaaagcacgggacaaggcugcgaccuguaauccucacacugggaaagagaaucccaggagcauuuccuggcuuccuggccagccagccuagcaaaacugggaaagcuccaguuucagugagagaccuucucucaaaaacaaaaccaagguagagaucaauagaggaaaauuccagguacacacacguacaugcagguaucuguacacaugaagugcaaugguacuuuguugacuguguuggcauuuccuggaacuucccuuaauauuugaguugagaauugugguccucaguagugcauuugccgaugcuguccagagcccaccaccgucaguuuuuauuuccugggcuuguaaggacuagucacauuaucucccggagagcugcauucuugucuaccucagaggaugaguggcucccauuaccagccacccaccaacuccucuuaaguccugccucuacguucuacuugauucugcguaagagcauuggguuaucuauuuugcucccugcucugaauaauaaccugacaaauuagcaacaauggaagggagccagucccacauggcaggggaggcauagcagcagcauaaggugacugacuggucauucuacaucuacuacacccaucgucaggaagcagagagaagccucaaggcccaccugcaaugauucacuuucucaaacaccauacagauucaucagcuuugccagaacagcaucaccaucugaagaccacaugagccagugggggauuguauuagucaggguccuccauacuuagugguccucaaccguucuaaugcugugacaauuccuccuguuguggugaccacaaccauaaaauuauuucauugcugcuucauaacuguaauuuugcuacuguuauuaauuguuauguaacuaucugauaugugcccccaaagggguuacaacucacaggauaaaaacuauugcucuagacaaaccgaaccaauagaaugaguguauacuacuaguuggaggcuucuuagauuggcuucaggguauauucaggaggauagcccagcaaugcuauucucauaccacagaggcugagacccccagcucugcaaacaaggcuggaugccugaagaaccacugaucuucaguucacacuggaagcccagaaaagcugguucuaauaucauggaaggaaucagcagcaggagcaacaggguagcugagcucagcaaugagaaugaagaucaaugggacagaagagcgaagcuuucuuuccuccaugaaauuguaucuggucugauauguuuaagaugggaauuucugcaauaauggaggcaaucccucacagacauggccucaggucaaccugguguacagaccaucaaccuguagagaccaaaggacagcuuguaggaagaguuguccaugguaguuguacaaccauguggauucccaggucaaacuccugucuuuaagagaaggcaaggaccucuaccacagagccacgucaccacccuuaaacuguguguuuuuagaauaguuuagauuuacugcaaaauugagcaaaaagugcagaguuguccuuauuccccugccccacaccccaauacuugagaguaucaacacaaucaggugggguuuuuuuuugcaacuaaggcccucucuggccacuguuggagcagcaaacaccaugggaucaaagaugcugccaucacuuagguacgccgugaaguuccucagacaaguguaugaucuugcuucuugacccugccucugagccccagggaggccucaaaagcaucucuccucuuccccacacgugacaccgcaucagaagcaucuuugccccaucaguccucccaugaauauccuagccgugcaugcuguuaauaugcacguccugagucuuguacuaacuuggcuccauugcugcccccagcaccgcauucacucacaguagagguugcuaaugggacaaagauggguccuugcaagagaagggcuggccauuacuauacagagcccuguuugucugauuaaaagcagccaccuucagucugagucgagucagcagcuuuuugagugggugagcagacaaacacgcagagggccaugacacagauaagauuugccaauggcacucauagccuggcucuugugucccacuuaaaccucaagcaaguuugaucuugcacguagacaugcauuuuuaauuuuuuauuucauuuauucgcuuguauguauacaugaguagaacauuuaaauuauuuuuaauggugugauaagauggaaaugaaaugaaaccucagucucaccaaaccuuguuucaggcagagcucuggauacagcuugacaucuugggucugguuucccuugcacuuaaggaacucuucgcucugugcuugcuauauggacauggcguaauaaagccuugaguggcugcacuguugggacuuggagugcuaauauggggaaagucaggcccacagcaucccaggcagugugacuuagagcaggguguugcuggcagacuaagaggaaggcucaauucucagguccacagcugugccugguugccgggaagcuuuaacaagagggccugggcugaggcuggaaucgaaucuaagaaagccuccaucucuaccuugugcugugacaccagcaaggccaacagggguucuagcccuuuguauugggcgcguuuaccuguaaaguaugaccuguuaguuuucuguguuucuccuauacaaaaucacucuucuauuuuugcuuuucuuccguucuuuaccguuuugaaugacuuucagccuagcaguuggcaucuuaaucuuuuuccuuucucuccacaaaaugucauuuccauucacucucauuuucauucuccaacauuucuuccuucuacagcccaacaauuacugcagacuuuuuucccauuccauuuuuacccccaccugggccuuucccugcaaaggccuccauucgggcuuuaucugggaagcgagcguucuuuucugaagcuguuccaaauugucugucuuauuguguuuggcugaggccuaguaauuuucaauaaagcccuuaauccaaguacuucacugaaaauuaccaggcuucucuguggaggaugagaguugaaaauagcagccacacuauugggagaauuuacaguagggaugccaguccuccccaggugacuguggcucucaaucucucaaguccagacccugcuggccauuaacaacgacgauguauaauuuacggccaggaugauguguggagcccugcaacgguuuuuaauugaauuuugccuucuuuacaacgagaucccauugaugaaguucacacuuugccuugugccaaacuuggggggggggggggggaguaaaaaaaaucaaaaccaaaaugcacacagccuacaucgucugugagcuguaaauaggaguuaggaaguguguuuccuuuuuguguguguaagagagagagaugguuggauuuuguuucuaaguugggugacauuuucacauccugugacauucauucccuuuuagaaggccuuguggaacccugucagaaguucauuuucaggcuuugcaaacucacagugugagccugagucuaucucaucagauggaaucucugugggaauucaggucucugagguucuuugggauuugacacuauuaaaaggaauuaacuuuugucagagcauuugagccaggagcaaugcugucugucacacuuuagccuguaggaucacagagaaauuucuccacuaacaaaccuacugugugcugcaggccacucugcacccugauauacacaaacauaggcagaguugaccucaagggacucacggccagcaucagaguucucaaagaguaucuacauaaggaagccuuccuugcccaugugacaccgguggacauagguagaccuaccucacaggugucaguggucccuuguucagauuuggggaccagaaggauguuaacugagcgugacggccuccugccgguccugggccacuaggucccucuggugcagaggggccucaagcagugcugaggccucuuccacaacauugauccucauccauuaaacaccagaaagcugugugggacucuggaaauucaggagguaauugagugugacuauucccaauaacugccagggaaaacggaugagcaguaaaaaaauggccgaaagucaggcuucauauaaaacaccuuugcuagggagcugcucgcagccaguaugugcacuaaaccaggguugcccaugggaguccuggugaaucagccagugacuguccuuucaccccuaaugacaucuccuucuucaucugcugcugaccugccauccugaagugucuccaucccuguaacccacaucaugucugccugagaaaucaauaccugguauauucucugccacugugugugugugugugugugugagagagagagagagagagagagagagagagagagagagagagagagagagagagaccuccuugacugccaccaucuugacacugagaaagguguuuuauuagaaaagaaaguuuucugggugcggggcuuaaagaaacggggagcuccagaaccaaggaagacaguaaagaucaccaucucaggaaagggggggaaccuaucccucagggaagaggacagaggccaaaugugcuuccccccccccaccucccccagacgauggcuaacaauuccccagauaccauaaacuggauuaaagaccucagaucagaaaauaaaguugucugcggauccaggcguuuucauuuggggcuguccaagccugcuaagcccgcagcucuuguaagaauggaacugagcccgaguucggucaccaaaggucaaagcgauucuuucccugagacaaucuaaaucuagaucguauugaaucugcuuccucuguggcacugaaauauuuuccucagcgcucguguuggaaguaugaacugcccacacucccuguagagcccugguccaauuaaaaauagaugaaaaucugcccaguguggaauccuuuaacacaaguggaggggcauggacgaggggggguggcuuauauauuuauagaaaaucugauaggaaacacagccaugaaaccucagggugagcaagaacagauauuuacucgagaccuauauuucuuuuaaaaacaauuacuuggcuacguaucuaaaguaccucaucugucauuuaggaucaagacagauuaagcuuuugcucgggaaugagcagcugagagaagguauauuagcuuacagaaacuaaggaacaaucggcuaaaggagaccuacaaggagcgggaauguggucuuugaaguggaaauauacuaagggaggcaugggugaguggugccuagaacauuauagcggagaguguucugagcaugugaacucaggcuccggaagaggacacgaaaggucuagagaggcagauguggguacacagaggauguaaaagaauaucagaccaaagagagcagugugaagugacuccuugaccuggggucccugucgccuccucuauuccucuucaggccagucuaccuuaucugaagcccacaaggaaccuacuuuuacuuugcucuuccgaguauuaaaaauacaguccuuaauucagagucaccuuuuuauuuucuuaccaagaauucccaguggcguuggacauaauggcacacugcuggcaucucagaacuugggggguagaggcagaagaaucgggaguucaaaaucauccucuuguauauagugaacuggaggaccccgucucagaauacccccaaugagagaaagggggaugguuuauaaagcaguaguaguagugcugcgacccuuuaauaccguuccucauguugugguggaccccccaccaucaccaccauguuauuuuguugcuacuucauaauaauuuugcuacugucaugaauuaugauauaauaugggaaccccccccaaagggucugagccacagcuugagaaacaccaacuaaguccuugucagggagacauucccccagcaggucuucaucuuuuuuucuuaaacuuuuuauggauucuuugugaauuucauaucagguccccagucccacuuguucccccuuucccuccuaccucacccuccuugcaacauucccuccaacagaggggggaaaacucaugguggaagcuguagugugucccacagcagacccuuuuguccacacuucuuugcuugcaaauauucauugcaaugacuugcuggucugguaugaggccucuggcuucugcuacucuaucaauacuggaagcucccuggaacucuucucagacaccuuaugguugcccguguccuagagauccuggagucugggaacuguaggaccugccccuucauguuuuacaucaggucacugauagaguagaaacugggaugggccaacucaaagcccuggaucuggaccugaggguuaucugagcugguccugcccucagggucagcuugccagccauccccugcuaccaaagccagcucuaccgugcugcccaggugaggugcagggucugcuccccugaguguuuguaucuggugagggacauggccaguucuuucagucucaugaaccugggagcggcucuccugccugucauaaauggcacaggaugaggaaggggaggagagcaucucucccuuauccuugucaccgaccugggaacaagagacagaacaggcucucuuguacucaugcccgccagcuggcucaccgacauacaacucccacaucuggggccagcucugcuguaccagggaagguacaggggcugcucucccagauguugccccaggugggagacaggugcagcucuccugcucucaugaccccaggaucggcucucccaccugguagguggcaaggggcaagagugagggaguuuaucucccuugcccacacugccccacgacagacaaguugaggggccagcucucucaugcucacacccuuaaggaaagucuccaauguccuaccaucaaggucagcucuacuguacugcccaaaugagguacagggcucugcucucagggccccaacugggccaacucucccaccugggggucaucucuuccucucuuccuugccuacaucaccacaagacagacaagugcugaggcuagcucuccuaaacccuuagaccagcacaacccuuccccuccaagggucagcucuacugcacuguccaggcgaggugugaaugugcagcuggugagggguagggcccuuucuccuacucuuauggucccaggaccuauuuucccaccugccacagacagugagggucaagggggaggaggguaucucuucuucauccaugccaugagauaucagugguagggccagcuuucccaugaugucuagguaagggggauagggccaguucuacacagcccucagacaucaacgugucuguagauggcaaccuagaccagggacaucugccuggccuuugauaacagacuccugcuacugcauggccacaaucucagacacaggccccaguggaaccacaagucaggacacacacacauacacgugcacacacacagguggcaucacuggcuacucacaucaggcucuuccucacuacccucgagucuucaguucuaccucucuucauuguaccacauccuucugcuucucuuucucuuccauucuuccaccauugcucaucuuaguggcuccuggggucucugagugucuguggucaucucagaaauagucucaggagugcucugcucugcucugcucugcucugcucugcucugcucaugcauuauggugccaggcaggggucaucucagaguaguuccuugucuggaccccauggugccagucuaguggucaccuuaggcuugcaccuugcccagucugcccuaguggccucuugugaggguccucugucucaggcucacucccaccuagggacugaagucccaggugggaugcuucuaguuucuggcuuucuucccauccugggagccugucugagccugucugguaccaggcuaaugguaaucucaggcuugcuuuuuuucagggaguguuaggcuacuuaucauucagauguucccaggucagaacacugagcauagacauagccucucuccucccugcuacuacuuacugacucacaugugacagcagccauaccugcaaugucucuaggggcaggaguccucaucuuuuucuagcuacugguaggcaagaaugaguagcucccaugaauauuagugcagugaucuccuagggaugauagcauuguggaaauauagagacaugaggcucagauuaguuuguuaggaauugucggaacuuuaguuuccugucagccuccuguucuguguacugagccuugaggaauagguagcuauguccucagcuuucaucugagugacacccagcccuugcucuuggggaaauacaaucugaggagaaaagacaaccauguuccaguuuuaauacauuaaagaaaguucugggucacugaaguccaaagaaggagagugggcagcaagugggauccaaaugucccaugcuucucaggcaauucaucuuucccaaggaggagccaggacuagcaucaaacuacuauguucaaaacuuuauccacauuaaaaaaugcuguugcuguuguuguugcugccccugcugcuguugcugcuguuaaugaugaugaugacaucgauggugaugguagugaucaugauagugauaagagcuggagugauggcuuauccauuaagagugcguucuauucuugcagggucccaaguuugguucccagcacccacccuggacaccuuacaacagccuauaacuccaucaccucucacuucaaacgacacuggcacuuguguguguguguguguguguguguguguguguguauacaaaauaaauuaguaaaauaaguaaaaguuuaauccauguuuuuaaaaguaagccacuugcagaagccacuugccauaggaaaauccccuuuucaagccacuugccauaggaaaauccccuuuucaaauacuggcaggauuugcaucugcaaaaagcaagaaaagcaagcaugaugaagcuuuggcagugugcauucuggaaccugauggcuaugcagugagaacauuugggaaguugccacauaguagauguuccucacuaugcaucuucacccuguggugucucuucccuggcucccaggcugcccugacagaugguccuuggcggccauugcuggcagcaggagaguggggacgagugaugcuggaccagcagacgaccaugccagggaagagguggugugauggaugaggcucggguugagcacuuuagucaagacugcagguccugagcccaaagcuggaaccucuagaaaacacucauacauuuccugcaugauuccccagcgugccuguuaaucucguguauuucuggauguuucauuguaaauaaugauuuuccuguuuggcuugaugcguaacucaugcuuggaucucucucucucuucucugugucacucacagaugugggaggaggccaucgcccugggcaaggaacuugcggagcaguacgaaacagagauguuugauuaugagcagcucagugaauugcuggucaguccuugcuuggguuugcgguuggguuuuuacuuagauuucccauucgguuuucauguugagacccaccccagauguucuuuuggcucugaccugugccuucuuuauuguccugggaaauggcucuccuuuaucugcugguugauuccagccucugaaaauucacucuuuauucucaaguaggccaagaaguuaaaccugguaucgguaaugcauaacaggugcuuacguccuaaguguaggggucuuggcagcccagagucucugagagucucagcuaguuuaaagugcucacccuuuccacaagagaggagauggagaggugguggccagaaccuuucgaucaugacauccucuaaguuuuuaguuacugacuucucagccaugccauaaucuaccuuuguuuauuuauuuauuuauuuauuuauuuagugcacagcaggccacguuuaugaccgaguguuugccuaugauuuagagcagaauaagucugucuuucaaauucucccagugucugcucuaucccccccccuuuuuuuuuaaagcaguagaagcgcagggaaauaacuuccuuggauuauugaaaauccccucaacagauaacuagcgaccaaguguggccuguuuagguuaccuugcugaacaacuugaaaaauaauauccaaauugagauucauccagguccaggccccaggcccccaagaagaauccagaaggguggaugggugcuccaaugcucugugcaacccugaaaugaguuuucauuuuacauuccagaaaaaacaggcacaauuuuacgagaacaucgugaaggugauaagacccaagccugacuauuuugcuguuggcuacuaugggcaaggguucccgucauuccuucggguaaguuugaucuucuugcucugaaccagcgucacucgcucagcagagagacaccuuccggucuuagugcuuuacagagcagauguugacucugggaugccagagagggacgaaaaauauuuaauuacaugaggacucuggauacauuuagagauuuugugugauuuuuuuuuccugaaugaacucugcucaaagauuuguauauguguuuaguuguguugaaauauacauagcaaaccagagagguggcucaguaggcagagcacuuggccaaagugcgaggaccuaaguuccgacccccagaaccuauacaaaaccagauucaauggcacauauccacaaaaccagcacucuaccaaaagauagacuguagauacaggagacccucuggaagcucauaggccagcuagucugguauauaaagcaauaaacaacaaaggggcccugccucaaacaaaguacaggauauuaaccaauacucguggcuccucucaucuccguaaacacucuguggaaugcgugcacauuuuauaaaaacuuuagugucuuuaugugugccccacauguaugaaucucaaggaaagaaagauuaaccuugggcuugacacacucaugcucauggggugguagagucuggggcccaggcacagagucccccugugauacaggggccaccaaccauggcuauaguuaucuagcuccaccagcaaggcagcagccugacugagcgugagauguaaugccccccaggggcacacugcaauacagucugaagcacuggcgacugcaggcuccagggaccguccugggucacuuccaccaucaaaggacagaauauaaaguaagacuaaagaguuuaaagcgcuugauuaauauugagcugacuuucccgacacaccugaauaacuccguggggcuguagcaauauauccauuacgcuucacagaucgccuggcaggggucagccugacaaugacauuaccaguuaccaaaaagugggcggaauguuuagcagcgucaagcugccgaagagagcagacgcugagcuaucugccuguccccuuggcacuguuucucuccauaaaucgagcucauugcuuuuuugcauucuuauuaauauuuaucauucucacaaggaauaaauaucucugacucuauguacauuuccuccauuuucauguuuggaaggacuacugcagaaugcaaaauaauggacauuucuggaaaauauuauuaguguuuuucgucuauaacucuaguguuuuucuauuaaagccuuuauguguuuuuauuauugugccuucuucgaagguaaagcuuaauaaaugcaugcuacuuucugaguggucugcucucuaguaaaucuuacggcauuccugaaauguuuggcuuccuagagccucacaggaggcccagacucuguauuuauauuucuaauuaagacuacauauuacuuuccuuucugcuugacauuuuucuuccagaaaaaaaauagggcauuuuuuuucuuccauaaugauguuucaagccauaccuaagcacaaagcaggggagaaaaaucuaauccuuaaacuguuacuuccuuuguaauuuguuaaacugcagaauaaauugggacuugaaagggggauuguucagguagguuuggauuguuauaacaaaacaccuuagacuggguaauuuauaaacaaccaaaaguuauugcucauagaucuggaggcugugaaguccagggcaagggaccaguugauucugugucugaugagacccuuuaggguaggagaagaaaaauucuggagaccuuagcagagcuaguucauucccaacacacacaaauacccaucagccauuacacuggugacuguauuucaguguuuaaaggguaaaaggguggcaggguccuucaagccacaguaagggcaggugucuccccuuaucugugugacagcgugcugauuggauaaguuuuuacuaauggcugagucaacacagaucuaagaguguguggcaaaaugcuguuaccucugucccucucuucuccucucacuccaucuuccuccuucucacugccaccaacucauaucuguccauggacagcuacugauaaggcagggcuucaccuagcaucacuagcugaugcagacaagucuuccaguagauagcagaagcacaggaaaggacugggcaguuggagaggcggcagacuucagaugacagcagcgaugucauguuguaaccgcugacaccuguuugugacugagaugacaugccgaacucucugguccuugaagagaucuguuauauaucucaggacccuuccuuccagauguauguaguguggcugcucaaacccacagagaguguaaggggagugucaauucaccuacgcacauaccagagcuaccuguucuggccuaugcuaacagcuuccagcggaaucuagauuggagaacaucacuugaaaaugacaaaagccaguccuaagagaacugcguacaccuuguagcugcugaguaaggaucuuacagagcucauccugccagaaggaaguccuaccauccacucauuucuaggcuucaggaaggccaggaguucagggucuuccuguuuggccaggguccccuuuccuccaucucugcugaccuccaugugaccauggaccaggucaggaucugaggaccuccccuugguccugugcagagcuguauucuuuuuuggcagaggaaugaugacuuaauuagggcuacaagggggaggcagcugccacuggccgcuggggucucaugccagcucuuuccugugucuagguagccaaucaacacaggacccaauucacaugagagaaacauaaaaacuaauuaauuuuauauauacauauggauuuucacaagagaauacauuccaacuauaugaccagaguugacagagcaaugaauuaacaaaauaaaagcaagacagacaacgggauagaaacuucugggaauguuacugacagaaauagguaggcgguuauccagguuacaguggaguaugaaaggcuccccuaguaagaauccguuuacuuccuucaaaaugaaaguagaagcuaauagauguguuagcacaugccuuuaauccuagcauucgggaggcagaggcaagaggucagccuggucuauacagugaguucuaggacagacaaaacuacauaauagagacucugucuccaaaaaaaagaggaggagaaggaggcugagcaacuccuauaguggccacagucccaugggggaaauuuggcuuuaaauaauuauauuccagucagcauauucuuaaguccuccacauucaccugagaagaaaaacaaauacuguuguccacacacacuggcuaguuaacccugugugaacaugugugggaguccugugccuugcuugauuacuuacuacauguauuuauauaauaauagaacuuauugccuacuuguguguguucaugugccgggguguggcuguggaggucagaggacaacuugugggagucacuucuuguaccaugugggucaggcuuggcuuacaaggaccuucaccugcuaaaccaucccgcugcccaccuucacagguuuguaaugaguccuucuuacucagaguaaagcucacagugaguauucagcgggaugaaguuuggugcucuugaugagagaggagaguuguuaguuauucuuaaaugcagugauuuaaaaaggaaaaacaaacuguccaaaacaagcaacaaauaaacaaaacugucaaacguaucugaagagcagcauucugugugugagcuuuucucggcccuccaccugugguguauuuaacaaaggucacugucuccagggcaaaguguucauuuaccgaggcaaggaauaugagcgacgggaagauuuugaagcucggcuguuaacucaguuuccaaaugcugaaaaaaugaagacgacgucuccaccgggcgaugacauuaagacuucucccggccaguguauccuuuaaggcagcaggagggccauucaugggaacaugggcgcacuggugcacacagggagcagggcuucucuugguugucaugugugcugccaucuuccuucacccccuuuccucagacauccagugcuucacagugaagcccaagcuagacuuaccuccgagauuucaccgacccgugucugaacagauuguaagguaacuacgcuaauuuucuuaccaauaagaggcagcaagauaagacggacgugguggcgcacgccuuuaaucccagcacucaggaggcagaggcaggcggauuucugaguucgaggcuagccuggucuacaaagugaguuccaggacaaccagagcuauacagagaaaccaugucucaaaaaaaaaaaaaaaaaaaaaaaaaaaaaaaggcagcaauaugcugacggugggugucuugcuaaucagucuaccuuuugaaggguagguagacuuuaaacuuugaagaacaugcuagauguuucuucuacccucucccaagaacaaggaaagcuagcgauuucugacacccaccaaaaggaaagaaaguuauuagaggggcgcucaggauuguuuuuccagcgucugcaaagaugaaacccagaaggaaggaaguaggccuugggucuccuuagagaccauacauucaggguaaaauacccaacaguguucaaagccaacccucgcccuguccuguggagauuacagacucuuugccuuuuaugauauggaagcagagauuagaguauuugcuccccauuaagaugcaaaacaguccguuugcacuggguuagagggaucauuccuuugguaaagcacggacuguaagcaauuggaccucaguuuuauccccaguacccauauuauaaacaaacaaaccaacggaaaccaccagguagggugcuuuuugcuuuaacccagaaauggcaaagugggaagccaaaacuguggagucccuguaaacucauugggcagcaagcagagcuacugggugaaguuccaggcuuuugagaccuugucucaaacagaaaguggaaggugccugaaagaccaugccaagggugguccucugaccucuacaugcacacccaucuccccuucuucuuccccccccccccaaaugaucacacagacagagucaugcaguggcauuuaaacuccacauaucccaguggggcugagcucacacaccagugcuaaggugcaacugacuggggggugggggguggggggcgcuguagaguaguucccugcaggcucuuugcuguggugaaucaucucuuugaucucugugcucaugggaacugcagccucuuugaggccugcuccuccucugguguguuuguuccacauccuggaguuccauuuuagccuuucaucacuguugccuuggaagccauggaaacaaucuagggcugccuuucagcggucacagaaaugcagcaguaggcaaagagaaucacaaagcugcucacauggcuuuguguacauucuuuccuggggagagaauuaagucgaguacaugggcaugcacacacccuucacaagcacuggccacgccuuagugguauggaagacagacaacaagcuguguguggcccugcccggaacaccacucugcuaaaucuacaucucaaaacucugaaauuagagugcauggcacccuucuuuuuuuuuaaagauacacauugucaguuccucuagauaaauugacuguuaauuuauuccguuagcuggggcagaggcagguggaucuuuagauauuuaaggccagccuugucuauauaacaagguacaagccaaggcugcauaaugacacacugucuuaaaaaaaaacuauacacacacauaacauacacacaugcaaacguacauacaugcaugcaugcauacaugcaugcauacauaugugguauguguauguaguuuuauuauuuauuauagaucacauauaucacuaaauuauauguuuauaucacuaaaaccacacauuauuguuuuuuauaaacagugcgcauaucuguggaauccacaggcacuuugucucuccuucacuucaccuugccaagccugugcccaguccaccuuacucagcaucucuucuccccugagggcugccagagacagagaggaggcaaaagucuccagucaguuuuucuaccugcagcaauguccccucaggagcugcuaaggaaggagccaaggcuguggcuucuggucaaaugugggcauacuuccugagauguguucugaacaggaccucccucccgcaaaucuaacagcaaacuggcuacuuucagguuaaaagucugaugauuugucugucucuacaguuuuuacagggugaaugagguacagcgauucgaguauucacggcccauccggaaaggagagaaaaacccagacaaugaauuugcgguaauuaaaaaacauauccaccauaacaaugcccccaaauccuuaccuccaggagaacacaucaccacaggccaccguggacaguguuaaaugucucuguacauugcacgcagacauccuaagcauuacauuccagacugagcaaagcuaguagcauuuuuacagagcuugucaucgagauagcugagacaggaaauaauggaccaauggcauuagggcauuggguauucccuucuagugaauguaaaauaauaauaauaauuagucuuauccccacccagcccagcgucaacugaaugagacucaaacuaggauuuauuuacuaggcucugugccauuaugaggauauaaccccuaaucuaguccucuaacaccagucucagugcucagaacuccagaggcuaauuuggccuuggugacaaugacagucaggugaggccaguaccaggccucccuguaacucaucacacugcagcaggaugcucacugccauucuggacugggugauccucuguggggccacaccaugcaccuccaaccugaacccagugucaucucccuggucaggacaaccagucagagcucuagacacugccagguauuucuucaguuuugcagccaccacaauaacccugggaauaguaacacacacacacacacacacacacacacacacacacacacacagagagagagagagagagagagagagagagagagagagagagaaggaagaaggaggaggcggaggaggcggcggcuuaccacagaagcaugaggaccugaauuccaucuccagaauccauguuaauaaaccugggugugguggugcauaucuauaauccagcauugggaugacagagcaaggcaguucucuggagcucacuggcuaaccacucuagcuuacuaagcaagccagguccuaauaugagacucuggaaaacaagaugaaaaguaccaaagauauacacacacaaacacacucucucucucucucucucucucucucucucucucucacacacacacacacacacacacacacacacacacacucaaagaaucuguuguacaaaugaacugaucuaauggagccuacuucaaaagguaucagaccaacccguaguuuaaaauguuaagaccucuuacuggaacgccucccugcagaaucucccuucagacccauguucagaggacacuuuagccccuaaguaacaucaaagaccagcccugcuagcauggccucauuuguugucuagaggccuuugggauauaggaggccaaaggggacuaaauagccacaccugacccaaagcauaguuugaagccaacugucaaggcugcuuuagggagaaggacuuucaccucccuccauagaaaucuugagaggcaaaacccugaguuuccuuaacaccuccugggagucaccuuaaguaacauccccucuggcccagagaccaguguccuugugugaugucaggacuuuggagugaguugacuuauuguuucaagacaaagguuguguuccuuggccaguaccaacaucccaggccuuugauggcuggucuuuaacuagggucagagccuaggaacagacacacuaagaguagaugaacaguuuucugaguauuuuucucacauaauaagucaugucgcucuuucugcaaugucagggacccagggauuuauugacuuucccccauuacccgccuuccaucuugcugaauguauauauccuuacacuguaaggaauagacacgaggaggccaagcgaauugcugaagggugcucagcgagcuggcagcggagcuaagaauaaccgagacaccugacauccuaagccucagagcuugugcugcuucuagauggccccaaaauccuccgauggccccauuuggguccucacacauagaugggccauucagaagcuacaggauuuaacccuucauagccugacaaacauucaggcauccagaaaagagcaaagugguuuucuguagugaggagcuugauccuggccccuucuauaggauuucuuaccccaagggcaaggcuagaaagacuuccccaggaagccaagagcugugccugagcaggggugaaucuauagccugagcugggggugaaacuucaagaggauccagccaaggugggggccugcauaaggaacuuggcaucaguauacgacauucacaaggguauggccguagagcagacaguuacccuuucucugguaaguccccaggaacacagauauaagaaccuggccuaggagacaaagaucugccagugaccacgaagcuccuguggucuccuugcuucgccugguaucucagauggucuaaaagccaggccagcuuucuguaauugucaucucaugacuagauaggucugcagaugugccacucuggaggguuauuugccuggcuacuagagcugagggaccaaccuuugaagagccagacagaauuagucucauugguuugaaagcauuuccugcagcguuauaaagacuacaauuuggaaauggcuuuuuuuuuuaauauagguagggcugagguugcaucuugaugguagaaugcuuaccuagaaugcaggaagagcugggucugagccccagcacugcacaagcugaguggauauuguggugcacaacuguaauccuagcacuaaggaucacaaguccaaguuccuccgcagcuaacuaccaaguuugggccagugggacuacaugagaccugucucaaaacaaauaaacaaaaaauacauggagaaaaggcauaacacugggugagaagccuugaacaaaggccacuaaaguguuuagguccuccucagugccuugaggauaugucucucuucuuucuccauacuaugugcucacacaauauuuguguuguuuaaacuauugauuuuauugacacacaagagguuaauuucaggaaaccuugaugcauuugugccuuugaguuucuuuugagcccuagguaaggcuaauuugaauucuagauaaggcuaguggaaaguacacuaggaucccucccacacacacacucauuuaagagggaagcccucucauucugagggauuuaggcaaccccugacaacccacuacauuuccuugccagacagcaggcaugcuugauaggugagaaaugggguacuuugauaauguacuauagcugucgaguagaacauggcuccugagguuccccucagcacacaccuguccuuugugaucacaggacaaccuuguccugcuagaggaccccacaugauggggucacacagauacgcagcagaacagagcccccuccuacuggcacuacccuccugacauguauugcauggucucuucuuacagaauauguggauugaaagaaccaucuacacuacggccuauaaacugccaggaauuuuaaggugguuugaagucaaaucugucuucaugguaagaauauacccuagaaggagauuccuaucuccuuaccuauugcauuugacaccucuccccgguuuguucucaagaaucgugugauugcuauguauggccuguuacaugcuacaggcccuucaguuccuguuacacccugugauauaccucagagcaucaguaucuccuaucccccagcaucuucuuuccaaagcuguguggccacccucagggcuagcuaacaggaaacccauuccuucucacaaauuagcaaucucagccagaacugugccgcuccaugaaccuugcaccaagccucuuucuggcacuuuugguguacuaauaacuuagccaauagaauuuacucauuucaagugaguaaauaagagaauguauucccauugggacauauuuuuaaagauacaauucccauuguauuaaucaauggguuauuuugucauuugguuugguuuaugagugcacauuuuacagucauguauauccuuuguauaugcaaugccugcuggagccaaaagagaggguguugugaguugugaguuacaaaugguuugugagccacgacagggauggcucagaagcaaacccaaguauucuggaagagcagucuguucucuuaaccacuaagccaucucugacaccaugggacacuuuuauuuacaugaaacaaacauuuguggggagauacaagaagacuucaccaaugaagcgcagagcuccaccauaggcuuauuaccaggacugaaacagcagcucugugacaguuguccacguaagacaauccccugaaaggauaagggugugguagcccacuuggaagcacgcuugucuugugugcauguuggcuucuauccccaacauaaacuggguguggcagugcacaccuauaauccuagcacacaggagaaucccaagccccaguguuaccuucagcucuauguugaaucugaagccagccugggcuacaugauagucugucucaagaaaaaaaaaacuaauuaaaauaugcuuuuguucaugugccuuugcugggcuggaucccauaucaggcgauggcuucugccguucaauuaacagugagucccugaaacaccuggugauuuggcuuaaggacuuggcuaagcuugccaaacuugcucuucccuucuguauguccaccaaucuuuuuuuuuuaccaauaagaacucugggcccuucuaugaacacgugucaccgcuccaccagacuucuccaccccacugcagcugagauggagccccccaauccuuuacucccagaguccucaggaucugagaccuccauucugugucccaaagcaaccaagguagauagaaggcaaucgugccguuagaccaugagaacguuuaggguggccaggcuaagaucuggaggaaagcccccgacacugcauuaacaugcacaaaaugacuaaauuuucauaaccccaaauaccuguauuuuuccagaaacuauguggacuacacagaaaguauacaugaggccagggaggcuuccucaccugggcacacuacaguagcugggugaugcccaccuucuucuuuuccuugcagguagagaucagcccacuggagaaugccaucgagacaaugcaguugaccaaugacaagaucagcagcaugguccagcagcaccuggaugacccgggccugccuaucaacccccuguccaugcuccugaauggcauuguggauccugcugucaugggugguuuugccaauuaugagaaggcacgugacacaccugggacagccuaaccauucacaaaguccauuccugggacccagaaguuauuguggagagucacccucacuuuccagaacucuggggcuaucaaagaucuaaauauuccauucuggagacaagcaagaguccagauguuuacccuagagagagagcauaggugcgguggagggucacuggcaucccuuaauaguagcgcagugagaauggguagaaauuaaagaucgugugguacaggcuaagccuguuuugcucaccauaguccacugccuauuuuuguaaaugcuggggcugugugcauuuauuuaugucuuguccaggauaguuuuccuaauguagcaaugauauuuugagccacuaggccugugugguccacaagaccaaaaucaugucuguuggcccuauacaaaagaagcuuguugacacagaucuaaaccugagaccaaaagggcucuccuggugagcugccaaugaucguggaagaaaaguuagucccuucccaauguuucugucguccagacaaaucucugucuggcuagaaucaauagaacagacgaauaucagcuacaaaagugaacuuccagacauugguacagcugagagggucauagccacugcuacuaagcaaucuaggucggacguggccuuucuggaucccuagcuaucugugugcuccacguaccuuaagcucuggggagaguccaucuaugguccugcaaggaguacccuaagagggcuguggggcuggguugugcuuguuucucuucccaaggcuccuauacacagugccgugauaggcaaucacaugugcuaaaaggcucucccugucuccacaggcuuucuucacagacagauaccugcaggagcauccugaggcccaugggcagauugagaagcucaaggaccugauagccuggcagguuuguaugucugggaaaggaagcuggguauccugggccuguccacauacauuccuaccacugaaguggcuucugggucaacacacucacaaggauaaagucacucaaacacccgcaaaauucugcauggcaaaugaacaagaucuguugggaaaccuuuggcuggaauuaauagaagaauaucagauauugagguggacccagagcugcaaaagcccaggccuuagccucuguggcgagagagagagagagagagagagagagagagagagagagagagagagagagagagaggaaggaaggaaggaaggaaggaaggaaggaaggaaggaaggaaggaaggaaggaaggaagacagagaaacagauccauaggggagcugcagccugcccaucccuucugcugugaggaggcagagagagagagagagagagagagagagagagagagagagagagagaggaaggaaggaaggaaggaaggaaggaaggaaggaaggaaggaaggaagacagagaaacagauccauaggggagcugcagccugcccaucccuucugcugugaggaggcaguuccagaggaugaguguccuuguuuguguuugcccagcugugguucugaacauuagauugcuuccauucuugcuucuaggcugagcccuucuugccuaucuacuucaagaguagggagcugcagagggccccuuguauuccucuggggucugugcuccccagaaccccugaucuggauugucuacacuuacacugucuacaauuguucuaccacuggagcgacuugcuagagguuuccauacacaggcaggaaggaggugcuggcaucaugauauucaugagguauaaccccacuagccagacugcagaagguagggagugggccacccugugcuugaguuaggaaugugcccaaucuauaggagguagaaagcuagcuaaguuguguuagaguugggcaggcgcccaggcugcaugcauggcuaagccuggcccuagacucuugaaugagccuaaggacaucuagacucaucagagaugcuucugcuaugagaccuuuccuucauucuguacugacuccuaaaggagucucauacuugggacguuucugucaucagcacauugaccagugagaccacuuagagugcgggccugaguuacggcuuguagcccaguuggacgacuucuucuucuuccucuuccucuuccucuuccucuuccucuuccucuuccucuuccucuuccucuucuuccucuuccucuuccucuuccucuuccucuuccucuuccucuuccucuuccucuuccucuuccucuuccucuuccucuucuucuucuucuucuucuucuucuucuucuucuucuucuucuucuucuucuuccucuucuaaauuugcaucuagaugacuagauugucacagcucuggcaugcaugcaugcgcgcgcgcacacacacacacacacacacacacacacacacacgcaccccuguucuaguugugccccuugaauuuucccuuagcuuccagcaucugcccuucugcucucggucugccuaaccugaggacucuaagaaacucuugaguagaacuguauaugauucauucuuuggugugucuuauuucacucagcauaaugacuucaagguucauccauguaguagcuuuuguuagaucaucuuuuugugaggccaaauaauauucugccguguggcuaugccacaguucauccaugcauuuaucugugaggguuuggguugugucuaccuggagguuagucugacuaacaaugaaaugaacacaaguucacagaugccugugaucgauccccuugcuuccuggacucugcauguacugaaggcugaaucuucuguaucguauaaaauucuaggucugagguuuucagccauuaccaaauuuaucuccagugcugaaucaucuuaaacaccaaacaacuggaauccaaggguccagugucugagucuucaccaagacuuguuguuauucguguucucuuuuuuuuccuaccauggucaucgucaugcaugugcagcuuuaguauauuuacauuuuaagagacuuacaugacgaaaagauacucugauuuuugucacaaagcuccugaaaucugauugcccugcaauuguuuugugacauaagaucccuaugaacaaaaagggagagacacuauuggccaauauaguuucuucacacagaauguaagucauauccccagucucccugugacuuuuauuuuggaaggagaagaagaagaagaagaagaagaagaagaagaagaagaagaaggaggaggaggaggaggaggaggaggaggaggaggaggagaagaagaagaagaagaagaagaagaagaagaagaagaagaagaagaagaagaagaagaagaagaagaagaagaagaagaagaagaagaagaagaagaaggugaugaagaugaugaugaagaugaugauggugaugaugaugaagaugaugauggugaugaugaugaagaugauaaagaugaugaugaugauuuggaugguuccaucugagucccuagaaaugaagggggcacagaacucaaaaucccccaguauucuauaacacagaaacuaguuuggucugcagaaguucuauugauuuuuuucccccuguaagcuuucacagcaaauuggauucuaugaguuucaagucaaacagaggaaaauaauuuguuccccagagagagacuuuaugccagcaccaugucaucgccccuaauaucuauauuaaaagaugaauuuuaaaacagcucaugggaaaguugaaagaaagucuguuuucuagcaacuucauuaaaucaaagagcaaagggaaagaaauacauauucagagcauuaccugugauuuugcucucauuugcaagcauuuugauagcuucguaucaguaauugaguuguauguucauuaaaaaaaaaugagagcuuuacaguuagccuuguucucguuuugcuccuuccuuuauucaguuuggguuuuuccggaaauucucucuaggguuucuccugggaggagucccaggacuugcuggcugaguuacaucacagguauauggcuguagacaagcaugucucccauaccuagaguuccugugagauuggcuggcgggcccuggccugcucuuuagcuccucuucaugauucugaacagugauggccuggcccucgacagcugggagacuggucaugaugcaggcugccuggagccugcagacuuugauacccagucagggcuacuuccucaaaggcuuagcucugucuucccuuaaacacaccugcagaguguccaaggaugagcccaugcauuuuccuauucaacugcuaugugccguacuuauuuucuuugaaguguacagagaagagcgagcagccucacucaucauccccagcugacaacuggcacuguccuaucugcaggggcuggugcccugcgagcaaugaacaaagcugucagauguucccugcugcuggcaaggcuuggacccgugcagggcccacauagcacgaugcugaagguucacuuagaacaacuggagguguggcuggaaaagccuccccuuucuuccagagucuggggcgcuucagaaauaacagguuccgaaauguacccauagugacucaagcuguggggcacaguuuccgagucccguggcaauuguggcaauccugaauggggcaaggaaucugccugccaaagauauuuugaacauagggaacaaaaaggccuccaaagaccccaggucuauggucuuucuuuguauauuaagcaucucauacauuggacugagcuccacaaauagcaugugauuucccuccauuuagaaccacagccgcagcucagauccaaauagcaaagacuaaauccuauucucugagaaggcuuugucugcucagugucagggacgacugagagugacuggcaaguucucucaccuugugcuacucaccugccaaagcccagguuccagcuguccccaugcaaaccaggaccucggcuuucauucucauccaccaagucgucucuuugguacaaagaauaacuuuaucaccccaacccucaccaccuccgccaccacaaaccccggggugauuggaucaaguuuugcacauuugaaacaaguuauucuaaaucagaacagcucuuagcaucaagaaugacugcggugucaccuagagacagccuucccacacagguuugccuucccuuuuccacggacaacacauuugccaugccacccaaagaugucccagcagguccuugucaccaccaccgccccuucaaacuccccuaccuccagucagaacucaggaagcaaaagaccagcaaugaacauuucuuaggccaguccugagugcaugguagcaagcccugggaaagcugccaucugcauaaggaauucauguggguuacgaaaagaccuugucuguuuugaagaagcucaccugcacacaggucuugugugauaaccagacagaaauggguaacaaaugacgugugccuuguguuuuggcccaacugucagcauaacuaacuuuugugucccugccuccugaguaggcuggguacuuugaauauggggguguuugugugccccuccuuuccuggaguacaagagaagcagcagcugugugcuauaaauggaagcagauacagcucaugaguggauucaucuugcuaagauuccuugaguuuguucacaugaaauucaauuguauacuuauuauuccucucccuaauaaauaugcugguucagaucgguauucuauccuauuaggaaaauauguuuuuaaucaguauuuuuacuuaauuauaaauuauuaagaggaagccucuuagcuugauugcauugaagacugacuaacuuccagucucgguccuaggggagaagcagaggccagggacagaauggagccucuucucauggccagucccuagccacaguugcuccaggguucucugccacugagaaaaugaaaaugucucaugugacagguuuuaaaggucagcagcgcuucuacuguuggaagugaaguguuggcauggauaucuugugacaguagugucgucagagaagugauuauuuuugguuuuaagggagaauaaauauaguuuuccuuuccacaugagaauaucuaucaggacuauggauggccuguaacugaacuguuauguuugggguaggcuacucaauugccuauaaauacaguguauccucggccgacaaaugagccauggcaugaccuuuugcuaccagcacaagauguaugugaacacauucaaagcaaaacugucccccaaaauccauugagaaaacacugguguugagucuguucuggggcugguugaguaacaagacaccucccacccccaccaaguaacagaaugcaguacucauggggucuuccaccuuggaaaugaucccccccaaaucccaagcaauucuuguuuaaacauuuccaucucugggggcuggagggguggggguggccugucugcugaugaguuuaaucagucacucugauuugggaacagaagcaggugcaaccagcuugccauugccaccuccugcuguguacugcuccaucuagaccuguuccccucccaaaucaggaacaucacccuguguuuuucagauuccauuuuuggcugaagggaucaggauucauggagacaaagucacagaggcccugaggccauuccacgagcgcauggaagccugcuucaagcaacugaaggaaaaaguggaaaagcaauauggcgucaggaccaugguaagugggcggguccacagaagaguguccguuuggaguggaggggcuggggccucugggauuuuuauggaccccagccuccuuaccaagcucacuuuaugggaguuguuaauuuccaaguaccucauucaucgucucugaguagugugcuguguagguuggugcagucugggggucucgauagggauaguucaagaauucaaaggaagcagggaagaucuagaguuugacagguagcaguggagaaaucuuggaacaccacgaacagacgcaacagaaucagcagacgaagaaaggcccuuauggugggugaagaaccacacaugcaacagacacacagagagaaggacccucugggaagcagacagggaacucgaacccagaaaccuaguuucuucucaagagcaggggauuuuuaggucucugaagagucuucugucucuaauuuaggguuggucaauuuggagaaaguacaggaggcuguuuuguucacaguuguuguguccugaucaggccuugaacuuguugagucagucuaugggggacgggauguugggguggagggugagggugggggugcugcugauggugguagagaaagccagcaaguccuuuguuugaaaguaccaggcuuuugucucacauggaugagcacuaagccaguguugaaaguuuaccaccuuuauuaccuggccauggcccuucucccugucugucaaccuaccagggagccuggcuaacuccuagucacucaaggucauggagaaauuucacagaggcccuuaggacucggguggguuacagagcucuuguccugagacaugccauacacagagagcuguguaacgcucaggcaguagcacccaugguauccuagagauggacucaaugccuagcucgaugcuggaaccuaagaacauaaccagcaggcucagggagacaauggcuuuauugaaagcaugaggaccaaaguucaauccccucaugucauguaaaauaaaacaaaaccaagcaugauggcacacacauguaauaccagugcuugguaggcagagauaugcagaucccuguaacucacuggccagccaguacugccuacuuggagagaucuaggcaaggugagagauccugucucauaauagaagguagacagcauacauguucacccaucagaacacacacacacacacacacacacacacacacacacacacacacauacacaccauggccggaaagggagaagagauggggagauggguuacugaugaucuaaacuguugcuaaauaaaagcuuagccacugaaggagguagaaaugguagaaaugauccaggcugggagauaaccaggguuuugaguggcaggccagaggccaaugcagacaaagguauacacuuaacagaagagcaccaaaggcaaguuggaaaggcaagcagccuucaugagccagaggcaccacucaggggcaguaggcuaugcucacaacauggggcugaaugacucuggugauguguuccugaaaaauucccagauugggguuggggucagaagcaugacagaugagcaucuuugauucucagcaaugcaaagagagcuacggauguauuuuuauagacaagcccccacugagcaugcucauggcggagccaaugucucuaaucccauuggucagugcuuugucacagacucagcaggacaugagccuggacucuggucguaaacccaacagaugagaaccugagacugacagcccagugggagccccugcagguaaacagcuaggauacaaggugccuccccugcuguuuuggagaacccuucuguaagacagaauccuugagcagugcuauugauagcuuggagccugcagcuugucagcaucagggcugaauggcaaaaggugugugugugugugugugugugugugugugugugugugugugugugugugugugucagaaggcaacucuuuccaaguuccaugcugcucuaagaaugaagugcuugugcaggcuccaaguucuuaacuuaguucaaugcuuccuauuuuaucaacccuuuauugaaucuuccacaauuaaagaaaccuauugaucuugccuguuaguuuuuacaucccuccucugcuaugaaauaccacugagaaaccaugcuauaggguauaggucaaaauagaaagugggggcaggaaggugguggugguggguuggguuggguuggauggggggacaugggggauguguaaagaugaaggaugucuuuucagacauguuucccuuguaucuuggcacccaucauuagcuaaaggcaaccacuuucuauaucaccuucuccauacaucaugcuucucuuggugggggcaacgggacaucccacccagcagggcuuucagagcaugaucuggagacagaauucaggaagcauuuauccccauggcuacuaggauacagggagcaaccuuuaugaguccuacuccauccuggggcccagaaugaggcucugcagccguccuuucuagguaagcagugguucaggcugcagcuugucauucggugagggauguggucauaaaggcaggcuggaaggcaccugucuugccuuaccuacuuuggaaaccuacaagcauaucagaauacuuugagaagcaauaucacaucauccuccuuccaaaaggauaggcuuuaaaaucauaauaauauaaaaaaaaacacagaaaggacauaaaccauuuuuucaauguuucuaagccagccuaagcuccaguaaggcaagcacuagacccccccugacuguguaauacaagggccucucccacuggcuccucugugccaucuauauugucgauucuggagauccaaggagacaccgcuucuuggaugaacgcugagcagauucccagagacccccccccagaaaggaaaugccaaacacuggccucugccuuugcuucccacagcaugugaaggcuccuccauauacaugaaaccuuuuuaucuguuuccuggcccuccuguccucuuccuaaagucagaugagguccagagggccuagcuuggcucugcucuuuucuccaccccucuccucaccugaaccaaaccaccauucagaccaugugcugguuggaacuccaagccucucucuccggguggccccuacacccuuguggagucuccucuaccccacagcccaguacuucagugcuacacccaucagcugcaacauccagucaucuaucuccccuacuggcuuuguuggcaccuccagcucagugcugggccucuuuaccuggagggagacucagaccaggccccugcuccugcacugcuucucauggcuucaaacauggcugccuucagggcagcauaaugccugagucuccaguccacaggcaaagaccaaaauacacuuaccucucucccuuccuugugaacucaccucgauccagucaccugaccgugauucauuguguagucaacauucaugguuaugauugaaaaacauacuucagccagaaagaaaagaugcaaaauucggugcuacagggcaaggcccgagugucauuuuaccuacaaagaccaaaauaaauuuuccauccagauaccaaggcaacaagagaaggacaauggaagcugcuacuaaccuugcaccaagccuuacagcccucauaugcagucauuguuaaucuuuacagaggacccacaauggggagacagcucucugcgcgucuuuaaagaagcucacaguaauuccuugguuugcauaugaucacacaguugaugcacgagacaaaaaucuagccuguucuaacacucuacuccuaaccuguuuggcccuauggcuggaacaggcagacagcaagacacucccguuuguguggccuugagcuaccuuuuggucuuacgugagguucuaguugguucagauggaacaaaugaaaguccucuuaguucuaaauuucucagccucuacucaauaaagaaauaagacuaaugguccagaagaacccacaguucuccucugugagucccuguaaauacaaaucuccaacagggccccugucuccuguuucaaggauccuucccaugaccuccuccuugucuuguacaucccagugcaugugcacauugguuaugugccagcccuugcugguugacagcagguggaugguccucuugaagucugaaggugacuuggucugaccuuuguacucuaugacccucaguggucuccuucuguacauggacgaucacugcaucacagauauagcagcccacaagcuggauauucucaggaauaggccucagaguuccggggcaaccccacucacauaccauauaggucaaguuucuucccagcucuuggcuuggcauugucuccuuggcuucuccuuccccugcccaggugguggugagacacaaggcagcauucccccaaguuacagaagucagcagaguccaacauuuucuugccuuccuuucuuucccaaccaguaugcccaauggauaaugauaaagucaagcuugaaacgcuugcaguagagucagaaagacagucucuccccagcuagagguuguuuggaaauguaagcaccuucaacaacugauucuccaccucuaguccuguagaagaauggccaaagacagugugcaucugagaaggccaaagauaugaccaggucucacuuaaagcauaaagugaguuaaaggcugagggcccauuggccucaaagauaccagagaguaacuggcaucucagguggguaggauagggcuuggguggugaugagcaagucagaauggaccuaggcagaacucuacccugaaucaaugggaaugacaaggacaaauagcuaccuacaucccugggacuagcccaaggcagagggaaaccuuaccgaucaagcuaucauucugcauacccagcagcacuucagaagggaugggaagagugcagagugauugguguaaauaccaacucuccagguguccuguagaaaauauuuagcacauggggagaaucuacuagucacccuacaccuuauaacuuccuccucauggcugauuaaucauagucaacauccauggaagugcccucuggcacuaaguucaagacuuugugcuggcaaaccccagacacugauuaucuugagccaguggccugcaccacaccaggggucacuugcauauuuuguaaauaaaguuuuauuagcagacagccccauuccuuucugcaucauauuuaaucggcaccuugcuaccuccaagggcugugaauguaacacaaaccagcuguccuguaggugauuaucuguauaacaugccaacagcauccuagggugcugugaggaaccugauacaacacaagaggagugacauucagacaugggauuucugccagcccaaagaaagcguuugugaagcagcugugguccagaugugccaacaucuggcuucaggcucagguacucugguguuuccuagcuaauuagaugucgauacaugcuguauccaaugaacguugggcguuuuguuugcuuguuuguuuguugguaauguacagcaaguugucaaggagagauuggaaaauucccucuagugacaauguucuuagaaugugugaaaaggagagacccacagccuggcccaggccuuucuuccaucacccuugcucagccaagaagacccgacucuagugugaggaggcgccucuguagugagagcuuugaaccaauacagcucugugagucugggcaucugacucagguauuacugugcagguggacaaaggucaugcaaagaucuuacacauuuuuagucacauucuagaugcacugugcuuuaaacuuccugugaguaaccccacugaaggacagguugauuugucuaggagaggaaaucuauauuuaaaauaaaaaggccaaggagguucuuucuggaauucuuauccguuaauucgggucucaaaagauguggaaacugucuucauuguuuuucccuucagcucagaacaagaaaagaaauaguuuaugaaguguggucccauaagguccuucagcacaaagaucugaccacaguggccuggaccuuaacauguugucuucuucuuuucucagcccucaggcuuggaugacaggagaggcagccguccacguucaauggugcgaucuuucaccaugccaucauccucccggccccugucaguggcuuccgucucuucuuucuccucugacagcacuccuuccaggccaggcucugaugggugaguggguucagccgccgggaauccugguagggacggcugggcaccgcauagggugccauccauacccugggauugcgcagcaauccuggucaugcuguuuugaaaacugagagucuccaagaccuggugguaccugacagugugguuacugugaccuugcucuaaguagcauugccagaaaggcgucugccaaaccuuaaaacucuagugagcauuuaauacucaaugcgucucaacucuucuaugaucccaaccaugccaacugccagagccagacuuauaucacuggauaauguguguguguguguguguguguguguguguguguguguguguguguaagagaaagacagcacagaauuguuuauuucuuuuaaauuguuuauuguuacuuuuuaaaaauauuuauuuuuauuuuauauacauacaaauguuuaccuacauauaauauauauauauauacacauacaucauacauacauacauucauacauacauacauauauacauauauacauauguguguguauauauagagauagauagauccaccacaugcaugccugguacccagaaaggccagccgauccucuagaacuggacuugcagguggcuaaagcaccaugugagugcuagaauugacaacccccccccacuccaaaaaaugacccaauacauacaccagguccucuguaagaagagugcaugcucuucacuacugagacaucucuccaucccagauuuauuacuuuauaaagagaaauucuguuuaaguuaaauacuugugagaaaaacucucuuucuacuuuauuuggcuacccugcagaauagaaaucacauucuuuuuccccaauuuuuaaauuauaguuuguugcaucauuaaaaccaccuuuaagaguaggcaaagugucuugcugccaagucugaucccugagacccauaugugcaaagagagaacuaauucuagcaaguuguccucuacacacacauacauguacaugaacacaacagauaaauacugauuaaaauuaaagaaaaacacuguuaaauauauacguauacauaaagucacacugcuguacacucuccuagaacucuuucauuauacaaacugaaccucacaccauuaaaccuuguaccccacuccuuuagaccccagcaacagccacuguacuuucuggcauugaauuuacccagucuagcauguauaauguccugugaggucaucuuacagaaccccgcauaaaaacugaaagcgggcaugaaccugcuaguuuacaagcuaacucaugagcccucagugugguuugaacauuaacucagaugguuguaaauaccaccuugauacuuguauuuuccuguuguuuuuacgugaaaaaccauguagaauuucuucuucugcaaaaagaagaaaauuucacauacaguuuauacaucauugaagaaccugugagcguuuaguuuugcacaguggugugcuucuccuagcccuuucuguugacaguuugucacuaucaaaccucaaggcuccugguccuuguauacagacacagccuaccagagaauaucaggggccccucaguucuaagugccuuuucuugccagcaguugaugcaccugauagagaaccgcaaaaucuagccauguucuuuccuuaacaguaauuuuuaucagugucuguuauuaggccaaccccauauggaaauucuccauuucgagguguuuaaaucaucugugccugucacuuagaacaagauagcuagagaaauuugaugccgcuucccuucaagagaauccccaggcuaguuaggaaaaggguuuuauauucccgagaacgcagggguuagguggaaauugauggagaaguuuuagauagagugguguguuacagucagcucacccaggaggcguuuguucaaccuuuaacuggaaagugucucuauuagagcccaggguugugcucauucuuggguugccaggcuuugcucucugacuaauacugacaaaaugaggcguacuaucaagugguacaggugacaugcaggcuagaguccauccugacucuccuccaaaggcaaagcacuguaccuggcucgcuugaguuccuugaaugcucucccagacagacugcagaggucuccuccuaagcuccaaaggggaccauaaauuugccuuuugccuauuuaaauugucucaaguucagaaacacauggacuagaguggugacauuucucuuuaguguugcuucuaauauuuuagauauaauauuucaugugucaugauguugauuugauacaaauauauaaauaaauauagacagauauuuaaguguauuuuauauguagaugauauauaaauauagauagauagauagauagauagauagauagauagauagauagauagauagauaggcaggcagacagguggacagauggacagauagaucagaaugccuuuauuuuaguuacuuuugucuugcugugauaaaauacccugacaaaaaauuaacaaggaaggcaggaugaggcuagcucacaguucuggaaagaaugaggucaccaugaacaggaaggugugacaccaggcaggaaaggcaggagagcagcaguggaggccaucacauugcacucagaaagcagagggcggggauagggguagagggagaagcacagagacgcagagagagagagagagaagagaauaggaaguaagucaaggcuaugaaccaccaaagccugccccgggccauacuucuuccuaaagacuccauaaccucugcaaacauagcaccuccuacuggggaccaagcguuucaaugcaugggucugugggaaauauuucucaugcagacugccaagccuucaugaucacagacaagagcugauguguauaucaccugucauuuuuaauaguuuuauuaugggaauuuuucaggcauguugaguauggacuaaauacuauuauaggaugucuuacccagcagccaaccuucacauuauaaacuaccuuccccuuuuguuuccaccuguaucucccccuaguccugacuucaucuuucuucuguaacaaguuuuaagcgucguauuuuguuaccuguugguccuccaugugaguuccuaaacgaugaggaguccccuuuagaaaacguagcuguauacuuuaacaucauguaagauaauugacaugaauuccuaaucaugaugaccuucauaacaauuucucauuugauaugcguguuuuuauuuuauuguuauuuuuaucuugcaugugugugucuguguguguguguuuacaugcaugcauacaggcaugcacacgccauugcaggcauguagcagucagaggagcaccuccccugcucgucuucaccuuccaccuuguuugagaugggguuucuuucuguuguucagcacuaugugcagcagccuaguugccccugcacuucuagguauuccccugccucugcucccgucucacuguugaagugcuaggauuacaacgggcagcaucauagccauccccaugugggugcuguagauuugagcucagguccucacagcugcacaagaacuguacacaccacaccauuuccguggcccuacuacacauuuuuaaaaguuuguuugaagcuaaacugaaugaagcccucaccauacucuugguuggaauuaucuccuuaagucucacaaucuacuuuuuaaaaacugucauugucuuuguaauuuguugaaaaauccaaauugcuuaccuuucugugucugcagaguggaucguauugauuuugugcccugcaguguagaugcugucugaugugugucuguccucccuauuaucagcguauugggaguugaaucuagaggucugguguaauucagguuugauuuggggccagcuaaccuuauagguggcaauagguccuucccaucaggggcacaucacagcugacuuucucucuuggugauguuaauggccauugguaaucuaugcucagauucaacaccauuacaauuuaaauugcauguacaccucaccaaugaaucccaucccacagcucuguuagccugggagaggcaacauguguguaacacaguucuugcacucugugguauuuaucuccuccagcagauaucauaugugcauucgugggagggcaguuuguguguuccugcaugcaucuugagugugugcucauguccaagggcaguauguacacaugaaggcugaaggaccugaucaaguaguacugcuagggcucuaguaccuuggugguuuuuaagauaaggucucuuacuggccuuuagcucacuaauuuagcuaagccagcuggccagcacaccuagaagaagcaagcacacacugccacauuuggcuuuuucaugucaguucuaaggagcaggcucagguccuugugcuuguguagcaagcauuuaaccaaagcagccaccucuagccuggugcuuuguuaggauucagacaucauuccugaugggucacaauacauccaaagaccccuguugccucucucuuugaaccaugccuuuccucguagaagucugugguuaccagauagccuggugcauggugccugacuuuacauaucucugccuggggaaagagcaguagcugcccugcuaagacauugcuuuagauaccuauuucuuucagauuugcucuagagccucugcugccgaagaagaugcacuccaggucccaggacaagcuagacaaggacgauccagauaaagagaagaaggacaagaagaaggagaaaaggaacagcaaacaccaagagauauuugauaaggaauucaagcccgcugacagcucccugcagcagucugaggcugugauccuuucugaaacgguaauuuaacuguagaucggaagagcucugcaggggugccugggacccaccuaggcucugcaucuuaccgagagggcugucaguuggauuuuauugaauuuuugcaaaauauagcaacuuaaaagcccgaggucuuuucaucucugaccucaaauaacccaaccgucagagacacagagcagugcugucuuuucucugagggcacaugcugucuuggccuuuauccucuuuuagaggggcuggauaggucaguccccuacagggaccucaugugucuaggcuccuuauagcuccguuggacuuggugcccuuguguccuagcaccucagagaacagaagcauagugcuuucacaagcuguacucacucauggauagcaaaugucuucccuaccccuuccugacuagcauccuuaagucuuagucacugccugaggguuagaauccgcucagcuucugccuggugaggugacucuauucuuggugcuuucaguuugaucccuugcauccacaugggagaugaaaauugacucccacaaguugcccugugaccuccacacauaugcuaugacaugugcagauacauacaaacauaggcauguaugcaugccuauacaaaugaauaaaguaauuguaagcgcgcuuucgucccacggugagucuugagccuacgcaucccagaagcacaccacaguguuuugggucuacauguagaaaugagguagaaaauguuucagacagacagacagacagacagauacaucaguguccagacugacauaaucugagagccacuucuagacguggauagcacuugacugggaaguggccagaucaugugucuugggcagcagcuccauuucagcugggauuaagggcaguuucaccaaaaugcugaucaagguauaguuuuuuuuaauucacuuuacauccucaucccagucccccucccuccuuucuucccagucccacccauacaaaccccucccuccaucagaggcacacuucucuguaagccauacuaaaccaugucggagagaacgucccgguaccaacaacugucauacaaaugcugcuugcucuacucaaggugguaggcagagauacaggugccagagcauggcucgagaaggccguugccucucggccuuguggacaugugcucucacuggagccgggcucugauggcucugugcagccuagugaccaagggcauugggcccacuggucaaggcuggcauuaaaugccuggauucugggccucaggcuguauaugaaaugaucaaccauuucagaaagccgggcuuccagacaaucccacaaguugagaucuccucuccgggcacacagcauccuaacuaguuggcucagcuuccuucuuggacauaguuacucagggucaggcacuuugcaguccuucagacauuuuuauuuaagcucuguuuuaagauauugaaacugggccugagaaacauagagccaaguagcagaaagggccacaguugaacuguguaaggacaacuccaaggacagggcugagccagugcaggacaguuucuguccuucccaaugaugaccaugucccugagacaacaccugcugaugacagggccaggugcaaaaccauaugggggccucucaggucacaggaacuacacaaggucagagcccagagccuugacuuugccaucaguaggugccugggguucgaggcacagugaccagggcugcaacagcagaguccuauccacuggucaggcacggugcaucuaugcaagcagaggccuccuccaggcacagguguugaugugguccccugggcaggagucauccuggaaagcaacugcauguuccaugaugacuguagcacccccuaguguucaggacgcugaugcugcuaguguucccagcccuccauagaccuacaggaguaaacugcucucuccugccucuguaggguuucccucuucccuuuugggcugggcucagcuuccuucuugauuugcaugguuaacaaucuccugaccuuuagcugagccucuccaagcugggccuucaggcuaccauuugcauuuccccaggaaaucuuccugaagcuuuguguuagaagcucagaagugagagaaacaccugacagccucagccucuuucaccagcuccuagcacaucuuccugagagagccaggcuuggagccaguccugaccucacccagcaaggacucuccauuuccacagaguacuuggucauggcacccacaccuucuguacagaauaauuuugaucuguacgcugaggcuaggugcugcucauguaucugaaggccucuucccugcucagaaccucacuucuacuucuggcuucaguagcuccagccugggcuggcuuugugggucucuucuaagguagauacagugacucacuggcuuuugccauuuccaccccuguaaaaccaccucagcccacccacucugccccaggauuaagcugaaacgccaaggccaggcccucugggagacagccucuucugcucuuccgccaaguuaauaacguuucugaauaauccuaccucagaauauuuuguaauugcugguguucccugauguguaagaucagagagcaagcuguaagaaauauacaaauuaaauuuacugauguuacaaacaggggaaagggcucagguggagaaaagucaagugcaccccgaagcccaaggccagcaagaagaggagagaaaaggaacuccuguuggcaauaacagcucagaggagaaacuaaacaaggggcaaaggggcuccuguccuuuugcugaggcuccagacuucuguucuguucuugauccuuugggggcauccuugggugugcucacuagcuacacagauagcucauagcugcacuccuccccuuuagcauuguggucaaguagccuauaaaggacuagggucauagcucgguggguagaguguuugccuagcaugcuaggccuuggguucaauccccaacaacucauaaaccccacgugguaguguaguagaggugcacacuuguaaugagcauucaggauauggagcaggaucaggaguucaaggucaucuuagguacauagcaaguucccggcuaggcuacucccaaaggcuggguugaagauucaugugaaguucuguguuaguggggacaggcugccagaacaaaguacuguccuuuccaugggcaacucagacaacagaaaguuguucccuaccaauucuagaagcuacagguccaagauuaaaguguagaugggguugcccccugcuaaggugguaagaaauuaaguuccacaccuccccuggcuucuggauugguuggccaucuuugguguccuuugacuugcugcagggguaccccaccucugcuuuugucuuccuaugacauucucucugcuugcaugcuguucagacccccuuaguuuauaaggucucguuggauucaugcuuacaccaucuuaacuuggcucuuugcaaaaaucccuauacccagaugggcuugugggcugggcacuggggucagggcuucagcacagggauuuggagaagacacagccaguccauacacaccuuaacuuuguucuuucugucccucaacgcagauaaguccccugcggccccaaagacccaagagccaggugaucaaugucauuggaaaugaaaggcgcuucucugugucuccagcaucaccguccucccagcagacgcccccuccagucacaccaagagccaagcucagcuucagcauucagcccaguaaguggaacuuaagguguugccccuuaaggugcccccugacuguggcccuuuguucaggacccuuuccccagcaguagagugaaaguuagagggguaugugacgucugaagaagucaccucagguugaggugggaaaucuagacuucaaacaucucacgcagaaagaaauccauccucaguggcagagcucaacaaauauaaagugcaggacccaacccaggagcagagcuccugccugaaaggagucuugagagccacaggguaccaaugucuucaggggucuuggggcuccgugucuagugggaggaacggugagagagucauugcuuacagcauagaaaugucuaccagggaugacagauggcacagcaccaucagccuguaaccaccaugggcuugcacacugcagaacuuaacaucacaucugcuuuacugcaaugacucagguauucaagugccacuccuggggaccccugcucucccagcucgacaccaagguuucuacauucaccacuggacuacccugucauugcccuauuaucagacaacugaccacuuuaaaaacucccaaaccauacccaucagugaaaguguccauuuuccucucuuugguuuaaaauaaaacaucucuuccaagagcaucagcaaaggcugaugaaguuagcccaccuuugugaucuccccucuguuuacaaacagccaguuuugucugcuuuaacaaccuguagcauauccuguuggcucuggaaggcagcugccagccgcuuccuguccuacaaucauggauugcccuggugagcuggcugugugccccaucaccggacucuaccagugagcucucccaauagcaacuguggcagacuuaccauaaagccacagccuugucgcaccaacuaugcggaugccacuaaggagaaggaggcucacagacaguaguauuuacacagagaguugauacguugcuucaagcucuagcacucuguuuccuuucuagaacauucuaccaggaaagaauccuacucuuuguagucucuacuccucuuuuacccuucgcuguguucuuuagacuuuuuugaucccucuguaaccauuucaccauuuuccaggucuggagcugaacggcaugaugggaauggauguggccgaugucccacccccucugccccucaaaggcaacauggcagauuauggaaaucugauggaaaaccaggauaugauggucucacccacaucuccaccuccuccucccccacaacggguaagugggaucuaaaaccacgagacuuuaguuucugcccgcagccaggacugagguaugcaugcucugugauacaguuucuuagcccuagcugcaggcagccccaccucccagacagugcugccuuugcucugaagcuguccugauggaugcuggucuuugagcuguuaguacuaccagcagcuuuggugccaagaggucugucugacugcacugaagagaugugcuguuccauaggggacgccuccuuuguuuuccccauuuuggcccucuagguucucuggacaauguuguccucacauugacaguucccugguagccacaggcucuugcuacuuagagaguccauaguaggguuccacauuggugcagacugcauacccuaccguccuguuucaucagcccucaagugcugcucaaagucuugguucaagguucuggccuggcuugcuccagcaguacucaugagcagccagcgcgaaccccagcgcugguccccaccagacacuuuuuuaaagucauuaaucacauccagugcacucccugcugagcagccucaggccuaccugcuaaugcaaugguagagaggguccuaaaugccacacugcacuggguccucacagcuauggucaugcauugcugggaggcuguggcccugacccauccucuuguaaugcucaaaagugaguaaagaagguaggcucagggaggaggcacagugucauuuaugcagucacaacaguaauguccacucccaaguccccauucccaugacgcauuuauucauggccuuauaaaguuaaaucaacucgggcugaagaguaaaacacucaagucuauguuuguacagcuggccauacuuuuugaugcccuuccuccauaaaguaauggcauggccaccagagcuccugagagcccugauggagugagauuugcugcuggcuaucacaaggcacaggaauugcuuuuuccucagucauaauaaaaauaaauucuccgugccuucucuuuuucuuucuuggggaggcauuuuacugggugcucugcaaaccucuuuucuucccuugugaaagcagugagggaggucagggaggucuggggugaugcucaguauguaaaaugcuuaucaugcaagggaccugagucccaguccaccagaagccauguaaaagugcuaggcaugcggacaggccccugucauccuaguacuagggcggugcuaggucacgaaggccccugaagcuccuuggccagucaugcuuaccaaauuagugagcucaggcucagugaaagcugagagagacugaggagggugccugauguugaccucuggcugccacacaggugcucauacacaaauauucacacuagcacauguuuaaacaucuacagacagacaggcguuugcacauacaaaaagaaaguagugagggaagagauuguguguuaacugugugucugguuguucuuuaaaggaaacuaaacucacucuaaggcuuuuucugugacaugcaagggacaaguggcgcuucuaaagcuaaaguagggagcugaccccggagaagggaguguucuauuaggcuagagggcucagacagcuacuggaauguaaacuugaccucuccaguacaaaaggagaccccagggggccuaggguaggggaaccuccaauuccuuagggaagccuauugaguugcuuauauccauauuuuauuugaaaagcagaaauaucccccagguccuccuauaaucugaaaccccugaacuuuggaagugugaucagguccauuuccgucucgcauccaugcaggggugacagauccaguguccuaagccaucaaucagugcugccugugacucgugcccuagcugcuccgcuuuauaaagcgggugcaaauucaauuagauuaauuacucaacucucuuugcaauuuguuucugguuuaauuugcagccagggcucaaguuuggaugacaggccggugguuagugcgucguaauuaguuaaggcguccucucaggugcgucccucugcacaggcccugagagccguuuuuggauaaugaucguucaucugcugcgggaggugaucgauagccucccgucacucucaucgaucggccccaggcuugucggugacucuaucucuaguuguugccauuuuaagcugucauucauuucagaaccgcucauaugaccagccaugugagcuaucauuuuacuuaauggugauaaaauccaacauucuccugcuugauguuaaggaugccucuggcaucuaacacugugauuucuugagacuggugguccuaccugcaggaacccucuguuggaggucacugucaccauagaugucaccugcaaagacaccuaccaugaauguucucaggccgucaaaucaguguuucuuuccacaguucacaccagccuuaaaagagacuuauaaauggacucauuacuuucuccuugauuuguguguuguggggagaggcugugugugugugugugugugugugugugugugugugugugugugcgcagguucguauggacauuuguguaucugcacaugggaacuggagguuuaacaucuggugucuuuucuuaaucacucuccuuuuuuuuuuuuuuuuuuuuuugagaaagaucucccaguaaaccuggauuuugcugauuccugcccagcaacacccaggaauucuccuggcccucaggcagggguuauaggcuugugcuauugugcccaguuuuuuacaugggcaugcauucaggcccuuaugcuugugugacaagaauuucaaaacugagccaacucccgagaccacugcuuuccccuguaaaauggcgaccuccuuccuucuguaucucagcaccaggaggaaaccgaggcagugagugagagaccccuaugucaugguucugcuuuugagaacuucccucacauucagccacacccccagccucugcugagagacuacgacucuggcccuuucgucacauguuggcucuugaacauucguugagauuucugccugugguggcucccaccucccccaguccaccaguuuuugcaucuucuuauucagccugucuuuagguaccugggccucucuuuucagcaucugugauggucgugagggucccuagagcaguugggcaguggcccccugagucacugacacccagcagguaccacccuaugaauuucugaggcuucacagcugugugguugguaccuguuuuggaggauauguucuauuaguuauuuuucuaaucuucaugaugcacugcuaagaagccuccugcaguagugccacuggcuagggucaagguguucaaacacaugagucugcaagggaggaggcauuuacaauaaagcuguacccagaacccaaggcauuuugcugccuaugaaccaauccagccagucccuugcuucuguucauaaaguuuccuucacccacaguuauggccauggcuucugcugguccagauuugggcugcuucccagccucagugagagccacacaugacccacaaauuauagaacauuacuuuccagagaaaucuugcugaccgaccugggcuguccauucagaaggcaagggacaaucucucaucacacccuagagaaccuguccuuugguugggugacgcuagggugacaauaccugaaucuaaaaaccacaaacaaugaugcuuuucaggggaugcacauagauucagaugucagaaauccacauggcugcagggaagcccagggugggguaguuaacaggcuggauccaagccaggcaggguggagccaggucacaggaagagggucagugccuauccuaaguguucagauggaccucccacuucuaugccgaguaagauucucagugaggauaccaguaaugcggugguuucuucauacuccuguuuccuagcaacagccaccuccacugcccagcaaaacaccaccuccucccccuccgaagacgacccgaaagcagaccucaguggacucuggaaucgugcagugaauccugggaggagaaggcuaaccuccugcuucucuccuacaucugccgugccugccgaugaccuccuccgggcccugggaugcuucgccuuagugugauuggcuuuucuuggaaagagguccauccuagccacgggaccagaggccugaagugucucagcacagugggaauggagccaagucauacauagucuggauugguuuuuuuuuuuuuuuuuaaguuggggacucagagcaugucagccuuucugauagccucagucuugcccugaaacucuuuccuuuugugccaaaugacuuauauucauuugcagagagcuuguccagugugagucagccaagcgggagggaugaggcaaaccccuagcccuacucccgugagaagcuaugcaguagccuuguaaggauccucacucggccucuccaacccagacucuagcucacccccaagggcugacugcucaaccccuauccuugauauaucugcagugugacuccugggguggagugucacuucagcugacaucaagcagcuaaguguaccccuucagagaagaucucaauuucccguggcauaauuuaaaguaggaauaucucuugauuacuaaagagauauuaauauacggcguagagacaccauuauggauacuggaucaaauggaaaauuaauaugagcauaggaaggugaauuuucauucuuuuuaaaauaugagcccccuauaccaccagaggugguuuuaauuggguggcuucucuguguguacagaauauuuguauauacggugguucucagagcuccggugagugucugucacccuugcuuacuccagcgggucucugaaaacgagcuccagugugucuucauguuuaacugcuggaaauauuuguuuucuaaauaccgcaaaauuguuuuccagauuuccaagguccugaaaauguugguggacaaugauucguuuguuuaaaaaaaaaacuaacuuuguauaaccuaauauuuuauuugaucaucuauauuuuuuuauucacucugaucaugauacuguuuguucuaggagaguucaaaguuaaucacugacaaaugagaaauaaauguuauuuaaaaaggacu

SEQ ID NO: 4155 - RNA, 4240 nt, Mus musculus
ugggaaaccuacagaggggccagagaagagaggguaaggagagccuggcuaacauuggggugcucaugugaaagacuuugccauaccauaccagaagagggguauggcacuuucucuuugcaacucccccaaacagaggaggaacccagagaacuagaaaauccccucucugagauuccccuuccuaggugaaucuagauugugacauauggagaaguaaaaccaaccaccacauacuuaaaauauuuacauggagaacaguucuucuccuugaguucuaggaaaugaguuacuaacaguggagggcacaggagccaccugacucugagggacugugugauggcuggagguaauucagggggcacgcuucgcacacccaugucaaaucaugugucagugucauucauaguuacugaugaugaggaagugggaaggcgcagcuuugggaguugaggaggauguagaaaggcuccuugcaagaacugauuucugaagguaaacaccaaggauaaguugccguuaaagaauugguugcaggggcuggagagauggcuaagugauuaagagcacugacuacucuugcaaagauccugaguucaauuccuagcaaccauauggaggcucacaaccauccauaacaauaucuggcucccucuucuggagugucugaagacagcuacaguguacuuacauauaauaaauacaucuuaaaaaaaaaaaagaauugguugcaggggcugggaauacuguauuggagucagaagcuagagaaagcauaaugauuugaaacaaucucaacauggcuggagggauguccuugagaaaagaugcugagcugggcucagagaugugggucuuuuagcauuugggaugcagaggcaaguggauagauuaguucaaggcuagccuggucuaugaagugagacccugccaaaaaaaaagaaaagauagcagaggggggaaaggggaguagaggggaaagacaggagagaagagaucuauuggguaaccauucaguagcagcagaguaaaaucaugugggguuuguccuauggccagggauucagaaagauugagggccauugacacaaucagacuuauuacuucagaaauguucugacugcucagggagagauaucagggggcaggaauagagguaagggaccugugagaagccacaaagaucagcugggaggcagacaaagguggucuggaugagggcugccgcacugaggaccaagaccggaagguuacugugucagaggguccuaggugggaugaaggaaaggggguguugaaaacaagucuguuuccugucugaagcaaguggaugcuggugugcaacuuuccaaaauaaaggacaaagaugaucaagaugggccaggucaaaucaggagagaaagaguaggagauggguaggaccaccaugcugugggcaggaagcagaggcugugacaucaagguagcagaaggcagugcaguaaaggcuauggugaugguguaggagggaguaagaggccaugaaagguaccuggagcugcuggaaaauggggaugggaugccagcuucaauucagugccuagagacacccuaacccugacucaccaacuguaacccuaacccugaccacuauugcacucccgguuccuucuuucuguguccugaugugacaaugagaugugaucagcagcucucuucuccagcuaucuguugccaugcuucccaaccauuccugacuucacccucuagaaccaaaauaaccuuucuucuguaaguugcuuuuggucauggcguuucaucgcagcaacagaaaaggaccuaagaauccaggucacggucaaacccacuugagcuaacuguggaguagggugaccaugagaacaucugagcccugcagccccuccucugaagcucuagccauuuucugaaggucacgauucucugcccaucguguaacuauaacauuaugugggaugaagguuaucaauacugcagucuuggacugauguaucaaaguacacagugcuugucaacugcuucucccaucucugcagagguuucugaauauguuugccuugucuccuccauugacaaagaaagauugaaaccuauaagcucaaaggaaagagcuaagggagcugagguaugacauaacuacgugccucuuacggcuuguuuggaucugcagucugccuaacagugacaccuacguccacacuaacggaagagaaagugucucaaugaauagcauuucaauggugcauacaacacaaguggaauggccuuuuaguuagguuagugaauccuugcuuggguauuuguuuuaauuaguucaaauucuagcuaccuaaaucggagagaaaaaaacccacucuuguuugugaggaagaagaugagaaagaggaggaaaaggaggaagagaggaagagaggaggaggagggagaggaggaugagaagggagaggaugagaaggaggagggagagaggaggaggagggagaggaggaggagggagaggaggagggagaggaggaugagaagggagaggaugagaaggaggagggagagaggaggaggaaggagaggaggaggagggagaggaggaggagggagaggaggagggagaggaggaugagaagggagaggaugagaaggaggagggagaggggaggaggaaggagaggaggaggagggagaggaggagggagaggaggaugagaagggagaggaugagaaggaggagggagagaggaggaggagggagaggaggaggaagaggaggaggagaaggaggagaaggagaaggagaaggagaaggagaagggggagguuugucuacuagcuaacaacugaagaggacauuuuuuccccaagaauuuuuaagccguucuaguuugacaggaauuauuuuaucaucaacagauuuuuuucacugauuuaugaaccauuuuaaccucuuucuguuguacugcgaacguuuucugguaaggaguuggaggagaccacgcaaagcaguuucauuuucugguaaggagucggaggagaccaugcaaagcaguuugcuuuguggcagcuuucccaucaucccugaagaguuccugggaggacucagcucuccaccaaacuuccccagaaccaucacuccucucuguggauggcagcagauuuaggacauuuguaagucgucuuuauaauacaauaaacaggaaugaggaccaugagcgcauccgugccuaccaaccuaugaaagugagagagaugcccacguuuuuagaaagggagaggaauaaaguuuucuucauggauguauuuuucuuuuaaagcaguuuguauucuggcacuggucaaacaacccagaaugauuagcucugguugaauuagcucuaggugaaugauaacccaaauucaccucugacguuccauagagggcagagcugcacugauuagaaagugccagaaagccaaguaucagugugucagcugcagauucuacugugccaggaacuaguaauguuuuccagaaaguuccaaaacccaaggaaagggcuuuacucccugcuagcacuuuuccuugcccagugaggugaguagaaacauuuuaauucauacacagaugucaucauuucucgugaaccuugagagcguauagugaaaaucauuuagccaaaaccuagccccuuccccccacagagcuaaagaucuucauucaaagucucaagcaaugauuaaauaucuucucuacaccauaccucugaucuucucuuuucaggacagaguuaaaccaguugaggauacauggauccaacaaggugucugcagcuuuucuguauuugaucuacaugcagacagauacuagcgaauggaaacaaauucuucauuuaaaagaguccuuggcguuccugagaagcauaaagaggaacacgaugcaaucuaagucucagauuaucaaaauguacaaagaauugggcucaugaaauauucaaagaaaaguaggcagcaucucauagaaauaugcauuugguugcaagggguacauggaaaguguagaucuugauuuguuuuccugugaacccaaaacuguuaaaaaaaaaaaaaagaagaagaagaagaaaagaaaagaaaaacccaaaaagcaaaaaacaaaaaaagcaaaacaaaagaaccaaaacaacaacaacaacaacaacaacaaaaaaccaccaccaaaacccccugaaauauaguauauauuguguauuua

SEQ ID NO: 4156 - RNA, 1806 nt, Mus musculus
ccucuuacugcgaggcacauugacuucuguguccaauuuccguuuuacagauugcuuccuuguuuuaaugacuuugccuucaccuucugguucucuagguaaguccacaauuuccccugauauuuguggaugcauuaugccuccugaaaguucauuuuucacgugaacuuuccucagaccaguucuggccugucuccgugagguuacugaagugucuguuggcucuagugguggagacgagcugggcaguuuugcaagauuguccacugucacugaauccuuguuauggccugauguuuggaagaccuccugaacaccagagaggucuucuggggacugggaccuuuucuuacaugaccuuugcugccucuugccacgaguaacauauauugcugguuccaauuucugagcuaacaauaccuucccaucuuuggucucucugccaugaucuucuccaagugugaggguuugcaugacuuucugugaugcacagcuugacuuacugagcggagagugcccuucucucacauccaucuuauugagaccugucuuggaaagucucuuugugcuugcccggguucugacugguucugcuugugaagauuccaaagauaucuuugcacuuucuucaacacucacaggguuacuggcaccagcugguguuuggaagaguucuuggaagccauccaggucuucuaggggcugagaccuguucuuagauguucgugaccuucucuuacucccugaugaauucucugcaaaauccaguuucugcuuuggaguuuccaugaaggcugugcugucauuuucuuccugcacuggugcuggugugccuggggcucugccuggugacuuuguuuuuuucccaaguguugaagggucuucucucacauccaccuuacugagaccugucuuggagagucucuuugugcuugccgggguuuugacugguuuugcuugugaagauuccaaagacaucuuugcacuuuccucaacagucacugagucacuagcaccagcugguguuuggaagaguucuuggaagccauccaggucuucuaggggcugagcucugaucuuagguguccguggccuccucuuauguccugaugaauuuccugugaaauccaguuucugcuuuggaguuuccaugaaggcugugcagucauuuucuuccugcacuggugcuggugugccuggugacuuuguuuuuuucucaaguauugaagggucuucucucacauccaccuuacugagaccugucuuggagagucucuuugugcuugccgggguuuugacugguucugcuugugaagauuccaaagacaucuuuacacuuuccucaacagucacugagucauuggcaccagcugguguuuggaagaguucuuggaagccauccaggucuucuaggggcugagcccugaucuuaggugucuguggccuccucuuauguccugaugaauuuccugugaaauccaguuucugcuuuggaguuuccaugaaggcugugcugucauuuucuuccugcacuggugcuggugugccuggggcucugccuagugacuucauucuuuucccaaguguugaagguucuugucucacauccacuuuacugagaccugucuuggagcgucucuuuguacuugcugggguucugacugguucugcuugugaagaugccaaagauaucuuugcacuuucuucaacacucacagggucacuggcaccagcugguguuugaaagaguucuuggaagccauccaggucuucuaggggcugagcccuguuuuuggguguccgagg

SEQ ID NO: 4157 - RNA, 1253 nt, Mus musculus
aauggggcucagggggaaaacacuccgccggcgccaggcugacucggagucagaggaggaugaacaagaaucagaggagguucggcuaaaacuggaagaaacccgagaggcgcagaacuuguggaagaggccaaauggguguggcugcccugcugauaggagagaagguucaagaggagacuacucugguggaugaucccuuccaaauggcgacaggggucaugguggacaugaagaaacugaaggagcagggcaaagacaaggucagugaagaggaggaucugcaccuggggacaucguuugcugcagagaccaaccggagggacgaagaugcagacaugaugaaguacauugagacggggcugaagaagaggaaggggauuguggagcaagaggaacagaaggccaagcccaagaaugcugaggacugccccuaugagcugccagagaauauccgagucucuucugccaagaagacugaggagaugcuguccaaccagaugcugaguggcaucccugagguggaccugggcauagacgcuaaaauaaaaaacaucauuuccacagaggaugccaaggcccagcugcuggcagagcagcagaacaagaagaaggauagcgagacaucuuuugugcccaccaacauggcugugaacuaugugcagcacaaccgauuuuaucacgaggagcucgaugcacccauccgaagaaacaaagaagagcccagagcccggcccuugcgagugggugacacagaaaagccagagccugaacgguccccucccaaccgcaagcguccugcuaaugaaaaggccacagaugacuaccacuaugagaaguucaagaagaugaacaggcgcuacugaggcagcgguaggggcuggauaacgaugugaugcacaggggugcgcuugugugcgugugcaagcgugggggcacacacacaugcccucuugcauaaaaccugcuuauuagcucuugaguuccccaucagauagugcuucugcucagcggcuggauuucuguucugguuuugguuggagacuguagcucucuguguauccuaggccaugaacucacuccuccucccuacuacugggauuuuagaccccccaccuccugcauuuucaagcacuaacuuuguaacuauuggaagaaaacaaugugucuaugucuaucuauauuguuuccuaccuagggcaaacucuccucaagaguguuauuaaauccuuuguaaauaaaaaaaaaaaaau
